US008137673B2

(12) United States Patent
Telford et al.

(10) Patent No.: US 8,137,673 B2
(45) Date of Patent: Mar. 20, 2012

(54) NUCLEIC ACIDS AND PROTEINS FROM *STREPTOCOCCUS* GROUPS A & B

(75) Inventors: John Telford, Monteriggioni (IT); Vega Masignani, Siena (IT); Maria Scarselli, Siena (IT); Guido Grandi, Segrate (IT); Herve Tettelin, Rockville, MD (US); Claire Fraser, Clarksville, MD (US)

(73) Assignees: Novartis Vaccines and Diagnostics, Inc., Emeryville, CA (US); J. Craig Venter Institute, Rockville, MD (US)

( * ) Notice: Subject to any disclaimer, the term of this patent is extended or adjusted under 35 U.S.C. 154(b) by 3 days.

(21) Appl. No.: 11/434,199

(22) Filed: May 16, 2006

(65) Prior Publication Data
US 2006/0210581 A1 Sep. 21, 2006

Related U.S. Application Data

(62) Division of application No. 10/415,182, filed as application No. PCT/GB01/04789 on Oct. 29, 2001, now Pat. No. 7,939,087.

(30) Foreign Application Priority Data

Oct. 27, 2000 (GB) .................................. 0026333.5
Nov. 24, 2000 (GB) .................................. 0028727.6
Mar. 7, 2001 (GB) .................................. 0105640.7

(51) Int. Cl.
*A61K 39/02* (2006.01)
*C07H 21/04* (2006.01)
(52) U.S. Cl. .................................... 424/190.1; 530/350
(58) Field of Classification Search .................. None
See application file for complete search history.

(56) References Cited

U.S. PATENT DOCUMENTS

| 4,425,330 | A | * | 1/1984 | Norcross et al. | ........... 424/203.1 |
| 4,454,121 | A | | 6/1984 | Beachey | |
| 5,098,827 | A | | 3/1992 | Boyle et al. | |
| 5,354,846 | A | | 10/1994 | Kehoe | |
| 5,378,620 | A | | 1/1995 | Adams et al. | |
| 5,391,712 | A | | 2/1995 | Adams et al. | |
| 5,445,820 | A | | 8/1995 | Seidel et al. | |
| 5,585,098 | A | | 12/1996 | Coleman | |
| 5,700,648 | A | | 12/1997 | Kehoe | |
| 5,804,198 | A | * | 9/1998 | Lindberg et al. | ........... 424/242.1 |

(Continued)

FOREIGN PATENT DOCUMENTS

EP 0369825 5/1990

(Continued)

OTHER PUBLICATIONS

Kalman, Sue et al, Nature Genetics, vol. 21, Apr. 1999, pp. 385-389, Comparative genomes of *Chlamydia pneumoniae* and *C. trachomatis*.*

(Continued)

*Primary Examiner* — Albert Navarro
*Assistant Examiner* — Ginny Portner
(74) *Attorney, Agent, or Firm* — Banner & Witcoff, Ltd.

(57) ABSTRACT

The invention provides proteins from group B *streptococcus* (*Streptococcus agalactiae*) and group A *streptococcus* (*Streptococcus pyogenes*), including amino acid sequences and the corresponding nucleotide sequences. Data are given to show that the proteins are useful antigens for vaccines, immunogenic compositions, and/or diagnostics. The proteins are also targets for antibiotics.

20 Claims, 3 Drawing Sheets

U.S. PATENT DOCUMENTS

| | | | |
|---|---|---|---|
| 5,821,088 A | 10/1998 | Darzins et al. | |
| 5,846,547 A | 12/1998 | Cleary | |
| 5,968,763 A | 10/1999 | Fischetti et al. | |
| 6,015,889 A * | 1/2000 | Lindahl et al. | 536/23.5 |
| 6,174,528 B1 * | 1/2001 | Cooper et al. | 424/184.1 |
| 6,372,222 B1 | 4/2002 | Michon et al. | |
| 6,406,883 B1 * | 6/2002 | Lutticken et al. | 435/69.1 |
| 6,420,152 B1 | 7/2002 | Adams et al. | |
| 6,426,074 B1 * | 7/2002 | Michel et al. | 424/244.1 |
| 6,579,711 B1 | 6/2003 | Gaier et al. | |
| 6,586,580 B1 * | 7/2003 | Lindahl et al. | 536/23.5 |
| 6,635,623 B1 | 10/2003 | Hoogeveen et al. | |
| 6,669,703 B2 | 12/2003 | Shue | |
| 6,737,521 B1 | 5/2004 | Fischetti et al. | |
| 6,747,437 B2 | 6/2004 | Chiu | |
| 6,777,547 B1 * | 8/2004 | Podbielski | 536/23.7 |
| 6,833,356 B1 | 12/2004 | Koenig et al. | |
| 6,936,252 B2 * | 8/2005 | Gilbert et al. | 424/190.1 |
| 7,098,182 B2 * | 8/2006 | Le Page et al. | 514/2 |
| 7,101,692 B2 | 9/2006 | Schneewind et al. | |
| 7,128,918 B1 * | 10/2006 | Hamel et al. | 424/244.1 |
| 7,128,919 B2 * | 10/2006 | Adderson et al. | 424/244.1 |
| 7,169,902 B2 | 1/2007 | Podbielski | |
| 7,247,308 B2 * | 7/2007 | Martin et al. | 424/244.1 |
| 7,348,006 B2 | 3/2008 | Contorni et al. | |
| 7,407,664 B2 * | 8/2008 | Beall et al. | 424/244.1 |
| 7,438,912 B2 * | 10/2008 | Meinke et al. | 424/165.1 |
| 7,485,710 B2 * | 2/2009 | Reinscheid et al. | 536/23.1 |
| 2002/0061569 A1 | 5/2002 | Haselbeck et al. | |
| 2002/0086023 A1 * | 7/2002 | Dale | 424/178.1 |
| 2003/0035805 A1 * | 2/2003 | Michel et al. | 424/184.1 |
| 2003/0109690 A1 | 6/2003 | Ruben et al. | |
| 2003/0157122 A1 * | 8/2003 | Dale | 424/190.1 |
| 2003/0171337 A1 * | 9/2003 | Aylward et al. | 514/114 |
| 2004/0101536 A1 * | 5/2004 | Teti et al. | 424/190.1 |
| 2004/0219639 A1 * | 11/2004 | Potter et al. | 435/69.3 |
| 2005/0019345 A1 * | 1/2005 | Podbielski | 424/190.1 |
| 2005/0020813 A1 * | 1/2005 | Masignani et al. | 530/350 |
| 2005/0181388 A1 | 8/2005 | Edwards et al. | |
| 2005/0214918 A1 | 9/2005 | Edwards et al. | |
| 2005/0288866 A1 | 12/2005 | Sachdeva | |
| 2006/0039922 A1 * | 2/2006 | Mizzen et al. | 424/190.1 |
| 2006/0041961 A1 | 2/2006 | Abad et al. | |
| 2006/0073530 A1 | 4/2006 | Schneewind et al. | |
| 2006/0115479 A1 * | 6/2006 | Reinscheid et al. | 424/146.1 |
| 2006/0160121 A1 | 7/2006 | Mounts et al. | |
| 2006/0165716 A1 * | 7/2006 | Telford et al. | 424/190.1 |
| 2006/0210579 A1 * | 9/2006 | Telford et al. | 424/190.1 |
| 2006/0210580 A1 * | 9/2006 | Telford et al. | 424/190.1 |
| 2006/0210581 A1 * | 9/2006 | Telford et al. | 424/190.1 |
| 2006/0210582 A1 * | 9/2006 | Telford et al. | 424/190.1 |
| 2006/0258849 A1 * | 11/2006 | Telford et al. | 530/350 |
| 2006/0269541 A1 | 11/2006 | Meinke et al. | |
| 2006/0275315 A1 * | 12/2006 | Telford et al. | 424/190.1 |
| 2007/0036828 A1 * | 2/2007 | Rappuoli et al. | 424/239.1 |
| 2007/0053924 A1 * | 3/2007 | Tettelin et al. | 424/190.1 |
| 2007/0065464 A1 * | 3/2007 | Grandi et al. | 424/244.1 |
| 2007/0098737 A1 * | 5/2007 | Dale | 424/190.1 |
| 2007/0116712 A1 * | 5/2007 | Hamel et al. | 424/190.1 |
| 2007/0128210 A1 | 6/2007 | Olmsted et al. | |
| 2007/0128211 A1 | 6/2007 | Olmsted et al. | |
| 2007/0128229 A1 | 6/2007 | Olmsted et al. | |
| 2007/0141635 A1 | 6/2007 | James | |
| 2008/0038268 A1 * | 2/2008 | Martin et al. | 424/139.1 |
| 2008/0193470 A1 * | 8/2008 | Masignani et al. | 424/185.1 |
| 2008/0220010 A1 * | 9/2008 | Telford et al. | 424/190.1 |
| 2009/0022753 A1 * | 1/2009 | Olmsted et al. | 424/190.1 |
| 2009/0136547 A1 * | 5/2009 | Telford et al. | 424/244.1 |
| 2009/0176311 A1 * | 7/2009 | Berti et al. | 436/94 |

FOREIGN PATENT DOCUMENTS

| | | | |
|---|---|---|---|
| EP | 0399843 | * | 5/1990 |
| EP | 0613947 | | 1/1994 |
| EP | 555438 | | 1/1997 |
| EP | 555439 | | 10/1997 |
| EP | 1770171 | | 4/2007 |
| GB | 2233977 | | 1/1991 |
| WO | WO9006951 | | 6/1990 |
| WO | WO9305155 | | 3/1993 |
| WO | WO9305156 | | 3/1993 |
| WO | WO 98 01561 | | 1/1998 |
| WO | WO9818931 | | 5/1998 |
| WO | WO9819689 | | 5/1998 |
| WO | WO 98 23631 | | 6/1998 |
| WO | 99/13084 | * | 3/1999 |
| WO | WO9913084 | | 3/1999 |
| WO | WO 99 16882 | | 4/1999 |
| WO | WO9926969 | | 6/1999 |
| WO | WO9942588 | | 8/1999 |
| WO | WO9954457 | | 10/1999 |
| WO | 00/06736 | * | 2/2000 |
| WO | WO0006736 | | 2/2000 |
| WO | WO0006737 | | 2/2000 |
| WO | WO0023456 | | 4/2000 |
| WO | WO0062804 | | 10/2000 |
| WO | WO0078787 | | 12/2000 |
| WO | WO 01 32882 | | 5/2001 |
| WO | WO0212294 | | 2/2002 |
| WO | WO02075507 | | 9/2002 |
| WO | WO 02/092818 | | 11/2002 |
| WO | WO02092818 | | 11/2002 |
| WO | WO03068813 | | 8/2003 |
| WO | WO03087353 | | 10/2003 |
| WO | WO03093306 | | 11/2003 |
| WO | WO 03093306 | | 11/2003 |
| WO | WO 2004/018646 | | 3/2004 |
| WO | WO 2004/035618 | | 3/2004 |
| WO | WO2004018646 | | 3/2004 |
| WO | WO2004035618 | | 3/2004 |
| WO | WO2004041157 | | 5/2004 |
| WO | WO2004099242 | | 11/2004 |
| WO | WO2005013666 | | 2/2005 |
| WO | WO 2005/028618 | | 3/2005 |
| WO | WO2005028618 | | 3/2005 |
| WO | PCT/US2005/010954 | | 7/2005 |
| WO | WO2005076010 | | 8/2005 |
| WO | WO2005108419 | | 11/2005 |
| WO | WO2006035311 | | 4/2006 |
| WO | WO2006042027 | | 4/2006 |
| WO | WO2006069200 | | 6/2006 |
| WO | WO2006078318 | | 7/2006 |
| WO | WO2006082527 | | 8/2006 |
| WO | WO2006082530 | | 8/2006 |
| WO | WO2006130328 | | 12/2006 |
| WO | WO2007018563 | | 2/2007 |
| WO | WO2007039319 | | 4/2007 |
| WO | WO2007052168 | | 5/2007 |
| WO | WO2008020335 | | 2/2008 |
| WO | WO2008108830 | | 9/2008 |
| WO | WO2008003515 | | 10/2008 |

OTHER PUBLICATIONS

Koch, Peter J. et al, PNAS, vol. 89, pp. 353-357, Jan. 1992, Complexity and expression patterns of the desmosmal cadherins.*
Su, J et al, Gene, vol. 145, pp. 155-156, 1994.*
Woodson, K et al, Microbiology, vol. 140, pp. 1829-1838, 1994.*
Swiss-Prot accession No. Q3DV91 for *Streptococcus agalactiae* strain 18R21.*
Lachenauer, Catherine S et al, Infection and Immunity, Oct. 1996, pp. 4255-4260, vol. 64(10), A protective surface protein from the Type V Group B *Streptococcus* shares N-terminal sequence homology with the Alpha C Protein.*
Rosini, Roberto et al, Molecular Microbiology, vol. 61(1), 2006, pp. 126-141, Identification of novel genomic islands coding for atnigenic pilus-like structures in *Streptococcus agalactiae*.*
Schneewind, Olaf et al, Science, Apr. 7, 1995, vol. 268(5207), pp. 103-106, Structure of the Cell Wall Anchor of Surface Proteins in *Staphylococcus aureus*.*
Nobbs, AH et al, Infection and Immunity, vol. 76(8), Aug. 2008, pp. 3550-3560, Sortase A Utilizes an ancillary protein anchor for efficient cell wall anchoring of pili in *Streptococcus agalactiae*.*
Ruch, Frank E. Jr. et al, Journal of Clinical Microbiology, Jul. 1982, pp. 145-152, vol. 16(1), Monoclonal Antibody to *Streptococcal* Group B Carbohydrate: Application in Latex Agglutination and Immunoprecipitin Assays.*

Grandi, "Genomics and Proteomics in Reverse Vaccines," in *Microbial Proteomics: Functional Biology of Whole Organisms*, Humphery-Smith & Hecker, eds., John Wiley & Sons, chapter 20, 2006.
Gutekunst et al., "Analysis of RogB-Controlled Virulence Mechanisms and Gene Expression in *Streptococcus agalactiae*," *Inf. Immun.* 71, 5056-64, Sep. 2003.
Lauer et al., "Genome Analysis Reveals Pili in Group B *Streptococcus*," *Science* 309, 105, Jul. 1, 2005.
Malone et al., "Identification of a Universal Group B *Streptococcus* Vaccine by Multiple Genome Screen," *Science* 309, 148-50, Jul. 1, 2005.
Pritzlaff et al: "*Streptococcus agalactiae* cyl gene cluster, partial sequence", Database Accession No. AF157015.
Pritzlaff et al.: "Genetic basis for the beta-haemolytic/cytolytic activity of group B *Streptococcus*"; Mol. Microbiol.; vol. 39, 2001, pp. 236-248.
Spellerberg et al: "*Streptococcus agalactiae* cyl gene cluster, complete sequence", Database Accession No. AF093787.
Spellerberg et al: "Identification of genetic determinants for the hemolytic activity of *Streptococcus agalactiae* by ISSI transposition"; J. Bacteriol.; vol. 181, No. 10, May 1999; pp. 212-3219.
Duez et al: "*Enterococcus hirae* mraR, pbp3s, mraY, murD, murG, ftsQ and ftsA genes, mraW, yllC and ftsZ partial genes"; Database Accession No. YI3922.
Guttierez et al: "*Streptococcus mutans* ProX (pouABC) gene, partial cds; YlxM (ylxM) gene, complete cds; Ffh (ffh) gene, complete cds, alternatively spliced; SatC (satC) and SatD (satD) gene, cds; and SatE (satE) gene, partical cds"; Database Accession No. U88582.
Pucci et al: "*Enterococcus faecalis* strain A24836 cell wall/cell division gene cluster, yllB, yllc, yllD, pbpC, mraY, murD, murG, div1B, ftsA and fitsZ genes, complete cds"; Database Accession No. U94707.
Simpson et al: "Xy lella fastidiosa 9a5c, section 136 of 229 of the complete genome"; Database Accession No. AE003990.
Black et al: "*Streptococcus oneumoniae* polypeptide coding region"; Database Accession No. AAV42990.
Meehan et al: "Sequence 1 from Patent WO 98 01561"; Database Accession No. A68631.
Michel et al: "Cloned alpha and beta C-protein antigens of group B *Streptococci* elicit protective immunity"; Infection and Immunity; vol. 59, No. 6, Jun. 1991; pp. 2023-2028.
Stalhammar-Carlemalm et al: "The R28 Protein of *Streptococcus pyogenes* is related to several group B *Streptococcal* surface proteins, confer protective immunity and promotes binding to human epithelial cells"; Molecular Microbiol.; vol. 33, No. 1, Jul. 1999, pp. 208-219.
Le Page et al: "Sequence 217 of Patent WO 01 32882"; Database Accession No. AX134653.
Ferretti et al: "*Streptococcus pyogenes* M1 GAS strain SF370, Section 87 of 167 of the complete genome" Database Accession No. AE006558.
Abbas et al., *Cellular and Molecular Immunology*, 4th ed., Chapter 15, pp. 360-362, 2000.
Amara et al., "Molecular detection of methionine in rat brain using specific antibodies," Neurosci. Lett. 185, 147-50, Feb. 13, 1995.
Areschoug et al., "Group B *Streptococcal* surface proteins as targets for protective antibodies: identification of two novel proteins in strains of serotype V.," Inf. Immun. 67(12), 6350-57, Dec. 1999.
Banks et al., "Progress toward characterization of the Group A *Streptococcus* metagenome: Complete genome sequence of a macrolide-resistant serotype M6 strain," *J. Infectious Diseases* 190, 727-38, Aug. 15, 2004.
Barnett & Scott, "Differential recognition of surface proteins in *Streptococcus pyogenes* by two sortase gene homologs," J. Bacteriol. 184, 2181-91, 2002.
Barnett et al., "A Novel Sortase, SrtC2, from *Streptococcus pyogenes* Anchors a Surface Protein Containing a QVPTGV Motif to the Cell Wall," *Journal of Bacteriology*, vol. 186, No. 17, pp. 5865-5875, Sep. 2004.
Beckmann et al., "Identification of Novel Adhesins from Group B *Streptococci* by Use of Phage Display Reveals that C5a Peptidase Mediates Fibronectin Binding," *Inf. Immun.* 70, 2869-76, Jun. 2002.

Bessen et al., "Genomic Localization of a T Serotype Locus to a Recombinatorial Zone Ending Extracellular Matrix-Binding Proteins in *Streptococcus pyogenes*," Infection and Immunity, vol. 70, No. 3, pp. 1159-1167, Mar. 2002.
Blackburn et al., "The end of the (DNA) line," Nature Structural Biology 7, 847-49, Oct. 2000.
Bork et al., "Powers and pitfalls in sequence analysis: the 70% hurdle," Genome Research 10, 398-400, 2000.
Borovec et al., "Synthesis and assembly of hepatitis a virus-specific proteins in BS-C-1 cells," J. Virol. 67, 3095-301, Jun. 1993.
Bowie et al., "Deciphering the message in protein sequences: tolerance to amino acid substitution," Science 257, 1306-10, 1990.
Brodeur et al., "Identification of group B *Streptococcal* Sip protein, which elicits cross-protective immunity," Inf. Immun. 68(10), 5610-8, Oct. 2000.
Burgess et al., "Possible dissociation of the heparin-binding and mitogenic activities of heparin-binding (acidic fibroblast) growth factor-1 from its receptor-binding activities by site-directed mutagenesis of a single lysine residue," J. Cell Biol. 111, 2129-38, 1990.
Chung et al., "chlorosome protein," NCBI Accession No. 2115394F, Jul. 10, 1992.
Clancy et al., "Cloning and Characterization of a Novel Macrolide Efflux Gene, mreA, from *Streptococcus agalactiae*," Antimicrobial Agents and Chemotherapy 41, 2719-23, 1997.
Collins et al., "Mutation of the principal sigma factor causes loss of virulence in a strain of the *Mycobacterium tuberculosis* complex," Proc. Natl. Acad. Sci. USA 92, 8036-40, 1995.
Dale et al., "New Protective Antigen of Gorup a *Streptococci*," J. Clin. Invest. 103, 1261-68, May 1999.
Dale et al., "Recombinant, octavalent group A *Streptococcal* M protein vaccine," Vaccine 14, 944-48, 1996.
Dale, "Group a *Streptococcal* Vaccines," Infectious Disease Clinics of North America 13, 227-43, Mar. 1999.
Dale, "Multivalent group A *Streptococcal* vaccine designed to optimize the immunogenicity of six tandem M protein fragments," Vaccine 17, 193-200, 1999.
Database EMBL, Accession No. AAX13129, *Enterococcus faecalis* genome contig SEQ ID No. 192, Mar. 19, 1999.
Database EPO Proteins, EBI Accession No. AX605513, "Sequence 3442 from WO0209818," Feb. 17, 2003.
Database Geneseq, "Group B *Streptococcus* protein sequence SEQ ID No. 49," EBI Accession No. GSP:AAY91320, May 30, 2000.
Database Geneseq, "*Streptococcus agalactiae* protein, SEQ ID 2382," EBI Accession No. GSP:ADV81242, Feb. 24, 2005.
Database Geneseq, "Fibrinogen-binding polypeptide, SEQ ID No. 17," EBI Accession No. GSP: ADS93952, Dec. 2, 2004; revised in 2007.
Database Geneseq, EBI Accession No. GSP: ABP30134, "*Streptococcus* polypeptide SEQ ID No. 9444," Jul. 2, 2002.
Database Geneseq, EBI Accession No. GSP: ABP27285, "*Streptococcus* polypeptide SEQ ID No. 3746," Jul. 2, 2002; revised in 2007.
Database Genseq, "Protein encoded by Prokaryotic essential gene #319788," Accession No. ABU46451, Jun. 13, 2003.
Database JPO Proteins, "Nucleic acid and protein originating in group B *Streptococcus*," EBI Accession No. JPOP:BD629260, Jul. 17, 2003.
Database SWISSPROT[Online] Oct. 1, 2002, accession No. EBI, Database accession No. Q9PGX9, Hypothetical protein XF0167.
Database UniProt [Online] Mar. 1, 2003, "Cell wall surface anchor family protein," retrieved from EBI accession No. UNIPROT: Q8DYR5, Database accession No. Q8DYR5, 87.2% identity with SEQ ID No. 20906.
Database UniProt [Online], 22 Nov. 2005, "Cell wall surface anchor family protein," retrieved from EBI accession No. UNIPROT: Q3D2D6; 100% identity with SEQ ID No. 20906; abstract.
De Boever et al., "*Enterococcus faecalis* conjugative plasmid pAM373. Complete nucleotide sequence and genetic analyses of sec phermone response," Mol. Microbiol. 37, 1327-41, 2000.
Dittmer et al., "Treatment of infectious diseases with immunostimulatory oligodeoxynucleotides containing CpG motifs," Curr. Opinion Microbiol. 6, 472-77, Oct. 2003.

Ellis, *Vaccines*, Chapter 29, Plotkin et al., eds., W.B. Saunders Company (Philadelphia), pp. 568-575, 1988.

Examination Report for NZ 560966, Mar. 4, 2009, 2 pages.

Ferretti et al., "Complete genome sequence of an M1 strain of *Streptococcus pyogenes*," Proc. Natl. Acad. Sci. USA 98, 4658-63, Apr. 10, 2001.

Ferretti et al., "Putative surface exclusion protein," Genbank Accession No. Q9A1H3, Oct. 31, 2006.

Glaser et al., "Genome sequence of *Streptococcus agalactiae*, a pathogen causing invasive neonatal disease," Mol. Moicrobiol. 45, 1499-1513, 2002.

Grandi & Zagursky, "The impact of genomics in vaccine discovery: achievements and lessons," Expert. Rev. Vaccines 3, 621-23, 2004.

Greenspan et al., "Defining epitopes: It's not as easy as it seems," Nature Biotechnol. 7, 936-37, 1999.

Gutierrez et al., "insertional Mutagenesis and Recovery of Interrupted Genes of *Streptococcus mutans* by Using Transposon Tn917: Preliminary Characterization of Mutants Displaying Acid Sensitivity and Nutritional Requirements," J. Bacteriol. 178, 4166-75, Jul. 1996.

Guzman et al., "Protective immune response against *Streptococcus pyogenes* in mice after intranasal vaccination with the fibronectin-binding protein Sfbl," J. Infectious Disease 179, 901-06, 1999.

Holmes, "PSMA specific antibodies and their diagnostic and therapeutic use," Exp. Opin. Invest. Drugs 10, 511-10, 2001.

Hong, "unnamed protein product [*Streptococcus pyogenes*]," NCBI Accession No. BAB1603, one page, Oct. 3, 2000.

Horvath et al., "Toward the development of a synthetic group a *Streptococcal* vaccine of high purity and broad protective coverage," J Med Chem. Jul. 29, 2004;47(16):4100-4.

Hughs et al., "Identification of Major Outer surface Proteins of *Streptococcus agalactiae*," Inf. Immun. 70, 1254-59, Mar. 2002.

International Preliminary Examination Report for PCT/GB01/04789 (published as WO 02/34771) dated Feb. 17, 2003.

International Preliminary Examination Report for PCT/GB2003/001882 (published as WO 03/093306) dated Aug. 18, 2004.

International Preliminary Examination Report for PCT/IB2005/036009 (published as WO 06/042027) dated Apr. 11, 2007.

International Preliminary Examination Report for PCT/US2003/029167 (published as WO 04/041157) dated Mar. 5, 2005.

International Preliminary Examination Report for PCT/US2004/024868 (published as WO 05/032582) dated Feb. 6, 2006.

International Preliminary Examination Report for PCT/US2004/030032 (published as WO 05/028618) dated Mar. 16, 2006.

International Search Report for PCT/GB01/04789 (published as WO 02/34771) dated Aug. 27, 2002.

International Search Report for PCT/GB2003/001882 (published as WO 03/093306) dated Nov. 14, 2002.

International Search Report for PCT/IB2005/036009 (published as WO 06/042027) dated Jun. 20, 2006.

International Search Report for PCT/US05/046491 dated Jun. 26, 2007 (published as WO 2006/069200).

International Search Report for PCT/US2003/029167 (published as WO 04/041157) dated Aug. 2, 2004.

International Search Report for PCT/US2004/024868 (published as WO 05/032582) dated Oct. 28, 2005.

International Search Report for PCT/US2004/030032 (published as WO 05/028618) dated Dec. 6, 2005.

International Search Report for PCT/US2005/027239 (published as WO 06/078318) dated Aug. 25, 2008.

International Search Report for PCT/US2007/022838 (published as WO 08/108830) dated Oct. 9, 2008.

Jobling et al., "Analysis of structure and function of the B subunit of cholera toxin by the use of site-directed mutagenesis," Mol. Microbiol. 5, 1755-67, 1991.

Kehoe et al., "Nucleotide Sequence of the Streptolysin O (SLO) Gene: Structural Homologies between SLO and Other Membrane-Damaging, Thiol-Activated Toxins," Inf. Immun. 55, 3228-32, Dec. 1987.

Kunst et al., "The complete genome sequence of the Gram positive bacterium *Bacillus subtilis*," NCBI Accession No. CAB14964, Nov. 20, 1997.

Lachenauer et al., "A protective surface protein from the Type V Group B *Streptococcus* shares N-terminal sequence homology with the Alpha C Protein," Inf. Immun. 64, 4255-60, Oct. 1996.

Larsson et al., "Protection against experimental infection with group B *Streptococcus* by immunization with a bivalent protein vaccine," Vaccine 17, 454-58, 1999.

Lazar et al., "Transforming growth factor alpha: mutation of aspartic acid 47 and leucine 48 results in different biological activities," Mol. Cell. Biol. 8, 1247-52, 1988.

Lei et al., "Identification and immunogenicity of group A *Streptococcus* culture supernatant proteins," Inf. Immunity 68, 6807-18, 2000.

Lewis, "Riddle of Biofilm Resistance," *Antimicrobial Agents and Chemotherapy*, vol. 45, No. 4, pp. 999-1007, Apr. 2001.

Lindahl et al., "Surface proteins of *Streptococcus agalactiae* and related proteins in other bacterial pathogens," Clinical Microbiol. Rev. 18(1), 102-07, Jan. 2005.

Madoff et al., "Maternal Immunization of Mice with Group B Streptococcal Type III Polysaccharide-Beta C Protein Conjugate Elicits Protective Antibody to Multiple Serotypes," J. Clinical Invest. 94, 286-92, 1994.

McMillan et al., "Identification and assessment of new vaccine candidates for group A *Streptococcal* infections," Vaccine 22, 2783-90, 2004.

McMillan et al., "Prospecting for new group A *Streptococcal* vaccine candidates," Indian J. Med. Res. 119, 121-25, May 2004.

Meinke et al., "*S. pyogenes* hyperimmune system reactive antigen Spy0269," EBI Accession No. ADR83896, Dec. 2, 2004; revised Jun. 15, 2007.

Molling et al., "Naked DNA for vaccine or therapy," J. Mol. Med. 75, 242-46, 1997.

Mora et al., "Group A *Streptococcus* produce pilus-like structures containing protective antigens and Lancefield T antigens," Proc. Natl. Acad. Sci. USA 102, 15641-46, Oct. 25, 2005.

Musser, "The Next Chapter in Reverse Vaccinology," Nat. Biotechnol. 24, 157-58, Feb. 2006.

Nakagawa et al., "Genome sequence of an M3 strain of *Streptococcus pyogenes* reveals a large-scale genomic rearrangement in invasive strains and new insights into phage evolution," *Genome Res.* 13, 1042-55, Jun. 2003.

Nakata et al., "MsmR, a specific positive regulator of the *Streptococcus pyogenes* FCT pathogenicity region and cytolysin-mediated translocation system genes," Mol. Microbiol. 57, 786-803, 2005.

Navarre et al., "Surface Proteins of Gram-Positive Bacteria and Mechanisms of Their Targeting to the Cell Wall Envelope," *Microbiology and Molecular Biology Reviews*, vol. 63, No. 1, pp. 174-229, Mar. 1999.

NCBI News, table on p. 4, "Microbial Genomes Available for BLAST Search," Jul. 1998.

Olive et al., "Protection of mice from group A *Streptococcal* infection by intranasal immunization with a peptide vaccine that contains a conserved M protein B cell epitope and lacks a T cell autoepitope," Vaccine 20, 2816-25, 2002.

Orefici et al., "Possible virulence marker for *Streptococcus agalactiae* (Lancefiled Group B)," J. Clin. Microbiol. Infectious Diseases 7, 302-05, 1988.

Paoletti et al., "Neonatal mouse protection against infection with multiple group B *Streptococcal* (GBS) serotypes by maternal immunization with a tetravalent GBS polysaccharide-tetanus toxoid conjugate vaccine," Inf. Immun. 62, 3236-43, 1994.

Paoletti, "Surface structure of group B *Streptoccoccus* important in human immunity," in *Gram Positive Pathogens*, Fischetti et al., eds., Chapter 14, pp. 137-153, 2000.

Pournaras et al., "Pheromone responses and high-level aminoglycoside resistance of conjugative plasmids of *Enterococcus faecalis* from Greece," J. Antimicrobial Chemotherapy 46, 1013-16, 2000.

Proft et al., "Identification and Characterization of Novel Superantigens from *Streptococcus pyogenes*," J. Exp. Med. 189, 89-101, Jan. 4, 1999.

Quinn, "The response of rheumatic and non-rheumatic children to streptolysin O concentrate," J. Clin. Invest. 36, 793-802, Jun. 1957.

Ramachandran et al., "Two Distinct Genotypes of prtF2, Encoding a Fibronectin Binding Protein, and Evolution of the Gene Family in *Streptococcus pyogenes*," *Journal of Bacteriology*, vol. 186, No. 22, pp. 7601-7609, Nov. 2004.

Rodewald et al., "Neonatal mouse model of group b *Streptococcal* infection," J. Infectious Diseases 166, 635-39, 1992.

Rodriguez-Ortega et al., "Characterization and identification of vaccine candidate proteins through analysis of the group A *Streptococcus* surface proteome," Nature Biotechnol. 24, 191-97, 2006.

Roitt et al., Structure of Antigens, *Immunology*, 4th ed., Mosby, London, pp. 7.7 and 7.8, 1998.

Rosini et al., "Identification of novel genomic islands coding for antigenic pilus-like structures in *Streptococcus agalactiae*," Mol. Microbiol. 61, 126-41, 2006.

Rudenko et al., "Selection for activation of a new variant surface glycoprotein gene expression site in *Trypanosoma brucei* can result in deletion of the old one," Mol. Biochem. Parisitol. 95, 97-109, 1998; NCBI Accession No. CAD21770.

Schneewind et al., "Sequence and Structural Characteristics of the Trypsin-Resistant T6 Surface Protein of Group A *Streptococci*," *Journal of Bacteriology*, vol. 172, No. 6, pp. 3310-3317, Jun. 1990.

Schneewind, "Structure of the Cell Wall anchor of Surface Proteins in *Staphylococcus aureus*," Science 268, 103-06, Apr. 7, 1995.

Segura et al., "*Streptococcus suis* and group B *Streptococcus* differ in their interactions with murine macrophages," FEMS Immunol. Med. Microbiol. 21, 189-95, 1998.

Seizen, "Multi-domain, cell envelope proteases of lactic acid bacteria," Antonie von Leeuwenhoek 76, 139-55, 1999.

Smoot et al., "Genome sequence and comparative microarray analysis of serotype M18 group A *Streptococcus* strains associated with acute rheumatic fever outbreaks," *Proc. Natl. Acad. Sci. USA 99*, 4668-73, Apr. 2, 2002.

Stephenson et al., "The Fap1 fimbrial adhesin is a glycoprotein: antibodies specific for the glycan moiety block the adhesion of *Streptococcus parasanguis* in an in vitro tooth model," *Mol. Microbiol. 43*, 147-57, 2002.

Supplementary Search report for EP 03799822 (corresponding to WO 04/041157) dated Jan. 21, 2008.

Surovov & Ferretti, "Physical and Genetic Chromosomal Map of an M Type 1 Strain of *Streptococcus pyogenes*," J. Bacteriol. 178, 5546-49, Sep. 1996.

Takami et al., "Two component sensor histidine kinase involved in phosphate regulation," NCBI Accession No. NP_244022.1, Sep. 10, 2001.

Telford et al., Sequence 7466 from WO 02/34771, EBI Accession No. CQ650509, Feb. 2, 2004; modified May 31, 2006.

Telford et al., "*Streptococcus* polypeptide SEQ ID No. 9188" of WO 02/34771, EBI Accession No. ABP300006, Jul. 2, 2002; revised Jun. 15, 1007.

Tettelin et al., "Complete genome sequence and comparative genomic analysis of an emerging human pathogen, serotype V *Streptococcus agalactiae*," Proc. Natl. Acad. Sci. USA 99, 12391-96, Sep. 17, 2002.

Tettelin et al., "Complete genome sequence of a virulent isolate of *Streptococcus pneumoniae*," Science 293, 498-506, 2001.

Tettelin et al., Database EMBL, Accession No. AE014193, *Streptococcus agalactiae* 2603V/R section 3 of 100 of the complete genome, Sep. 2, 2002.

Tettelin et al., Swiss-Prot Accession No. Q3DV91 for *Streptococcus agalactiae* strain 18R21, Nov. 22, 2005.

Tighe et al., "Gene vaccination: plasmid DNA is more than just a blueprint," Immunology Today 19, 89-97, Feb. 1998.

Todd, "Antigenic *Streptococcal* Hemolysin," J. Exp. Med. 55, 267-80, 1932.

Ton-That & Schneewind, "Assembly of pili on the surface of *Corynebacterium diphtheriae*," Mol. Microbiol. 50, 1429-38, 2003.

Ton-That et al., "Sortases and pilin elements involved in pilus assembly of *Corynebacterium diphtheriae*," Mol. Microbiol. 53, 251-61, 2004.

UniProt Accession No. A7CNQ7, Jul. 5, 2004.

UniProt Accession No. Q5XEL1, Nov. 23, 2004.

UniProt Accession No. Q8P318, Oct. 1, 2002.

Vallet et al., "The chaperone/usher pathways of *Pseudomonas aeruginosa*: Identification of fimbrial gene clusters (cup) and their involvement in biofilm formation," *PNAS*, vol. 98, No. 12, pp. 6911-6916, Jun. 2001.

Wang et al., "Protein encoded by prokaryotic essential gene #31978," EBI Accession No. ABU46451, Jun. 19, 2003; revised Jun. 15, 2007.

Watnick et al., "Steps in the development of a *Vibrio cholerae* El Tor biofilm," *Molecular Microbiology*, vol. 34, No. 3, pp. 586-595, 1999.

Wessels et al., "Stimulation of protective antibodies against type 1a and 1b group B *Streptococci* by a type 1a polysaccharide-tetanus toxoid conjugate vaccine," Inf. Immun. 61, 4760-66, 1993.

Zhong et al., "Hypothetical protein of *Arabidopsis thaliana*," NBCI Accession No. AAD29767, May 11, 1999.

Basha, "Two-Dimensional Gel Electrophoretic Separation of Proteins," in *Methods for Protein Analysis*, Cherry & Barford, eds., American Oil Chemists' Society, Champaign, IL, p. 70, 1988.

Joshi, "Study of Antibody Recognition Pattern of HCV by Western Blot," *Kathmandu University Medical Journal 1*, 256-62, 2003.

Lachenauer & Madoff, "surface trypsin-resistant laddering protein {N-terminal} [*Streptococcus* sp., type V strain GBS, Peptide Partial, 19 aa]," NCBI Accession No. AAB46876, Feb. 11, 1997.

Madoff et al., "Phenotypic Diversity in the Alpha C Protein of Group B *Streptococci*," *Inf. Immun. 59*, 2638-44, 1991.

* cited by examiner

NUCLEIC ACIDS AND PROTEINS FROM *STREPTOCOCCUS* GROUPS A & B

This application is a division of Ser. No. 10/415,182 filed Apr. 28, 2003. Ser. No. 10/415,182 is a National Stage application of PCT application PCT/GB01/04789, which was filed Oct. 29, 2001 and published in English under PCT Article 21(2) on May 2, 2002. PCT/GB01/04789 claims the benefit of Serial No. GB0026333.5 filed Oct. 27, 2000, Serial No. GB0028727.6 filed Nov. 24, 2000, and Serial No. GB0105640.7 filed Mar. 7, 2001. Each of these applications and all the other documents cited herein are incorporated by reference in their entireties.

This application incorporates by reference the contents of a 21 MB text file created Jan. 11, 2012 and named "11434199substituesequencelisting.txt," which is the sequence listing for this application.

TECHNICAL FIELD

This invention relates to nucleic acid and proteins from the bacteria *Streptococcus agalactiae* (GBS) and *Streptococcus pyogenes* (GAS).

BACKGROUND ART

Once thought to infect only cows, the Gram-positive bacterium *Streptococcus agalactiae* (or "group B *streptococcus*", abbreviated to "GBS") is now known to cause serious disease, bacteremia and meningitis, in immunocompromised individuals and in neonates. There are two types of neonatal infection. The first (early onset, usually within 5 days of birth) is manifested by bacteremia and pneumonia. It is contracted vertically as a baby passes through the birth canal. GBS colonises the vagina of about 25% of young women, and approximately 1% of infants born via a vaginal birth to colonised mothers will become infected. Mortality is between 50-70%. The second is a meningitis that occurs 10 to 60 days after birth. If pregnant women are vaccinated with type III capsule so that the infants are passively immunised, the incidence of the late onset meningitis is reduced but is not entirely eliminated.

The "B" in "GBS" refers to the Lancefield classification, which is based on the antigenicity of a carbohydrate which is soluble in dilute acid and called the C carbohydrate. Lancefield identified 13 types of C carbohydrate, designated A to O, that could be serologically differentiated. The organisms that most commonly infect humans are found in groups A, B, D, and G. Within group B, strains can be divided into 8 serotypes (Ia, Ib, Ia/c, II, III, IV, V, and VI) based on the structure of their polysaccharide capsule.

Group A *streptococcus* ("GAS", *S. pyogenes*) is a frequent human pathogen, estimated to be present in between 5-15% of normal individuals without signs of disease. When host defences are compromised, or when the organism is able to exert its virulence, or when it is introduced to vulnerable tissues or hosts, however, an acute infection occurs. Diseases include puerperal fever, scarlet fever, erysipelas, pharyngitis, impetigo, necrotising fasciitis, myositis and streptococcal toxic shock syndrome.

*S. pyogenes* is typically treated using antibiotics. Although *S. agalactiae* is inhibited by antibiotics, however, it is not killed by penicillin as easily as GAS. Prophylactic vaccination is thus preferable.

Current GBS vaccines are based on polysaccharide antigens, although these suffer from poor immunogenicity. Anti-idiotypic approaches have also been used (e.g. WO99/54457). There remains a need, however, for effective adult vaccines against *S. agalactiae* infection. There also remains a need for vaccines against *S. pyogenes* infection.

It is an object of the invention to provide proteins which can be used in the development of such vaccines. The proteins may also be useful for diagnostic purposes, and as targets for antibiotics.

DETAILED DESCRIPTION

Figure 1:
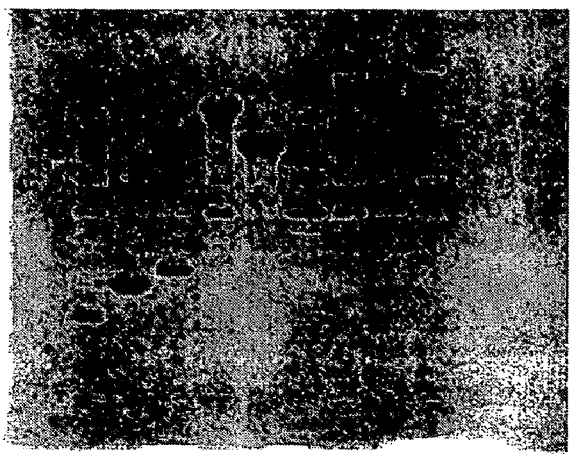
FIG. 1 is an SDS-PAGE analysis of total cell extracts from cultures of recombinant *E. coli* expressing GBS proteins of the invention. Lane 1 in contains molecular weight markers (250, 150, 100, 75, 50, 37, 25, 15 & 10 kDa).

The invention provides proteins comprising the *S. agalactiae* amino acid sequences disclosed in the examples, and proteins comprising the *S. pyogenes* amino acid sequences disclosed in the examples. These amino acid sequences are the even SEQ ID NOS: between 1 and 10960.

It also provides proteins comprising amino acid sequences having sequence identity to the *S. agalactiae* amino acid sequences disclosed in the examples, and proteins comprising amino acid sequences having sequence identity to the *S. pyogenes* amino acid sequences disclosed in the examples. Depending on the particular sequence, the degree of sequence identity is preferably greater than 50% (e.g. 60%, 70%, 80%, 90%, 95%, 99% or more). These proteins include homologs, orthologs, allelic variants and functional mutants. Typically, 50% identity or more between two proteins is considered to be an indication of functional equivalence. Identity between proteins is preferably determined by the Smith-Waterman homology search algorithm as implemented in the MPSRCH program (Oxford Molecular), using an affine gap search with parameters gap open penalty=12 and gap extension penalty=1.

A preferred protein of the invention is GBS67 (SEQ ID NO:3746).

The invention further provides proteins comprising fragments of the *S. agalactiae* amino acid sequences disclosed in the examples, and proteins comprising fragments of the *S. pyogenes* amino acid sequences disclosed in the examples. The fragments should comprise at least n consecutive amino acids from the sequences and, depending on the particular sequence, n is 7 or more (e.g. 8, 10, 12, 14, 16, 18, 20, 30, 40, 50, 60, 70, 80, 90, 100 or more). Preferably the fragments comprise one or more epitopes from the sequence. Other preferred fragments are (a) the N-terminal signal peptides of the proteins disclosed in the examples, (b) the proteins disclosed in the examples, but without their N-terminal signal peptides, (c) fragments common to the related GAS and GBS proteins disclosed in the examples, and (d) the proteins disclosed in the examples, but without their N-terminal amino acid residue.

The proteins of the invention can, of course, be prepared by various means (e.g. recombinant expression, purification from GAS or GBS, chemical synthesis etc.) and in various forms (e.g. native, fusions, glycosylated, non-glycosylated etc.). They are preferably prepared in substantially pure form (i.e. substantially free from other streptococcal or host cell proteins) or substantially isolated form. Proteins of the invention are preferably streptococcal proteins.

According to a further aspect, the invention provides antibodies which bind to these proteins. These may be polyclonal or monoclonal and may be produced by any suitable means (e.g. by recombinant expression). To increase compatibility with the human immune system, the antibodies may be chimeric or humanised (e.g. Breedveld (2000) *Lancet* 355(9205):735-740; Gorman & Clark (1990) *Semin. Immunol.* 2:457-466), or fully human antibodies may be used. The antibodies may include a detectable label (e.g. for diagnostic assays).

According to a further aspect, the invention provides nucleic acid comprising the *S. agalactiae* nucleotide sequences disclosed in the examples, and nucleic acid comprising the *S. pyogenes* nucleotide sequences disclosed in the examples. These nucleic acid sequences are the odd SEQ ID NOS: between 1 and 10966.

In addition, the invention provides nucleic acid comprising nucleotide sequences having sequence identity to the *S. agalactiae* nucleotide sequences disclosed in the examples, and nucleic acid comprising nucleotide sequences having sequence identity to the *S. pyogenes* nucleotide sequences disclosed in the examples. Identity between sequences is preferably determined by the Smith-Waterman homology search algorithm as described above.

Furthermore, the invention provides nucleic acid which can hybridise to the *S. agalactiae* nucleic acid disclosed in the examples, and nucleic acid which can hybridise to the *S. pyogenes* nucleic acid disclosed in the examples preferably under 'high stringency' conditions (e.g. 65° C. in 0.1×SSC, 0.5% SDS solution).

Nucleic acid comprising fragments of these sequences are also provided. These should comprise at least n consecutive nucleotides from the *S. agalactiae* or *S. pyogenes* sequences and, depending on the particular sequence, n is 10 or more (e.g. 12, 14, 15, 18, 20, 25, 30, 35, 40, 50, 60, 70, 80, 90, 100, 150, 200 or more). The fragments may comprise sequences which are common to the related GAS and GBS sequences disclosed in the examples.

According to a further aspect, the invention provides nucleic acid encoding the proteins and protein fragments of the invention.

The invention also provides: nucleic acid comprising nucleotide sequence SEQ ID NO:3745; nucleic acid comprising nucleotide sequences having sequence identity to SEQ ID NO:3745; nucleic acid which can hybridise to SEQ ID NO:3745 (preferably under 'high stringency' conditions); nucleic acid comprising a fragment of at least n consecutive nucleotides from SEQ ID NO:3745, wherein n is 10 or more e.g. 12, 14, 15, 18, 20, 25, 30, 35, 40, 50, 60, 70, 80, 90, 100, 150, 200, 250, 300, 350, 400, 450, 500, 600, 700, 800, 900, 1000, 1500, 2000, 3000, 4000, 5000, 10000, 100000, 1000000 or more.

Nucleic acids of the invention can be used in hybridisation reactions (e.g. Northern or Southern blots, or in nucleic acid microarrays or 'gene chips') and amplification reactions (e.g. PCR, SDA, SSSR, LCR, TMA, NASBA etc.) and other nucleic acid techniques.

It should also be appreciated that the invention provides nucleic acid comprising sequences complementary to those described above (e.g. for antisense or probing, or for use as primers).

Nucleic acid according to the invention can, of course, be prepared in many ways (e.g. by chemical synthesis, from genomic or cDNA libraries, from the organism itself etc.) and can take various forms (e.g. single stranded, double stranded, vectors, primers, probes, labelled etc.). The nucleic acid is preferably in substantially isolated form.

Nucleic acid according to the invention may be labelled e.g. with a radioactive or fluorescent label. This is particularly useful where the nucleic acid is to be used in nucleic acid detection techniques e.g. where the nucleic acid is a primer or as a probe for use in techniques such as PCR, LCR, TMA, NASBA etc.

In addition, the term "nucleic acid" includes DNA and RNA, and also their analogues, such as those containing modified backbones, and also peptide nucleic acids (PNA) etc.

According to a further aspect, the invention provides vectors comprising nucleotide sequences of the invention (e.g. cloning or expression vectors) and host cells transformed with such vectors.

According to a further aspect, the invention provides compositions comprising protein, antibody, and/or nucleic acid according to the invention. These compositions may be suitable as immunogenic compositions, for instance, or as diagnostic reagents, or as vaccines.

The invention also provides nucleic acid, protein, or antibody according to the invention for use as medicaments (e.g. as immunogenic compositions or as vaccines) or as diagnostic reagents. It also provides the use of nucleic acid, protein, or antibody according to the invention in the manufacture of: (i) a medicament for treating or preventing disease and/or infection caused by *streptococcus*; (ii) a diagnostic reagent for detecting the presence of *streptococcus* or of antibodies raised against *streptococcus*; and/or (iii) a reagent which can raise antibodies against *streptococcus*. Said *streptococcus* may be any species, group or strain, but is preferably *S. agalactiae*, especially serotype III or V, or *S. pyogenes*. Said disease may be bacteremia, meningitis, puerperal fever, scarlet fever, erysipelas, pharyngitis, impetigo, necrotising fasciitis, myositis or toxic shock syndrome.

The invention also provides a method of treating a patient, comprising administering to the patient a therapeutically effective amount of nucleic acid, protein, and/or antibody of the invention. The patient may either be at risk from the disease themselves or may be a pregnant woman ('maternal immunisation' e.g. Glezen & Alpers (1999) *Clin. Infect. Dis.* 28:219-224).

Administration of protein antigens is a preferred method of treatment for inducing immunity.

Administration of antibodies of the invention is another preferred method of treatment. This method of passive immunisation is particularly useful for newborn children or for pregnant women. This method will typically use monoclonal antibodies, which will be humanised or fully human.

The invention also provides a kit comprising primers (e.g. PCR primers) for amplifying a template sequence contained within a *Streptococcus* (e.g. *S. pyogenes* or *S. agalactiae*) nucleic acid sequence, the kit comprising a first primer and a second primer, wherein the first primer is substantially complementary to said template sequence and the second primer is substantially complementary to a complement of said template sequence, wherein the parts of said primers which have substantial complementarity define the termini of the template sequence to be amplified. The first primer and/or the second primer may include a detectable label (e.g. a fluorescent label).

The invention also provides a kit comprising first and second single-stranded oligonucleotides which allow amplification of a *Streptococcus* template nucleic acid sequence contained in a single- or double-stranded nucleic acid (or mixture thereof), wherein: (a) the first oligonucleotide comprises a primer sequence which is substantially complementary to said template nucleic acid sequence; (b) the second oligonucleotide comprises a primer sequence which is substantially complementary to the complement of said template nucleic acid sequence; (c) the first oligonucleotide and/or the second oligonucleotide comprise(s) sequence which is not complementary to said template nucleic acid; and (d) said primer sequences define the termini of the template sequence to be amplified. The non-complementary sequence(s) of feature (c) are preferably upstream of (i.e. 5' to) the primer sequences. One or both of these (c) sequences may comprise a restriction site (e.g. EP-B-0509612) or a promoter sequence (e.g. EP-B-0505012). The first oligonucleotide and/or the second oligonucleotide may include a detectable label (e.g. a fluorescent label).

The template sequence may be any part of a genome sequence (e.g. SEQ ID NO:3745). For example, it could be a rRNA gene (e.g. Turenne et al. (2000) *J. Clin. Microbiol.* 38:513-520; SEQ ID NOS: 12018-12024 herein) or a protein-coding gene. The template sequence is preferably specific to GBS.

The invention also provides a computer-readable medium (e.g. a floppy disk, a hard disk, a CD-ROM, a DVD etc.) and/or a computer database containing one or more of the sequences in the sequence listing. The medium preferably contains one or both of SEQ ID NOS: 3744 and 3743.

The invention also provides a hybrid protein represented by the formula $NH_2$-A-[-X-L-]$_n$-B—COOH, wherein X is a protein of the invention, L is an optional linker amino acid sequence, A is an optional N-terminal amino acid sequence, B is an optional C-terminal amino acid sequence, and n is an integer greater than 1. The value of n is between 2 and x, and the value of x is typically 3, 4, 5, 6, 7, 8, 9 or 10. Preferably n is 2, 3 or 4; it is more preferably 2 or 3; most preferably, n=2. For each n instances, —X— may be the same or different. For each n instances of [-X-L-], linker amino acid sequence -L- may be present or absent. For instance, when n=2 the hybrid may be $NH_2$—$X_1$-$L_1$-$X_2$-$L_2$-COOH, $NH_2$—$X_1$—$X_2$—COOH, $NH_2$—$X_1$-$L_1$-$X_2$—COOH, $NH_2$—$X_1$—$X_2$-$L_2$-COOH, etc. Linker amino acid sequence(s) -L- will typically be short (e.g. 20 or fewer amino acids i.e. 19, 18, 17, 16, 15, 14, 13, 12, 11, 10, 9, 8, 7, 6, 5, 4, 3, 2, 1). Examples include short peptide sequences which facilitate cloning, poly-glycine linkers (i.e. Gly$_n$ where n=2, 3, 4, 5, 6, 7, 8, 9, 10 or more), and histidine tags (i.e. His$_n$ where n=3, 4, 5, 6, 7, 8, 9, 10 or more). Other suitable linker amino acid sequences will be apparent to those skilled in the art. -A- and —B— are optional sequences which will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. His$_n$ where n=3, 4, 5, 6, 7, 8, 9, 10 or more). Other suitable N-terminal and C-terminal amino acid sequences will be apparent to those skilled in the art. In some embodiments, each X will be a GBS sequence; in others, mixtures of GAS and GBS will be used.

According to further aspects, the invention provides various processes.

A process for producing proteins of the invention is provided, comprising the step of culturing a host cell of to the invention under conditions which induce protein expression.

A process for producing protein or nucleic acid of the invention is provided, wherein the protein or nucleic acid is synthesised in part or in whole using chemical means.

A process for detecting polynucleotides of the invention is provided, comprising the steps of: (a) contacting a nucleic probe according to the invention with a biological sample under hybridising conditions to form duplexes; and (b) detecting said duplexes.

A process for detecting *Streptococcus* in a biological sample (e.g. blood) is also provided, comprising the step of contacting nucleic acid according to the invention with the biological sample under hybridising conditions. The process may involve nucleic acid amplification (e.g. PCR, SDA, SSSR, LCR, TMA, NASBA etc.) or hybridisation (e.g. microarrays, blots, hybridisation with a probe in solution etc.). PCR detection of *Streptococcus* in clinical samples, in particular *S. pyogenes*, has been reported [see e.g. Louie et al. (2000) *CMAJ* 163:301-309; Louie et al. (1998) *J. Clin. Microbiol.* 36:1769-1771]. Clinical assays based on nucleic acid are described in general in Tang et al. (1997) *Clin. Chem.* 43:2021-2038.

A process for detecting proteins of the invention is provided, comprising the steps of: (a) contacting an antibody of the invention with a biological sample under conditions suitable for the formation of an antibody-antigen complexes; and (b) detecting said complexes.

A process for identifying an amino acid sequence is provided, comprising the step of searching for putative open reading frames or protein-coding regions within a genome sequence of *S. agalactiae*. This will typically involve in silico searching the sequence for an initiation codon and for an in-frame termination codon in the downstream sequence. The region between these initiation and termination codons is a putative protein-coding sequence. Typically, all six possible reading frames will be searched. Suitable software for such analysis includes ORFFINDER (NCBI), GENEMARK [Borodovsky & McIninch (1993) *Computers Chem.* 17:122-133), GLIMMER [Salzberg et al. (1998) *Nucleic Acids Res.* 26:544-548; Salzberg et al. (1999) *Genomics* 59:24-31; Delcher et al. (1999) *Nucleic Acids Res.* 27:4636-4641], or other software which uses Markov models [e.g. Shmatkov et al. (1999) *Bioinformatics* 15:874-876]. The invention also provides a protein comprising the identified amino acid sequence. These proteins can then expressed using conventional techniques.

The invention also provides a process for determining whether a test compound binds to a protein of the invention. If a test compound binds to a protein of the invention and this binding inhibits the life cycle of the GBS bacterium, then the test compound can be used as an antibiotic or as a lead compound for the design of antibiotics. The process will typically comprise the steps of contacting a test compound with a protein of the invention, and determining whether the test compound binds to said protein. Preferred proteins of the invention for use in these processes are enzymes (e.g. tRNA synthetases), membrane transporters and ribosomal proteins. Suitable test compounds include proteins, polypeptides, carbohydrates, lipids, nucleic acids (e.g. DNA, RNA, and modified forms thereof), as well as small organic compounds (e.g.

MW between 200 and 2000 Da). The test compounds may be provided individually, but will typically be part of a library (e.g. a combinatorial library). Methods for detecting a binding interaction include NMR, filter-binding assays, gel-retardation assays, displacement assays, surface plasmon resonance, reverse two-hybrid etc. A compound which binds to a protein of the invention can be tested for antibiotic activity by contacting the compound with GBS bacteria and then monitoring for inhibition of growth. The invention also provides a compound identified using these methods.

The invention also provides a composition comprising a protein or the invention and one or more of the following antigens:

- a protein antigen from *Helicobacter pylori* such as VacA, CagA, NAP, HopX, HopY [e.g. WO98/04702] and/or urease.
- a protein antigen from *N. meningitidis* serogroup B, such as those in WO99/24578, WO99/36544, WO99/57280, WO00/22430, Tettelin et al. (2000) *Science* 287:1809-1815, Pizza et al. (2000) *Science* 287:1816-1820 and WO96/29412, with protein '287' and derivatives being particularly preferred.
- an outer-membrane vesicle (OMV) preparation from *N. meningitidis* serogroup B, such as those disclosed in WO01/52885; Bjune et al. (1991) *Lancet* 338(8775): 1093-1096; Fukasawa et al. (1999) *Vaccine* 17:2951-2958; Rosenqvist et al. (1998) *Dev. Biol. Stand.* 92:323-333 etc.
- a saccharide antigen from *N. meningitidis* serogroup A, C, W135 and/or Y, such as the oligosaccharide disclosed in Costantino et al. (1992) *Vaccine* 10:691-698 from serogroup C [see also Costantino et al. (1999) *Vaccine* 17:1251-1263].
- a saccharide antigen from *Streptococcus pneumoniae* [e.g. Watson (2000) *Pediatr Infect Dis J* 19:331-332; Rubin (2000) *Pediatr Clin North Am* 47:269-285, v; Jedrzejas (2001) *Microbiol Mol Biol Rev* 65:187-207].
- an antigen from hepatitis A virus, such as inactivated virus [e.g. Bell (2000) *Pediatr Infect Dis J* 19:1187-1188; Iwarson (1995) *APMIS* 103:321-326].
- an antigen from hepatitis B virus, such as the surface and/or core antigens [e.g. Gerlich et al. (1990) *Vaccine* 8 Suppl: S63-68 & 79-80].
- an antigen from hepatitis C virus [e.g. Hsu et al. (1999) *Clin Liver Dis* 3:901-915].
- an antigen from *Bordetella pertussis*, such as pertussis holotoxin (PT) and filamentous haemagglutinin (FHA) from *B. pertussis*, optionally also in combination with pertactin and/or agglutinogens 2 and 3 [e.g. Gustafsson et al. (1996) *N. Engl. J. Med.* 334:349-355; Rappuoli et al. (1991) *TIBTECH* 9:232-238].
- a diphtheria antigen, such as a diphtheria toxoid [e.g. chapter 3 of Vaccines (1988) eds. Plotkin & Mortimer. ISBN 0-7216-1946-0] e.g. the $CRM_{197}$ mutant [e.g. Del Guidice et al. (1998) *Molecular Aspects of Medicine* 19:1-70].
- a tetanus antigen, such as a tetanus toxoid [e.g. chapter 4 of Plotkin & Mortimer].
- a saccharide antigen from *Haemophilus influenzae* B.
- an antigen from *N. gonorrhoeae* [e.g. WO99/24578, WO99/36544, WO99/57280].
- an antigen from *Chlamydia pneumoniae* [e.g. PCT/IB01/01445; Kalman et al. (1999) *Nature Genetics* 21:385-389; Read et al. (2000) *Nucleic Acids Res* 28:1397-406; Shirai et al. (2000) *J. Infect. Dis.* 181(Suppl 3): S524-S527; WO99/27105; WO00/27994; WO00/37494].
- an antigen from *Chlamydia trachomatis* [e.g. WO99/28475].
- an antigen from *Porphyromonas gingivalis* [e.g. Ross et al. (2001) *Vaccine* 19:4135-4142].
- polio antigen(s) [e.g. Sutter et al. (2000) *Pediatr Clin North Am* 47:287-308; Zimmerman & Spann (1999) *Am Fam Physician* 59:113-118, 125-126] such as IPV or OPV.
- rabies antigen(s) [e.g. Dreesen (1997) *Vaccine* 15 Suppl: S2-6] such as lyophilised inactivated virus [e.g. *MMWR Morb Mortal Wkly Rep* 1998 Jan. 16; 47(1): 12, 19; RabAvert™].
- measles, mumps and/or rubella antigens [e.g. chapters 9, 10 & 11 of Plotkin & Mortimer].
- influenza antigen(s) [e.g. chapter 19 of Plotkin & Mortimer], such as the haemagglutinin and/or neuramimidase surface proteins.
- an antigen from *Moraxella catarrhalis* [e.g. McMichael (2000) *Vaccine* 19 Suppl 1: S101-107].
- an antigen from *Staphylococcus aureus* [e.g. Kuroda et al. (2001) *Lancet* 357(9264):1225-1240; see also pages 1218-1219].

Where a saccharide or carbohydrate antigen is included, it is preferably conjugated to a carrier protein in order to enhance immunogenicity [e.g. Ramsay et al. (2001) *Lancet* 357(9251):195-196; Lindberg (1999) *Vaccine* 17 Suppl 2: S28-36; *Conjugate Vaccines* (eds. Cruse et al.) ISBN 3805549326, particularly vol. 10:48-114 etc.]. Preferred carrier proteins are bacterial toxins or toxoids, such as diphtheria or tetanus toxoids. The $CRM_{197}$ diphtheria toxoid is particularly preferred. Other suitable carrier proteins include the *N. meningitidis* outer membrane protein [e.g. EP-0372501], synthetic peptides [e.g. EP-0378881, EP-0427347], heat shock proteins [e.g. WO93/17712], pertussis proteins [e.g. WO98/58668; EP-0471177], protein D from *H. influenzae* [e.g. WO00/56360], toxin A or B from *C. difficile* [e.g. WO00/61761], etc. Any suitable conjugation reaction can be used, with any suitable linker where necessary.

Toxic protein antigens may be detoxified where necessary (e.g. detoxification of pertussis toxin by chemical and/or genetic means).

Where a diphtheria antigen is included in the composition it is preferred also to include tetanus antigen and pertussis antigens. Similarly, where a tetanus antigen is included it is preferred also to include diphtheria and pertussis antigens. Similarly, where a pertussis antigen is included it is preferred also to include diphtheria and tetanus antigens.

Antigens are preferably adsorbed to an aluminium salt.

Antigens in the composition will typically be present at a concentration of at least 1 µg/ml each. In general, the concentration of any given antigen will be sufficient to elicit an immune response against that antigen.

The invention also provides compositions comprising two or more proteins of the present invention. The two or more proteins may comprise GBS sequences or may comprise GAS and GBS sequences.

A summary of standard techniques and procedures which may be employed to perform the invention (e.g. to utilise the disclosed sequences for vaccination or diagnostic purposes) follows. This summary is not a limitation on the invention but, rather, gives examples that may be used, but are not required.

General

The practice of the present invention will employ, unless otherwise indicated, conventional techniques of molecular biology, microbiology, recombinant DNA, and immunology, which are within the skill of the art. Such techniques are explained fully in the literature eg. Sambrook *Molecular Cloning; A Laboratory Manual, Second Edition* (1989); *DNA*

Cloning, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification*: Principles and Practice, Second Edition (Springer-Verlag, N.Y.), and *Handbook of Experimental Immunology*, Volumes I-IV (D. M. Weir and C. C. Blackwell eds 1986).

Standard abbreviations for nucleotides and amino acids are used in this specification.

DEFINITIONS

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "comprising" means "including" as well as "consisting" e.g. a composition "comprising" X may consist exclusively of X or may include something additional e.g. X+Y.

The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a *streptococcus* sequence is heterologous to a mouse host cell. A further examples would be two epitopes from the same or different proteins which have been assembled in a single protein in an arrangement not found in nature.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as DNA, RNA or amino acid sequence differing from but having sequence identity with the native or disclosed sequence. Depending on the particular sequence, the degree of sequence identity between the native or disclosed sequence and the mutant sequence is preferably greater than 50% (eg. 60%, 70%, 80%, 90%, 95%, 99% or more, calculated using the Smith-Waterman algorithm as described above). As used herein, an "allelic variant" of a nucleic acid molecule, or region, for which nucleic acid sequence is provided herein is a nucleic acid molecule, or region, that occurs essentially at the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions (eg. see U.S. Pat. No. 5,753, 235).

Expression Systems

The *streptococcus* nucleotide sequences can be expressed in a variety of different expression systems; for example those used with mammalian cells, baculoviruses, plants, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (eg. structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation [Sambrook et al. (1989) "Expression of Cloned Genes in Mammalian Cells." In *Molecular Cloning: A Laboratory Manual, 2nd ed.]*.

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallotheionin gene, also provide useful promoter sequences. Expression may be either constitutive or regulated (inducible), depending on the promoter can be induced with glucocorticoid in hormone-responsive cells.

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter [Maniatis et al. (1987) *Science* 236:1237; Alberts et al. (1989) *Molecular Biology of the Cell*, 2nd ed.]. Enhancer elements derived from viruses may be particularly useful, because they usually have a broader host range. Examples include the SV40 early gene enhancer [Dijkema et al (1985) *EMBO J.* 4:761] and the enhancer/promoters derived from the long terminal repeat (LTR) of the Rous Sarcoma Virus [Gorman et al. (1982b) *Proc. Natl. Acad. Sci.* 79:6777] and from human cytomegalovirus [Boshart et al. (1985) *Cell* 41:521]. Additionally, some enhancers are regulatable and become active only in the presence of an inducer, such as a hormone or metal ion [Sassone-Corsi and Borelli (1986) *Trends Genet.* 2:215; Maniatis et al. (1987) *Science* 236:1237].

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus tripartite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation [Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105]. These sequences direct the transcription of an mRNA which can be translated into the polypeptide encoded by the DNA. Examples of transcription terminator/polyadenylation signals include those derived from SV40 [Sambrook et al (1989) "Expression of cloned genes in cultured mammalian cells." *In Molecular Cloning: A Laboratory Manual]*.

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (eg. plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 [Gluzman (1981) *Cell* 23:175] or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 [Kaufman et al. (1989) *Mol. Cell. Biol.* 9:946] and pHEBO [Shimizu et al. (1986) *Mol. Cell. Biol.* 6:1074].

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (eg. Hep G2), and a number of other cell lines.

ii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MaxBac" kit). These techniques are generally known to those skilled in the art and fully described in Summers and Smith, *Texas Agricultural Experiment Station Bulletin No. 1555* (1987) (hereinafter "Summers and Smith").

Prior to inserting the DNA sequence encoding the protein into the baculovirus genome, the above described components, comprising a promoter, leader (if desired), coding sequence, and transcription termination sequence, are usually assembled into an intermediate transplacement construct (transfer vector). This may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extra-chromosomal element (e.g. plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.,* 42:177) and a prokaryotic ampicillin-resistance (amp) gene and origin of replication for selection and propagation in *E. coli*.

Baculovirus transfer vectors usually contain a baculovirus promoter. A baculovirus promoter is any DNA sequence capable of binding a baculovirus RNA polymerase and initiating the downstream (5' to 3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene,* 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA,* 82:8404; mouse IL-3, (Miyajima et al., (1987) *Gene* 58:273; and human glucocerebrosidase, Martin et al. (1988) *DNA,* 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91 The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 µm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. "Current Protocols in Microbiology" Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda,* and *Trichoplusia ni* (WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, eg. Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, eg. HPLC, affinity chromatography, ion exchange chromatography, etc.; electrophoresis; density gradient centrifugation; solvent extraction, etc. As appropriate, the product may be further purified, as required, so as to remove substantially any insect proteins which are also present in the medium, so as to provide a product which is at least substantially free of host debris, eg. proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iii. Plant Systems

There are many plant cell culture and whole plant genetic expression systems known in the art. Exemplary plant cellular genetic expression systems include those described in patents, such as: U.S. Pat. No. 5,693,506; U.S. Pat. No. 5,659, 122; and U.S. Pat. No. 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: Advanced Plant Physiology, Malcolm B. Wilkins, ed., 1984 Pitman Publishing Limited, London, pp. 21-52. References that describe other metabolically-regulated genes: Sheen, *Plant Cell*, 2:1027-1038(1990); Maas et al., *EMBO J.* 9:3447-3452 (1990); Benkel and Hickey, *Proc. Natl. Acad. Sci.* 84:1337-1339 (1987).

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature,* 296, 72-74, 1982. Another method of introduction of nucleic acid segments is high velocity ballistic penetration by small particles with the nucleic acid either within the matrix of small beads or particles, or on the surface, Klein, et al., *Nature,* 327, 70-73, 1987 and Knudsen and Muller, 1991, *Planta,* 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum,* and *Datura.*

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iv. Bacterial Systems

Bacterial expression techniques are known in the art. A bacterial promoter is any DNA sequence capable of binding bacterial RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) [Raibaud et al. (1984) *Annu. Rev. Genet.* 18:173]. Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) [Chang et al. (1977) *Nature* 198:1056], and maltose. Additional examples include promoter sequences derived from biosynthetic enzymes such as tryptophan (trp) [Goeddel et al. (1980) *Nuc. Acids Res.* 8:4057; Yelverton et al. (1981) *Nucl. Acids Res.* 9:731; U.S. Pat. No. 4,738,921; EP-A-0036776 and EP-A-0121775]. The g-laotamase (bla) promoter system [Weissmann (1981) "The cloning of interferon and other mistakes." In *Interferon* 3 (ed. I. Gresser)], bacteriophage lambda PL [Shimatake et al. (1981) *Nature* 292:128] and T5 [U.S. Pat. No. 4,689,406] promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter [U.S. Pat. No. 4,551,433]. For example, the tac promoter is a hybrid trp-lac promoter comprised of both trp promoter and lac operon sequences that is regulated by the lac repressor [Amann et al. (1983) *Gene* 25:167; de Boer et al. (1983) *Proc. Natl. Acad. Sci.* 80:21]. Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system [Studier et al. (1986) *J. Mol. Biol.* 189:113; Tabor et al. (1985) *Proc Natl. Acad. Sci.* 82:1074]. In addition, a hybrid promoter can also be comprised of a bacteriophage promoter and an *E. coli* operator region (EPO-A-0 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon [Shine et al. (1975) *Nature* 254:34]. The SD sequence is thought to promote binding of mRNA to the ribosome by the pairing of bases between the SD sequence and the 3' and of *E. coli* 16S rRNA [Steitz et al. (1979) "Genetic signals and nucleotide sequences in messenger RNA." In *Biological Regulation and Development: Gene Expression* (ed. R. F. Goldberger)]. To express eukaryotic genes and prokaryotic genes with weak ribosome-binding site [Sambrook et al. (1989) "Expression of cloned genes in *Escherichia coli*." In *Molecular Cloning: A Laboratory Manual*].

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo on in vitro incubation with a bacterial methionine N-terminal peptidase (EP-A-0 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene [Nagai et al. (1984) *Nature* 309:810]. Fusion proteins can also be made with sequences from the lacZ [Jia et al. (1987) *Gene* 60:197], trpE [Allen et al. (1987) *J. Biotechnol.* 5:93; Makoff et al. (1989) *J. Gen. Microbiol.* 135:11], and Chey [EP-A-0 324 647] genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (eg. ubiquitin specific processing-protease) to cleave the ubiquitin from the foreign protein. Through this method, native foreign protein can be isolated [Miller et al. (1989) *Bio/Technology* 7:698].

Alternatively, foreign proteins can also be secreted from the cell by creating chimeric DNA molecules that encode a fusion protein comprised of a signal peptide sequence fragment that provides for secretion of the foreign protein in bacteria [U.S. Pat. No. 4,336,336]. The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) [Masui et al. (1983), in: *Experimental Manipulation of Gene Expression*; Ghrayeb et al. (1984) *EMBO J.* 3:2437] and the *E. coli* alkaline phosphatase signal sequence (phoA) [Oka et al. (1985) *Proc. Natl. Acad. Sci.* 82:7212]. As an additional example, the signal sequence of the alpha-amylase gene from various *Bacillus* strains can be used to secrete heterologous proteins from *B. subtilis* [Palva et al. (1982) *Proc. Natl. Acad. Sci. USA* 79:5582; EP-A-0 244 042].

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (eg. plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP-A-0 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline [Davies et al. (1978) *Annu. Rev. Microbiol.* 32:469]. Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* [Palva et al. (1982) *Proc. Natl. Acad. Sci. USA* 79:5582; EP-A-0 036 259 and EP-A-0 063 953; WO 84/04541], *Escherichia coli* [Shimatake et al. (1981) *Nature* 292:128; Amann et al. (1985) *Gene* 40:183; Studier et al. (1986) *J. Mol. Biol.* 189:113; EP-A-0 036 776, EP-A-0 136 829 and EP-A-0 136 907], *Streptococcus cremoris* [Powell et al. (1988) *Appl. Environ. Microbiol.* 54:655]; *Streptococcus lividans* [Powell et al. (1988) *Appl. Environ. Microbiol.* 54:655], *Streptomyces lividans* [U.S. Pat. No. 4,745,056].

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. See eg. [Masson et al. (1989) *FEMS Microbiol. Lett.* 60:273; Palva et al. (1982) *Proc. Natl. Acad. Sci. USA* 79:5582; EP-A-0 036 259 and EP-A-0 063 953; WO 84/04541, *Bacillus*], [Miller et al. (1988) *Proc. Natl. Acad. Sci.* 85:856; Wang et al. (1990) *J. Bacteriol.* 172:949, *Campylobacter*], [Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; *Escherichia*], [Chassy et al. (1987) *FEMS Microbiol. Lett.* 44:173 *Lactobacillus*]; [Fiedler et al. (1988) *Anal. Biochem* 170:38, *Pseudomonas*]; [Augustin et al. (1990) *FEMS Microbiol. Lett.* 66:203, *Staphylococcus*], [Barany et al. (1980) *J. Bacteriol.* 144:698; Harlander (1987) "Transformation of *Streptococcus* lactis by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Sonikuti et al. (1987) *Proc. 4th Evr. Cong. Biotechnology* 1:412, *Streptococcus*].

v. Yeast Expression

Yeast expression systems are also known to one of ordinary skill in the art. A yeast promoter is any DNA sequence capable of binding yeast RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EP-A-0 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO-A-0 329 203). The yeast PHO5 gene, encoding acid phosphatase, also provides useful promoter sequences [Myanohara et al. (1983) *Proc. Natl. Acad. Sci. USA* 80: 1].

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876,197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EP-A-0 164 556). Furthermore, a yeast promoter can include naturally occurring promoters of non-yeast origin that have the ability to bind yeast RNA polymerase and initiate transcription. Examples of such promoters include, inter alia, [Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109;].

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See eg. EP-A-0 196 056. Another example is a ubiquitin fusion protein. Such a fusion protein is made with the ubiquitin region that preferably retains a site for a processing enzyme (eg. ubiquitin-specific processing protease) to cleave the ubiquitin from the foreign protein. Through this method, therefore, native foreign protein can be isolated (eg. WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EP-A-0 012 873; JPO. 62,096,086) and the A-factor gene (U.S. Pat. No. 4,588,684). Alternatively, leaders of non-yeast origin, such as an interferon leader, exist that also provide for secretion in yeast (EP-A-0 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EP-A-0 324 274). Additional leaders employing an alpha-factor leader fragment that provides for secretion include hybrid alpha-factor leaders made with a presequence of a first yeast, but a pro-region from a second yeast alphafactor. (eg. see WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (eg. plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 [Botstein et al. (1979) *Gene* 8:17-24], pCl/1 [Brake et al. (1984) *Proc. Natl. Acad. Sci USA* 81:4642-4646], and YRp17 [Stinchcomb et al. (1982) *J. Mol. Biol.* 158:157]. In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See eg. Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome [Orr-Weaver et al. (1983) *Methods in Enzymol.* 101:228-245]. An integrating vector may be directed to a specific locus in yeast by selecting the appropriate homologous sequence for inclusion in the vector. See Orr-Weaver et al., supra. One or more expression construct may integrate, possibly affecting levels of recombinant protein produced [Rine et al. (1983) *Proc. Natl. Acad. Sci. USA* 80:6750]. The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions [Butt et al. (1987) *Microbiol, Rev.* 51:351].

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors have been developed for, inter alia, the following yeasts: *Candida albicans* [Kurtz, et al. (1986) *Mol. Cell. Biol.* 6:142], *Candida maltosa* [Kunze, et al. (1985) *J. Basic Microbiol.* 25:141]. *Hansenula polymorpha* [Gleeson, et al. (1986) *J. Gen. Microbiol.* 132:3459; Roggenkamp et al. (1986) *Mol. Gen. Genet.* 202:302], *Kluyveromyces fragilis* [Das, et al. (1984) *J. Bacteriol.* 158:1165], *Kluyveromyces lactis* [De Louvencourt et al. (1983) *J. Bacteriol.* 154:737; Van den Berg et al. (1990) *Bio/Technology* 8:135], *Pichia guillerimondii* [Kunze et al. (1985) *J. Basic Microbiol.* 25:141], *Pichia pastoris* [Cregg, et al. (1985) *Mol. Cell. Biol.* 5:3376; U.S. Pat. Nos. 4,837,148 and 4,929,555], *Saccharomyces cerevisiae* [Hinnen et al. (1978) *Proc. Natl. Acad. Sci. USA* 75:1929; Ito et al. (1983) *J. Bacteriol.* 153:163], *Schizosaccharomyces pombe* [Beach and Nurse (1981) *Nature* 300:706], and *Yarrowia lipolytica* [Davidow, et al. (1985) *Curr. Genet.* 10:380471 Gaillardin, et al. (1985) *Curr. Genet.* 10:49].

Methods of introducing exogenous DNA into yeast hosts are well-known in the art, and usually include either the transformation of spheroplasts or of intact yeast cells treated with alkali cations. Transformation procedures usually vary with the yeast species to be transformed. See eg. [Kurtz et al. (1986) *Mol. Cell. Biol.* 6:142; Kunze et al. (1985) *J. Basic Microbiol.* 25:141; *Candida*]; [Gleeson et al. (1986) *J. Gen. Microbiol.* 132:3459; Roggenkamp et al. (1986) *Mol. Gen. Genet.* 202:302; *Hansenula*]; [Das et al. (1984) *J. Bacteriol.* 158:1165; De Louvencourt et al. (1983) *J. Bacteriol* 154: 1165; Van den Berg et al. (1990) *Bio/Technology* 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75; 1929; Ito et al. (1983) *J. Bacteriol.* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia*].

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanised antibodies, altered antibodies, univalent antibodies, Fab proteins, and single domain antibodies.

Antibodies against the proteins of the invention are useful for affinity chromatography, immunoassays, and distinguishing/identifying *streptococcus* proteins.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 μg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (eg 1,000 g for 10 minutes). About 20-50 ml per bleed may be obtained from rabbits.

Monoclonal antibodies are prepared using the standard method of Kohler & Milstein [*Nature* (1975) 256:495-96], or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells expressing membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (eg. hypoxanthine, aminopterin, thymidine medium, "HAT"). The resulting hybridomas are plated by limiting dilution, and are assayed for production of antibodies which bind specifically to the immunizing antigen (and which do not bind to unrelated antigens). The selected MAb-secreting hybridomas are then cultured either in vitro (eg. in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}$P and $^{125}$I), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}$I may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}$I, or with an anti-biotin MAb labeled with HRP. Other permutations and possibilities will be readily apparent to those of ordinary skill in the art, and are considered as equivalents within the scope of the instant invention.

Pharmaceutical Compositions

Pharmaceutical compositions can comprise either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgement of the clinician.

For purposes of the present invention, an effective dose will be from about 0.01 mg/kg to 50 mg/kg or 0.05 mg/kg to about 10 mg/kg of the molecule of the invention in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Vaccines

Vaccines according to the invention may either be prophylactic (ie. to prevent infection) or therapeutic (ie. to treat disease after infection).

Such vaccines comprise immunising antigen(s), immunogen(s), polypeptide(s), protein(s) or nucleic acid, usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) oil-in-water emulsion formulations (with or without other specific immunostimulating agents such as muramyl peptides (see below) or bacterial cell wall components), such as for example (a) MF59™ (WO90/14837; Chapter 10 in *Vaccine Design—the subunit and adjuvant approach* (1995) ed. Powell & Newman), containing 5% squalene, 0.5% TWEEN® 80 (polyoxyethylene sorbitan monooleate), and 0.5% SPAN® 85 (sorbitan trioleate) (optionally containing MTP-PE) formulated into submicron particles using a microfluidizer, (b) SAF, containing 10% squalene, 0.4% TWEEN® 80, 5% pluronic-blocked polymer L121, and thr-MDP either microfluidized into a submicron emulsion or vortexed to generate a larger particle size emulsion, and (c) RIBI™ adjuvant system (RAS), (Ribi Immunochem, Hamilton, Mont.) containing 2% squalene, 0.2% TWEEN® 80, and one or more bacterial cell wall components from the group consisting of monophosphorylipid A (MPL), trehalose dimycolate (TDM), and cell wall skeleton (CWS), preferably MPL+CWS (DETOX™); (2) saponin adjuvants, such as QS21 or STIMULON™ (Cambridge Bioscience, Worcester, Mass.) may be used or particles generated therefrom such as ISCOMs (immunostimulating complexes), which ISCOMS may be devoid of additional detergent e.g. WO00/07621; (3) Complete Freund's Adjuvant (CFA) and Incomplete Freund's Adjuvant (IFA); (4) cytokines, such as interleukins (e.g. IL-1, IL-2, IL-4, IL-5, IL-6, IL-7, IL-12 (WO99/44636), etc.), interferons (e.g. gamma interferon), macrophage colony stimulating factor (M-CSF), tumor necrosis factor (TNF), etc.; (5) monophosphoryl lipid A (MPL) or 3-O-deacylated MPL (3dMPL)

e.g. GB-2220221, EP-A-0689454; (6) combinations of 3dMPL with, for example, QS21 and/or oil-in-water emulsions e.g. EP-A-0835318, EP-A-0735898, EP-A-0761231; (7) oligonucleotides comprising CpG motifs [Krieg Vaccine 2000, 19, 618-622; Krieg *Curr Opin Mol Ther* 2001 3:15-24; Roman et al., *Nat. Med.*, 1997, 3, 849-854; Weiner et al., *PNAS USA,* 1997, 94, 10833-10837; Davis et al., *J. Immunol.*, 1998, 160, 870-876; Chu et al., *J. Exp. Med.*, 1997, 186, 1623-1631; Lipford et al., *Eur. J. Immunol.*, 1997, 27, 2340-2344; Moldoveanu et al., *Vaccine,* 1988, 16, 1216-1224, Krieg et al., *Nature,* 1995, 374, 546-549; Klinman et al., *PNAS USA,* 1996, 93, 2879-2883; Ballas et al., *J. Immunol.*, 1996, 157, 1840-1845; Cowdery et al., *J. Immunol.*, 1996, 156, 4570-4575; Halpern et al., *Cell. Immunol.*, 1996, 167, 72-78; Yamamoto et al., *Jpn. J. Cancer Res.*, 1988, 79, 866-873; Stacey et al., *J. Immunol.*, 1996, 157, 2116-2122; Messina et al., *J. Immunol.*, 1991, 147, 1759-1764; Yi et al., *J. Immunol.*, 1996, 157, 4918-4925; Yi et al., *J. Immunol.*, 1996, 157, 5394-5402; Yi et al., *J. Immunol.*, 1998, 160, 4755-4761; and Yi et al., *J. Immunol.*, 1998, 160, 5898-5906; International patent applications WO96/02555, WO98/16247, WO98/18810, WO98/40100, WO98/55495, WO98/37919 and WO98/52581] i.e. containing at least one CG dinucleotide, with 5-methylcytosine optionally being used in place of cytosine; (8) a polyoxyethylene ether or a polyoxyethylene ester e.g. WO99/52549; (9) a polyoxyethylene sorbitan ester surfactant in combination with an octoxynol (e.g. WO01/21207) or a polyoxyethylene alkyl ether or ester surfactant in combination with at least one additional non-ionic surfactant such as an octoxynol (e.g. WO01/21152); (10) an immunostimulatory oligonucleotide (e.g. a CpG oligonucleotide) and a saponin e.g. WO00/62800; (11) an immunostimulant and a particle of metal salt e.g. WO00/23105; (12) a saponin and an oil-in-water emulsion e.g. WO99/11241; (13) a saponin (e.g. QS21)+3dMPL+IL-12 (optionally+a sterol) e.g. WO98/57659; (14) aluminium salts, preferably hydroxide or phosphate, but any other suitable salt may also be used (e.g. hydroxyphosphate, oxyhydroxide, orthophosphate, sulphate etc. [e.g. see chapters 8 & 9 of Powell & Newman]). Mixtures of different aluminium salts may also be used. The salt may take any suitable form (e.g. gel, crystalline, amorphous etc.); (15) other substances that act as immunostimulating agents to enhance the efficacy of the composition. Aluminium salts and/or MF59™ are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (MTP-PE), etc.

The immunogenic compositions (eg. the immunising antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles.

Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (eg. nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

The immunogenic compositions are conventionally administered parenterally, eg. by injection, either subcutaneously, intramuscularly, or transdermally/transcutaneously (eg. WO98/20734). Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents.

As an alternative to protein-based vaccines, DNA vaccination may be used [eg. Robinson & Torres (1997) *Seminars in Immunol* 9:271-283; Donnelly et al. (1997) *Annu Rev Immunol* 15:617-648; later herein].

Gene Delivery Vehicles

Gene therapy vehicles for delivery of constructs including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art and we contemplate that any retroviral gene therapy vector is employable in the invention, including B, C and D type retroviruses, xenotropic retroviruses (for example, NZB-X1, NZB-X2 and NZB9-1 (see O'Neill (1985) *J. Virol.* 53:160) polytropic retroviruses eg. MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (eg. HT1080 cells) or mink parent cell lines, which eliminates inactivation in human serum.

Preferred retroviruses for the construction of retroviral gene therapy vectors include Avian Leukosis Virus, Bovine Leukemia, Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in Rockville, Md. or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. No. 5,219,740, U.S. Pat. No. 4,405, 712, U.S. Pat. No. 4,861,719, U.S. Pat. No. 4,980,289, U.S. Pat. No. 4,777,127, U.S. Pat. No. 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (ie. there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. No. 5,354,678, U.S. Pat. No. 5,173,414, U.S. Pat. No. 5,139,941, and U.S. Pat. No. 5,252,479.

The gene therapy vectors of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with the ATCC with accession numbers VR-977 and VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. No. 5,091,309 and U.S. Pat. No. 5,217,879 are employable. Such alpha viruses may be obtained from depositories or collections such as the ATCC in Rockville, Md. or isolated from known sources using commonly available techniques. Preferably, alphavirus vectors with reduced cytotoxicity are used (see U.S. Ser. No. 08/679,640).

DNA vector systems such as eukaryotic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, *Nature* 339 (1989) 385 and Sabin (1973) *J. Biol. Standardization* 1:115; rhinovirus, for example ATCC VR-1110 and those described in Arnold (1990) *J Cell Biochem L*401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569: 86, Flexner (1990) *Vaccine* 8:17; in U.S. Pat. No. 4,603,112 and U.S. Pat. No. 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and *Nature* (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-125I, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. S No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24): 11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as RII.

B. Hormones, Vitamins, etc.

Other groups that can be included are, for example: hormones, steroids, androgens, estrogens, thyroid hormone, or vitamins, folic acid.

C. Polyalkylenes, Polysaccharides, etc.

Also, polyalkylene glycol can be included with the desired polynucleotides/polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide)

D. Lipids, and Liposomes

The desired polynucleotide/polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097:1-17; Straubinger (1983) *Meth. Enzymol.* 101:512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethyl-ammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) *Proc. Natl. Acad. Sci. USA* 75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide/polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C & E, over time these lipoproteins lose A and acquire C & E. VLDL comprises A, B, C & E apoproteins, LDL comprises apoprotein B; and HDL comprises apoproteins A, C, & E.

The amino acid of these apoproteins are known and are described in, for example, Breslow (1985) Annu Rev. Biochem 54:699; Law (1986) Adv. Exp Med. Biol. 151:162; Chen (1986) J Biol Chem 261:12918; Kane (1980) Proc Natl Acad Sci USA 77:2465; and Utermann (1984) Hum Genet 65:232.

Lipoproteins contain a variety of lipids including, triglycerides, cholesterol (free and esters), and phospholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J. Clin. Invest* 64:743-750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443. Lipoproteins can also be purchased from commercial suppliers, such as Biomedical Technologies, Inc., Stoughton, Mass., USA. Further description of lipoproteins can be found in WO98/06437.

F. Polycationic Agents

Polycationic agents can be included, with or without lipoprotein, in a composition with the desired polynucleotide/polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic polycationic agents which are useful include, for example, DEAE-dextran, polybrene. Lipofectin™, and LIPOFECTAMINE™ are monomers that form polycationic complexes when combined with polynucleotides/polypeptides.

Immunodiagnostic Assays

*Streptococcus* antigens of the invention can be used in immunoassays to detect antibody levels (or, conversely, anti-*streptococcus* antibodies can be used to detect antigen levels). Immunoassays based on well defined, recombinant antigens can be developed to replace invasive diagnostics methods. Antibodies to *streptococcus* proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 g for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 µg of yeast DNA, blotting for two hours, and hybridizing for 4-8 hours with a probe of $10^8$ cpm/µg. For a single-copy mammalian gene a conservative approach would start with 10 µg of DNA, blot overnight, and hybridize overnight in the presence of 10% dextran sulfate using a probe of greater than $10^8$ cpm/µg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm=81+16.6(\log_{10} Ci)+0.4[\%(G+C)]-0.6(\% \text{ formamide})-600/n-1.5(\% \text{ mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the *streptococcus* nucleotide sequences of the invention (including both sense and antisense strands). Though many different nucleotide sequences will encode the amino acid sequence, the native *streptococcus* sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the *streptococcus* sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional *streptococcus* sequence may also be helpful as a label to detect the formed duplex. For example, a non-complementary nucleotide sequence may be attached to the 5' end of the probe, with the remainder of the probe sequence being complementary to a *streptococcus* sequence. Alternatively, non-complementary bases or longer sequences can be interspersed into the probe, provided that the probe sequence has sufficient complementarity with the a *streptococcus* sequence in order to hybridize therewith and thereby form a duplex which can be detected.

The exact length and sequence of the probe will depend on the hybridization conditions (e.g. temperature, salt condition etc.). For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Iyer (1995) *Curr Opin Biotechnol* 6:12-19; Agrawal (1996) *TIBTECH* 14:376-387]; analogues such as peptide nucleic acids may also be used [eg. see Corey (1997) *TIBTECH* 15:224-229; Buchardt et al. (1993) *TIBTECH* 11:384-386].

Alternatively, the polymerase chain reaction (PCR) is another well-known means for detecting small amounts of target nucleic acid. The assay is described in Mullis et al. [*Meth. Enzymol.* (1987) 155:335-350] & U.S. Pat. Nos. 4,683,195 & 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired *streptococcus* sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the *streptococcus* sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

EXAMPLES

The following examples describe nucleic acid sequences which have been identified in *Streptococcus*, along with their inferred translation products. The examples are generally in the following format:

a nucleotide sequence which has been identified in *Streptococcus* the inferred translation product of this sequence a computer analysis (e.g. PSORT output) of the translation product, indicating antigenicity Most examples describe nucleotide sequences from *S. agalactiae*. The specific strain which was sequenced was from serotype V, and is a clinical strain isolated in Italy which expresses the R antigen (ISS/Rome/Italy collection, strain.2603 V/R). For several of these examples, the corresponding sequences from *S. pyogenes* are also given. Where GBS and GAS show homology in this way, there is conservation between species which suggests an essential function and also gives good cross-species reactivity.

In contrast, several examples describe nucleotide sequences from GAS for which no homolog in GBS has been identified. This lack of homology gives molecules which are useful for distinguishing GAS from GBS and for making GAS-specific products. The same is true for GBS sequences which lack GAS homologs e.g. these are useful for making GBS-specific products.

The examples typically include details of homology to sequences in the public databases. Proteins that are similar in sequence are generally similar in both structure and function, and the homology often indicates a common evolutionary origin. Comparison with sequences of proteins of known function is widely used as a guide for the assignment of putative protein function to a new sequence and has proved particularly useful in whole-genome analyses.

Various tests can be used to assess the in vivo immunogenicity of the proteins identified in the examples. For example, the proteins can be expressed recombinantly and used to screen patient sera by immunoblot. A positive reaction between the protein and patient serum indicates that the patient has previously mounted an immune response to the protein in question i.e. the protein is an immunogen. This method can also be used to identify immunodominant proteins. The mouse model used in the examples can also be used.

The recombinant protein can also be conveniently used to prepare antibodies e.g. in a mouse. These can be used for direct confirmation that a protein is located on the cell-surface. Labelled antibody (e.g. fluorescent labelling for FACS) can be incubated with intact bacteria and the presence of label on the bacterial surface confirms the location of the protein.

For many GBS proteins, the following data are given:
SDS-PAGE analysis of total recombinant *E. coli* cell extracts for GBS protein expression
SDS-PAGE analysis after the protein purification
Western-blot analysis of GBS total cell extract using antisera raised against recombinant proteins
FACS and ELISA analysis against GBS using antisera raise against recombinant proteins
Results of the in vivo passive protection assay Details of experimental techniques used are presented below:

Sequence Analysis

Open reading frames (ORFs) within nucleotide sequences were predicted using the GLIMMER program [Salzberg et al. (1998) *Nucleic Acids Res* 26:544-8]. Where necessary, start codons were modified and corrected manually on the basis of the presence of ribosome-binding sites and promoter regions on the upstream DNA sequence.

ORFs were then screened against the non-redundant protein databases using the programs BLASTp [Altschul et al. (1990) *J. Mol. Biol.* 215:403-410] and PRAZE, a modification of the Smith-Waterman algorithm [Smith & Waterman (1981) *J Mol Biol* 147:195-7; see Fleischmann et al (1995) *Science* 269:496-512].

Leader peptides within the ORFs were located using three different approaches: (i) PSORT [Nakai (1991) *Bull. Inst. Chem. Res., Kyoto Univ.* 69:269-291; Horton & Nakai (1996) *Intellig. Syst. Mol. Biol.* 4:109-115; Horton & Nakai (1997) *Intellig. Syst. Mol. Biol.* 5:147-152]; (ii) SignalP [Nielsen & Krogh (1998) in *Proceedings of the Sixth International Conference on Intelligent Systems for Molecular Biology (ISMB 6)*, AAAI Press, Menlo Park, Calif., pp. 122-130; Nielsen et al. (1999) *Protein Engineering* 12:3-9; Nielsen et al. (1997). *Int. J. Neural Sys.* 8:581-599]; and (iii) visual inspection of the ORF sequences. Where a signal sequences is given a "possible site" value, the value represents the C-terminus residue of the signal peptide e.g. a "possible site" of 26 means that the signal sequence consists of amino acids 1-26.

Lipoprotein-specific signal peptides were located using three different approaches: (i) PSORT [see above]; (ii) the "prokaryotic membrane lipoprotein lipid attachment site" PROSITE motif [Hofmann et al. (1999) *Nucleic Acids Res.* 27:215-219; Bucher & Bairoch (1994) in *Proceedings 2nd International Conference on Intelligent Systems for Molecular Biology* (ISMB-94), AAAI Press, pages 53-61]; and (iii) the FINDPATTERNS program available in the GCG Wisconsin Package, using the pattern (M, L, V)×{9, 35}LxxCx.

Transmembrane domains were located using two approaches: (i) PSORT [see above]; (ii) TopPred [von Heijne (1992) *J. Mol. Biol.* 225:487-494].

LPXTG motifs, characteristic of cell-wall attached proteins in Gram-positive bacteria [Fischetti et al. (1990) *Mol Microbiol* 4:1603-5] were located with FINDPATTERNS using the pattern (L, I, V, M, Y, F)Px(T, A, S, G) (G, N, S, T, A, L).

RGD motifs, characteristic of cell-adhesion molecules [D'Souza et al. (1991) *Trends Biochem Sci* 16:246-50] were located using FINDPATTERNS.

Enzymes belonging to the glycolytic pathway were also selected as antigens, because these have been found experimentally expressed on the surface of *Streptococci* [e.g. Pancholi & Fischetti (1992) *J Exp Med* 176:415-26; Pancholi & Fischetti (1998) *J Biol Chem* 273:14503-15].

Cloning, Expression and Purification of Proteins

GBS genes were cloned to facilitate expression in *E. coli* as two different types of fusion proteins:
a) proteins having a hexa-histidine tag at the amino-terminus (His-gbs)
b) proteins having a GST fusion partner at the amino-terminus (Gst-gbs)

Cloning was performed using the Gateway™ technology (Life Technologies), which is based on the site-specific recombination reactions that mediate integration and excision of phage lambda into and from the *E. coli* genome. A single cloning experiment included the following steps:
1—Amplification of GBS chromosomal DNA to obtain a PCR product coding for a single ORF flanked by attB recombination sites.
2—Insertion of the PCR product into a pDONR vector (containing attP sites) through a BP reaction (attB×attP sites). This reaction gives a so called 'pEntry' vector, which now contains attL sites flanking the insert.
3—Insertion of the GBS gene into *E. coli* expression vectors (pDestination vectors, containing attR sites) through a LR reaction between pEntry and pDestination plasmids (attL×attR sites).

A) Chromosomal DNA Preparation

For chromosomal DNA preparation, GBS strain 2603 V/R (Istituto Superiore Sanitá, Rome) was grown to exponential phase in 2 liters TH Broth (Difco) at 37° C., harvested by centrifugation, and dissolved in 40 ml TES (50 mM Tris pH 8, 5 mM EDTA pH 8, 20% sucrose). After addition of 2.5 ml lysozyme solution (25 mg/ml in TES) and 0.5 ml mutanolysin (Sigma M-9901, 25000 U/ml in $H_2O$), the suspension was incubated at 37° C. for 1 hour. 1 ml RNase (20 mg/ml) and 0.1 ml proteinase K (20 mg/ml) were added and incubation was continued for 30 min. at 37° C.

Cell lysis was obtained by adding 5 ml sarkosyl solution (10% N-laurylsarcosine in 250 mM EDTA pH 8.0), and incubating 1 hour at 37° C. with frequent inversion. After sequential extraction with phenol, phenol-chloroform and chloroform, DNA was precipitated with 0.3M sodium acetate pH 5.2 and 2 volumes of absolute ethanol. The DNA pellet was rinsed with 70% ethanol and dissolved in TE buffer (10 mM Tris-HCl, 1 mM EDTA, pH 8). DNA concentration was evaluated by $OD_{260}$.

B) Oligonucleotide Design

Synthetic oligonucleotide primers were designed on the basis of the coding sequence of each ORF. The aim was to express the protein's extracellular region. Accordingly, predicted signal peptides were omitted (by deducing the 5' end amplification primer sequence immediately downstream from the predicted leader sequence) and C-terminal cell-wall anchoring regions were removed (e.g. LPXTG motifs and downstream amino acids). Where additional nucleotides have been deleted, this is indicated by the suffix 'd' (e.g. 'GBS352d'). Conversely, a suffix 'L' refers to expression without these deletions. Deletions of C- or N-terminal residues were also sometimes made, as indicated by a 'C' or 'N' suffix.

The amino acid sequences of the expressed GBS proteins (including 'd' and 'L' forms etc.) are definitively defined by the sequences of the oligonucleotide primers.

5' tails of forward primers and 3' tails of reverse primers included attB1 and attB2 sites respectively:

Forward primers: 5'-GGGGACAAGTTTGTA-CAAAAAAGCAGGCTCT-ORF in frame-3' (nucleotides 1-31 of SEQ ID NO:11027; the TCT sequence preceding the ORF was omitted when the ORF's first coding triplet began with T).

Reverse primers: 5'-GGGGACCACTTTGTACAA-GAAAGCTGGGTT-ORF reverse complement-3' (nucleotides 1-30 of SEQ ID NO:11552).

The primers for GBS67 are thus:

```
Fwd: GGGGACAAGTTTGTACAAAAAAGCAGG (SEQ ID NO: 11036)
     CTCTAATGTTTTAGGGGAAA

Rev: GGGGACCACTTTGTACAAGAAAGCTGG (SEQ ID NO: 11561)
     GTTAATTCCTTTTGGTGG
```

The number of nucleotides which hybridized to the sequence to be amplified depended on the melting temperature of the primers, which was determined as described by Breslauer et al. [*PNAS USA* (1986) 83:3746-50]. The average melting temperature of the selected oligos was 50-55° C. for the hybridizing region and 80-85° C. for the whole oligos.

C) Amplification

The standard PCR protocol was as follows: 50 ng genomic DNA were used as template in the presence of 0.5 µM each primer, 200 µM each dNTP, 1.5 mM MgCl$_2$, 1× buffer minus Mg++ (Gibco-BRL) and 2 units of Taq DNA polymerase (Platinum Taq, Gibco-BRL) in a final volume of 100 µl. Each sample underwent a double-step of amplification: 5 cycles performed using as the hybridizing temperature 50° C., followed by 25 cycles at 68° C.

The standard cycles were as follows:
Denaturation: 94° C., 2 min
5 cycles: Denaturation: 94° C., 30 seconds
Hybridization: 50° C., 50 seconds
Elongation: 72° C., 1 min. or 2 min. and 40 sec.
25 cycles: Denaturation: 94° C., 30 seconds
Hybridization: 68° C., 50 seconds
Elongation: 72° C., 1 min. or 2 min. and 40 sec.
Elongation time was 1 minute for ORFs shorter than 2000 bp and 2:40 minutes for ORFs longer than 2000 bp. Amplifications were performed using a Gene Amp PCR system 9600 (Perkin Elmer).

To check amplification results, 2 µl of each PCR product were loaded onto 1-1.5 agarose gel and the size of amplified fragments was compared with DNA molecular weight standards (DNA marker IX Roche, 1 kb DNA ladder Biolabs).

Single band PCR products were purified by PEG precipitation: 300 µl of TE buffer and 200 µl of 30% PEG 8000/30 mM MgCl$_2$ were added to 100 µl PCR reaction. After vortexing, the DNA was centrifuged for 20 min at 10000 g, washed with 1 vol. 70% ethanol and the pellet dissolved in 30 µl TE. PCR products smaller than 350 bp were purified using a PCR purification Kit (Qiagen) and eluted with 30 µl of the provided elution buffer.

In order to evaluate the yield, 2 µl of the purified DNA were subjected to agarose gel electrophoresis and compared to titrated molecular weight standards.

D) Cloning of PCR Products into Expression Vectors

Cloning was performed following the GATEWAY™ technology's "one-tube protocol", which consists of a two step reaction (BP and LR) for direct insertion of PCR products into expression vectors.

BP reaction (attB×attP sites): The reaction allowed insertion of the PCR product into a pDONR vector. The pDONR™ 201 vector we used contains the killer toxin gene ccdB between attP1 and attP2 sites to minimize background colonies lacking the PCR insert, and a selectable marker gene for kanamycin resistance. The reaction resulted in a so called pEntry vector, in which the GBS gene was located between attL1 and attL2 sites.

60 fmol of PCR product and 100 ng of pDONR™ 201 vector were incubated with 2.5 µl of BP CLONASE™ in a final volume of 12.5 µl for 4 hours at 25° C.

LR reaction (attL×attR sites): The reaction allowed the insertion of the GBS gene, now present in the pEntry vector, into *E. coli* expression vectors (pDestination vectors, containing attR sites). Two pDestination vectors were used (PD-EST15 for N-terminal GST fusions—Figure 86; and pDEST17-1 for N-terminal His-tagged fusions—Figure 87). Both allow transcription of the ORF fusion coding mRNA under T7 RNA polymerase promoter [Studier et al (1990) *Meth. Enzymol* 185: 60ff].

To 5 µl of BP reaction were added 0.25 µl of 0.75 M NaCl, 100 ng of destination vector and 1.5 µl of LR CLONASE™. The reaction was incubated at 25° C. for 2 hours and stopped with 1 µl of 1 mg/ml proteinase K solution at 37° C. for 15 min.

1 µl of the completed reaction was used to transform 50 µl electrocompetent BL21-SI™ cells (0.1 cm, 200 ohms, 25 µF). BL21-SI cells contain an integrated T7 RNA polymerase gene under the control of the salt-inducible prU promoter [Gowrishankar (1985) *J. Bacteriol.* 164:434 ff]. After electroporation cells were diluted in 1 ml SOC medium (20 g/l bacto-tryptone, 5 g/l yeast extract, 0.58 g/l NaCl, 0.186 g/l KCl, 20 mM glucose, 10 mM MgCl$_2$) and incubated at 37° C. for 1 hour. 200 µl cells were plated onto LBON plates (Luria Broth medium without NaCl) containing 100 µg/ml ampicillin. Plates were then incubated for 16 hours at 37° C.

Entry clones: In order to allow the future preparation of Gateway compatible pEntry plasmids containing genes which might turn out of interest after immunological assays, 2.5 µl of BP reaction were incubated for 15 min in the presence of 3 µl 0.15 mg/ml proteinase K solution and then kept at −20° C. The reaction was in this way available to transform *E. coli* competent cells so as to produce Entry clones for future introduction of the genes in other Destination vectors.

E) Protein Expression

Single colonies derived from the transformation of LR reactions were inoculated as small-scale cultures in 3 ml LBON 100 µg/ml ampicillin for overnight growth at 25° C. 50-200 µl of the culture was inoculated in 3 ml LBON/Amp to an initial OD600 of 0.1. The cultures were grown at 37° C. until OD600 0.4-0.6 and recombinant protein expression was induced by adding NaCl to a final concentration of 0.3 M. After 2 hour incubation the final OD was checked and the cultures were cooled on ice. 0.5 OD$_{600}$ of cells were harvested by centrifugation. The cell pellet was suspended in 50 µl of protein Loading Sample Buffer (50 mM TRIS-HCl pH 6.8, 0.5% w/v SDS, 2.5% v/v glycerin, 0.05% w/v Bromophenol Blue, 100 mM DTT) and incubated at 100° C. for 5 min. 10 μl of sample was analyzed by SDS-PAGE and Coomassie Blue staining to verify the presence of induced protein band.

F) Purification of the Recombinant Proteins

Single colonies were inoculated in 25 ml LBON 100 μg/ml ampicillin and grown at 25° C. overnight. The overnight culture was inoculated in 500 ml LBON/amp and grown under shaking at 25° C. until $OD_{600}$ values of 0.4-0.6. Protein expression was then induced by adding NaCl to a final concentration of 0.3 M. After 3 hours incubation at 25° C. the final $OD_{600}$ was checked and the cultures were cooled on ice. After centrifugation at 6000 rpm (JA10 rotor, Beckman) for 20 min., the cell pellet was processed for purification or frozen at −20° C.

Proteins were purified in 1 of 3 ways depending on the fusion partner and the protein's solubility:

Purification of Soluble His-Tagged Proteins from *E. coli*
1. Transfer pellets from −20° C. to ice bath and reconstitute each pellet with 10 ml B-PER™ solution (Bacterial-Protein Extraction Reagent, Pierce cat. 78266), 10 μl of a 100 mM $MgCl_2$ solution, 50 μl of DNAse I (Sigma D-4263, 100 Kunits in PBS) and 100 μl of 100 mg/ml lysozyme in PBS (Sigma L-7651, final concentration 1 mg/ml).
2. Transfer resuspended pellets in 50 ml centrifuge tubes and leave at room temperature for 30-40 minutes, vortexing 3-4 times.
3. Centrifuge 15-20 minutes at about 30-40000×g.
4. Prepare Poly-Prep (Bio-Rad) columns containing 1 ml of Fast Flow Ni-activated Chelating Sepharose (Pharmacia). Equilibrate with 50 mM phosphate buffer, 300 mM NaCl, pH 8.0.
5. Store the pellet at −20° C., and load the supernatant on to the columns.
6. Discard the flow through.
7. Wash with 10 ml 20 mM imidazole buffer, 50 mM phosphate, 300 mM NaCl, pH 8.0.
8. Elute the proteins bound to the columns with 4.5 ml (1.5 ml+1.5 ml+1.5 ml) 250 mM imidazole buffer, 50 mM phosphate, 300 mM NaCl, pH 8.0 and collect three fractions of ~1.5 ml each. Add to each tube 15 μl DTT 200 mM (final concentration 2 mM).
9. Measure the protein concentration of the collected fractions with the Bradford method and analyse the proteins by SDS-PAGE.
10. Store the collected fractions at +4° C. while waiting for the results of the SDS-PAGE analysis.
11. For immunisation prepare 4-5 aliquots of 20-100 μg each in 0.5 ml in 40% glycerol. The dilution buffer is the above elution buffer, plus 2 mM DTT. Store the aliquots at −20° C. until immunisation.

Purification of His-Tagged Proteins from Inclusion Bodies
1. Bacteria are collected from 500 ml cultures by centrifugation. If required store bacterial pellets at −20° C. Transfer the pellets from −20° C. to room temperature and reconstitute each pellet with 10 ml B-PER™ solution, 10 μl of a 100 mM $MgCl_2$ solution (final 1 mM), 50 μl of DNAse I equivalent to 100 Kunits units in PBS and 100 μl of a 100 mg/ml lysozyme (Sigma L-7651) solution in PBS (equivalent to 10 mg, final concentration 1 mg/ml).
2. Transfer the resuspended pellets in 50 ml centrifuge tubes and let at room temperature for 30-40 minutes, vortexing 3-4 times.
3. Centrifuge 15 minutes at 30-4000×g and collect the pellets.
4. Dissolve the pellets with 50 mM TRIS-HCl, 1 mM TCEP {Tris(2-carboxyethyl)-phosphine hydrochloride, Pierce}, 6M guanidine hydrochloride, pH 8.5. Stir for ~10 min. with a magnetic bar.
5. Centrifuge as described above, and collect the supernatant.
6. Prepare Poly-Prep (Bio-Rad) columns containing 1 ml of Fast Flow Ni-activated Chelating Sepharose (Pharmacia). Wash the columns twice with 5 ml of $H_2O$ and equilibrate with 50 mM TRIS-HCl, 1 mM TCEP, 6M guanidine hydrochloride, pH 8.5.
7. Load the supernatants from step 5 onto the columns, and wash with 5 ml of 50 mM TRIS-HCl buffer, 1 mM TCEP, 6M urea, pH 8.5
8. Wash the columns with 10 ml of 20 mM imidazole, 50 mM TRIS-HCl, 6M urea, 1 mM TCEP, pH 8.5. Collect and set aside the first 5 ml for possible further controls.
9. Elute proteins bound to columns with 4.5 ml buffer containing 250 mM imidazole, 50 mM TRIS-HCl, 6M urea, 1 mM TCEP, pH 8.5. Add the elution buffer in three 1.5 ml aliquots, and collect the corresponding three fractions. Add to each fraction 15 μl DTT (final concentration 2 mM).
10. Measure eluted protein concentration with Bradford method and analyse proteins by SDS-PAGE.
11. Dialyse overnight the selected fraction against 50 mM Na phosphate buffer, pH 8.8, containing 10% glycerol, 0.5 M arginine, 5 mM reduced glutathione, 0.5 mM oxidized glutathione, 2 M urea.
12. Dialyse against 50 mM Na phosphate buffer, pH 8.8, containing 10% glycerol, 0.5 M arginine, 5 mM reduced glutathione, 0.5 mM oxidized glutathione.
13. Clarify the dialysed protein preparation by centrifugation and discard the non-soluble material and measure the protein concentration with the Bradford method.
14. For each protein destined to the immunization prepare 4-5 aliquot of 20-100 μg each in 0.5 ml after having adjusted the glycerol content up to 40%. Store the prepared aliquots at −20° C. until immunization.

Purification of GST-Fusion Proteins from *E. coli*
1. Bacteria are collected from 500 ml cultures by centrifugation. If required store bacterial pellets at −20° C. Transfer the pellets from −20° C. to room temperature and reconstitute each pellet with 10 ml B-PER™ solution, 10 μl of a 100 mM $MgCl_2$ solution (final 1 mM), 50 μl of DNAse I equivalent to 100 Kunits units in PBS and 100 μl of a 100 mg/ml lysozyme (Sigma L-7651) solution in PBS (equivalent to 10 mg, final concentration 1 mg/ml).
2. Transfer the resuspended pellets in 50 ml centrifuge tubes and let at room temperature for 30-40 minutes, vortexing 3-4 times.
3. Centrifuge 15-20 minutes at about 30-40000×g.
4. Discard centrifugation pellets and load supernatants onto the chromatography columns, as follows.
5. Prepare Poly-Prep (Bio-Rad) columns containing 0.5 ml of Glutathione-Sepharose 4B resin. Wash the columns twice with 1 ml of $H_2O$ and equilibrate with 10 ml PBS, pH 7.4.
6. Load supernatants on to the columns and discard the flow through.
7. Wash the columns with 10 ml PBS, pH 7.4.
8. Elute proteins bound to columns with 4.5 ml of 50 mM TRIS buffer, 10 mM reduced glutathione, pH 8.0, adding 1.5 ml+1.5 ml+1.5 ml and collecting the respective 3 fractions of ~1.5 ml each.
9. Measure protein concentration of the fractions with the Bradford method and analyse the proteins by SDS-PAGE.
10. Store the collected fractions at +4° C. while waiting for the results of the SDS-PAGE analysis.
11. For each protein destined for immunisation prepare 4-5 aliquots of 20-100 μg each in 0.5 ml of 40% glycerol. The dilution buffer is 50 mM TRIS-HCl, 2 mM DTT, pH 8.0. Store the aliquots at −20° C. until immunisation.

FIG. 4

Figure 4:
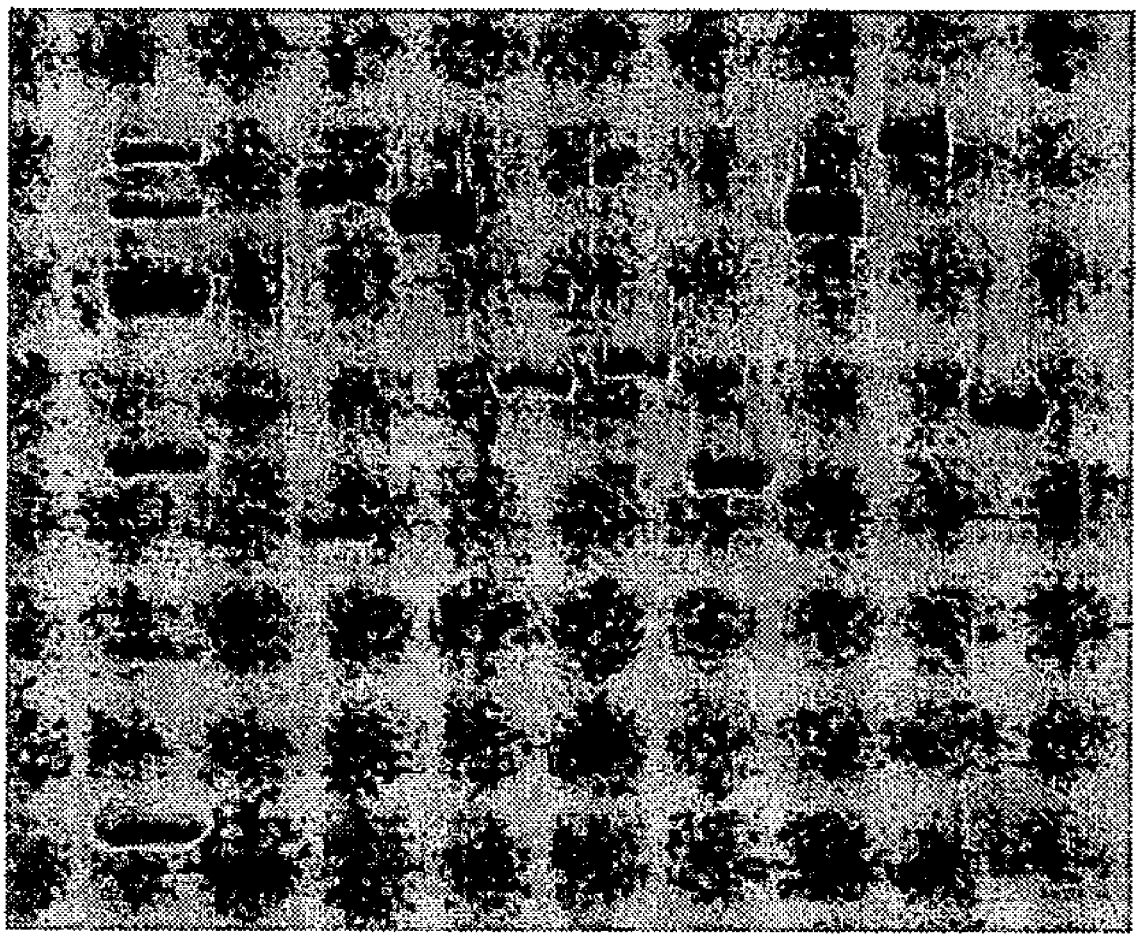
FIG. 4 is an SDS-PAGE analysis of purified GBS proteins of the invention. The left-hand lane contains molecular weight markers. These are 94, 67, 43, 30, 20.1 & 14.4 kDa.
Figure 5A:
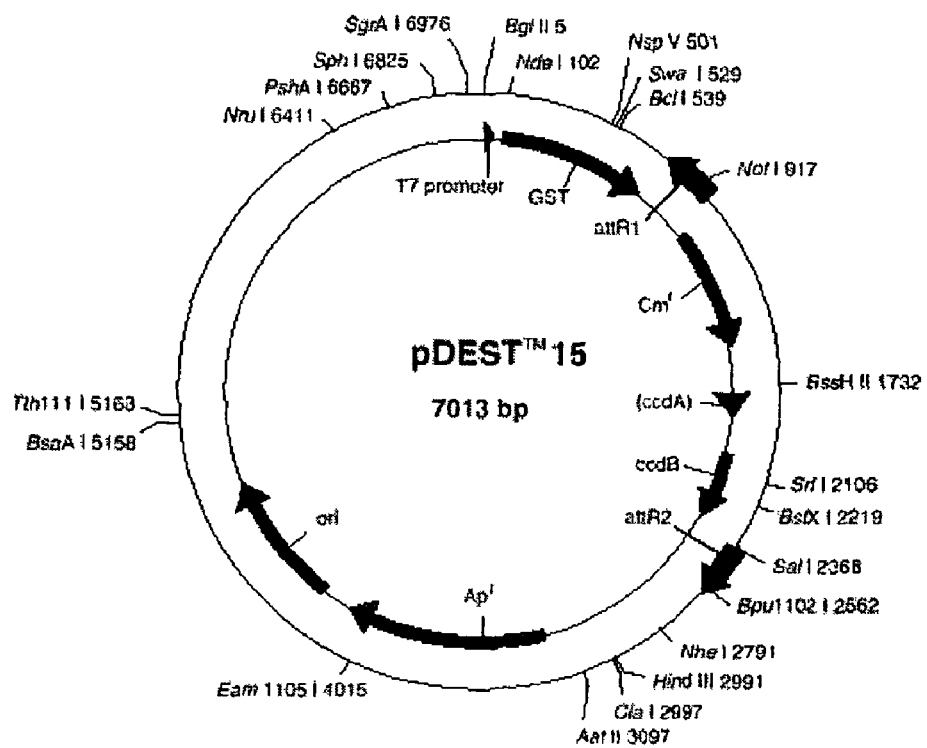
FIG. 5A shows the pDEST15 vector.
Figure 5B:
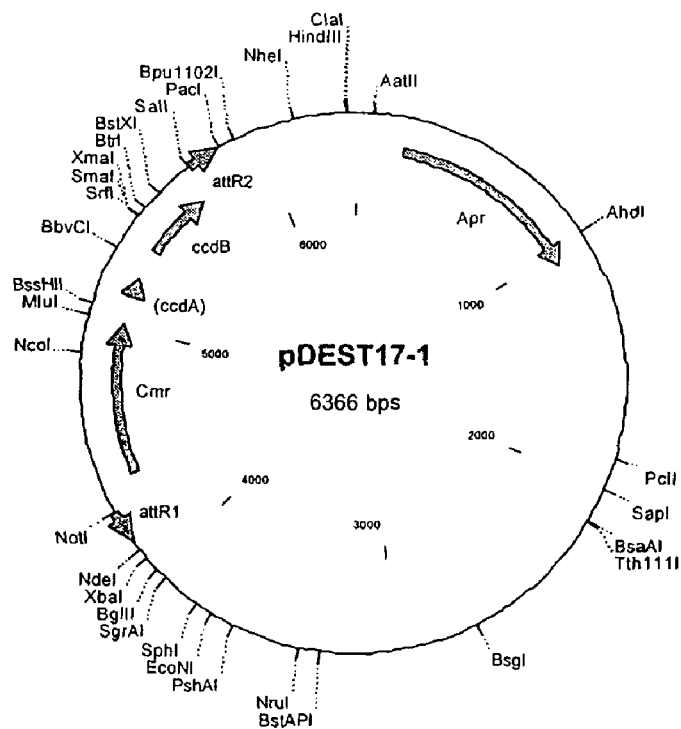
FIG. 5B shows the pDEST17-1 vector.

For the experiment shown in FIG. 4, the GBS proteins were fused at the N-terminus to thioredoxin and at C-terminus to a poly-His tail. The plasmid used for cloning is pBAD-DEST49 (Invitrogen Gateway™ technology) and expression is under the control of an L(+)-Arabinose dependent promoter. For the production of these GBS antigens, bacteria are grown on RM medium (6 g/l $Na_2HPO_4$, 3 g/l $KH_2PO_4$, 0.5 g/l NaCl, 1 g/l $NH_4Cl$, pH7.4, 2% casaminoacids, 0.2% glucose, 1 mM $MgCl_2$) containing 100 μg/ml ampicillin. After incubation at 37° C. until cells reach $OD_{600}$=0.5, protein expression is induced by adding 0.2% (v/v) L(+)Arabinose for 3 hours.

Immunisations with GBS Proteins

The purified proteins were used to immunise groups of four CD-1 mice intraperitoneally. 20 μg of each purified protein was injected in Freund's adjuvant at days 1, 21 & 35. Immune responses were monitored by using samples taken on day 0 & 49. Sera were analysed as pools of sera from each group of mice.

FACScan Bacteria Binding Assay Procedure.

GBS serotype V 2603 V/R strain was plated on TSA blood agar plates and incubated overnight at 37° C. Bacterial colonies were collected from the plates using a sterile dracon swab and inoculated into 100 ml Todd Hewitt Broth. Bacterial growth was monitored every 30 minutes by following $OD_{600}$. Bacteria were grown until $OD_{600}$=0.7-0.8. The culture was centrifuged for 20 minutes at 5000 rpm. The supernatant was discarded and bacteria were washed once with PBS, resuspended in ½ culture volume of PBS containing 0.05% paraformaldehyde, and incubated for 1 hour at 37° C. and then overnight at 4° C.

50 μl bacterial cells ($OD_{600}$ 0.1) were washed once with PBS and resuspended in 20 μl blocking serum (Newborn Calf Serum, Sigma) and incubated for 20 minutes at room temperature. The cells were then incubated with 100 μl diluted sera (1:200) in dilution buffer (20% Newborn Calf Serum 0.1% BSA in PBS) for 1 hour at 4° C. Cells were centrifuged at 5000 rpm, the supernatant aspirated and cells washed by adding 200 μl washing buffer (0.1% BSA in PBS). 50 μl R-Phicoerytrin conjugated $F(ab)_2$ goat anti-mouse, diluted 1:100 in dilution buffer, was added to each sample and incubated for 1 hour at 4° C. Cells were spun down by centrifugation at 5000 rpm and washed by adding 200 μl of washing buffer. The supernatant was aspirated and cells resuspended in 200 μl PBS. Samples were transferred to FACScan tubes and read. The condition for FACScan setting were: FL2 on; FSC-H threshold: 54; FSC PMT Voltage: E 02; SSC PMT: 516; Amp. Gains 2.63; FL-2 PMT: 728. Compensation values: 0.

Samples were considered as positive if they had a Δ mean values >50 channel values.

Whole Extracts Preparation

GBS serotype III COH1 strain and serotype V 2603 V/R strain cells were grown overnight in Todd Hewitt Broth. 1 ml of the culture was inoculated into 100 ml Todd Hewitt Broth. Bacterial growth was monitored every 30 minutes by following $OD_{600}$. The bacteria were grown until the OD reached 0.7-0.8. The culture was centrifuged for 20 minutes at 5000 rpm. The supernatant was discarded and bacteria were washed once with PBS, resuspended in 2 ml 50 mM Tris-HCl, pH 6.8 adding 400 units of Mutanolysin (Sigma-Aldrich) and incubated 3 hrs at 37° C. After 3 cycles of freeze/thaw, cellular debris were removed by centrifugation at 14000 g for 15 minutes and the protein concentration of the supernatant was measured by the Bio-Rad Protein assay, using BSA as a standard.

Western Blotting

Purified proteins (50 ng) and total cell extracts (25 μg) derived from GBS serotype III COH1 strain and serotype V 2603 V/R strain were loaded on 12% or 15% SDS-PAGE and transferred to a nitrocellulose membrane. The transfer was performed for 1 hours at 100V at 4° C., in transferring buffer (25 mM Tris base, 192 mM glycine, 20% methanol). The membrane was saturated by overnight incubation at 4° C. in saturation buffer (5% skimmed milk, 0.1% Tween 20 in PBS). The membrane was incubated for 1 hour at room temperature with 1:1000 mouse sera diluted in saturation buffer. The membrane was washed twice with washing buffer (3% skimmed milk, 0.1% Tween 20 in PBS) and incubated for 1 hour with a 1:5000 dilution of horseradish peroxidase labelled anti-mouse Ig (Bio-Rad). The membrane was washed twice with 0.1% Tween 20 in PBS and developed with the Opti-4CN Substrate Kit (Bio-Rad). The reaction was stopped by adding water.

Unless otherwise indicated, lanes 1, 2 and 3 of blots in the drawings are: (1) the purified protein; (2) GBS-III extracts; and (3) GBS-V extracts. Molecular weight markers are also shown.

In Vivo Passive Protection Assay in Neonatal Sepsis Mouse Model

The immune sera collected from the CD1 immunized mice were tested in a mouse neonatal sepsis model to verify their protective efficacy in mice challenged with GBS serotype III. Newborn Balb/C littermates were randomly divided in two groups within 24 hrs from birth and injected subcutaneously with 25 μl of diluted sera (1:15) from immunized CD1 adult mice. One group received preimmune sera, the other received immune sera. Four hours later all pups were challenged with a 75% lethal dose of the GBS serotype III COH1 strain. The challenge dose obtained diluting a mid log phase culture was administered subcutaneously in 25 μl of saline. The number of pups surviving GBS infection was assessed every 12 hours for 4 days.

The results for GBS67 are shown below:

| | % survival | |
|---|---|---|
| GBS # | Pre-immune | Post-immune |
| 67 | 23.5 | 27.8 |

Identification of GBS67

A DNA sequence (GBSx1279) was identified in *S. agalactiae* <SEQ ID 3745> which encodes the amino acid sequence <SEQ ID 3746>. Analysis of this protein sequence reveals the following:

Possible site: 25
>>> Seems to have an uncleavable N-term signal seq
INTEGRAL Likelihood = −3.13 Transmembrane 870-886 (864-887)
Final Results

| bacterial membrane | Certainty = 0.2253 (Affirmative) <succ> |
|---|---|
| bacterial outside | Certainty = 0.0000 (Not Clear) <succ> |
| bacterial cytoplasm | Certainty = 0.0000 (Not Clear) <succ> |

The protein (Sbjct; SEQ ID NO:3746) has homology with the following sequence in the GENPEPT database.

```
>GP:AAD33086 GB:AF071083 fibronectin-binding protein I [Streptococcus
pyogenes] (SEQ ID NO: 12026)
Identities = 58/176 (32%), Positives = 83/176 (46%),
Gaps = 19/176 (10%)

Query:    6 KFSKILTLSLFCLSQIPLNTNVLGEST---VPENGA--KGKLVVKKTDDQNKPLSKATFV    60
            K S +L+L+ F L + +   + G S       NGA  +G   +Kk D   NKPL    AT
Sbjct:    8 KLSFLLSLTGFILGLLLVFIGLSGVSVGHAETRNGANKQGSFEIKKVDQNNKPLPGATSS   67

Query:   61 LKTTAHPESKIEKVTAELTGEATFDNLIPGDYTLSEETAPEGYKKTNQTWQVKVESNGKT  120
            L +    + ++    T+   G       NL PG YTL EETAP+GY KT++TW V V  NG T
Sbjct:   68 LTSKDGKGTSVQTFTSNDKGIVDAQNLQPGTYTLKEETAPDGYDKTSRTWTVTVYENGYT  127

Query:  121 TIQNSGDKNSTIGQNQEELDKQYPPTGIYEDTKESYKLEHVKGSVPN--GKSEAKA      174
            + +      I +              +D    S +LE+ K SV +  GK+E +
Sbjct:  128 KLVENPYNGEIISKAGS-----------KDVSSSLQLENPKMSVVSKYGKTEVSS       171

Identities = 31/92 (33%), Positives = 49/92 (52%),
Gaps = 14/92 (15%)

Query:  725 PTITIKNEKKLGEIEFIKVDKDNNKLLLKGATFELQEFNEDYKLYLPIKNNNSKVVTGEN  784
            P+IT+ N K++ ++  F K+   DN  + L    A  FEL+  N          N+  K+     N
Sbjct:  501 PSITVANLKRVAQLRFKKMSTDN--VPLPEAAFELRSSN----------GNSQKLEASSN  548

Query:  785 --GKISYKDLKDGKYQLIEAVSPEDYQKITNK                              814
              G++  +KDL   G Y L  E  +P+  YQ++T K
Sbjct:  549 TQGEVHFKDLTSGTYDLYETKAPKGYQQVTEK                              580
```

No corresponding DNA sequence was identified in *S. pyogenes*.

Figure 2:
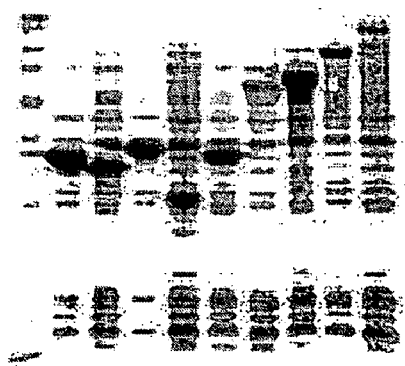
FIG. 2 is an SDS-PAGE analysis of total cell extracts from cultures of recombinant *E. coli* expressing GBS proteins of the invention. Lane 1 in contains molecular weight markers (250, 150, 100, 75, 50, 37, 25, 15 & 10 kDa).
Figure 3:
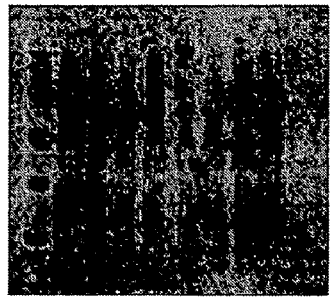
FIG. 3 is an SDS-PAGE analysis of total cell extracts from cultures of recombinant *E. coli* expressing GBS proteins of the invention. Lane 1 in contains molecular weight markers (250, 150, 100, 75, 50, 37, 25, 15 & 10 kDa).

SEQ ID 3746 (GBS67) was expressed in *E. coli* as a His-fusion product. SDS-PAGE analysis of total cell extract is shown in FIG. 1 (lane 10; MW 140 kDa), in FIG. 2 (lane 10; MW 150 kDa) and in FIG. 3 (lane 6; MW 95.3 kDa).

| GBS # | expected mol. weight (dalton) | | |
|---|---|---|---|
| | GST-fusion | His-fusion | Native |
| 67 | 120335 | 95370 | 91630 |

GBS67-His was purified as shown in FIG. 4, lane 10.

Based on this analysis, it was predicted that this protein and its epitopes, could be useful antigens for vaccines or diagnostics.

SEQUENCE LISTING (12026 sequences)

SEQ ID NO: 1 - DNA, 576 bp, Streptococcus agalactiae
atgaaagtgaaaaataagattttaacgatggtagcacttactgtcttaacatgtgctacttattcatcaatcggttatgctgatacaagtgataagaatactgacacgagtgtcgtgactacgaccttatctgaggagaaaagatcagatgaactagaccagtctagtactggttcttcttctgaaaatgaatcgagttcatcaagtgaaccagaaacaaatccgtcaactaatccacctacaacagaaccatcgcaaccctcacctagtgaagagaacaagcctgatggtagaacgaagacagaaattggcaataataaggatatttctagtggaacaaaagtattaatttcagaagatagtattaagaattttagtaaagcaagtagtgatcaagaagaagtggatcgcgatgaatcatcatcttcaaaagcaaatgatgggaaaaaaggccacagtaagcctaaaaaggaacttcctaaaacaggagatagccactcagatactgtaatagcatctacgggagggattattctgttatcattaagtttttacaataagaaaatgaaactttat

SEQ ID NO: 2 - protein, 192 aa, Streptococcus agalactiae
MKVKNKILTMVALTVLTCATYSSIGYADTSDKNTDTSVVTTTLSEEKRSDELDQSSTGSSSENESSSSSEPETNPSTNPPTTEPSQPSPSEENKPDGRTKTEIGNNKDISSGTKVLISEDSIKNFSKASSDQEEVDRDESSSSKANDGKKGHSKPKKELPKTGDSHSDTVIASTGGIILLSLSFYNKKMKLY

SEQ ID NO: 3 - DNA, 537 bp, Streptococcus agalactiae
atgtcaataacctcggttaaaaaatcaaaaccatttaaattaggagtggcaggtcttttagtgggtgcttcattagctttaccactttcagtaagcgcagcatcttataccgtgaaatcaggtgataccttatcagctattgctaaaaatcataaaactacggtacaagagttagtgtctctcaatagtatcagtaacgctgatgtcatcagtataggtgatgttttaaaattggataattctacagctagtcaagcagaagcaaaatctcaaccaacaattgaaaattcaatgaattcttcatcaaatttgagttcaagtgattcagccgcaaaagaagaaatagctcgtcgtgaatcaaatggtagttatactgcacagaatggacaatattatggaagatatcaactgtctcaatcttacctaaatggcgacttatctcctgaaaatcaagaaaaagtagcggacaattatgtggtttctcgttacggatcttggtcggcagcgctatcattttggaatagtaacggctggtat

SEQ ID NO: 4 - protein, 179 aa, Streptococcus agalactiae
MSITSVKKSKPFKLGVAGLLVGASLALPLSVSAASYTVKSGDTLSAIAKNHKTTVQELVSLNSISNADVISIGDVLKLDNSTASQAEAKSQPTIENSMNSSSNLSSSDSAAKEEIARRESNGSYTAQNGQYYGRYQLSQSYLNGDLSPENQEKVADNYVVSRYGSWSAALSFWNSNGWY

SEQ ID NO: 5 - DNA, 837 bp, Streptococcus agalactiae
atgaataagaaaaaaatacttaccggactttctttttttctggtaagtcttcttttatcttttgggattttttccttgatcattccaaaatcaaatcctaaattaacaaaaaaagacttcctaacaaagaaagttatcccacttaactatgttgctcttggagattctctgaccgaaggtgtgggcgatacaacctctcaaggtggttttgttccactgctatcagaatcactccataatcgatactcttaccaagtgacttctgttaattatggtgtgtctgggaatactagtcaacaaattttaaaacgtatgacgacagatcctcaaatcgaaaaagatttagagaaagctgatttattgacgctaactgttggtggtaatgatgtcttggctgttattcgtaaagagctcagtcatttatcactaaattcctttgagaaaccagcagaagcatataaggaacgtttgaaagaaatccttgcaaaagcaagacaagataatcctaaattgcctatttatgttttaggcatttataatcctttttacctaaactttccacaattaactaaaatgcaaaccgttattgataattggaataaagctacaaaagaagtagttgatgcttcagaaaatgtttattttgtcccaattaatgaccgcctttataagggaataaatggtaaagagggtattacagagtcatcaaatagtcaggcaagtatcactaatgatgctctctttactggagaccattttcatcccaataatattggctatcaaatcatgtctaacgccgttatggagaaaataaatgaaacaagaaaaaactggccg

SEQ ID NO: 6 - protein, 279 aa, Streptococcus agalactiae
MNKKKILTGLSFFLVSLLLSFGIFSLIIPKSNPKLTKKDFLTKKVIPLNYVALGDSLTEGVGDTTSQGGFVPLLSESLHNRYSYQVTSVNYGVSGNTSQQILKRMTTDPQIEKDLEKADLLTLTVGGNDVLAVIRKELSHLSLNSFEKPAEAYKERLKEILAKARQDNPKLPIYVLGIYNPFYLNFPQLTKMQTVIDNWNKATKEVVDASENVYFVPINDRLYKGINGKEGITESSNSQASITNDALFTGDHFHPNNIGYQIMSNAVMEKINETRKNWP

SEQ ID NO: 7 - DNA, 1536 bp, Streptococcus agalactiae
ttgattatggagacgggtagtgtaagtaagaaagttcaacaacttcctttaagtcctagattatctaaaaataagcatatgagggatatgctacttactatgcaaaaagattcagcgtattacgaaacaagtgacagtctagtccttcgaattaatctcactgcagatactaaacttaattttaatgctgttaaaggagcgagtgctcttactgaaaatatgatgatgagacagtttgcagttgctggaccacaagatgatcctgttagtgaacataaatacccatcagtatttctcttaactcctgccttattggaaactgctagtgaggcaactctaaatggtaaggaaatcacagcatctggtattatcggtcacatcaaggatggtgataaaagcaagcatgttgaagtcaaaatggtgaatgaaaatggagacatgctaggaacccctgttattattcaaggtaaagacttgactaatcgaacaaaaccattaatgagtggacgtagagtactttatgccggtaaacaatatgagttccgggctaaattaccacttagtcgttttaacacttggattagggttgaagtggtaacagaagcaggagagaaagcaagtattgttcgtcgcatgttctttgaccaatcagttccagagcttaacacagcagttgctaaacgtgatttgacttctgatactgctcttatccacatcgttgccaaagatgactctctaaaactaaaattatatcaagatgattcattacttgaatctgttgataaaaccggtctttatagttttagaaatggtgtagaaatcactaaagatatgacagtaccactagaatttggagataatattattaagttatctgctgttgacttatcaaattatcgtcgtaatgagacccttcatatctatagaaaccgttttgatgttaaagcaagccaaatgacagctgacaaaggagctaaagtaactgtggatatgttgatgaagcacttagttgttccagaaatggcaggagcttatacattaacaatcgacgaagctccaaacacaaatgaatcaggaatgttaacaaacgctaaagtatcgattcattatgtaaatggtggtgttgataaagttgatgttccgattaaagtagttgacttagaagctattcgtaaagctgaagaagcacgtaaagctgaagaagcacgtaaagctgaagaagcacgtaaagctgaagagggacataaaacccaagaagcacctatagttgaagaaggctacaaggttaataacgttcatcaaactgatactacagttaaagcgtctgatttaccaaagactaagacagtttccgcagttcatatggctagaacagacaataaacagataacttcacatcagacacatgttgaaaaacaaattaaaaatacattgccatccactggtgacagcaaacgtggttattatatcactggaatggctatcgttatgctgagtgtattatttagtttagctaaaaagtttaaaagcaaatat

SEQ ID NO: 8 - protein, 512 aa, Streptococcus agalactiae
LIMETGSVSKKVQQLPLSPRLSKNKHMRDMLLTMQKDSAYYETSDSLVLRINLTADTKLNFNAVKGASALTENMMMRQFAVAGPQDDPVSEHKYPSVFLLTPALLETASEATLNGKEITASGIIGHIKDGDKSKHVEVKMVNENGDMLGTPVIIQGKDLTNRTKPLMSGRRVLYAGKQYEFRAKLPLSRFNTWIRVEVVTEAGEKASIVRRMFFDQSVPELNTAVAKRDLTSDTALIHIVAKDDSLKLKLYQDDSLLESVDKTGLYSFRNGVEITKDMTVPLEFGDNIIKLSAVDLSNYRRNETLHIYRNRFDVKASQMTADKGAKVTVDMLMKHLVVPEMAGAYTLTIDEAPNTNESGMLTNAKVSIHYVNGGVDKVDVPIKVVDLEAIRKAEEARKAEEARKAEEARKAEEGHKTQEAPIVEEGYKVNNVHQTDTTVKASDLPKTKTVSAVHMARTDNKQITSHQTHVEKQIKNTLPSTGDSKRGYYITGMAIVMLSVLFSLAKKFKSKY

SEQ ID NO: 9 - DNA, 96 bp, Streptococcus agalactiae
atgttaacaaaatcatcaataaataatgataaaaagaaactctcattcccattgattttgctaaaacaggatcaaaagaagtcaataataattctt

SEQ ID NO: 10 - protein, 32 aa, Streptococcus agalactiae
MLTKSSINNDKKKLSFPLILLKQDQKKSIIIL

SEQ ID NO: 11 - DNA, 831 bp, Streptococcus agalactiae
atgtttacgaaattttttgaaggcttattgacttatcattttttgcaaaatgcttttataactgcaattgtgattggtattgtagcgggtgcagtaggctgttttattatcttgcgctcaatgtctttgatgggtgatgctatttctcacgctgttctaccaggtgttgctatatcttttattttagggattaacttttttataggtgctattgtctttggtttgttgtcttcgattatcattacttatattaaagaaaatagtgtcataaaaggagatactgctattggaattactttttcgtcctttttagccttaggtatcattttaattggacttgctaatagtacaactgacctctttcatattctttttgggaatattttggcagtacaagatagtgataaatatatgactattattgtgggattaattgtactgactctgattactatcttctttaaagaattattattgacttcttttgatcctgttttagcaaaatcaatgggaatgagagtttctttttatcattatttattgatgattttgttaacattagttgcagtaacagctatgcagagtgtgggaacaatattgatcgtagcacttttaattacaccagctgcaacagcatatctttatgttaaaagtctcagaacaatgttgtttttatcatctgcattaggagcagtagcatctgttctggggttatatatcggttatacatttaatattgccgcaggatcaagtattgttttaacatctacttttatgtttttacttgctttcctattttctcctaaacaaagtttgtttaaaaagaaacaa

SEQ ID NO: 12 - protein, 277 aa, Streptococcus agalactiae
MFTKFFEGLLTYHFLQNAFITAIVIGIVAGAVGCFIILRSMSLMGDAISHAVLPGVAISFILGINFFIGAIVFGLLSSIIITYIKENSVIKGDTAIGITFSSFLALGIILIGLANSTTDLFHILFGNILAVQDSDKYMTIIVGLIVLTLITIFFKELLLTSFDPVLAKSMGMRVSFYHYLLMILLTLVAVTAMQSVGTILIVALLITPAATAYLYVKSLRTMLFLSSALGAVASVLGLYIGYTFNIAAGSSIVLTSTFMFLLAFLFSPKQSLFKKKQ

SEQ ID NO: 13 - DNA, 852 bp, Streptococcus pyogenes
atgtctatgaaattttttgagggcttgatgtcataccactttttacaaaatgcactgataacggctgtagtcattggtatcgtctcaggtgctgtagggtgttttattatccttaggtcaatgtctcttatgggtgatgccatctcacacgctgttttaccaggggttgctttgtcatttattttaggagtcaatttttttattggagcgattatttttgggttattagcttctgttattattacttatatcaaggaaaactctgtcattaaaggagatacggctattggtatcacctttagctcttttttggcactgggagtcatcttgataggggtagccaatagttcgacggacttatttcatattttgtttgggaatattttagctgtgcaagatagcgataagtggattactattggtgtttcgatttttgttttagtggttattagtctctttttcaaagaactattattaacatcatttgatcctatcttagccaaatcaatgggtgtgaaggtcaatgcgtatcattatttgttgatggtcctattaactttagtggctgttacggcgatgcaaagcgtgggtactatcttgattgttgccttattgattacgccagcagcgacagcttatttatatgctaatagcttaaaagtaatgttagtgatgtcatctttactaggcgctttagcatcggttttagggctttatttgggctatacctttaatgttgccgcagggtcaagtatcgtactgacttctgcgatgatgtttttgatcagtttctttgtttcacccaagcaaggctaccttaaaagatggatgcaaaaaaaagaaaaaacacct

SEQ ID NO: 14 - protein, 284 aa, Streptococcus pyogenes
MSMKFFEGLMSYHFLQNALITAVVIGIVSGAVGCFIILRSMSLMGDAISHAVLPGVALSFILGVNFFIGAIIFGLLASVIITYIKENSVIKGDTAIGITFSSFLALGVILIGVANSSTDLFHILFGNILAVQDSDKWITIGVSIFVLVVISLFFKELLLTSFDPILAKSMGVKVNAYHYLLMVLLTLVAVTAMQSVGTILIVALLITPAATAYLYANSLKVMLVMSSLLGALASVLGLYLGYTFNVAAGSSIVLTSAMMFLISFFVSPKQGYLKRWMQKKEKTP

SEQ ID NO: 15 - DNA, 123 bp, Streptococcus agalactiae
gtgaccctaatggagacgggaccggtggaaaatctatatggaatagcaaagataaaaagaaagattctggaaatggttttgttaatgaaatatccccttacctctacaatatcaggggaagtt

SEQ ID NO: 16 - protein, 41 aa, Streptococcus agalactiae
MTLMETGPVENLYGIAKIKRKILEMVLLMKYPLTSTISGEV

SEQ ID NO: 17 - DNA, 801 bp, Streptococcus agalactiae
atgaaaaaaattatttatcttggtttagcctgtgtcagtatattaactttaagtggttgcgagtcaattgagcgttctctaaaaggagaccgttatgttgaccaaaaactagctgaaaactcttcaaaggaagctactgaacaactaaacaaaaaaactaagcaagccttaaaagctgataaaaaagcttttcctcaattggacaaggctgttgccaaaaacgaggcacaagtgcttataaaaacctctaaaggtgatataaatatcaagttatttccaaaatatgctcctttagctgttgaaaattttctaacacatgcaaaagaaggatactataatgggttaagtttccacagagttatcaaagattttatgatacaatctggtgaccctaatggagacgggaccggtggaaaatctatatggaatagcaaagataaaaagaaagattctggaaatggttttgttaatgaaatatccccttacctctacaatatcaggggaagtttagcaatggcaaatgctggagctgatactaatggcagccaattctttatcaatcaaagccagcaagatcattccaaacaactgtcagataaaaaagttcctaaggtgattattaaagcctattcagagggaggaaatccaagtttagatggtggttataccgtctttggacaagtaatctctggcatggaaactgtggataaaattgcttcggtagaagttacaaaatcagatcaaccaaaagaaaaaattactattacaagtatcaaagttattaaagactacaaatttaaa

SEQ ID NO: 18 - protein, 267 aa, Streptococcus agalactiae
MKKIIYLGLACVSILTLSGCESIERSLKGDRYVDQKLAENSSKEATEQLNKKTKQALKADKKAFPQLDKAVAKNEAQVLIKTSKGDINIKLFPKYAPLAVENFLTHAKEGYYNGLSFHRVIKDFMIQSGDPNGDGTGGKSIWNSKDKKKDSGNGFVNEISPYLYNIRGSLAMANAGADTNGSQFFINQSQQDHSKQLSDKKVPKVIIKAYSEGGNPSLDGGYTVFGQVISGMETVDKIASVEVTKSDQPKEKITITSIKVIKDYKFK

SEQ ID NO: 19 - DNA, 804 bp, Streptococcus pyogenes
atgaaaaaattattatctctcagtttagtagccattagtttacttaatttgagtgcttgtgaatctgttgaccgcgctataaaaggcgataaatacattgatgaaaaaactgccaaagaagaaagcgaagcagcttctaaagcctatgaagaaagcattcaaaaagctctcaaagctgatgctagccaatttccacaactaaccaaagaagtcggcaaagaagaagctaaggtcgtaatgaggacaagtcaaggggacattacccttaagttattcccaaaatatgctcccttagctgttgagaacttcctcacccatgctaaaaaaggctactatgataaccttaccttccatcgtgtgatcaacgactttatgattcaatcaggtgaccccaaaggagatggcacaggtggtgaatcgatttggaaaggcaaggatcctaaaaaagatgctggcaatggctttgtcaacgaaatctctccatttttatatcatattcgcggtgctcttgccatggcaaatgctggtgctaatactaacggtagccaattttatatcaaccaaaacaagaaaaatcaaagcaagggattatcaagtaccaactacccaaaacctatcatctctgcctatgagcatggcggcaatccaagcttagatggcggttatactgtatttggtcaagtcattgatggtatggatgttgtcgataaaattgccgctacttctatcaaccaaaatgataaaccagaacaagacattacgattacctcaattgacattgtcaaagattatcgctttaaaaac

SEQ ID NO: 20 - protein, 268 aa, Streptococcus pyogenes
MKKLLSLSLVAISLLNLSACESVDRAIKGDKYIDEKTAKEESEAASKAYEESIQKALKADASQFPQLTKEVGKEEAKVVMRTSQGDITLKLFPKYAPLAVENFLTHAKKGYYDNLTFHRVINDFMIQSGDPKGDGTGGESIWKGKDPKKDAGNGFVNEISPFLYHIRGALAMANAGANTNGSQFYINQNKKNQSKGLSSTNYPKPIISAYEHGGNPSLDGGYTVFGQVIDGMDVVDKIAATSINQNDKPEQDITITSIDIVKDYRFKN

SEQ ID NO: 21 - DNA, 2448 bp, Streptococcus agalactiae
atggtatttatggcaaataagaaaaaaacaaaaggaaagaaaaccagaagacctactaaggcagaaatagagcgtcaaagagctattcaaaggatgattactgctcttgttttaacaattattctcttctttggtattatcagattaggtatttttggtattacagtctataacgtcatccgttttatggtaggtagcttggcttacttatttattgcggcaactttaatctacctttatttctttaaatggttgcgaaagaaagatagcttagtagcaggttttttgatagcttctttaggattattgattgagtggcatgcttaccttttctcaatgcctattttgaaagataaagaaattttgcgttcaactgctcgattaattgtgtctgatttaatgcaatttaaaatcactgtttttgccggtggaggtatgttgggtgctttgatttacaagccaattgcttttctcttttctaatattggtgcctatatgattggtgttctcttcatcattttgggtctctttttaatgagttctctggaagtttatgacatcgtcgaatttattagagcttttaaaaataaagtggcagagaagcacgagcaaaataaaaaggagcgttttgctaagcgagagatgaaaaaagcaatcgctgaacaagagcgcatagagcgtcaaaaagctgaagaagaagcttatttagcttcggttaatgtagaccctgaaacgggtgagattctagaggatcaagctgaggacaatttggatgatgcgctaccacctgaggtaagtgaaacatcaactccggtatttgagccagagatccttgcttatgagacatcgcctcaaaatgatcctttaccagtagagccgacaatttatttagaagactatgattcgccgattcctaatatgagagaaaatgatgaggaaatggtttatgatttagatgatgatgtagatgatagtgatatagaaaatgtcgactttacacctaaaacgacactggtttataaattaccaacgatagatttatttgcaccagataagcctaaaaatcaatccaaagaaaaggatttagtccgaaagaatatcagagttttagaagaaacatttagaagttttggtatcgatgtaaaagtagaacgtgctgaaattggaccatcagttactaaatatgaaattaaaccagcagttggagttcgtgtgaatcgtatttcaaatctatctgacgacctagctcttgctcttgcagcaaaagatgtgcgtatagaaacaccaattcctggaaaatcattaataggtattgaagttcctaactcagaaattgcaacggtttctttccgcgaactttgggaacaatctgatgccaatcctgaaaaccttttagaagtaccactaggaaaagctgttaacggcaatgctcgcagttttaacttagctagaatgccgcatcttttggtagctggttcaactggttcaggtaaatctgtggcagttaatggaattatttcaagtattttgatgaaggcacgtccagatcaagttaagtttatgatgattgatcccaaaatggttgaattatctgtttataatgatattccacatttattaatccctgttgtaaccaatccgcgtaaagcaagtaaggcactccaaaaagttgttgatgaaatggaaaatcgatacgagttatttagcaaaattggtgtgcgtaatatagcaggttataatacaaaggttgaagagtttaatgcttcctctgagcaaaaacaaatacctttgcctttaatcgttgtcattgtagatgaattggctgacttgatgatggttgctagtaaagaagttgaagatgctattattcgtttggggcaaaaagcacgtgctgcaggtatccatatgattcttgcaactcaacgtccatccgtagatgttatttctggtttgattaaagcaaatgttccgtcgcgtattgcatttgctgtttcaagtggtactgatagccgtacgatccttgatgaaaatggtgctgaaaagctcttgggacggggtgacatgctctttaagcctattgatgagaatcatccagtacgactacaaggttcctttatttcagatgatgatgttgaaaggatcgttggttttatcaaagaccaagccgaggctgactatgatgatgcctttgatcctggagaagtatctgaaacagataacggctctggtggtggcggcggagtacctgaaagtgatcctctttttgaagaagccaagggactcgttttagagacgcaaaaagcaagtgcctcaatgattcaacgccgattgtctgttggtttcaatagagcaacaagactaatggaagaattagaagcagcgggggttattggtccagcagaaggaaccaagccacgaaaagttttaatgactccaactccgagtgaa

SEQ ID NO: 22 - protein, 816 aa, Streptococcus agalactiae
MVFMANKKKTKGKKTRRPTKAEIERQRAIQRMITALVLTIILFFGIIRLGIFGITVYNVIRFMVGSLAYLFIAATLIYLYFFKWLRKKDSLVAGFLIASLGLLIEWHAYLFSMPILKDKEILRSTARLIVSDLMQFKITVFAGGGMLGALIYKPIAFLFSNIGAYMIGVLFIILGLFLMSSLEVYDIVEFIRAFKNKVAEKHEQNKKERFAKREMKKAIAEQERIERQKAEEEAYLASVNVDPETGEILEDQAEDNLDDALPPEVSETSTPVFEPEILAYETSPQNDPLPVEPTIYLEDYDSPIPNMRENDEEMVYDLDDDVDDSDIENVDFTPKTTLVYKLPTIDLFAPDKPKNQSKEKDLVRKNIRVLEETFRSFGIDVKVERAEIGPSVTKYEIKPAVGVRVNRISNLSDDLALALAAKDVRIETPIPGKSLIGIEVPNSEIATVSFRELWEQSDANPENLLEVPLGKAVNGNARSFNLARMPHLLVAGSTGSGKSVAVNGIISSILMKARPDQVKFMMIDPKMVELSVYNDIPHLLIPVVTNPRKASKALQKVVDEMENRYELFSKIGVRNIAGYNTKVEEFNASSEQKQIPLPLIVVIVDELADLMMVASKEVEDAIIRLGQKARAAGIHMILATQRPSVDVISGLIKANVPSRIAFAVSSGTDSRTILDENGAEKLLGRGDMLFKPIDENHPVRLQGSFISDDDVERIVGFIKDQAEADYDDAFDPGEVSETDNGSGGGGGVPESDPLFEEAKGLVLETQKASASMIQRRLSVGFNRATRLMEELEAAGVIGPAEGTKPRKVLMTPTPSE

SEQ ID NO: 23 - DNA, 2403 bp, Streptococcus agalactiae
atggttaaaagaaatcaaagaaaaaaaagtgcgcctaagaagcgtttaacaaaagcagaagtggaaaagcaacgtgccattaagaggatgattttatctgttttaatggctttgttgcttatttttgcgatgcttcgcttgggcgtctttggtgtgacaacttataatatgattcgttttttggtgggtagtttagcctatccgtttatgtttgcctggttaatttacttattttgttttaaatggttacggcaaaaagatggaatgattgcgggagttgttattgcctttttgggattgctagttgagtggcacgccttcttatttgcgatgcctaggatgcttgatcaagatatttttctaggcactgctcggctaattacaagagatttactagccctgcgcgtgactgaatttgttggtggaggaatgcttggtgcattactttataaacccatagcctttttattttcgaatatcggctcttactttattggttttttgtttatcttattaggattatttctaatgacgccttgggatatctatgatgtgagtcactttgtgaaagaggctgttgataaactagcagtggcttatcaggaaaataaagaaaagcggttcatcaaacgagaagagcaccgcttacaagctgaaaaagaggctttagagaaacaagcacaagaggaagaaaaacgtctagcagaattgacggttgatcctgagacgggagagattgttgaggatagtcagtctcaagtcagctatgatttggctgaggatatgacaaaagaaccagagattcttgcttatgatagtcacctcaaagacgatgagacaagcttatttgatcaagaagacttggcttacgctcatgaggaaattggggcttatgactctttatctgctttagcatcttctgaagatgagatggatatggatgaacctgttgaagttgatttcacaccaaaaacccatcttctttataaacttccaacgatagatttatttgcaccagataagcccaaaaaccagtccaaagagaaaaacttagtccgcaaaaatatcaaggtgcttgaagataccttccaaagttttgggattgatgtcaaggtagagcgagcagaaatcgggccttccgtcaccaaatatgaaatcaagccagctgtcggggtccgagttaatcgtatttcaaatcttgctgatgatttggcacttgctctggctgctaaagatgttcgtattgaagcaccaattcctggaaaatccttaataggtattgaagttcctaactcagaaattgcaacggtttctttccgcgaactttgggaacaatctgatgccaatcctgaaaaccttttagaagtaccactaggtaaagctgttaatggcaatgcgcgcagttttaacttagctagaatgccgcatcttttggtagctggttcaactggttcaggtaaatctgtggcagttaatggcattatttcaagtattttgatgaaggcacgtccagatcaagttaagtttatgatgattgaccccaaaatggttgaattatctgtttataatgatattccacatttattaatcccagttgtaaccaatccgcgtaaagccagtaaggcactccaaaaagtggttgatgagatggaaaaccgctacgagttatttagtaaaattggtgtgcgtaatatagcaggttataatacaaaggttgaagagtttaatgcttcttctgagcaaaaacaaataccgttgcctttaatcgttgtcattgtagatgaattggctgacttgatgatggtggctagtaaagaagttgaagatgctattattcgtttgggacaaaaagcacgtgctgcaggtatccatatgattcttgcaactcaacgtccctctgtagatgttatttctggtttgattaaagcaaatgttccgtcgcgtatggcatttgctgtttcaagtggtactgatagccgtacgatccttgatgaaaatggtgctgaaaagctcttgggacggggtgatatgctctttaagccgattgatgaaaatcaccctgttcgcttgcaagggtctttcatctcagatgatgatgtggagcgtattgtcaactttatcaaagaccaaactgaagcggattatgatgacgcctttgatcctggtgaagttagcgacaatgatcctggtttttctggaaatggcggagctgctgaaggtgatcctctttttgaagaagcaaaagccttggtcttagaaacacaaaaagctagtgcctcaatgattcaaaggcgtttgtcggttggatttaatcgtgccacgcgcttgatggatgaattggaagaagcaggtgttatcggtccagcagaaggaaccaagcctcgtaaggtattgcagacaaac

SEQ ID NO: 24 - protein, 801 aa, Streptococcus agalactiae
MVKRNQRKKSAPKKRLTKAEVEKQRAIKRMILSVLMALLLIFAMLRLGVFGVTTYNMIRFLVGSLAYPFMFAWLIYLFCFKWLRQKDGMIAGVVIAFLGLLVEWHAFLFAMPRMLDQDIFLGTARLITRDLLALRVTEFVGGGMLGALLYKPIAFLFSNIGSYFIGFLFILLGLFLMTPWDIYDVSHFVKEAVDKLAVAYQENKEKRFIKREEHRLQAEKEALEKQAQEEEKRLAELTVDPETGEIVEDSQSQVSYDLAEDMTKEPEILAYDSHLKDDETSLFDQEDLAYAHEEIGAYDSLSALASSEDEMDMDEPVEVDFTPKTHLLYKLPTIDLFAPDKPKNQSKEKNLVRKNIKVLEDTFQSFGIDVKVERAEIGPSVTKYEIKPAVGVRVNRISNLADDLALALAAKDVRIEAPIPGKSLIGIEVPNSEIATVSFRELWEQSDANPENLLEVPLGKAVNGNARSFNLARMPHLLVAGSTGSGKSVAVNGIISSILMKARPDQVKFMMIDPKMVELSVYNDIPHLLIPVVTNPRKASKALQKVVDEMENRYELFSKIGVRNIAGYNTKVEEFNASSEQKQIPLPLIVVIVDELADLMMVASKEVEDAIIRLGQKARAAGIHMILATQRPSVDVISGLIKANVPSRMAFAVSSGTDSRTILDENGAEKLLGRGDMLFKPIDENHPVRLQGSFISDDDVERIVNFIKDQTEADYDDAFDPGEVSDNDPGFSGNGGAAEGDPLFEEAKALVLETQKASASMIQRRLSVGFNRATRLMDELEEAGVIGPAEGTKPRKVLQTN

SEQ ID NO: 25 - DNA, 1713 bp, Streptococcus agalactiae
atgcatattgagactgttattgatttcaaagaattaggaaaaagatatcgttttaaaaatcctacaaaagaattaatagctgatactttagaacaagtcttagaagtgataaaagaagttgattattatcaatctcaaaattattatgttgttggttatttatcttatgaagcatctgctgcttttgattcacattttaaagtttctcaacagaagttggctggagaacatctagcttattttacagtacataaagattgtgagaacgaagcttttcctttaagttatgaaaatgttagattagcagataattggactgctaatgtttctgagcaagaatatcaagaggcaattgctaatattaaaggacaaattagacaaggaaatacttatcaagtaaattatacactagagcttagccaacaattatgctcggatccctttagtgtttatgaacgcctaatggtagaacaaggagcaggatataatgcttatattgcctacgacgataaaaggattttatctgtaagcccggaattgttctttaagaagaaggatgaagtcttaacaactagaccaatgaagggaacaagcgctagaaagcctacttatcaagaagatgtggcggagcgagattggttggcaaatgatcctaaaaatcgttctgaaaatatgatgattgttgatttattaagaaacgatatgggccgtatctgtgatgttggaacagttaaggtaaaaaaactatgtcaagtggagcagtatgcaactgtgtggcaaatgacatcaactattgaaggagttttatcgccagaagtgacacttatgtctatttttcaagctctatatccttgtggatctatcactggagctcctaagatatcaacaatggctattattaatgagttggaaaaacggccaagaggtatttattgtgggacgataggactttgcatgccagacggacaagctatttttaacgttcctattcgcacagtacaaatgaaaggtcaacaagcctattacggcgttggtggaggtattacgtgggagagccagacagattctgaatatgaagaaacccgtcaaaaatcagctgttttaacacgtgtcaatccaaaatttcaattaataactacaggaagagtgactgaaaataaacttcttttctctcaacaacatgtcgagagattagttgaatcagcgtcttattttgcttattcttttgataaaagtaaattcgaaagggaactgaaaaaataccttcatcagctagatgagaaggattaccgcttgaaaataatgcttgataaaactggtaaggtaacgtttgaggtaaaacaactagtgaatttatcaaaaaagtttttaacggcagaggtggtcgtacaagactaccctattaaattatccccgtttacttattttaaaacttcttatcgcccacatattattgaaggtcagaatgaaaagatatttgtatctcctgaggggttgctattggaaacaagtattgggaatattgttttagaaaaaaatggaaggtttttaaccccagatttatcagaaggagggttgaatgggatttatcgtcgtcatctccttaaaaaccaaaaagtaattgaagcaccactaactttaaaagatttagaatcagccgatgctatatacgcctgtaatgctgttagagggctttatcctctaaacctaaag

SEQ ID NO: 26 - protein, 571 aa, Streptococcus agalactiae
MHIETVIDFKELGKRYRFKNPTKELIADTLEQVLEVIKEVDYYQSQNYYVVGYLSYEASAAFDSHFKVSQQKLAGEHLAYFTVHKDCENEAFPLSYENVRLADNWTANVSEQEYQEAIANIKGQIRQGNTYQVNYTLELSQQLCSDPFSVYERLMVEQGAGYNAYIAYDDKRILSVSPELFFKKKDEVLTTRPMKGTSARKPTYQEDVAERDWLANDPKNRSENMMIVDLLRNDMGRICDVGTVKVKKLCQVEQYATVWQMTSTIEGVLSPEVTLMSIFQALYPCGSITGAPKISTMAIINELEKRPRGIYCGTIGLCMPDGQAIFNVPIRTVQMKGQQAYYGVGGGITWESQTDSEYEETRQKSAVLTRVNPKFQLITTGRVTENKLLFSQQHVERLVESASYFAYSFDKSKFERELKKYLHQLDEKDYRLKIMLDKTGKVTFEVKQLVNLSKKFLTAEVVVQDYPIKLSPFTYFKTSYRPHIIEGQNEKIFVSPEGLLLETSIGNIVLEKNGRFLTPDLSEGGLNGIYRRHLLKNQKVIEAPLTLKDLESADAIYACNAVRGLYPLNLK

SEQ ID NO: 27 - DNA, 1761 bp, Streptococcus pyogenes
ttgggtatgcatagaaaaactattattgatttcaaagagctcgggcaacgctatctttttgatgagccattagtagaattggtagccaagtccttagatcaggtcggtccagtcattgaaaaagtacaacactaccaacagctgggctattacgtggtgggctatctcagttatgaagcagctgctttttttgacaatgccctacaaacccataatgacagactaggcaacgagtaccttgcctattttacagtgcacaaaacctgtcaaaaaaaagacctacctcttgattatgacagcattactatccctaaccaatgggtcagcgcaactcaaaaagaagcctatcaaaaagccattgaaaccattcaccgtgagatgcaacagggcaatacttatcaggttaactacacccttcaattaactcaggaactcaatgcagctgatagtttagccatttacaataaactcgtcgttgaacaggctgctggctacaatgcctacatcgcccatgatgagtttgccgttatttcagctagtcctgaattgttctttaaacaagagggcaacaggttaactactaggcctatgaaaggcaccaccaaacgaggggttaatagctggctggatcaacaagaacatgactggctccaagctgacgggaaaaaccgttctgaaaacatgatgattgtggatttgctccgcaatgacatggggaaaatttgccaaacaggcagtgttcgtgttgataggctctgtgaggtcgagcgatactctaccgtctggcaaatgacctcaactattgttggtgacctcaaagcggactgtgacctgatagacattctcaaagctctctttccttgtggctctatcacaggggcaccaaaagtctccaccatggcaattatcacatctctggagccaaaaccaagggggatttattgtggaagtattggcatttgcctacctgatggtcgccgtttcttcaatgttcccattagaaccatccagctcagtcataatcaagctacttatggtgtcggaggcggcatcacttggcaaagcaagtgggaagacgaatacgaggaagtccatcaaaaaacagcttttctctatcggcacaaacaaatctttgacctcaaaacaaccgccaaggtggaacacaaaaaaatagccttccttgagcaacacctcaatcgccttaaagaagcagccacttattttgcttacccttataatgaaaaagctttgcagaaacaactgtcaacctatttggaaaataagaataatgctgcctaccgtttgatgattcgtttatccaaagatggaaagattagcctctctgatcaacccttggaacctttgtcagccgattttctgacagctcaactctctttacagaaaaaggacgtgacagcttcgccttttacctactttaagaccagctaccggcctcatattgagcaaaaatcttatgaacagctattctataaccaagcggggcaattattggaaacgtccattggcaatctctttgttcagctgggtcagaccctctacacaccaccagtggctgtggggattttaccaggactttttcgccaagaactgctagctactggtcaagctcaggaaaaagaggtgacactagctgatttaaaagaggctagcgctatttttggaggaaatgctgtccgtggcctttatcctctcaaccttgagcttactcaccttgatgccctcttagctaagagtcaagcc

SEQ ID NO: 28 - protein, 587 aa, Streptococcus pyogenes
LGMHRKTIIDFKELGQRYLFDEPLVELVAKSLDQVGPVIEKVQHYQQLGYYVVGYLSYEAAAFFDNALQTHNDRLGNEYLAYFTVHKTCQKKDLPLDYDSITIPNQWVSATQKEAYQKAIETIHREMQQGNTYQVNYTLQLTQELNAADSLAIYNKLVVEQAAGYNAYIAHDEFAVISASPELFFKQEGNRLTTRPMKGTTKRGVNSWLDQQEHDWLQADGKNRSENMMIVDLLRNDMGKICQTGSVRVDRLCEVERYSTVWQMTSTIVGDLKADCDLIDILKALFPCGSITGAPKVSTMAIITSLEPKPRGIYCGSIGICLPDGRRFFNVPIRTIQLSHNQATYGVGGGITWQSKWEDEYEEVHQKTAFLYRHKQIFDLKTTAKVEHKKIAFLEQHLNRLKEAATYFAYPYNEKALQKQLSTYLENKNNAAYRLMIRLSKDGKISLSDQPLEPLSADFLTAQLSLQKKDVTASPFTYFKTSYRPHIEQKSYEQLFYNQAGQLLETSIGNLFVQLGQTLYTPPVAVGILPGLFRQELLATGQAQEKEVTLADLKEASAIFGGNAVRGLYPLNLELTHLDALLAKSQA

SEQ ID NO: 29 - DNA, 831 bp, Streptococcus agalactiae
atggtcacaggaggattccgactagacctcttacttgagataactaagatagctcgtgcaacttactattatcaactaaagaaactgaataaaccaaataaagacaaagcaatcaaatctgacattcaatccatttatgatgaacatagaggaaactatggctatcgtcggatttatttagaactgcgaaatcgtggctttgtcatcaaccacaaaagggtgcaaggcttgatgaaaagtatgggcttgactgctcgtattcgtcgtaagcgcaagtatgcctcttacaaaggtgaggttggtaagaaggctgataacctgattcaacgccagtttgaggggtcgaagccctatgagaagtgctataccgatgtgacggagtttgctttacctgaagggaaactttatctatcgcctgttcttgatggctataacagtgagataattgattttaccctgtctcggtctcctgacttgaaacaggttcaaaccatgcttgagagggcttttcctgcggcttcatacagcgaaaccattctccacagcgaccaaggctggcagtaccagcacaagtcctaccatcaatttctggaggacaaaggcattcgtccttctatgtcacggaaggggaacagtcctgacaacggtatgatggaatctttctttgggattctaaaatctgagatgttctatggcttggagaagtcttacaaatcacttgatgaccttgagcaagctatcacagattacattttttactacaacaacaagcgaatcaaagcaaaactaaaaggacttagtcctgtgcaatacagaactaaatccttcact

SEQ ID NO: 30 - protein, 277 aa, Streptococcus agalactiae
MVTGGFRLDLLLEITKIARATYYYQLKKLNKPNKDKAIKSDIQSIYDEHRGNYGYRRIYLELRNRGFVINHKRVQGLMKSMGLTARIRRKRKYASYKGEVGKKADNLIQRQFEGSKPYEKCYTDVTEFALPEGKLYLSPVLDGYNSEIIDFTLSRSPDLKQVQTMLERAFPAASYSETILHSDQGWQYQHKSYHQFLEDKGIRPSMSRKGNSPDNGMMESFFGILKSEMFYGLEKSYKSLDDLEQAITDYIFYYNNKRIKAKLKGLSPVQYRTKSFT

SEQ ID NO: 31 - DNA, 804 bp, Streptococcus pyogenes
atgctacttgaaatccttgatttatcacgctccacctattactatcaagtgaagcgactagctcaaggagataaggatatagaactaaagcatgtgattcgagagatttatgatgagcataaaggtaattacggttatcgtcggattcatatggagttgcgtaaccgaggatttgtggtcaatcataagaaagttcaacgtctcatgaaagtcatgggcttagcagcccgcattcgtcggaagcgcaagtattcttcttacaaaggagaggttggtaagaaggctgataatctgattaaacgtcacttcgaaggctctaaaccttacgaaaaatgttacactgatgtgacggagttggccttacctgaaggaaaactctacttatcacctgttcttgatggctataacagtgagattattgatttcactctatctcggtctcctaacttgaaacaggttcaaaccatgcttgagaagacttttccagcagattcatacagcggaactattcttcatagtgaccaggggtggcaataccaacaccagtcctaccatgattttttagagtctaaaggtattctggcatccatgtcccgcaaagggaatagtccggataacggcatgatggaatccttctttggcattctcaaatctgaaatgttttatggactcgagacaacttatcaatcacttgacaagcttgaagaagctattacagattacattttttactacaacaacaaacgaattaaagcaaaactaaaaggatttagtcctgtccaatacagaactaaatcctttcaa

SEQ ID NO: 32 - protein, 268 aa, Streptococcus pyogenes
MLLEILDLSRSTYYYQVKRLAQGDKDIELKHVIREIYDEHKGNYGYRRIHMELRNRGFVVNHKKVQRLMKVMGLAARIRRKRKYSSYKGEVGKKADNLIKRHFEGSKPYEKCYTDVTELALPEGKLYLSPVLDGYNSEIIDFTLSRSPNLKQVQTMLEKTFPADSYSGTILHSDQGWQYQHQSYHDFLESKGILASMSRKGNSPDNGMMESFFGILKSEMFYGLETTYQSLDKLEEAITDYIFYYNNKRIKAKLKGFSPVQYRTKSFQ

SEQ ID NO: 33 - DNA, 534 bp, Streptococcus agalactiae
atgaaattaagttatgaagataaactagaaatatacgagttaagaaagatcgggatgtcctggtctcagattagtcaacgatatgatgttcgtatctcgaatcttaaatacatgataaaactcatggatcggtatggtgtagaaatcgtcgaaaaaggtagaaatgagtattatccacctgaattaaagcaggaaatgatagataaagtcttgattcatggttgttctcaactctctgtttctcttgattatgctctctctaattgttctatactcacaaattggctttcccaatttaagaaaaatggttatactattgttgagaaaacaagagggagaccgagtaaaatgggacgtaagcgtaagaaaacttgggaagaaatgacagagctcgagcgacttcaggaagaaaatgagcgcttgagaacggagaatgcctttctaaaaaagttgagggatttgcgcttgagggacgaagccttacagagcgaacggcagaaacaattagagaaatggtcacaggaggattccgac

SEQ ID NO: 34 - protein, 178 aa, Streptococcus agalactiae
MKLSYEDKLEIYELRKIGMSWSQISQRYDVRISNLKYMIKLMDRYGVEIVEKGRNEYYPPELKQEMIDKVLIHGCSQLSVSLDYALSNCSILTNWLSQFKKNGYTIVEKTRGRPSKMGRKRKKTWEEMTELERLQEENERLRTENAFLKKLRDLRLRDEALQSERQKQLEKWSQEDSD

SEQ ID NO: 35 - DNA, 513 bp, Streptococcus pyogenes
atgaaatttaatcaagaaacgaaagttaagatttatgagttacggcaaatgggagagtccattaaatccatatcaaaaaagtttgatatggcagaatccgatctcaaatatatgattcgcttgattgataggtatggggtaaccattgttcaaaaatgtaagaatcattattattctccagaactgaagcaagagataataaataaagtcctgattgacggccaatctcagaaacaaacatccttagattatgctttaccaacttctagtatgctctcaaggtggatagcgcaatacaagaaaaacggttatactattcttgaaaaaccaagagggagaccgagtaagatggggcgtaaacgtaagaaaaatttggaagagatgacagaggttgaacgtcttcagaaggaattagaataccctagagcggagaatgctgtgctaaaaaagctgagagaataccgcttgagggacgaagcaaaactcaaagagcaacagaaatcattcaagcat

SEQ ID NO: 36 - protein, 171 aa, Streptococcus pyogenes
MKFNQETKVKIYELRQMGESIKSISKKFDMAESDLKYMIRLIDRYGVTIVQKCKNHYYSPELKQEIINKVLIDGQSQKQTSLDYALPTSSMLSRWIAQYKKNGYTILEKPRGRPSKMGRKRKKNLEEMTEVERLQKELEYPRAENAVLKKLREYRLRDEAKLKEQQKSFKH

SEQ ID NO: 37 - DNA, 903 bp, Streptococcus agalactiae
ttgaaaaatcaacaaaaattaatgtatctagagagtatcgagctatactcaaacatcactaaagccgctgcacacctttttatttctcaaccttacctaagcaaagtgatcaagcaattagaaaatgagttagaaataaaactcatccagagccaaggacaccaaacctttttaacttatgctggacagagatatctattctacctaaaagaaattgatatgattgagcgtcaaatggccaaagaactatatctcatccgttctgataaaaaaggagaaatcacacttgggattaactctggcttagcaagttctattctggcaaatgtacttcccaaatttaacttggagcacccagaaatttctgtcaaattactcgaaaacaatcaaaatatttctgaacaattggtagcgagtggtgatattgacctagctgttgggatggctcctatcctttataaagatggaattgcatcaaccactatttaccgcgacgaattgtttttaatgatacctaccaccagccaactctacaacgctgaaaaacgtggacagattattccttttgaatatcctatttcagttctagacaatgaacctcttatcctaacaccattagagtacggaattggcaaaacaattgcacaattctatgagcttcatcacatgtcattaaatcagatgattacaactagtaccgttcctacagcagctagcctatctttgtcagggatgggagcaacatttgttccacaaactctcattcatcgctatttggataaagagtgcaatgtctaccattttcataagaataagttattttcagagtacattatgatttataaaaaagatgttgaattatctggaattgctctcctactttataaagcttttttaaccaag

SEQ ID NO: 38 - protein, 301 aa, Streptococcus agalactiae
MKNQQKLMYLESIELYSNITKAAAHLFISQPYLSKVIKQLENELEIKLIQSQGHQTFLTYAGQRYLFYLKEIDMIERQMAKELYLIRSDKKGEITLGINSGLASSILANVLPKFNLEHPEISVKLLENNQNISEQLVASGDIDLAVGMAPILYKDGIASTTIYRDELFLMIPTTSQLYNAEKRGQIIPFEYPISVLDNEPLILTPLEYGIGKTIAQFYELHHMSLNQMITTSTVPTAASLSLSGMGATFVPQTLIHRYLDKECNVYHFHKNKLFSEYIMIYKKDVELSGIALLLYKAFLTK

SEQ ID NO: 39 - DNA, 918 bp, Streptococcus pyogenes
ttgataagacaaggagaatcctatttggatattaaacaaattcgttattttatcgcaatcgttgaaaatcattttaacttgagccaggcggcggaactgttgtatgtgtcgcagccgacacttagcatgatgatcaatgattttgaaaaaagagaaaatgttaagctcttcaaacgaaaaagaggtcgtattattgggttaacctatcttggtgataattattataaggacgctcaaaaggttctcagtctctatgatgacatgtttttgaaattgcatgatcacagtaaagggttaaagggaagtatcaatattggtattcctcctcttattttatcagttgttttctcagaagtaatgccaaaactgattttagaaaatccggggattcaattcaatgttaaggagattggtgcttaccaactaaaaaatgaactactcgtgggaaatgttgacgtcgcagtcttgttatccccaacaggcatcgctgataatttggttgagacttatgaaatccagagatcagaattatctgtatgcctgtctccacgccatcgtttagcttccaaaaaagttattcagtgggaagatttaacagatgaacaacttgccctatttgatcctagtttcatggttcaccatttagtgcttgaagcttgcgagcgtcaccaagtcagacctaatattattttgacgtcctcttcctgggattttatgcttaattctaccaagattaatcacaacgtcttaactatttgtcccaaacctattacagaattataccaattaaaggacattaagtgtattccaatggaacgtcccatttcttggcgtgttgtcttaacacgcctccggaaaaaaagttattctgaaatagaagcctacatcatggacgacttgctacagtctttttttaag

SEQ ID NO: 40 - protein, 306 aa, Streptococcus pyogenes
LIRQGESYLDIKQIRYFIAIVENHFNLSQAAELLYVSQPTLSMMINDFEKRENVKLFKRKRGRIIGLTYLGDNYYKDAQKVLSLYDDMFLKLHDHSKGLKGSINIGIPPLILSVVFSEVMPKLILENPGIQFNVKEIGAYQLKNELLVGNVDVAVLLSPTGIADNLVETYEIQRSELSVCLSPRHRLASKKVIQWEDLTDEQLALFDPSFMVHHLVLEACERHQVRPNIILTSSSWDFMLNSTKINHNVLTICPKPITELYQLKDIKCIPMERPISWRVVLTRLRKKSYSEIEAYIMDDLLQSFFK

SEQ ID NO: 41 - DNA, 1212 bp, Streptococcus agalactiae
atggccaatgcatctttgcgacatcaattatttgaaaaacttgaccaaaaatgtgatcaaatggttgctattcgtcgctatttacatgaaaatcccgaattatcatttaaagagacaaaaacagcagcttatatttcagatttttataaaggtaaggactgtcatgttcagacacaatttggtggtatgaatggcgtcgtagttgatatctatggtgataaagcgacagataagcccatcaaacacattgctttgagagccgactttgatgctcttccaattcaggaagagacagggctttcttttgcttcaaaaacagcgggcgtcatgcatgcttgtggacatgatgcccatacagcttatttattgattttggctgagagcttgattgaattaaaatcagaattttcaggtcatatccgtatcttacatcaaccggctgaagaggtgccaccaggcggagcaaaagcaatgattgaagcaggatgtttagatggcattgatgctgtccttggtatccatgttatgtcaacgatggaagagggaacggtacaatatcacgcaggtcccattcaaacagggcgtgccacttttaaagttattttgcaaggtaagggtggacatggttccatgccacatcgtgcaaatgatacaattgttgcagcttctagttttgttatggcagcgcaaacgattgtcagtcgtcgagttaatccatttgacacagcagtagttactatcggatcttttgatggtaaaggttctgctaatgtgatcaaagatagtgtaaccttagaaggtgatgtgcgcgtgatgtctgaagagacacgaggtgttgttgaggaggaatttaagcgtattctagatggaatagcacaaacttatggtgttagttatcagttagactatcagaatgattatcctgttttagttaataacagtgaagtgacacagaaagttgcaaatagtttaaaatctgttgctataaaagaaattttagatgtcattgattgcgaccctcaaacgccgtctgaagattttgcctattatgctcaaacaatcccagcttgcttcttctatgttggagcacatgaagaggggcaaccatattacccacatcatcatccaaaattccaaattgcagaatcatcattgatggtatctgctaaatcaatggcaacagcagcgcttgctatgcttgtagaaggagaa

SEQ ID NO: 42 - protein, 404 aa, Streptococcus agalactiae
MANASLRHQLFEKLDQKCDQMVAIRRYLHENPELSFKETKTAAYISDFYKGKDCHVQTQFGGMNGVVVDIYGDKATDKPIKHIALRADFDALPIQEETGLSFASKTAGVMHACGHDAHTAYLLILAESLIELKSEFSGHIRILHQPAEEVPPGGAKAMIEAGCLDGIDAVLGIHVMSTMEEGTVQYHAGPIQTGRATFKVILQGKGGHGSMPHRANDTIVAASSFVMAAQTIVSRRVNPFDTAVVTIGSFDGKGSANVIKDSVTLEGDVRVMSEETRGVVEEEFKRILDGIAQTYGVSYQLDYQNDYPVLVNNSEVTQKVANSLKSVAIKEILDVIDCDPQTPSEDFAYYAQTIPACFFYVGAHEEGQPYYPHHHPKFQIAESSLMVSAKSMATAALAMLVEGE

SEQ ID NO: 43 - DNA, 1380 bp, Streptococcus agalactiae
atgttaacgacaaaggaaaatttcaaaggaaataacaaattattggtgggaattgtactcgctgtactatcattttggttatttgcacagtctattttaaacatgggaccagatgttcagtcatcattaggtatttcatctggtgcaatggatattggtgtctcaagtacggcattgttttcaggtttatttattgttgtaactggtggtttagcagataaacttggtcgagttaaatttacttttattggtctttgcttaaatattattggttctctactaattgttttagctaatggagcagtgctatttattatgggacgtatttttcaaggattggcagcagcttttattatgccatcaacaatggccttggttaaaacgtactatgatggtaaagatagacaacgtgcagttagtttctggtcaatcggatcgtggggtggctcaggtctatgttcttattttggtggagcggtggcaagtactctaggttggcgttatgtctttatcttttcaatcatcgcatcagtagttagttttctattaattttaggaaccccagaaagtaaaaatgttggacaaaaaactcactttgattaccttggtttaattatttttattatttcaatgttatcgttaaatattgggatatctatggctcaggaacatggattgatgaacgttattccattgagtctttttacagtgatgcttattggatttgttctgttttattatgttgaaacacgtaaatctaatagttttattgactttcatctgtttgaaaatcgattttacttaggtgcgacaatatcaaatttcttactgaatgcagttgcaggaactctgattgttattaatacttacatgcaacaaggtcgccagctaacaccaaaggttgcaggtgaaatgtctttaggctatttggtttgtgtactaattgctatccgagttggtgagaaaattttacaacgttttggtgcccgtaagccaatgcttttgggagctatgagtacatttgttgggatatttttaatgactttggtcaatattcaaggacctttgtatcttgtgttagtctttgttggttatgctttatttggaacaggcttggggatctatgcgacaccatcaacagatacagctatttctagtattcctaatgaaaaagtaggttctgcatctggaatttacaaaatggcaagttcactaggtggtgcaattggtgtagcaacttcaattgcgatttatcatgctttttctggtaatgcagattttcacaaagcagctttgtgtggattaattttaaacctagttttttgtagtctatcgatcttatcaattctttttgttatccctaagaaaattgaggataaa

SEQ ID NO: 44 - protein, 460 aa, Streptococcus agalactiae
MLTTKENFKGNNKLLVGIVLAVLSFWLFAQSILNMGPDVQSSLGISSGAMDIGVSSTALFSGLFIVVTGGLADKLGRVKFTFIGLCLNIIGSLLIVLANGAVLFIMGRIFQGLAAAFIMPSTMALVKTYYDGKDRQRAVSFWSIGSWGGSGLCSYFGGAVASTLGWRYVFIFSIIASVVSFLLILGTPESKNVGQKTHFDYLGLIIFIISMLSLNIGISMAQEHGLMNVIPLSLFTVMLIGFVLFYYVETRKSNSFIDFHLFENRFYLGATISNFLLNAVAGTLIVINTYMQQGRQLTPKVAGEMSLGYLVCVLIAIRVGEKILQRFGARKPMLLGAMSTFVGIFLMTLVNIQGPLYLVLVFVGYALFGTGLGIYATPSTDTAISSIPNEKVGSASGIYKMASSLGGAIGVATSIAIYHAFSGNADFHKAALCGLILNLVFCSLSILSILFVIPKKIEDK

SEQ ID NO: 45 - DNA, 1365 bp, Streptococcus pyogenes
atgtcacatcatcaacaaaccgtttcaaaacaaacaattatggcgattatcgccatagcactcattggtttttcaggaattttgtctgaaaccagtatgaatgtcaccttcccgacactgatgtcagtctatcagttacccttaaatagcttgcaatggatgacgaccatttatttactagcagtggcgattatgatgaccacttcggctacactgaaaaaaaatgtgcgggaaagacccctcttttttatggccacaggtctttttacatttggcaccatcttggccgttctgacccagtcctttgcgatcatgttgctagcccgcatttttcaaggcattggtactggtctggtaatgcctcagatgtttaatattattttagagcgtgtcccaatgcataaggtaggtctatttatgggatttgctggtcttattattagcttagcacctgcttttgggcctacttatgggggctttatgattagccattttagttggcaatggatttttatctgtatactccctgtaccactgattgcaggtattctagcttattattacctcgaagattctccagtaagcgaaaaagtaccctttgactggttggcatttattgcactatcgattagcttaacttctgccttattagctattactagtctagaaaacggcagtgttaatttgtattacttagggctttttattctcagctttatcctcttcctctacaagaatctcacagctaagcaaccctttcttgatattcgcattctcaaaattccctctctaacctttggcctgattcccttttttgtcttccagctgattaatttaggcataaattttctaacgccaaactttattgtcatggaaaagattgctaatagttctcaagctggtatggtgttactacctggtaccttactcggagctctactagcacctgcttttggtaaactttatgatcaaaaaggagcaagactttcgctttatttaggaaatgccttatttagtttatcattgattattatgacacttcaaacaagacattttatgcttttaccattcactcttttatatattttattcacgtttgggcgtaacatgggctttaataatagcttagccacggctattcgagaattgcctgccgagaaaaatgccgatgccacggccatttttcagatgatgcagcaatttgctggcgctctaggaactgctatggcatcactgatagcaaatagtcaagcagaattcacaagcggtgtccagtctgtctaccttctctttactatttttgctctacttgattttatctttttctttgctatgttttaccatttagggaaaaaaggattagcc

SEQ ID NO: 46 - protein, 455 aa, Streptococcus pyogenes
MSHHQQTVSKQTIMAIIAIALIGFSGILSETSMNVTFPTLMSVYQLPLNSLQWMTTIYLLAVAIMMTTSATLKKNVRERPLFFMATGLFTFGTILAVLTQSFAIMLLARIFQGIGTGLVMPQMFNIILERVPMHKVGLFMGFAGLIISLAPAFGPTYGGFMISHFSWQWIFICILPVPLIAGILAYYYLEDSPVSEKVPFDWLAFIALSISLTSALLAITSLENGSVNLYYLGLFILSFILFLYKNLTAKQPFLDIRILKIPSLTFGLIPFFVFQLINLGINFLTPNFIVMEKIANSSQAGMVLLPGTLLGALLAPAFGKLYDQKGARLSLYLGNALFSLSLIIMTLQTRHFMLLPFTLLYILFTFGRNMGFNNSLATAIRELPAEKNADATAIFQMMQQFAGALGTAMASLIANSQAEFTSGVQSVYLLFTIFALLDFIFFFAMFYHLGKKGLA

SEQ ID NO: 47 - DNA, 615 bp, Streptococcus agalactiae
  misc_feature (1)..(615): n = a, c, g, or t
atgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacataacnnnnnttaat

SEQ ID NO: 48 - protein, 205 aa, Streptococcus agalactiae
  misc_feature (1)..(205): Xaa = Any Amino Acid
MSLSIMTKHKHLTLLDRNDIQSGLDRGETFKAIGLNLLKHPTTIAKEVKRNKQLRESTKDCLDCPLLRKAPYVCNGCPKRRINCGYKKTFYLAKQAQRNYEKLLVESREGIPLNKETFWKIDRVLSNGVKKGQRIYHILKTNDLEVSSSTVYRHIKKGYLSITPIDLPRAVKFKKRRKSTLPPIPKAIKEGRRYEDFIEHITXXN

SEQ ID NO: 49 - DNA, 423 bp, Streptococcus agalactiae
atggctaaaaaagttgaaaaacttgtaaaacttcaaattcctgctggtaaagcaactccagctccaccagttggaccagcacttggtcaagcaggaatcaacatcatgggattcactaaagagtttaacgctcgtacagctgatcaagctggtatgattattccagttgttatctcagtatatgaagacaaatcatttgatttcatcactaaaacaccaccagctgctgttcttttgaaaaaagctgcaggtgttgaaaaaggatcaggtgaacctaacaaaactaaagttgcaacaattactcgtgcgcaagtacaagaaattgctgaaactaaaatgccagatttaaacgctgcaaaccttgagtctgcaatgcgtatgatcgaaggtactgctcgttctatgggattcactgttactgac

SEQ ID NO: 50 - protein, 141 aa, Streptococcus agalactiae
MAKKVEKLVKLQIPAGKATPAPPVGPALGQAGINIMGFTKEFNARTADQAGMIIPVVISVYEDKSFDFITKTPPAAVLLKKAAGVEKGSGEPNKTKVATITRAQVQEIAETKMPDLNAANLESAMRMIEGTARSMGFTVTD

SEQ ID NO: 51 - DNA, 495 bp, Streptococcus pyogenes
atgcaatattgcatatctgtgggaggtaaaaatctcaattaccgccaaaaccacaacaggaggatttttaaaatggctaaaaaagtcgaaaaacttgtaaaacttcaaatccctgctggtaaagctacaccagctccaccagttggaccagctcttggtcaagcaggtatcaacatcatgggcttcactaaagaatttaacgctcgtacagctgatcaagctggtatgatcatcccagttgttatctcagtttatgaagacaaatcatttgatttcatcactaaaacaccaccagctgctgttcttttgaaaaaagctgcaggtgttgaaaaaggatcaggtacacctaacactactaaggttgcgacagttactcgtgcacaagtacaagaaattgctgaaactaagatgccagatttgaacgctgcaaacattgaagctgcaatgcgtatgatcgaaggtactgctcgttctatgggattcactgttactgac

SEQ ID NO: 52 - protein, 165 aa, Streptococcus pyogenes
MQYCISVGGKNLNYRQNHNRRIFKMAKKVEKLVKLQIPAGKATPAPPVGPALGQAGINIMGFTKEFNARTADQAGMIIPVVISVYEDKSFDFITKTPPAAVLLKKAAGVEKGSGTPNTTKVATVTRAQVQEIAETKMPDLNAANIEAAMRMIEGTARSMGFTVTD

SEQ ID NO: 53 - DNA, 687 bp, Streptococcus agalactiae
atggctaaaaaaagtaaaaacttacgtgctgctcttgagaaaattgatagcactaaagcatacagcgtagaagaagctgtagctcttgcaaaagaaactaactttgctaaatttgatgcaactgttgaagtttcttataaccttaacattgacgttaaaaaagctgaccaacaaatccgtggtgctatggttttaccagcaggtactggtaaaacttcacgtgttcttgtttttgctcgtggtgctaaagctgaagaagctaaagcagcaggtgcagactttgtcggtgaagatgacttagttgctaaaatccaaggtggatggcttgactttgatgttgttatcgcaacaccagatatgatggcacttgttggacgtcttggacgtgtccttggacctcgtaacttgatgccaaaccctaaaactggtacagtaactatggacgttgctaaagcagttgaagagtctaaaggtggtaaaattacttaccgtgctgataaagcaggtaacgtccaagcccttattggtaaagtttcatttgatgatgctaaattagttgataacttcaaagcatttaatgatgttattgttaaagctaaaccagctactgcaaaaggaacttacatcacaaacctttcaattacaacaacacaaggtgttggtatcaaagttgatcctaactcactt

SEQ ID NO: 54 - protein, 229 aa, Streptococcus agalactiae
MAKKSKNLRAALEKIDSTKAYSVEEAVALAKETNFAKFDATVEVSYNLNIDVKKADQQIRGAMVLPAGTGKTSRVLVFARGAKAEEAKAAGADFVGEDDLVAKIQGGWLDFDVVIATPDMMALVGRLGRVLGPRNLMPNPKTGTVTMDVAKAVEESKGGKITYRADKAGNVQALIGKVSFDDAKLVDNFKAFNDVIVKAKPATAKGTYITNLSITTTQGVGIKVDPNSL

SEQ ID NO: 55 - DNA, 687 bp, Streptococcus pyogenes
atggctaaaaaaagcaaacaaatgcgtgctgcacttgaaaaagtagatagcacaaaagcgtacagtgtagaagaagctgtagcattagtaaaagaaacgaacttcgcaaaatttgatgcgtctgttgaagttgcttacaacttgaacattgacgttcgtaaagcagaccaacaaatccgtggcgcaatggtattgccaaacggaactggtaaaacacaacgtgttcttgtttttgcacgtggtgcaaaagctgaagaagcaaaagcagctggtgcagacttcgtaggtgaagacgaccttgttgcaaaaatcaatggtggatggcttgactttgacgttgttatcgcaacgccagacatgatggctatcgtaggtcgtcttggacgtgtccttggacctcgtaacttgatgccaaaccctaaaactggtacagtaacgatggatgttgctaaagccgttgaagagtctaaaggtggtaaaatcacttaccgtgctgacaaagcaggtaatgttcaagctcttattggtaaagtttcatttgatgctgacaaattggttgaaaacttcaaagccttccacgatgtaatggctaaagctaaacctgcaacagctaaaggaacttacatggcaaacgtctcaatcacatcaacacaaggtgttggtatcaaggttgatcctaactcactt

SEQ ID NO: 56 - protein, 229 aa, Streptococcus pyogenes
MAKKSKQMRAALEKVDSTKAYSVEEAVALVKETNFAKFDASVEVAYNLNIDVRKADQQIRGAMVLPNGTGKTQRVLVFARGAKAEEAKAAGADFVGEDDLVAKINGGWLDFDVVIATPDMMAIVGRLGRVLGPRNLMPNPKTGTVTMDVAKAVEESKGGKITYRADKAGNVQALIGKVSFDADKLVENFKAFHDVMAKAKPATAKGTYMANVSITSTQGVGIKVDPNSL

SEQ ID NO: 57 - DNA, 1623 bp, Streptococcus agalactiae
ttggtaaaaatgagacgtaacatattattgagcattacttgtttattgatggtgactctgactgcatgccattcacaggatagcaaaagtcataaactaaacagtgataaactcacgcttgcttggggagaagactttggtgatgttaatccgcatcgctataaccctgatcagtttgttatccaggatatggtttatgaggggttggtacgatatggtgacaatgggaaaattgaaccagctttagcgaaaagctggagcattagtcaagatggaaaaacctacacttttaaattgagaaatgctaaatattctgatggcagtaactttaatgctgcgaatgtcaaacgtaattttgatagtattttttcgaagtctaatagaggtaatcataattggtttaatttaacgaatcaattggaaaattatcgtgccttgaatcaaagtacttttgaaattaaactgaaacaagcttatagtgctactttatatgatctctctatgattcgaccaattcgctttttatctgatagcgctttccctaaaggtgatgatacaactaagaagaatgtaaaaaaaccaattggaacgggtcaatgggttgtgaaaagtaaaaagcaaaatgaatatattaccttcaaacgtaatgagaattactggggaaagaaaccaaaattaaaagaagtaaccgtaaaagttatacccgatgctcagacgcgtgctttagcattcgaatcaggtgacgttgatttgatctatgggaatggcattattggtttagacacttttgcccaatatacgaaggacaagaaatatgtcacagctatttctcaacctatgtcaacaagacttttgttgctaaatgctaaggaaagtattttccaagataaaaaagttcgtcaggcaatgaatcatgctattgacaaggtttctattgctaagaacacctttagaggaacagaaaagccagcagacactattttttcaaaatcaacatctcactcagatgctaagttaaatccttatagctataatgttgataaagcaaatcagctattggatcaagctggttggaagatgggaaaagataaggttcgtgaaaaagatggtaaaactctaaccttacgtcttccttatatcgccactaaggcaactgataaagacctggtaacttatttccaaggagaatggcgtaaaatcggtattaatgtttctcttattgctatggaagaagatgattattgggctaatgctaaaaagggtaattttgatatgatgttaacctattcttggggagcaccatgggaccctcatgcttggatgtcggcattaactgccaaggcagatcatggacatccagaaaatatagctttagaaaatctagcaactaaaactgaaatggatagacttattaagtcagctctagtagatcctaaggaagaaaatgttgatagagactataagaaggttcttgaattattgcatgatgaggctgtatatatcccattaacttatcaatcggtgatttctgtttataggaaaggtgattttaaaaccatgcgttttgcgccagaagaaaattcattcccattacgctatatagaaaaaaacaatgtatctaag

SEQ ID NO: 58 - protein, 541 aa, Streptococcus agalactiae
MVKMRRNILLSITCLLMVTLTACHSQDSKSHKLNSDKLTLAWGEDFGDVNPHRYNPDQFVIQDMVYEGLVRYGDNGKIEPALAKSWSISQDGKTYTFKLRNAKYSDGSNFNAANVKRNFDSIFSKSNRGNHNWFNLTNQLENYRALNQSTFEIKLKQAYSATLYDLSMIRPIRFLSDSAFPKGDDTTKKNVKKPIGTGQWVVKSKKQNEYITFKRNENYWGKKPKLKEVTVKVIPDAQTRALAFESGDVDLIYGNGIIGLDTFAQYTKDKKYVTAISQPMSTRLLLLNAKESIFQDKKVRQAMNHAIDKVSIAKNTFRGTEKPADTIFSKSTSHSDAKLNPYSYNVDKANQLLDQAGWKMGKDKVREKDGKTLTLRLPYIATKATDKDLVTYFQGEWRKIGINVSLIAMEEDDYWANAKKGNFDMMLTYSWGAPWDPHAWMSALTAKADHGHPENIALENLATKTEMDRLIKSALVDPKEENVDRDYKKVLELLHDEAVYIPLTYQSVISVYRKGDFKTMRFAPEENSFPLRYIEKNNVSK

SEQ ID NO: 59 - DNA, 1632 bp, Streptococcus pyogenes
ttgattgtgtcaaaatacctaaaatacttctctattatcacgttatttttgactgggcttattttagttgcatgtcaacaacaaaagcctcaaacaaaagaacgtcagcgcaaacaacgtccaaaagacgaacttgtcgtttctatgggggcaaagctccctcatgaattcgatccaaaggaccgttatggagtccacaatgaagggaatatcactcatagcactctattgaaacgttctcctgaactagatataaaaggagagcttgctaaaacataccatctctctgaagatgggctgacttggtcgtttgacttgcatgatgattttaaattctcaaatggtgagcctgttactgctgatgatgttaagtttacttatgatatgttgaaagcagatggaaaggcttgggatctaaccttcattaagaacgttgaagtagttgggaaaaatcaggtcaatatccatttgactgaggcgcattcgacatttacagcacagttgactgaaatcccaatcgtccctaaaaaacattacaatgataagtataagagcaatcctatcggttcaggaccttacatggtaaaagaatataaggctggagaacaagctatttttgttcgtaacccttattggcatgggaaaaaaccatactttaaaaaatggacttgggtcttacttgatgaaaacacagcactagcagctttagaatctggtgatgttgatatgatctacgcaacgccagaacttgctgataaaaaagtcaaaggcacccgcctccttgatattccatcaaatgatgtgcgcggcttatcattaccttatgtgaaaaagggcgtcatcactgattctcctgatggttatcctgtaggaaatgatgtcactagtgatccagcaatccgaaaagccttgactattggtttaaataggcaaaaagttctcgatacggttttaaatggttatggtaaaccagcttattcaattattgataaaacaccattttggaatccaaaaacagccattaaagataataaagtagctaaagctaagcaattattgacaaaagcgggatggaaagaacaagcagacggtagccgtaaaaaaggtgaccttgatgcagcgtttgatctgtactaccctactaatgatcaattgcgagcgaacttagccgttgaagtagcagagcaagccaaggccctagggattactattaaactcaaagctagtaactgggatgaaatggcaacgaagtcacatgactcagccttactttatgccggaggacgtcatcacgcgcagcaattttatgaatcgcatcatccaagcctagcagggaaaggttggaccaatattacgttttataacaatcctaccgtgactaagtaccttgacaaagcaatgacatcttctgaccttgataaagctaacgaatattggaagttagcgcagtgggatggcaaaacaggtgcttctactcttggagatttgccaaatgtatggttggtgagccttaaccatacttatattggtgataaacgtatcaatgtaggtaaacaaggcgtccacagtcatggtcatgattggtcattattgactaacattgccgagtggacttgggatgaatcaactaag

SEQ ID NO: 60 - protein, 544 aa, Streptococcus pyogenes
LIVSKYLKYFSIITLFLTGLILVACQQQKPQTKERQRKQRPKDELVVSMGAKLPHEFDPKDRYGVHNEGNITHSTLLKRSPELDIKGELAKTYHLSEDGLTWSFDLHDDFKFSNGEPVTADDVKFTYDMLKADGKAWDLTFIKNVEVVGKNQVNIHLTEAHSTFTAQLTEIPIVPKKHYNDKYKSNPIGSGPYMVKEYKAGEQAIFVRNPYWHGKKPYFKKWTWVLLDENTALAALESGDVDMIYATPELADKKVKGTRLLDIPSNDVRGLSLPYVKKGVITDSPDGYPVGNDVTSDPAIRKALTIGLNRQKVLDTVLNGYGKPAYSIIDKTPFWNPKTAIKDNKVAKAKQLLTKAGWKEQADGSRKKGDLDAAFDLYYPTNDQLRANLAVEVAEQAKALGITIKLKASNWDEMATKSHDSALLYAGGRHHAQQFYESHHPSLAGKGWTNITFYNNPTVTKYLDKAMTSSDLDKANEYWKLAQWDGKTGASTLGDLPNVWLVSLNHTYIGDKRINVGKQGVHSHGHDWSLLTNIAEWTWDESTK

SEQ ID NO: 61 - DNA, 942 bp, Streptococcus agalactiae
atgtatctaagtagttcgatcatcaaaaaaatattgtcagcttttttggcattgtttttcatatcacttctaacatttattcttatcaaactatcaacagttaattcagcagaaaattaccttcgtttatcaaaaataagtgttagtccagaagcgctaaaagaagcagagcactatttaggtttagataagccattatggaagcagtactggctgtggttccaaaaagcattaacaggagattttggatattcttatgtgctcaggttgccagtattagatttggttttacaacggtttttggctactttatttttaggcacgagtgccttcttgctaattgttaccatttctaccccgttaggtgtgtgggctggcttacatgaatctgctcggagtgatcacttgattcgatttttgagtttttctagtgtgtctatgccaaatttttgggttgcttacttgttgatgctgctattttcggcaaaattaaatcttctgcctgtttcaggaggtaacgatttacaaagtttaattttgccaagtattaccttaagtttttctaccgtaggtcaatacatagcccttattcgaaaagctattagtcaagaaaatagaagtttaaatgtggaaaatgcccgattaagaggagtaaaagaacgttatattgtcacacatcacctccttagaaatgccttacctgcgataatgacagcacttagcttgacttgggtttacttattaacaggatcaattattgttgaagaaattttttcatggaatggaataggacgtttatttgtgaccagtctaagaacttcagatcttccagtaatacaagcttgtatgctaatttttggaaccttatttttagctaataattttatgacacagtgttttatgaattgggttgatcctcggttacgaaagtcaagggagaaa

SEQ ID NO: 62 - protein, 314 aa, Streptococcus agalactiae
MYLSSSIIKKILSAFLALFFISLLTFILIKLSTVNSAENYLRLSKISVSPEALKEAEHYLGLDKPLWKQYWLWFQKALTGDFGYSYVLRLPVLDLVLQRFLATLFLGTSAFLLIVTISTPLGVWAGLHESARSDHLIRFLSFSSVSMPNFWVAYLLMLLFSAKLNLLPVSGGNDLQSLILPSITLSFSTVGQYIALIRKAISQENRSLNVENARLRGVKERYIVTHHLLRNALPAIMTALSLTWVYLLTGSIIVEEIFSWNGIGRLFVTSLRTSDLPVIQACMLIFGTLFLANNFMTQCFMNWVDPRLRKSREK

SEQ ID NO: 63 - DNA, 975 bp, Streptococcus pyogenes
gtgaaacgtactaccattattatcatctggaaaatcatcagatgtgtcacgcttatttttggggtatctgttttgaccttcgttttgttaaaacaatctccagtagatccagtcatggcaagtgtcaattatgacacatcactaacccctgctcagtacaaagcgattgctcaccactatggcttggataagccagctctagtccaatattttatttggttgaaaaatgtgatacagggagatttagggacctcgctcgtttatcggcaacctgttagtgatattattagatcacgggcaggtgcttctttcatacttatgggactctcttggatcttatcgggtcttattggatttatcttaggaacgttatccgctttccatcaagggaaattacttgaccgagttgtcaggtggttttcataccttcagatatcagtaccaacgttttggattggactcatttttttattaatcttttctgtccagctggggtggttcccgattggtatttcttccccgataggcactttgagtcaagatattacgttagctgatcgagttaagcaccttatgttacctgttttcacgctaagtattctaggcattgccaatgtcacccttcatacgagaactaaaatgatgtcggtgctttctagtgaatatgtcttatttgccagagcgcgtggggaaacacagtggcaaatttttaaacatcattgccttagaaatgctatcgtaccagctattacactgcatttttcctattttggagaattgtttggaggatctgttcttgctgagcaagttttctcatatcctggcttagggtctaccctcactgaagcaggacttaaaagtgatacaccgctccttctagctattgtgatgatagggacattatttgtttttgcgggcaatcttattgcggatattttaaatagcatcatcaatccacagttaaggagaaaagta

SEQ ID NO: 64 - protein, 325 aa, Streptococcus pyogenes
VKRTTIIIIWKIIRCVTLIFGVSVLTFVLLKQSPVDPVMASVNYDTSLTPAQYKAIAHHYGLDKPALVQYFIWLKNVIQGDLGTSLVYRQPVSDIIRSRAGASFILMGLSWILSGLIGFILGTLSAFHQGKLLDRVVRWFSYLQISVPTFWIGLIFLLIFSVQLGWFPIGISSPIGTLSQDITLADRVKHLMLPVFTLSILGIANVTLHTRTKMMSVLSSEYVLFARARGETQWQIFKHHCLRNAIVPAITLHFSYFGELFGGSVLAEQVFSYPGLGSTLTEAGLKSDTPLLLAIVMIGTLFVFAGNLIADILNSIINPQLRRKV

SEQ ID NO: 65 - DNA, 765 bp, Streptococcus agalactiae
ttgttagtgattagtgccatttttgcccctattctatctagctttgatccacaatacgtagatttatcacaaaaattattggctcccaataatgttcatttgttagggactgaccaattgggtagagatgtattatctcgcttgctttatggtgctagatattcactgtttttagctattattattagcttattggaattaacgattggtatgtttgtgggtcttattgttggttggtatcaaggaaagttagaaaacctctttttatggatagctaatattattttagcttttccgagctttttgctctctcttgcaaccgtgggaatcttaggtcatggtctagggaatttaatttttgcaattgtctttgtggaatgggtttactatgctaaattaatgaccaatttagttaagagtgcaaaaaaagagccttatgtgataaatgcgcaaattatgggactttcagtctggcatattttaagaaaacatatttttccttttgtgtatcagccaatcctcgttatggtccttatgaatataggaaatattattttaatgatttctggcttttctttcttagggattggtgtgcaacctaatgtcacagaatggggaatgatgttgcacgatgctagaggatattttaggacagctacttggatgatgttatctcctggaattgcgatttttttaacagtattttcctttaatactttaggcgatgccatagataaaaaagattggaaacgacaatggaacagt

SEQ ID NO: 66 - protein, 255 aa, Streptococcus agalactiae
MLVISAIFAPILSSFDPQYVDLSQKLLAPNNVHLLGTDQLGRDVLSRLLYGARYSLFLAIIISLLELTIGMFVGLIVGWYQGKLENLFLWIANIILAFPSFLLSLATVGILGHGLGNLIFAIVFVEWVYYAKLMTNLVKSAKKEPYVINAQIMGLSVWHILRKHIFPFVYQPILVMVLMNIGNIILMISGFSFLGIGVQPNVTEWGMMLHDARGYFRTATWMMLSPGIAIFLTVFSFNTLGDAIDKKDWKRQWNS

SEQ ID NO: 67 - DNA, 819 bp, Streptococcus pyogenes
atgatattgaaacgtcgaacgatggttttatggcaactgggtatcgccatttctctcattcttagtattctagccttaaacctttatttctataggacgcctttggaaaccaatgcagctttacgcaacctcgctccttccttaaaccatctttttgggacagatggtttaggtagggatatgtttgtcagaacgattaaagggctttatttctctttacaagtcggcttattaggcgcccttatgggagtctttcttgcgaccgtttttggagtgcttgcaggtctaggaaatagccttattgataaaataatagcctggttggttgatttgtttattggtatgcctcatttgatttttatgattctcatttcttttgttgttgggaaaggggctcaaggggttatcattgcaacagctgttacccattggccctctctagcaaggcttatccgcaatgaagtctatgatctaaagaataaagcctttgtccagctctctaaaagcatgggaaaaacgccttattatattgtgaggcatcatatcctgcctttgattgcttctcaaattttcattgggtttatcctcttatttccgcacgtcatcttgcatgaagcatccatgactttcttaggatttggcctttctgccgaacaaccttcggttggtatcattttgtcagaggcagctaagcatatctctcttggcaattggtggttggtgatttttccaggcctttatcttattttggttgtcaatgcctttgatactatcggagaatctttaaagaaactcttttaccctcaaacggatcatttt

SEQ ID NO: 68 - protein, 273 aa, Streptococcus pyogenes
MILKRRTMVLWQLGIAISLILSILALNLYFYRTPLETNAALRNLAPSLNHLFGTDGLGRDMFVRTIKGLYFSLQVGLLGALMGVFLATVFGVLAGLGNSLIDKIIAWLVDLFIGMPHLIFMILISFVVGKGAQGVIIATAVTHWPSLARLIRNEVYDLKNKAFVQLSKSMGKTPYYIVRHHILPLIASQIFIGFILLFPHVILHEASMTFLGFGLSAEQPSVGIILSEAAKHISLGNWWLVIFPGLYLILVVNAFDTIGESLKKLFYPQTDHF

SEQ ID NO: 69 - DNA, 798 bp, Streptococcus agalactiae
ttggaaacgacaatggaacagttagaaataagaaaattgtcattacagataggagaggtccctgtactaagagattttagttgtaaaatagatatgggagaatcgctaactattattggtgagagtggttcagggaaaaccctcttggcaaaattattggttggtcacattccacaaggtatgacagttagaggaaacatattttttaagggagttgatttaggtaaactaactgtaaagcagtggcagaaattaaggggacgagatattgcctatttagtgcaaaatcccatgtctatgtttaatccttttcaaaaaattgaagcgcatattttggaaacaatccttagtcatgagaaatgttcaaagagagtagccttatctaaagcgttagaatggatgaaacgtttaaatttagatgatgcgatatccctgttaaaaaaatacccttttgagcttagtggaggaatgctacaaagaattatgttagccactatattatctcttgatcctcaggtaatcatattagatgagccgacctcagcggttgattgtcataattgttctactatatcagctattttgcaggaattgcaaaataatggaaaaaccttgattactgtaacgcatgattatcagttagctagagacctggggggacaattattagttataagtgagggagaagttgttgaacagggacaaacccaagctattttaagcaatcctcaacataactatacgaaagcactgacagtgcaaatggagtatgaaggagatattcttaatgttggtttg

SEQ ID NO: 70 - protein, 266 aa, Streptococcus agalactiae
METTMEQLEIRKLSLQIGEVPVLRDFSCKIDMGESLTIIGESGSGKTLLAKLLVGHIPQGMTVRGNIFFKGVDLGKLTVKQWQKLRGRDIAYLVQNPMSMFNPFQKIEAHILETILSHEKCSKRVALSKALEWMKRLNLDDAISLLKKYPFELSGGMLQRIMLATILSLDPQVIILDEPTSAVDCHNCSTISAILQELQNNGKTLITVTHDYQLARDLGGQLLVISEGEVVEQGQTQAILSNPQHNYTKALTVQMEYEGDILNVGL

SEQ ID NO: 71 - DNA, 1068 bp, Streptococcus pyogenes
atgacaaaagaaaataatgtaatcttaactgccaaagatgtggtggtagaatttgatgtgcgtgatcgtgttttaacagctatccgtaacgtctcactggaacttgttgaaggagaagtccttgcttttgtaggggaatcaggctcaggtaaatctgttttaacaaagacctttacagggatgttggagtctaatggacgcattgctaatggttcaattgtctatcgtgggcaagaattgacagatttaaaaacaaataaagagtgggcaaagattcgcggctcaaaaatcgcaacgattttccaagacccaatgaccagtcttagtcccattaaaactatcggtagccaaatcacagaagtgattattaagcaccaaaaagtaagtcatgccaaagctaaagaaatggcccttgattacatgaataaagtgggtatcccaaatgccaaaaaacgctttgaagattacccatttgagtattcaggaggaatgcgtcaacgtattgttatcgctattgctttagcttgtcgcccagatattcttatctgtgatgagccaacaacagcccttgatgtgactattcaagctcaaatcgttgagttattgaagtcgcttcaacgagaatatcatttcaccattatctttattacgcacgatttaggtgttgtggcaagcattgcagataaagtggctgtcatgtatgcaggagaaattgttgaatttggaacagtcgaagagattttctatgatccaagacacccctatacatggagtttgctgtctagcttaccgcagttggcagatgaatctggtgaactttacgctattccaggaacgcctccatcactttattcaccaattatcggagatgcctttgcacttcgctcagaatatgctatggttttagactttgaaaaagcacctccggcgattaacgtatctgagactcattgggccaaaacatggcttttacacccagaggctccaaaagttcaaaaaccagaagtcattcaagatttgcatcaaaaaatcttaagaaaaatgtcacaacaggaggaaggaaatgtc

SEQ ID NO: 72 - protein, 356 aa, Streptococcus pyogenes
MTKENNVILTAKDVVVEFDVRDRVLTAIRNVSLELVEGEVLAFVGESGSGKSVLTKTFTGMLESNGRIANGSIVYRGQELTDLKTNKEWAKIRGSKIATIFQDPMTSLSPIKTIGSQITEVIIKHQKVSHAKAKEMALDYMNKVGIPNAKKRFEDYPFEYSGGMRQRIVIAIALACRPDILICDEPTTALDVTIQAQIVELLKSLQREYHFTIIFITHDLGVVASIADKVAVMYAGEIVEFGTVEEIFYDPRHPYTWSLLSSLPQLADESGELYAIPGTPPSLYSPIIGDAFALRSEYAMVLDFEKAPPAINVSETHWAKTWLLHPEAPKVQKPEVIQDLHQKILRKMSQQEEGNV

SEQ ID NO: 73 - DNA, 696 bp, Streptococcus agalactiae
atgaaggagatattcttaatgttggtttgtaatcatgtcggaaaaacatttggacgacaagaggttttaaaggactgtcattttcatcttaaaagaggagaaataattggtataatgggtaaaagtggcagtggtaaaagtagccttgcccgactcattataggactagatagtcctacttgtggttcgatatattttcaaggaaaaatttacacacctaaagatggtaaggcgcagattatccttgtttttcaagatgcgcttagttcggtcaatccatattttagtattgaggaaattttgaatgaagctttttatggaaaaaaaacaacttttgaattatgtcaaatattagaagcggtgggtttagatggaacttatctaaaatataaagctagacaacttagtggtggtcagctacagagagtttgtatcgctagagctttactcttaaagcctaaaattattatttttgatgaatccttaagtggattagacccagtaactcaaattaaaatgctacgtttattacaaaaaataaaacgccgttatgaattaagttttataatgatttctcatgaccctaaaatttgtcaagctatctgtaaccgggtctttctgataaaaaatggttatttagtagaagataatgaattcttgaagagagcgtgttctactaactgtttgaccaatctc

SEQ ID NO: 74 - protein, 232 aa, Streptococcus agalactiae
MKEIFLMLVCNHVGKTFGRQEVLKDCHFHLKRGEIIGIMGKSGSGKSSLARLIIGLDSPTCGSIYFQGKIYTPKDGKAQIILVFQDALSSVNPYFSIEEILNEAFYGKKTTFELCQILEAVGLDGTYLKYKARQLSGGQLQRVCIARALLLKPKIIIFDESLSGLDPVTQIKMLRLLQKIKRRYELSFIMISHDPKICQAICNRVFLIKNGYLVEDNEFLKRACSTNCLTNL

SEQ ID NO: 75 - DNA, 1062 bp, Streptococcus pyogenes
atgaatgaagcaataattcaattagatcatattgatattaccttccgtcaaaaaaaacgggttatcgaagctgttaaagatgtcacggttcatatcaatcaaggagatatttatggcattgttgggtattcaggtgccgggaaatcaactcttgtgcgtgtgattaacctgctacaggcaccaacaaacgggaaaatcactgttgatggggatgtgacttttgaccaggggaaaattcaattgtcagctgatgcccttcgccaaaaacgacgtgatattggtatgatcttccaacatttcaatttgatggcccaaaaaacagccaaagaaaatgtagcatttgcgctccgtcattcgtcgttaagtaagactgagaaagaacacaaagttatcgaactgctagaacttgtaggtttatcagagcgagcagataactaccctgcccagttatcgggtgggcaaaaacaaagggtggctattgcgcgtgctctagctaacgatccaaaaattttgatttcagatgaggccacatcagcactagatccaaaaaccactaaacaaattttggcgctcttgcaagaattaaaccgcaaacttggccttaccattgttatgattactcatgaaatgcaaattgttaaggatatttgtaatcgtgttgctgttatgcaaaatggtgttttgattgaagaaggttctgtccttgatatcttttcaaatccaaaagaagccttgacacaggaatttatcacaacagctacagggattgatgaggctttagaaaaaattaaccaacaagacattgttaaacatttgcctgcaaatgcccttctagctcagttgaaatatgcaggaacttctacggatgagcctctacttaatagcatttaccgtcagtttgaagtgacagctaatattttgtatggcaatattgagattttagatcatattccagttggtgacatgattgttgtcttggaagggcaagctgaaaatattcttgcggctgagaaagccttgcatgaagctggtgttgatgttagtattttaaagagaggagcc

SEQ ID NO: 76 - protein, 354 aa, Streptococcus pyogenes
MNEAIIQLDHIDITFRQKKRVIEAVKDVTVHINQGDIYGIVGYSGAGKSTLVRVINLLQAPTNGKITVDGDVTFDQGKIQLSADALRQKRRDIGMIFQHFNLMAQKTAKENVAFALRHSSLSKTEKEHKVIELLELVGLSERADNYPAQLSGGQKQRVAIARALANDPKILISDEATSALDPKTTKQILALLQELNRKLGLTIVMITHEMQIVKDICNRVAVMQNGVLIEEGSVLDIFSNPKEALTQEFITTATGIDEALEKINQQDIVKHLPANALLAQLKYAGTSTDEPLLNSIYRQFEVTANILYGNIEILDHIPVGDMIVVLEGQAENILAAEKALHEAGVDVSILKRGA

SEQ ID NO: 77 - DNA, 726 bp, Streptococcus agalactiae
gtggaacctaaatatcaacgtatattaattaagttatctggtgaagcattggcgggagataagggtgtcggtattgacattcctaccgttcaatctattgcaaaagaaattgccgaagtacacaattcaggtgttcaaatagcgcttgtcattggtggaggtaatctttggcgtggagaacctgcagcagaagcagggatggatcgtgttcaagctgattatacagggatgttagggacagtaatgaatgctcttgtaatggctgatagccttcaacaatatggggtagatactagagttcaaacagctattccaatgcaaactgttgctgagccttacgtacgtggtcgtgctttacgtcatctagagaagaatcgtattgttgtctttggagcgggtattggttcgccttatttctcaactgatacaacagcagcgcttcgtgctgctgagattgaggcagaagcaattttaatggctaaaaatggagtagatggtgtttataatgctgatccaaagaaagatgccaatgctgtcaaatttgatgaattaactcacgttgaagtaataaaacgagggttaaaaatcatggatgcaaccgcatcaactatttcaatggataatgatattgaccttgttgttttcaatatgaatgagactggtaatattaagcgtgttgttcttggagaacaaatcggaacaactgtttcaaacaaagcatctgaa

SEQ ID NO: 78 - protein, 242 aa, Streptococcus agalactiae
MEPKYQRILIKLSGEALAGDKGVGIDIPTVQSIAKEIAEVHNSGVQIALVIGGGNLWRGEPAAEAGMDRVQADYTGMLGTVMNALVMADSLQQYGVDTRVQTAIPMQTVAEPYVRGRALRHLEKNRIVVFGAGIGSPYFSTDTTAALRAAEIEAEAILMAKNGVDGVYNADPKKDANAVKFDELTHVEVIKRGLKIMDATASTISMDNDIDLVVFNMNETGNIKRVVLGEQIGTTVSNKASE

SEQ ID NO: 79 - DNA, 726 bp, Streptococcus pyogenes
gtggaacctaaatatcaacgtatattaattaagttatctggtgaagcattagcaggtgaaaaaggagttggcattgacattccaactgttcaggctattgcaaaagaaattgccgaagttcatgtgtcgggagtacagatcgctcttgttattggtggaggcaatctctggcgtggagagcctgcagcagacgctggaatggaccgtgttcaggctgattacactggcatgcttggaacggtgatgaatgccctagtcatggctgatagtcttcaacattatggtgttgatacccgtgtgcaaacagctattcctatgcaaaatgtagcagaaccttatattcgcggacgtgccttgcgccatctagaaaaaaatcggattgttgtttttggagctggtattggctcgccttatttttcaacagacaccaccgcggcactgcgtgctgctgagattgaagcagatgctattttaatggcaaaaaatggtgtggatggggtctataatgctgatcctaaaaaagatgctaatgcggttaaatttgatgaattaacacatggtgaagtgatcaaacgtggtctcaaaatcatggatgcaacggcatcgaccttatcgatggataacgatattgatttggtggttttcaatatgaatgaagctggcaatattcaacgtgttgtctttggagaacatattggaactactgtatcaaataaagtttgtgac

SEQ ID NO: 80 - protein, 242 aa, Streptococcus pyogenes
VEPKYQRILIKLSGEALAGEKGVGIDIPTVQAIAKEIAEVHVSGVQIALVIGGGNLWRGEPAADAGMDRVQADYTGMLGTVMNALVMADSLQHYGVDTRVQTAIPMQNVAEPYIRGRALRHLEKNRIVVFGAGIGSPYFSTDTTAALRAAEIEADAILMAKNGVDGVYNADPKKDANAVKFDELTHGEVIKRGLKIMDATASTLSMDNDIDLVVFNMNEAGNIQRVVFGEHIGTTVSNKVCD

SEQ ID NO: 81 - DNA, 93 bp, Streptococcus agalactiae
ttgattgatgatttatcaaatggtgaaattaaaagaacacgagcttcaggtacagtaatagaagctaattggttaaggggggttggcgctcca

SEQ ID NO: 82 - protein, 31 aa, Streptococcus agalactiae
MIDDLSNGEIKRTRASGTVIEANWLRGVGAP

SEQ ID NO: 83 - DNA, 555 bp, Streptococcus agalactiae
atgactaaggaaatcgttacaaaagctcaagagcgttttgagcaatcacaccaaagtttatcaagagaatttgcagggattcgtgcaggacgtgctaatgctagcttgcttgatcgtattcaagttgagtattatggagcgccaaccccccttaaccaattagcttctattactgtacctgaagctcgtgttcttttaatttcaccatttgataaatcatcaatcaaagatattgagcgtgctattaacgaatcagatttaggtattaatcctgcaaatgatggttcagttattcgtcttgttattccagctttgacagaagaaacacgtcgtgatttagctaaagaagtgaaaaaagtcggagaaaatgctaagattgctatccgtaatattcgccgtgatgctatggatgaagctaagaagcaagaaaagaataaagaaattacagaagatgacttgaaatctcttgaaaaagatattcaaaaggctactgatgatgctgtaaaacatattgatgagatgactgctaataaagaaaaagaattgttggaagtt

SEQ ID NO: 84 - protein, 185 aa, Streptococcus agalactiae
MTKEIVTKAQERFEQSHQSLSREFAGIRAGRANASLLDRIQVEYYGAPTPLNQLASITVPEARVLLISPFDKSSIKDIERAINESDLGINPANDGSVIRLVIPALTEETRRDLAKEVKKVGENAKIAIRNIRRDAMDEAKKQEKNKEITEDDLKSLEKDIQKATDDAVKHIDEMTANKEKELLEV

SEQ ID NO: 85 - DNA, 555 bp, Streptococcus pyogenes
atggcaaatgcaattattgaaactgcaaaagaacgttttgcacaatcccatcagtctttatcacgtgaatatgccagcattcgtgcgggtcgtgccaacgctagtcttttagaccgtatccaagttgattattacggggcaccgacaccattaaatcaattggcttcaatcactgtaccagaagcgcgtgtcttattgatctcgccttttgataaatcttctatcaaagatatcgagcgcgctcttaacgcatcagatttaggcattacacctgctaacgatggctctgtcattcgtttggttattccagctttgaccgaagaaacacgtaaagaattagccaaagaagtgaaaaaagttggtgaaaatgctaaaattgcaatccgtaatatccgccgcgatgctatggatgatgctaaaaagcaagaaaaagcaaaagaaatcactgaagatgagttaaaaacacttgagaaagatatccaaaaagcaaccgatgatgctatcaaagaaattgaccgcatgacggctgaaaaagaaaaagaattgctctcagtg

SEQ ID NO: 86 - protein, 185 aa, Streptococcus pyogenes
MANAIIETAKERFAQSHQSLSREYASIRAGRANASLLDRIQVDYYGAPTPLNQLASITVPEARVLLISPFDKSSIKDIERALNASDLGITPANDGSVIRLVIPALTEETRKELAKEVKKVGENAKIAIRNIRRDAMDDAKKQEKAKEITEDELKTLEKDIQKATDDAIKEIDRMTAEKEKELLSV

SEQ ID NO: 87 - DNA, 942 bp, Streptococcus agalactiae
ttggcaagtaataaaatgattatggaggtaactgatagaatcaaaaccagatggatttggtttgtcggttacctttttaaaaggagaaaaatgaatacattattagcgacagtcataacaggcttagtaactgatgaaaacaaagatttttactttatccaaaaagatggctttacctttgcattatcaaagtcagaaggagagcatcacattggtgaaatggttaaaggattcgcctatacagatatgcaacaaaaagcacgtcttacaactaaagaaacatttgcgactcgagatcattatggttgggggacagttactgaggtacgtaaagacttgggagtatttcttgatactggtcttccagataagcaagtggttgtttctttggatgttcttcctgaattgaaagaactttggcctaaaaaaggtgatcgcctctacgtttgcttagatgttgataaaaaagatcgtctctgggctctccctgcagatcctgaagtgtttcaacgaatggcaacccctgcatataacaatatgcaaaatcaaaattggccagcaatcgtttatcgcttaaaattgtcaggaacttttgtttatctaccagaaaataatatgctcggctttattcaccctagtgaacgttacagtgaacctcgtttagggcaagtgctggatgcacgagttattggcttcagagaagttgatagaaccttaaatttatcattaaagcctcgttcttttgaaatgttagaaaatgacgcacaaatgattttaacgtatttagaaagtaacggaggattcatgactttaaatgataaatcttctccagaggaaattaaagctacttttggaatttccaaaggtcagtttaaaaaagcacttggaggactcatgaaagctaaaaagatcaaacaagatcagctaggtacagaattatta

SEQ ID NO: 88 - protein, 314 aa, Streptococcus agalactiae
MASNKMIMEVTDRIKTRWIWFVGYLFKRRKMNTLLATVITGLVTDENKDFYFIQKDGFTFALSKSEGEHHIGEMVKGFAYTDMQQKARLTTKETFATRDHYGWGTVTEVRKDLGVFLDTGLPDKQVVVSLDVLPELKELWPKKGDRLYVCLDVDKKDRLWALPADPEVFQRMATPAYNNMQNQNWPAIVYRLKLSGTFVYLPENNMLGFIHPSERYSEPRLGQVLDARVIGFREVDRTLNLSLKPRSFEMLENDAQMILTYLESNGGFMTLNDKSSPEEIKATFGISKGQFKKALGGLMKAKKIKQDQLGTELL

SEQ ID NO: 89 - DNA, 855 bp, Streptococcus pyogenes
atgaatgatttactagcaacagtcattactgggcttattaaagaagaaaacgctaatgactattttatccacaaagaagggtttacctttaccttgtctaaagcagaaggagaacgccagattggtgatatggtcacaggctttgcctatacagacatagagcaaaaggcacgtctcacaaccaaagagatccgttcaacacggacaagttatggctggggggaagtgacagaggttcgtcgtgacctaggcgtttttgtcgatacaggaattccaaataaagaaattgtggtttctttggacgtgttgcctgagatgaaagaactatggcctaaaaaaggggataaactttacattcgtttggatgtggataaaaaagaccgtatttggggacttccagcagagcctgaggtctttcaaaagatggctagccctgcttacaataacatgcaaaatcaacattggccagcaattgtttaccgcctaaaattaacaggaacgtttgtttacctgcctgaaaacaacatgttgggctttattcactcaagtgaacgctacgcagaaccgcgcttaggtcaggttttagatgcccgtgtgattgggtttagagaggtcgatcgtaccttgaatttatcgttgaaaccacgttcttttgagatgttggagaatgacgctcagatgattgttacttatctggaagccaatggtggtttcatgactttaaatgacaaatcaagtccagaagagattaaagcaagctttggtatttcaaaaggccagtttaaaaaagccttgggtggattgatgaaagctaaacgtatcaaacaagacgccacaggaactgaattaatagga

SEQ ID NO: 90 - protein, 285 aa, Streptococcus pyogenes
MNDLLATVITGLIKEENANDYFIHKEGFTFTLSKAEGERQIGDMVTGFAYTDIEQKARLTTKEIRSTRTSYGWGEVTEVRRDLGVFVDTGIPNKEIVVSLDVLPEMKELWPKKGDKLYIRLDVDKKDRIWGLPAEPEVFQKMASPAYNNMQNQHWPAIVYRLKLTGTFVYLPENNMLGFIHSSERYAEPRLGQVLDARVIGFREVDRTLNLSLKPRSFEMLENDAQMIVTYLEANGGFMTLNDKSSPEEIKASFGISKGQFKKALGGLMKAKRIKQDATGTELIG

SEQ ID NO: 91 - DNA, 555 bp, Streptococcus agalactiae
ttggctttttttgttataatgtatctattaaaaagaatggagaacgatatggaacgtgcgatttttgctggaggttgtttttggtgtatggtacaaccatttgaagaattagatggtattgaatctgttttatctggatacactggaggacatgttgagaatccaacttataaagaagtttgtagtaaaactactggacatacagaagctgttgaaattatttttaatcctgaaaaaatctcttatgcagatttagttgagttatattgggcacaaacagatccaacagacgcttttggtcagtttgaagatcgtggggataattatcgtcctgtcatcttttatgagaatgaagagcaacgtcagattgctcaaaaatcaaaagataagctacaagcttcgggtagatttgatagaccaattgtaaccagcattgagcctgctgatactttttacccagcagaagactatcatcaagcattctatcggactaaccctgctcgttacgccttgagtagtgccagaagacatgcatttctagaggagaactggcat

SEQ ID NO: 92 - protein, 185 aa, Streptococcus agalactiae
MAFFVIMYLLKRMENDMERAIFAGGCFWCMVQPFEELDGIESVLSGYTGGHVENPTYKEVCSKTTGHTEAVEIIFNPEKISYADLVELYWAQTDPTDAFGQFEDRGDNYRPVIFYENEEQRQIAQKSKDKLQASGRFDRPIVTSIEPADTFYPAEDYHQAFYRTNPARYALSSARRHAFLEENWH

SEQ ID NO: 93 - DNA, 507 bp, Streptococcus pyogenes
atggaaagagccatttttgcaggaggttgtttctggtgtatggtgcaaccttttgaggagcaagcaggtattttgtcagtcagaagtggctacacaggtgggcatctcccaaatcctagctatgaacaagtttgtgccaaaacaacaggacatacagaagctgttgaaattatttttgaccctaagcaaatcgcttataaagatttggtagagctctattggacgcagacggatccaacagacgcctttgggcaatttgaagatcgtggggacaactaccgtcctgtcatttactacacaacggaaagacaaaaagaaattgcagagcaatcaaaagcaaacttgcaagcttcaggacgttttgaccaacccattgtcaccactattgaaccagcagagccattttatctcgcagaggattatcaccaaggattttataaaaagaatcccaagcggtatgcacaaagcagtgctattcgtcatcagtttttagaggagaattggtca

SEQ ID NO: 94 - protein, 169 aa, Streptococcus pyogenes
MERAIFAGGCFWCMVQPFEEQAGILSVRSGYTGGHLPNPSYEQVCAKTTGHTEAVEIIFDPKQIAYKDLVELYWTQTDPTDAFGQFEDRGDNYRPVIYYTTERQKEIAEQSKANLQASGRFDQPIVTTIEPAEPFYLAEDYHQGFYKKNPKRYAQSSAIRHQFLEENWS

SEQ ID NO: 95 - DNA, 213 bp, Streptococcus agalactiae
ttgagaaaatcattttacagttggttgatgacacaaagaaatccaaaatcaaatgaaccagtagcaatcctagcagattacgcttttgatgaaaccacttttccaaaacatagttcggattttgaaacagttagtcgctatttagaagatgaggccagtttttcctttaatttaacagattttgatgatatttgggaagattatctcaatcat

SEQ ID NO: 96 - protein, 71 aa, Streptococcus agalactiae
MRKSFYSWLMTQRNPKSNEPVAILADYAFDETTFPKHSSDFETVSRYLEDEASFSFNLTDFDDIWEDYLNH

SEQ ID NO: 97 - DNA, 219 bp, Streptococcus pyogenes
ttggtcatgagaaaatcattttacagctggctgatgacacaacgtaaccctaaatcaaatgaacctgtggcgattttagcagatttggtgtttgatgacaccacttttccaaagcataccaatgattttgaactcattagtcggtatctagaagatcaagctagtttttcctttaatttaggtcaatttgatgaaatctgggaagattatctagcacat

SEQ ID NO: 98 - protein, 73 aa, Streptococcus pyogenes
LVMRKSFYSWLMTQRNPKSNEPVAILADLVFDDTTFPKHTNDFELISRYLEDQASFSFNLGQFDEIWEDYLAH

SEQ ID NO: 99 - DNA, 1776 bp, Streptococcus agalactiae
ttgtttatgagatatacaaatggaaattttgaagcctttgcaagacctcgaaaacctgaaggtgtggataaaaaatccgcttatattgttggttctggtttagcaggattagctgccgctgtctttttaatacgtgacggtcaaatggatggtcaacgtattcatatttttgaagaactacctctttctggaggatcacttgacggtgtcaaacgacctgatatcggttttgtaacgcgtggtggtcgtgaaatggaaaatcacttcgaatgtatgtgggatatgtaccgttccatcccctctctcgaagttccagatgcttcttatctagatgaattttattggcttgacaaggatgatcccaattcatctaactgtcgcctcattcataaacaggggaatcgcttagaatctgatggtgattttacactcggaacacattccaaagagttagttaagctagtcatggagactgaagagtctttaggtgctaagacgattgaagaagttttttcaaaagaattttttgaaagtaatttttggacttattggggtactatgtttgcctttgagaaatggcattcagcgattgaaatgcgtcgatatgctatgcgctttatccatcatattggtggtctgcctgatttcacttcattaaaatttaataaatataatcaatatgattctatggtgaaaccaatcatcagttatttagagtctcataatgtagatgttcaatttgatagcaaggtaactaatatctccgtagactttaagaacggtcagaagcttgcaaaagctattcatctcacagttggtggtgaagcaaaaacaattgatcttactccaaatgattttgtttttgtaacgaatggttctatcactgaaagtacgaactatggtagtcatgatactgtagctaaacctaataccgatttgggaggttcttggaatctttgggaaaacttagctgctcaatctgatgaatttggacatcctaaagtcttctacaaagatattccaaaagagtcatggtttgtttctgctactgcaacaataaaagatccagctattgaaccttatatagagcgtttaacacatcgtgacctccatgatggtaaagtaaataccggaggcattgttacagttacagattctaattggatgatgagttttgctatccatcgccaaccgcatttcaaagagcaaaaggaaaatgaaacaattgtttggatttatggactctattcaaatgtggaaggtaattatattaaaaaaccaattgaagaatgtactggtcgagaaatcacagaagagtggttatatcacttaggtgttcctgaaatgaagattcatgatttatctgataaacaatatgtaagtacagttcctgtttatatgccttacattactagttatttcatgcctcgagttaaaggtgaccgaccagatgttatcccacaaggatctgttaacctagccttcattggtaattttgcagaatctccatccagagatacagtatttacaacggaatattctattagaactgctatggaagctgtttatactttcttaaatattgaacgtggtgttccagaagtctttaattcagcatttgatattcgtgtcttgttgcaatctttatactatctcaatgataagaaatctgttgaagatatggatttaccaatacctgccttaatgcgtaaagtaggcatgaaaaaaattagaggaacttatttagaagaattacttcgagaagctcatctttta

SEQ ID NO: 100 - protein, 592 aa, Streptococcus agalactiae
MFMRYTNGNFEAFARPRKPEGVDKKSAYIVGSGLAGLAAAVFLIRDGQMDGQRIHIFEELPLSGGSLDGVKRPDIGFVTRGGREMENHFECMWDMYRSIPSLEVPDASYLDEFYWLDKDDPNSSNCRLIHKQGNRLESDGDFTLGTHSKELVKLVMETEESLGAKTIEEVFSKEFFESNFWTYWGTMFAFEKWHSAIEMRRYAMRFIHHIGGLPDFTSLKFNKYNQYDSMVKPIISYLESHNVDVQFDSKVTNISVDFKNGQKLAKAIHLTVGGEAKTIDLTPNDFVFVTNGSITESTNYGSHDTVAKPNTDLGGSWNLWENLAAQSDEFGHPKVFYKDIPKESWFVSATATIKDPAIEPYIERLTHRDLHDGKVNTGGIVTVTDSNWMMSFAIHRQPHFKEQKENETIVWIYGLYSNVEGNYIKKPIEECTGREITEEWLYHLGVPEMKIHDLSDKQYVSTVPVYMPYITSYFMPRVKGDRPDVIPQGSVNLAFIGNFAESPSRDTVFTTEYSIRTAMEAVYTFLNIERGVPEVFNSAFDIRVLLQSLYYLNDKKSVEDMDLPIPALMRKVGMKKIRGTYLEELLREAHLL

SEQ ID NO: 101 - DNA, 1812 bp, Streptococcus pyogenes
gtgatgatatcactttgcttgactattcaaggaggtcttgaaatgtattatactagtggtaattacgaagcttttgcaacacctcgaaaacccgaaggggtagatcagaaatcagcttatattgttggtactggtttagctggtttagcagcagctgttttccttattcgcgatgggcatatggctggggaacgcattcatctgtttgaggaattgcctttagcaggtggttctttagatggtattgaaaagcctcatcttggttttgtgacccgtggtggtcgtgagatggaaaatcattttgagtgtatgtgggacatgtatcggtctattccctcactggaaattcccggtgcgtcttatttagatgaattttattggttggataaggatgatcctaactcatccaactgtcgtttgattcacaagagaggaaatcgtgtggatgatgacggccagtatacgctcggtaaacagtcaaaagaattaatccatttaatcatgaagacagaagaatctctaggagaccaaaccattgaagagttcttctcagaagatttctttaagagtaatttttgggtgtattgggcaaccatgtttgcttttgaaaaatggcattctgctgtagaaatgcgacgctatgcgatgaggtttatccaccatattgatggtttgccagatttcacctccctcaagttcaacaaatataaccaatatgactctatggtcaaaccgattattgcttacctagaatcacacgacgttgacatccaatttgacacaaaagtcactgatattcaggtggagcaaacagctggtaaaaaggtagcaaaaaccatccatatgacggtgtctggggaggctaaggcgattgagctaacacctgatgatttggtttttgtgaccaatggttctattactgaaagcagcacatacggtagtcatcacgaagtggctaagccaaccaaagcgttaggtggttcttggaatttatgggaaaatctagctgctcaatcagatgattttggtcatcctaaagtgttttaccaggacttgcctgctgaaagctggtttgtgtctgctacagcaaccataaaacacccagctatcgagccttatatagaacgtttgacccaccgtgacttgcacgatggcaaagtgaacactggcggcatcatcactattacagattctaactggatgatgagctttgccattcaccgtcaacctcattttaaagaacaaaaagaaaatgagaccactgtctggatttacggtctttattccaatagtgagggcaattacgtccacaagaaaattgaggagtgtacaggtcaagaaatcacagaagaatggttgtaccaccttggggtacctgttgataaaatcaaggacttagcgagtcaggactatatcaatacagttcctgtttacatgccttatattacgagttactttatgccacgcgtcaaaggagaccgtccgaaagttatcccagatggttcagtcaacttggcctttattggtaactttgcggaatctccatctcgagatacggtctttacgactgagtattctattcgtactgccatggaagcagtgtatagcttcttgaatgtggaacgaggcatcccagaagtctttaattcagcctatgatattcgtgaattgctcaaagccttttattaccttaatgataaaaaggcaatcaaggatatggatttgccaattcctgcactgattgagaaaatcggacataaaaaaatcaaggatacctttatcgaagaattgctcaaagatgctaatcttatg

SEQ ID NO: 102 - protein, 604 aa, Streptococcus pyogenes
VMISLCLTIQGGLEMYYTSGNYEAFATPRKPEGVDQKSAYIVGTGLAGLAAAVFLIRDGHMAGERIHLFEELPLAGGSLDGIEKPHLGFVTRGGREMENHFECMWDMYRSIPSLEIPGASYLDEFYWLDKDDPNSSNCRLIHKRGNRVDDDGQYTLGKQSKELIHLIMKTEESLGDQTIEEFFSEDFFKSNFWVYWATMFAFEKWHSAVEMRRYAMRFIHHIDGLPDFTSLKFNKYNQYDSMVKPIIAYLESHDVDIQFDTKVTDIQVEQTAGKKVAKTIHMTVSGEAKAIELTPDDLVFVTNGSITESSTYGSHHEVAKPTKALGGSWNLWENLAAQSDDFGHPKVFYQDLPAESWFVSATATIKHPAIEPYIERLTHRDLHDGKVNTGGIITITDSNWMMSFAIHRQPHFKEQKENETTVWIYGLYSNSEGNYVHKKIEECTGQEITEEWLYHLGVPVDKIKDLASQDYINTVPVYMPYITSYFMPRVKGDRPKVIPDGSVNLAFIGNFAESPSRDTVFTTEYSIRTAMEAVYSFLNVERGIPEVFNSAYDIRELLKAFYYLNDKKAIKDMDLPIPALIEKIGHKKIKDTFIEELLKDANLM

SEQ ID NO: 103 - DNA, 1035 bp, Streptococcus agalactiae
atgaaattttgttataatgtagtcacttactgtacgaaaaggaagaataatttgcaagaatactctatcgaaattactttacaacatccagatgatatgatgtcactctttggcagcaatgagcgccatttaaaattaatcgaagaaaatttagatgttatcattcatgctagaactgaacgtgttcaggtattaggtgactctgaagaagcagtagaaaccgctcggttaaccattgaagcattattagtgcttgttaaccgcgggatgactgtgaatacttcagatgttgtaacagccttatccatggcacaaaatggttcaattgataaattcgttgccctttatgaggaagaaattattaaggatagctatggtaagcctatccgtgttaagactttagggcaaaaaatatacgttgatagcgttaaaaatcatgatgttgtttttggtattgggcctgctggaacgggaaaaacttttttagcagtcactctagcagtaacggcactaaagcgtggtcaagttaaacgaataatcttaacgagaccagcggttgaagctggtgaaagccttggtttcttgcctggagatctcaaagagaaagttgatccttatttgagaccagtttatgatgccctatatcaaattttaggtaaagagcaaacaagtcgcttaatggagcgtgaaatcatcgaaattgctccattggcttacatgcgtggtcgtactttagatgatgcatttgtcatattagatgaagcgcaaaacaccactataatgcaaatgaaaatgttcctaacacgtcttggcttcaattctaaaatgattgtaaatggcgatgttagccaaattgacttaccaaagaatgttaaatctggtttgattgatgctgttgagaaattacgaaatatcaaaaagattgactttattcatttatcagcaaaggatgttgtaagacaccctgtcgttgctgaaataataaatgcttattcagattcagaaagtagtcacaagctacaatctgataaggac

SEQ ID NO: 104 - protein, 345 aa, Streptococcus agalactiae
MKFCYNVVTYCTKRKNNLQEYSIEITLQHPDDMMSLFGSNERHLKLIEENLDVIIHARTERVQVLGDSEEAVETARLTIEALLVLVNRGMTVNTSDVVTALSMAQNGSIDKFVALYEEEIIKDSYGKPIRVKTLGQKIYVDSVKNHDVVFGIGPAGTGKTFLAVTLAVTALKRGQVKRIILTRPAVEAGESLGFLPGDLKEKVDPYLRPVYDALYQILGKEQTSRLMEREIIEIAPLAYMRGRTLDDAFVILDEAQNTTIMQMKMFLTRLGFNSKMIVNGDVSQIDLPKNVKSGLIDAVEKLRNIKKIDFIHLSAKDVVRHPVVAEIINAYSDSESSHKLQSDKD

SEQ ID NO: 105 - DNA, 1050 bp, Streptococcus pyogenes
ttgcaagagtattctattgacattaccttaacccatcctgatgatgttttagctctttttggtagcaacgagcgtcatttgaagctaatagaagctcatttaggagttattgttcacgcaagaaccgagcgagtccaagtgattggtgatgatgaagaagctgtggaattggctcgattgaccatcaaagccctactggttctagtgggtcgtggcatggtggtcaacacatcagatgtggtgacagctttatctatggcagaatctcatcagattgaccaatttatggcgctttatgaagaagaaatcattaaagataactatggtaaggcaatacgagtcaaaacattaggtcaaaaaacctatgttgatagtgtcaaacgtcatgatgtggtttttggtgtaggacctgcagggacaggtaaaaccttcttagctgttacgcttgcagtcactgctctgaaaagaggacaggtaaagcgtattattttgacgcgtcctgcggtagaagctggcgaaagcctaggttttttaccaggcgatttgaaagaaaaggtggatccttacctcagacctgtttacgatgccctttatcacattttaggcaaggaacaaaccacacgcctgatggaacgagatgtgattgagattgctccgttagcttatatgcgaggtcgtactctggatgacgcttttgttatcttagatgaggctcaaaacacgaccatcatgcaaatgaagatgtttttgacccgtcttggttttaattctaaaatgattgtcaatggagatacgagtcagattgacctccctcgaaatgtcaagtctggtttgattgatgctactcagaaattacaaggcattaaacagattgattttgtctatttctctgctaaggatgttgtccgacatcctgttgtggctgatattatcaaggcttatgaaacgtcctcagaggagatgaaggacttactaaaacctaaggctagtgacgttgaagctgattaccagccaggcttgacaaaataccctgtgatcggtcaagagcac

SEQ ID NO: 106 - protein, 350 aa, Streptococcus pyogenes
LQEYSIDITLTHPDDVLALFGSNERHLKLIEAHLGVIVHARTERVQVIGDDEEAVELARLTIKALLVLVGRGMVVNTSDVVTALSMAESHQIDQFMALYEEEIIKDNYGKAIRVKTLGQKTYVDSVKRHDVVFGVGPAGTGKTFLAVTLAVTALKRGQVKRIILTRPAVEAGESLGFLPGDLKEKVDPYLRPVYDALYHILGKEQTTRLMERDVIEIAPLAYMRGRTLDDAFVILDEAQNTTIMQMKMFLTRLGFNSKMIVNGDTSQIDLPRNVKSGLIDATQKLQGIKQIDFVYFSAKDVVRHPVVADIIKAYETSSEEMKDLLKPKASDVEADYQPGLTKYPVIGQEH

SEQ ID NO: 107 - DNA, 801 bp, Streptococcus agalactiae
atggaccatttcacaaaactctggcaagatttctctaaacttccaaatgttgttgctatagcactcggaggctcacgctctggtgacagttttgaccaatcttccgattatgatttgtatgtttattgtgcagcaactcctgatatcactagtcgtaaacgtatccttaacaagcactgtcattacattgaacttaacaatcattactgggagcttgaagataatggtactttaaacgacggaactgatattgatattctctatcgtaacatagataactttttatcagacttagaagatgtcgttgaacaccacaattctcgaattggatacactacttgtttttggcataacctcatcaattgccaaatactctatgatcctgaaaatcaattacaatcactcaaagagagattcgaagtttcttatcccagtcagttacaaaaacaaattatcattcaaaatcgtaacttattaactggcaagcttccctcttacgataaacaaattataaaagcccttaaacgccaagactttgttagtactcaccatagaactactgctttcttagattcctactttgatattatttttgcacttaataagttgacacatcctggcgaaaaaagaatgatttcctatgctaagaagaatgctacattgcttcctaaacatttcgaagaaaatatcattaaactatgtcatcacaactccaacgaacacactgttaaagaaacattaaacgatataataatgcatctcgacgtcatgcttaaagaaaattttcaacactttataggt

SEQ ID NO: 108 - protein, 267 aa, Streptococcus agalactiae
MDHFTKLWQDFSKLPNVVAIALGGSRSGDSFDQSSDYDLYVYCAATPDITSRKRILNKHCHYIELNNHYWELEDNGTLNDGTDIDILYRNIDNFLSDLEDVVEHHNSRIGYTTCFWHNLINCQILYDPENQLQSLKERFEVSYPSQLQKQIIIQNRNLLTGKLPSYDKQIIKALKRQDFVSTHHRTTAFLDSYFDIIFALNKLTHPGEKRMISYAKKNATLLPKHFEENIIKLCHHNSNEHTVKETLNDIIMHLDVMLKENFQHFIG

SEQ ID NO: 109 - DNA, 474 bp, Streptococcus agalactiae
atgaaacaagattatatttcctacattaggtcaaaagttggacatgagactatctttttaacatattctggtggtattttgacagatggtaagggacgtgtcttactccaattaagagctgataagaattcttggggaattattggtggatgtatggagttaggtgagtcatcagtagatacattgaaaagagaatttttcgaagaaactggattgagagtggaaccaatcagactgttaaatgtttatactaactttcaagactcttatcccaatggcgataaagcacaaaccgtcggttttatttatgaagtaagctgtccaaaaccagttaatatagaaggttttcataatgaggaaacattgcaattggactatttttctaaagaagacgtcaaaaatattacgatcgtaaatgaacaacaccaattaattttagatgaatatttttcacaaacattccaaatggggcgt

SEQ ID NO: 110 - protein, 158 aa, Streptococcus agalactiae
MKQDYISYIRSKVGHETIFLTYSGGILTDGKGRVLLQLRADKNSWGIIGGCMELGESSVDTLKREFFEETGLRVEPIRLLNVYTNFQDSYPNGDKAQTVGFIYEVSCPKPVNIEGFHNEETLQLDYFSKEDVKNITIVNEQHQLILDEYFSQTFQMGR

SEQ ID NO: 111 - DNA, 519 bp, Streptococcus pyogenes
ttggctataatgagaaagaatactaacatagtaaagcgagatcatatgccacaagactacatttcttatatccgctccaaagttgggcatgataagattattcttaactttgctggtgggattttgaccaatgatgacggcaaggtgctgatgcagctgcgtggtgataagaaaacctggactattcctggtggcactatggaactgggtgagagctctttagagacttgcaaacgtgagttcttagaggaaaccggaattgaggttgaagctgttcgcttactgaatgtttacactcattttgaggaagtttatcccaacggtgatgctgttcagactattgtctttatctatgaactaacggctgtttctgatatggctattgataactttcataatgaggaaacgctcaagttacaatttttctctcatgaggagatagcagagttagagagtgtctcagccaaacatcgcctgatgttagaggaatattttagtgatagctttgctatggggcat

SEQ ID NO: 112 - protein, 173 aa, Streptococcus pyogenes
LAIMRKNTNIVKRDHMPQDYISYIRSKVGHDKIILNFAGGILTNDDGKVLMQLRGDKKTWTIPGGTMELGESSLETCKREFLEETGIEVEAVRLLNVYTHFEEVYPNGDAVQTIVFIYELTAVSDMAIDNFHNEETLKLQFFSHEEIAELESVSAKHRLMLEEYFSDSFAMGH

SEQ ID NO: 113 - DNA, 117 bp, Streptococcus agalactiae
gtgactgtttttttagaaagcataagaagtacagaaaaagaaaattatggaatatttgatggtggggatatgctttacttacggtattggaatgatatacttaaagaaatccagttt

SEQ ID NO: 114 - protein, 39 aa, Streptococcus agalactiae
MTVFLESIRSTEKENYGIFDGGDMLYLRYWNDILKEIQF

SEQ ID NO: 115 - DNA, 804 bp, Streptococcus agalactiae
atgaagataacattacacggcgttgctgaaacgttattaatcaccttatatattagggctaaagatgcgatggctaaacatccgatacttaatgatcaaaaatccttagcaattgttgaacagatagaatatgattttgataaattcgataattcagaagcttctttttatgcaacattagctagaattcgcgttatggatagagaaatcaaaaaatttattagagaaaatccaaatagtcaaatcctttcaattggttgtggacttgatacaaggtttgaaagagtcgataatggacaaattaggtggtataaccttgatttgccagaggttatggagataagaaaattattttttgaagagcatgaaagagttactaatatagcaaaatcagccctagatgaaacttggacacgggaggtaaatccccaaaatgccccttttctaatcgtgtcagaaggtgttttaatgtttctaaaagaagatgacgtagagacttttcttcatatcctgacaaattcatttagccaatttatggcacaatttgatttgtgtcataaggaaatgattaataaaggaaagcaacatgatacagtaaagtatatggatacagaatttcagtttggtatcacagatggtcatgagattgtggatttagaccctaaattaaagcaaataaatctgattaactttacagatgagatgagcaaatttgagttaggcacacttcgctctttacttccaacaattcgtaaatttaataattgtttaggtgtgtacgaatataaagcatctgagaaaaag

SEQ ID NO: 116 - protein, 268 aa, Streptococcus agalactiae
MKITLHGVAETLLITLYIRAKDAMAKHPILNDQKSLAIVEQIEYDFDKFDNSEASFYATLARIRVMDREIKKFIRENPNSQILSIGCGLDTRFERVDNGQIRWYNLDLPEVMEIRKLFFEEHERVTNIAKSALDETWTREVNPQNAPFLIVSEGVLMFLKEDDVETFLHILTNSFSQFMAQFDLCHKEMINKGKQHDTVKYMDTEFQFGITDGHEIVDLDPKLKQINLINFTDEMSKFELGTLRSLLPTIRKFNNCLGVYEYKASEKK

SEQ ID NO: 117 - DNA, 495 bp, Streptococcus agalactiae
atgtacgttgaaatgattgatgaaactggacaagtttcagaagatatcaaaaagcaaactcttgatttgttagagtttgcagcacaaaaaacaggtaaagagaataaagaaatggctgtaacgtttgtcactaatgaacgtagccatgaattgaatttagagtatcgagataccgatcgtccgactgatgttatcagtttagaatataagcctgaggttgatatttcttttgatgaagaagatctggctgaaaatcctgaacttgctgagatgctagaagattttgattcttatattggtgaactttttatttctattgataaagctaaagaacaagcagaagagtacggtcactcttatgaacgtgaaatgggttttttagctgtacatggttttttgcatattaacggttatgatcattatacacccgaagaagaaaaagagatgttcagcttacaggaagaaattttaactgcttatggacttaaacgacaa

SEQ ID NO: 118 - protein, 165 aa, Streptococcus agalactiae
MYVEMIDETGQVSEDIKKQTLDLLEFAAQKTGKENKEMAVTFVTNERSHELNLEYRDTDRPTDVISLEYKPEVDISFDEEDLAENPELAEMLEDFDSYIGELFISIDKAKEQAEEYGHSYEREMGFLAVHGFLHINGYDHYTPEEEKEMFSLQEEILTAYGLKRQ

SEQ ID NO: 119 - DNA, 546 bp, Streptococcus pyogenes
gtgcccaacataccaaatgaggtgggcagcccttccctaacaattaaccttatgtatatcgagatgattgacgaaacgggacaagtttcgcaagagattatggagcaaacacttgatttgctcaattttgctgctcaaaagacgggcaaagaagaaaaagaaatgtctgtgacctttgtgaccaatgaaagaagtcatgaactcaacttagaataccgagatactgatcgtccaacagatgtgatttctctagaatataagccagaaacgcctattttatttagtcaagaggatttggctgctgatcctagtttggcagagatgatggcagagtttgatgcttatattggcgaattgtttatttctattgacaaggcgcgtgagcagtcccaagaatatgggcactcttttgagcgtgaaatgggatttttggctgttcatggattcttacatattaatgggtatgatcactacacccttgaagaagaaaaagagatgtttaccttacaggaagagattttgactgcttatggccttacacgacaa

SEQ ID NO: 120 - protein, 182 aa, Streptococcus pyogenes
VPNIPNEVGSPSLTINLMYIEMIDETGQVSQEIMEQTLDLLNFAAQKTGKEEKEMSVTFVTNERSHELNLEYRDTDRPTDVISLEYKPETPILFSQEDLAADPSLAEMMAEFDAYIGELFISIDKAREQSQEYGHSFEREMGFLAVHGFLHINGYDHYTLEEEKEMFTLQEEILTAYGLTRQ

SEQ ID NO: 121 - DNA, 708 bp, Streptococcus agalactiae
atgtcagaaaatcctgatgcctatattattcgtagtcaaaatttgcataatcaggatttcccaagtaacctcaaagctattgctagggcgggtgcaggaacaaataatattcctattgaagaggcaagtgcacagggaatagtcgtgtttaataccccaggtgcaaatgctaatgctgtaaaagaagcggtcattgctgccttattactttcagctcgtgattatttaggagctaaccgatgggttaatactctaactggaacagatattcccaaacaaattgaagcaggaaagaaagcttttgctggtaatgaaattgcaggaaaaaaattgggagttatcggccttggtgccattggagctagaattgcgaatgatgctagacgcttaggaatgacagttcttggttatgatccctatgtttcaattgaaacagcttggaatatttcaagccatgttcaaagggttaaagagattaaggatatttttgaaacttgtgactatatcacaattcatgttcccttaacaaatgaaactaagcatacttttgatgcgaaagctttttcaatcatgaaaaaaggaactacgattatcaactttgctcgtgcagaattagtcaataaccaagagctatttgaagcgatagaaactggtgttgtcaagcgctatattactgattttggagacaaagaattattaaaccaaaag

SEQ ID NO: 122 - protein, 236 aa, Streptococcus agalactiae
MSENPDAYIIRSQNLHNQDFPSNLKAIARAGAGTNNIPIEEASAQGIVVFNTPGANANAVKEAVIAALLLSARDYLGANRWVNTLTGTDIPKQIEAGKKAFAGNEIAGKKLGVIGLGAIGARIANDARRLGMTVLGYDPYVSIETAWNISSHVQRVKEIKDIFETCDYITIHVPLTNETKHTFDAKAFSIMKKGTTIINFARAELVNNQELFEAIETGVVKRYITDFGDKELLNQK

SEQ ID NO: 123 - DNA, 993 bp, Streptococcus pyogenes
ttgatgaaattaaaattatataatgttagaggcgaagaagcagtcttagcaaaaaaatgggctgatgacaatgggattgagatttccttgacggagtctcccttaactcctgaaacggttaaagaagctgaaggctttgacgggattgccaatgcccaaattggtcctttagatgatgcgatttatcctctcttaaaggaaatggggattaaacaaatcgctcagcacagtgctagtgtcgatatgtataaccttgatttggccaccgaaaatgacattattatcacaaatgttcctagctattctccagaatccattgcagaatttacggttactattgtccttaatttaattcgtcatgtggagttgattcgtgaaaatgttaaaaaacaaaatttcacttggggactccctatccgcggccgtgttttaggtgatatgacagttgcgattatcggaactggacgtattggtctagctactgctaaaatctttaaaggttttggctgcaaggtcgttggatatgatatttaccaaagcgatgctgccaaagctgtcttggactataaggaatctgtagaagaagcgattaaagatgctgatcttgtttccttacacatgccaccaactgcagagaacacacaccttttcaattctgatttatttaaatcattcaaaaaaggggctattttgatgaatatggcgcgtggtgccgtcattgagacgcaagatttactggatgctttggatgcaggcttactgagcggagctggtattgacacttacgaatttgaaggaccttatatacctaagaattttgaaggtcaagaaattacagattcactatttaaagctttgattaaccatcctaaggttatttatacacctcatgcagcttattatactgatgaagccgttaaaaacctagttgaaggtgcccttaatgctacagtagagattatcaaaactgggacaacgacaactcgtgttaac

SEQ ID NO: 124 - protein, 331 aa, Streptococcus pyogenes
LMKLKLYNVRGEEAVLAKKWADDNGIEISLTESPLTPETVKEAEGFDGIANAQIGPLDDAIYPLLKEMGIKQIAQHSASVDMYNLDLATENDIIITNVPSYSPESIAEFTVTIVLNLIRHVELIRENVKKQNFTWGLPIRGRVLGDMTVAIIGTGRIGLATAKIFKGFGCKVVGYDIYQSDAAKAVLDYKESVEEAIKDADLVSLHMPPTAENTHLFNSDLFKSFKKGAILMNMARGAVIETQDLLDALDAGLLSGAGIDTYEFEGPYIPKNFEGQEITDSLFKALINHPKVIYTPHAAYYTDEAVKNLVEGALNATVEIIKTGTTTTRVN

SEQ ID NO: 125 - DNA, 159 bp, Streptococcus agalactiae
  misc_feature (1)..(159): n = a, c, g, or t
atgcttttcatgagagataatttagattctttgattcagcctgttattgatgagatggctaaacattatcaatggtctgatcaagacaaaactttctatgaagaagaattacatgagactctaaaagacaatgacttggcagctttgaannnnnttaat

SEQ ID NO: 126 - protein, 53 aa, Streptococcus agalactiae
  misc_feature (1)..(53): Xaa = Any Amino Acid
MLFMRDNLDSLIQPVIDEMAKHYQWSDQDKTFYEEELHETLKDNDLAALXXXN

SEQ ID NO: 127 - DNA, 1836 bp, Streptococcus pyogenes
atggaattttcaagagaaacaagacgcttagctctccaaaaaatgcaagaaagagatttagacctactgattattgggggaggtattacgggtgctggtgtggcacttcaggcggcagctagtggcctagatacgggtctgattgagatgcaagattttgctcaaggaacctctagccgttcaaccaaattggttcacggggggcttcgttacttgaaacaatttgatgtggaggtggtttcagatacggtgtcagagcgggctgtggtgcaacaaattgcaccccacattccaaaaccagaccctatgttattacctgtttatgacgaacctggcagtacctttagcatgttccgtttgaaggtcgctatggatttgtatgatcttttagcaggcgtgtccaatacgccagcggccaacaaggtgttaaccaaagaagaagtcttaaaacgagaaccagacttaaaacaagaaggcttgcttggtggtggggtttaccttgatttccgcaataatgacgcaaggcttgttattgaaaatatcaaacgagctaatcgtgatggggctcttattgctagtcatgtgaaagcagaagatttcttgctagatgacaatggtaagattattggtgtgaaggcgcgtgatctgctgtcagatcaagaaatcattatcaaggctaaattagtcatcaacaccacaggtccatggagtgatgagattcgtcaattctctcataagggacaaccgattcatcaaatgcgccctacaaaaggggtgcatctggtagtggaccgtcaaaaattaccagtgtctcaacctgtctatgttgacacagggttaaatgatggtcgtatggtctttgtcttgccacgtgaggaaaaaacttattttggaacaacggacacggactacactggagacttggagcacccacaagttactcaagaagatgtggattatttgttaggcgttgtcaataaccgctttccaaatgccaacgtgaccattgatgatattgaaagcagttgggctggtcttcgccccttgttatcaggtaatagtgcttctgactacaatggtggcaacagcggtaaagtcagtgatgatagttttgatcacttggttgatactgtcaaagcctatattaaccacgaagatagccgagaagctgttgaaaaagctattaagcaggttgaaaccagcacatctgaaaaagaattggatccgtctgcagtgtcacgaggttcaagttttgagcgtgatgagaatggactctttaccttggcaggtggtaagattaccgactatcgcaaaatggctgaaggagcattgacagggattattcaaatcctcaaagaagagtttggcaaatccttcaagcttatcaattcaaaaacctatcctgtttcaggaggtgaaatcaatccagccaatgtagattcggaaatagaagcctatgctcaattaggaactcttagtggtctttcgatggatgatgctaggtatttggcaaacctttatggttctaatgcgccaaaagtctttgccttaactcgtcaattaacagcagctgaagggttaagtttagctgaaaccttgtccttacattatgcgatggattatgaaatggctcttaaaccgacagattatttcttgagaagaacaaatcacctcttatttatgcgagatagcctagatgctttgattgacccagtgattaatgaaatggctaaacattttgaatggtctgatcaggaaagagtggcacaagaagacgatcttcgtcgcgtgattgcagacaatgatttgagtgccttaaaaggccatcaggagggt

SEQ ID NO: 128 - protein, 612 aa, Streptococcus pyogenes
MEFSRETRRLALQKMQERDLDLLIIGGGITGAGVALQAAASGLDTGLIEMQDFAQGTSSRSTKLVHGGLRYLKQFDVEVVSDTVSERAVVQQIAPHIPKPDPMLLPVYDEPGSTFSMFRLKVAMDLYDLLAGVSNTPAANKVLTKEEVLKREPDLKQEGLLGGGVYLDFRNNDARLVIENIKRANRDGALIASHVKAEDFLLDDNGKIIGVKARDLLSDQEIIIKAKLVINTTGPWSDEIRQFSHKGQPIHQMRPTKGVHLVVDRQKLPVSQPVYVDTGLNDGRMVFVLPREEKTYFGTTDTDYTGDLEHPQVTQEDVDYLLGVVNNRFPNANVTIDDIESSWAGLRPLLSGNSASDYNGGNSGKVSDDSFDHLVDTVKAYINHEDSREAVEKAIKQVETSTSEKELDPSAVSRGSSFERDENGLFTLAGGKITDYRKMAEGALTGIIQILKEEFGKSFKLINSKTYPVSGGEINPANVDSEIEAYAQLGTLSGLSMDDARYLANLYGSNAPKVFALTRQLTAAEGLSLAETLSLHYAMDYEMALKPTDYFLRRTNHLLFMRDSLDALIDPVINEMAKHFEWSDQERVAQEDDLRRVIADNDLSALKGHQEG

SEQ ID NO: 129 - DNA, 489 bp, Streptococcus agalactiae
atggttcgtacaactcgtccaacaactgataaggttaaaggcgctatttttaatatgattggtcctttttttgaaggtggtcgtgttttagaccttttttctggcagtggtagcttagctattgaggcgatctcaaggggaatggaccaagctgtcctagttgaaaaagataggcgtgcgcaggtcgttattcaagaaaatattgcaatgactaagagtccggagcaatttcaattattaaaaatggaagccaaccgtgctttagaacaattaacgggacaatttgatttggtcttgttggacccgccatatgctaaggaagaaattgtaaagcaaatccaaatcatggatagcaagggtttattaggcgatgatatcatgattgcttgtgaaacggacaaatcagttgatttacctgaagaaattgcttcttttgggatatggaaacagaaaatttatggcatttctaaagtaacggtctacgttcgt

SEQ ID NO: 130 - protein, 163 aa, Streptococcus agalactiae
MVRTTRPTTDKVKGAIFNMIGPFFEGGRVLDLFSGSGSLAIEAISRGMDQAVLVEKDRRAQVVIQENIAMTKSPEQFQLLKMEANRALEQLTGQFDLVLLDPPYAKEEIVKQIQIMDSKGLLGDDIMIACETDKSVDLPEEIASFGIWKQKIYGISKVTVYVR

SEQ ID NO: 131 - DNA, 537 bp, Streptococcus pyogenes
atgagagttgtatcaggtgaatttggtgggcgtcctttaaagacgctcgatggaaagataacacgccctacttcagacaaagttagaggtgcgatttttaatatgataggaccttactttaatggtggtcgtgttttagatttgtttgcaggttcaggtggattagccattgaggctgtttctcgtgggatgtctgctgcagttttggttgagaagaatcgtaaagcgcaagctattattcaagacaatattataatgactaaagctgagaatcggtttaccttgttaaaaatggaagctgagcgagctattgattgcttgactggtcgatttgacttagtctttttagaccctccttatgccaaagaaacaattgtggcaactattgaagctttagcagctaaaaacttattgagtgaacaggttatggttgtctgtgagacagataaaacagtcttgttgccaaaagagattgcaacgttaggtatttggaaagaaaaaatttatggaattagtaaggtaacagtttatgttaac

SEQ ID NO: 132 - protein, 179 aa, Streptococcus pyogenes
MRVVSGEFGGRPLKTLDGKITRPTSDKVRGAIFNMIGPYFNGGRVLDLFAGSGGLAIEAVSRGMSAAVLVEKNRKAQAIIQDNIIMTKAENRFTLLKMEAERAIDCLTGRFDLVFLDPPYAKETIVATIEALAAKNLLSEQVMVVCETDKTVLLPKEIATLGIWKEKIYGISKVTVYVN

SEQ ID NO: 133 - DNA, 483 bp, Streptococcus agalactiae
atgacaaagaaagctttatttacaggttcatttgatcctgttactaatggacatttagatattattgagcgcgccagctatctatttgatcatgtttacattgggttattttataaccttgagaagcaaggttacttttcgattgagtgccgtaaaaaaatgttagaagaagctatccgtcagtttaagaatgtttcagttttagtggcgcaagatagactggctgttgacttagcaagggaagtgggagcaaaatattttgttcgaggtctgcgtaatagccaggattttgattatgaagccaatttggagttttttaataaacagttggcagatgatattgagacagtttatttatcaacgtcgccatctttgagtccgatatcatctagtcgcatccgtgaattgatacattttaaggcttctgtgaagccttttgttccaaagagtgttgttagagaagtggagaaaatgagtgaagaa

SEQ ID NO: 134 - protein, 161 aa, Streptococcus agalactiae
MTKKALFTGSFDPVTNGHLDIIERASYLFDHVYIGLFYNLEKQGYFSIECRKKMLEEAIRQFKNVSVLVAQDRLAVDLAREVGAKYFVRGLRNSQDFDYEANLEFFNKQLADDIETVYLSTSPSLSPISSSRIRELIHFKASVKPFVPKSVVREVEKMSEE

SEQ ID NO: 135 - DNA, 489 bp, Streptococcus pyogenes
atgttaactaaaataggactttatacagggtcatttgatcctgttacaaacggtcatctcgatattgttaaacgggcaagtggcctatttgatcaaatatatgttgggatttttgataatcctaccaaaaaaagctattttaaactagaagttcgtaaagcaatgcttactcaagctctggctgattttacaaatgtaattgtagtaacttcgcacgaacgtttagctattgatgtagctaaagaattacgagtaactcacttgattagaggcttgcgaaatgcaactgactttgagtatgaagaaaatttggaatattttaatcaccttttagctccaaatattgaaaccgtctatttgatatcaagaaataaatggcaggcccttagctctagtcgtgtgagagagctaattcattttcagtcttccttagaaggtttggttcctcagtcggttattgctcaagtggagaaaatgaatgaaaagact

SEQ ID NO: 136 - protein, 163 aa, Streptococcus pyogenes
MLTKIGLYTGSFDPVTNGHLDIVKRASGLFDQIYVGIFDNPTKKSYFKLEVRKAMLTQALADFTNVIVVTSHERLAIDVAKELRVTHLIRGLRNATDFEYEENLEYFNHLLAPNIETVYLISRNKWQALSSSRVRELIHFQSSLEGLVPQSVIAQVEKMNEKT

SEQ ID NO: 137 - DNA, 141 bp, Streptococcus agalactiae
ttggatctctattcttcactcattttctccacttctctaacaacactctttggaacaaaaggcttcacagaagccttaaaatgtatcaattcacggatgcgactagatgatatcggactcaaagatggcgacgttgataaa

SEQ ID NO: 138 - protein, 47 aa, Streptococcus agalactiae
MDLYSSLIFSTSLTTLFGTKGFTEALKCINSRMRLDDIGLKDGDVDK

SEQ ID NO: 139 - DNA, 1071 bp, Streptococcus agalactiae
gtgaagaatagagatccaaaaagaaaacataaaagtttactaggtctgcttaaatggtggattataggttttgcttttttattgttagtattagcaagccttgtagtgagactaccttattatttggaaatgccaggtggagcttatgatatccgttcggtattgaaagtgaataaaaaggctgataaagctaagggttcgtacaattttgtagcggtatctgtcagtcaagcaacgccagctcaggttctttatgcttggttaactccttttacagaattatctagtaaagaggagacaacaggtggctttagtaatgacgattatctcagaattaatcaattctacatggagacttctcaaaatgagtccatctatcaagctttaaagttagctaataagcaagtatctcttacttataaaggagtttatgtgcttaacttagctaaaaattcgacatttaaagatagattacatttagctgatacagtcacaggagttaatggcaaaagtttcaaaaattcttctcaacttatcaaatatgttgcagctcttcatctaggtgataaagtaaaggtacaatacacaagtcaaggtaaaaagaaagaatcagttggtaaagttattaaactatcaaacggtaaaaatggtattggtatcggtttgacagaccatacagaagtattatctgatgttcctgtggactttaatactgaaggtgttggaggaccaagtgcaggtttaatgtttactttagcgatttacgaccaattggttaaagaagatttacgtaaaggacgtaagattgcaggtactggtactattgagcaaaatgggcatgttggcgatattggtggagcaggtttgaaagttgtttcagcggctaaaaaaggaatggatattttctttgttcctaataatccgatcgataaaaatgctaaaaaaggcaaaacaaaggttcagacgaattatcaagaggcaaaagcagcagctaagcgattaggtacgaagatgaaaattgtaccagttcaaaatgttcagcaagctattgattatttgaaaaaaacaaaa

SEQ ID NO: 140 - protein, 357 aa, Streptococcus agalactiae
MKNRDPKRKHKSLLGLLKWWIIGFAFLLLVLASLVVRLPYYLEMPGGAYDIRSVLKVNKKADKAKGSYNFVAVSVSQATPAQVLYAWLTPFTELSSKEETTGGFSNDDYLRINQFYMETSQNESIYQALKLANKQVSLTYKGVYVLNLAKNSTFKDRLHLADTVTGVNGKSFKNSSQLIKYVAALHLGDKVKVQYTSQGKKKESVGKVIKLSNGKNGIGIGLTDHTEVLSDVPVDFNTEGVGGPSAGLMFTLAIYDQLVKEDLRKGRKIAGTGTIEQNGHVGDIGGAGLKVVSAAKKGMDIFFVPNNPIDKNAKKGKTKVQTNYQEAKAAAKRLGTKMKIVPVQNVQQAIDYLKKTK

SEQ ID NO: 141 - DNA, 1035 bp, Streptococcus pyogenes
atgaaaagacttaaaaaaatcaaatggtggttagtgggtctgctagctttaatctctttgttgctagcgttattttttccgctaccttattatattgaaatgcctggaggcgcttacgatattcggactgtcttacaagtcaatggcaaagaagacaaacgaaaaggagcttaccagtttgttgcagtgggcattagtcgtgccagcctcgctcagctattatatgcttggctgacaccgtttactgaaattagtacagcagaagatacaacaggcggatacagcgatgctgatttccttcgaattaatcaattttacatggaaacatcacaaaatgcagctatttatcaagctttatccttagctggaaaaccagttacattagattataaaggcgtatatgttttagacgtaaacaacgaatctacttttaaaggaacgctacacttagcagatactgtaacaggtgtaaatggtaaacagtttactagttcagcagaacttattgactatgtttctcacctaaaactaggggatgaagttacggttcagtttacgagtgataataagcctaaaaaaggagttggccgtattatcaaactgaaaaatgggaaaaatgggattggcattgccttgactgatcatacaagtgtcaattcagaagacacagtgatctttagtactaaaggagtaggaggacctagtgctggtctaatgtttactcttgatatatatgatcaaataactaaagaagatttacgcaagggccgtacaattgcaggtacaggaactattggcaaggatggcgaagtaggagatattggtggtgcaggtcttaaagtagttgcagcagctgaagctggtgcagatatattttttgttccgaataatcctgttgataaggaaattaaaaaagttaatccaaatgctataagtaattacgaagaagccaaacgggcagccaaacgactaaagaccaaaatgaagattgttcctgttacgactgttcaagaggcactggtttatcttcgcaaa

SEQ ID NO: 142 - protein, 345 aa, Streptococcus pyogenes
MKRLKKIKWWLVGLLALISLLLALFFPLPYYIEMPGGAYDIRTVLQVNGKEDKRKGAYQFVAVGISRASLAQLLYAWLTPFTEISTAEDTTGGYSDADFLRINQFYMETSQNAAIYQALSLAGKPVTLDYKGVYVLDVNNESTFKGTLHLADTVTGVNGKQFTSSAELIDYVSHLKLGDEVTVQFTSDNKPKKGVGRIIKLKNGKNGIGIALTDHTSVNSEDTVIFSTKGVGGPSAGLMFTLDIYDQITKEDLRKGRTIAGTGTIGKDGEVGDIGGAGLKVVAAAEAGADIFFVPNNPVDKEIKKVNPNAISNYEEAKRAAKRLKTKMKIVPVTTVQEALVYLRK

SEQ ID NO: 143 - DNA, 822 bp, Streptococcus agalactiae
atgacagagcttataagaatactacatttaaatgatctgcactctcattttgagaattttcctaaggtaaaacgattttttcatgacaatcaagcgcagccaatagagacgatttcacttgacttgggggataatattgataaaagccatcctttgacagaagcaagctcgggaaaggctaatgtccaattgatgaatgaactgggtattgagcttgctactattggtaataatgaaggagttggtttatccaaaaaagacttggaccaagtctacaaagattcagattttacggttattgttggcaatctaaaagataacataatcgaaccgagttgggcaaaaccttacattatttatgagacgcagcaaggaactaagcttgcctttttagcttatacttttccttattataaaacctatgaacctaatgggtggacgatagaagatccaattgactgtcttaaatgccatttacaaataaatgagataaaagaggcaaattgtcgcattttgatgagtcatttaggtattcgttttgatacaaggattgctcaagaattttcagaaattgaccttattataggtgcacatacacaccatttatttgaggaaggggagctaattaacggtacatatcttgcagcagctggtaaatatggtcgctttgttgggagtattgatataacttttgataatcatacactaaaagatattttaatctcaacatgtgatacaaaacaactaactggttatccttcggacagtgactggctaagaagattgagtcagaaggtaaagaacagcttagaaaagaaagtt

SEQ ID NO: 144 - protein, 274 aa, Streptococcus agalactiae
MTELIRILHLNDLHSHFENFPKVKRFFHDNQAQPIETISLDLGDNIDKSHPLTEASSGKANVQLMNELGIELATIGNNEGVGLSKKDLDQVYKDSDFTVIVGNLKDNIIEPSWAKPYIIYETQQGTKLAFLAYTFPYYKTYEPNGWTIEDPIDCLKCHLQINEIKEANCRILMSHLGIRFDTRIAQEFSEIDLIIGAHTHHLFEEGELINGTYLAAAGKYGRFVGSIDITFDNHTLKDILISTCDTKQLTGYPSDSDWLRRLSQKVKNSLEKKV

SEQ ID NO: 145 - DNA, 441 bp, Streptococcus agalactiae
atggatgcgatgctgttttacgcaggtgcagatgttgctattatcaattctggcttaattgttcagccatttgaaaaagacttttcgaggaaaaatctccacgaatcattacctcatcaaatgcgcctcgctaaattgacagtgagtagtcaagaacttttagagatttatgaaactatttatcaacaaggtcaatttttagcgcaacaaaagattcatggtatgggctttcgtggcaagtgctttggagaagttttacattcgggatttgattacaaaaatggaaaaatagtgtataatgagaaagatattgatgccaaagaagaagtgattcttgtaatcgttgatcagtattattttgcatcgtattttgagtgtttaaaaacgaaaaaagtagacttgcttttcctgaattactcagagatgtggcagcagattatt

SEQ ID NO: 146 - protein, 147 aa, Streptococcus agalactiae
MDAMLFYAGADVAIINSGLIVQPFEKDFSRKNLHESLPHQMRLAKLTVSSQELLEIYETIYQQGQFLAQQKIHGMGFRGKCFGEVLHSGFDYKNGKIVYNEKDIDAKEEVILVIVDQYYFASYFECLKTKKVDLLFLNYSEMWQQII

SEQ ID NO: 147 - DNA, 576 bp, Streptococcus agalactiae
atgcgaaaagaagtgacaccagagatgcttaactataataagtatcctggcccacagttcattcactttgaaaatatcgttaaaagtgatgatattgaatttcaacttgttattaatgaaaaatcagcttttgatgtgactgtctttggacaacgtttttctgagattttattaaaatatgattttatcgttggcgattggggtaacgagcagttgaggctaagaggcttttacaaagatgctagtacaattagaaaaaatagccggatttcacgtttagaagattatattaaagagtattgtaactttggttgtgcttattttgtgttggagaatccaaatcctagagatattaaatttgatgatgaaagacctcataagcgtcgtaagtcaagatccaaatcacaatcatcaaagtcacaaactagaaataatcgttcccagtcaaatgccaatgctcattttacaagtaaaaagcgtaaagacacaaaacgccgtcaagaacgtcatattaaagaagagcaagataaggaaatgacctctgcaaagcagcattttgttattcgtaagaaaaaa

SEQ ID NO: 148 - protein, 192 aa, Streptococcus agalactiae
MRKEVTPEMLNYNKYPGPQFIHFENIVKSDDIEFQLVINEKSAFDVTVFGQRFSEILLKYDFIVGDWGNEQLRLRGFYKDASTIRKNSRISRLEDYIKEYCNFGCAYFVLENPNPRDIKFDDERPHKRRKSRSKSQSSKSQTRNNRSQSNANAHFTSKKRKDTKRRQERHIKEEQDKEMTSAKQHFVIRKKK

SEQ ID NO: 149 - DNA, 642 bp, Streptococcus pyogenes
atggatttttcagaaaggtgtcaaatgaaaaaagaaatttcgccagaaatgtacaactataataaatttccaggtcccaaatttattcattttgaagagcaagttaaggctgaaggcattgatttgttactcttagaagatgttaagaacgcttttgatacgactagctttggtcaacgttatacagaagttctcctaaagtatgactatattgttggcgattggggaaatgaacagcttcgtcttaaagggttttataaggatagtgacgatatcaagaaaacgaatcgcatctcacgtttagaagattatattaaagaattttgcaattttggttgtgcttattttgttttagaaaatcttcatccacaagatattaaatttgaagaggagcgccaaccaagacgaaagaaatcacctaaatcaaaatcaaatcgtcgcaagccaaactattcaaatcagcagcccgcaacacctaagagcaaatcgaagcgggcatcaaaagaaaagcaacctgaaaaccaagcgtttaccagtcaaaaacgtcgaagtaatactaagcataaagaaaagtcaaaacgtaatcagactagtcaacttaataccaaaattagtcattttatcatcagaaagaaagataaa

SEQ ID NO: 150 - protein, 214 aa, Streptococcus pyogenes
MDFSERCQMKKEISPEMYNYNKFPGPKFIHFEEQVKAEGIDLLLLEDVKNAFDTTSFGQRYTEVLLKYDYIVGDWGNEQLRLKGFYKDSDDIKKTNRISRLEDYIKEFCNFGCAYFVLENLHPQDIKFEEERQPRRKKSPKSKSNRRKPNYSNQQPATPKSKSKRASKEKQPENQAFTSQKRRSNTKHKEKSKRNQTSQLNTKISHFIIRKKDK

SEQ ID NO: 151 - DNA, 1122 bp, Streptococcus agalactiae
atgaagaaagaaaatattatgcctaaaaaaactgatacacccgcctataaaccctctatttatagcttaactcgcgatgaactaatagcttgggctattgaacatggagaaaagaaattccgtgcttcacaaatctgggactggctctataaaaagcgtgtgcaaagcttcgatgaaatgactaacatttccaaagattttattgcacttttgaacgagaattttgttgttaatcctctaaaacaacgtattgttcaagaatctgctgatggaactgttaaatacctttttgaattacctgatggcatgctgattgagacggttttgatgcgtcaacattatggtttatcagtatgtgtaacgactcaagttggttgtaacattggttgcactttctgtgcaagtggtttaataaagaaacaacgtgatcttaacaatggcgaaatcactgctcaaattatgcttgttcaaaaatattttgatgaacgtggacaaggtgagcgcgttagtcacattgtggtcatgggaataggtgaaccctttgataactataccaatgtattaaaattcttgcgtacagttaatgatgataatggattagctattggtgcacgtcacattacagtgtctacttcaggtttagcacataaaattcgtgaatttgcaaatgaaggtgtacaagttaacttagcagtatctcttcatgctccaaataacgatttacgatcaagtatcatgcgtattaatcgttctttccctcttgaaaagttgtttgcggctattgaatattatattgagacgactaaccgtcgtgtaacatttgagtatattatgttaaatggtgtcaacgataccccagaaaatgctcaagagttagcagatttaacgaaaaagattcgcaaattatcttatgtcaatttaattccttacaatcctgtctcagaacatgaccagtatagtcgtagtcctaaagagcgtgtagaagctttctatgacgttttgaagaaaaatggagttaactgtgttgttcgtcaagaacatggtacggacattgatgcagcttgcgggcaattacgttcaaacacaatgaaacgcgatcgtcaaaaagcgaaggtagggcag

SEQ ID NO: 152 - protein, 374 aa, Streptococcus agalactiae
MKKENIMPKKTDTPAYKPSIYSLTRDELIAWAIEHGEKKFRASQIWDWLYKKRVQSFDEMTNISKDFIALLNENFVVNPLKQRIVQESADGTVKYLFELPDGMLIETVLMRQHYGLSVCVTTQVGCNIGCTFCASGLIKKQRDLNNGEITAQIMLVQKYFDERGQGERVSHIVVMGIGEPFDNYTNVLKFLRTVNDDNGLAIGARHITVSTSGLAHKIREFANEGVQVNLAVSLHAPNNDLRSSIMRINRSFPLEKLFAAIEYYIETTNRRVTFEYIMLNGVNDTPENAQELADLTKKIRKLSYVNLIPYNPVSEHDQYSRSPKERVEAFYDVLKKNGVNCVVRQEHGTDIDAACGQLRSNTMKRDRQKAKVGQ

SEQ ID NO: 153 - DNA, 1077 bp, Streptococcus pyogenes
atgaaaccatcgatttatagcttaacacgcgatgaactgatcgcgtgggcagttgaacgcggccaaaaacagtttagagctactcaaatttgggattggctctataaaaaaagagttcaatcttttgaggagatgacgaatatttctaaagattttgtttctattttaaatgatagtttctgtgtcaatcctttaaaacagcgagttgtacaagagtcagctgatggtacagtaaaatatttatttgaactgcccgatggtatgttaattgaaacagttttaatgcgtcaacattatggtcattctgtttgtgtgacgactcaagttggctgtaacattggctgtactttttgtgctagtggattgatcaaaaagcaacgtgatctaaacagtggggaaattacagctcaaatcatgttagtccaaaaatattttgacgatagaaagcaaggtgagcgggttagccatgttgtcgtaatgggcattggtgaaccttttgataattacaaaaatgtcatgtgctttcttcgcgtcatcaacgatgataatggcttagcaattggtgcccgtcatattacagtctctacctcagggttagctcacaagattcgggattttgcaaacgagggagtacaggttaacttagcagtctcgttgcatgcaccaaataatgatttacgttcaagtattatgcgagtaaatcgctcttttccgcttgaaaagctcttttcagctatagaatactatattgaaaaaacgaatcgtcgtgtcacttttgaatacattatgctaaatgaagttaacgatagcattaagcaagctcaagaattagcagacttaactaaaactattcgtaagttatcttatgttaacttgattccgtataatcctgtttcagaacatgatcagtatagtagaagtcctaaagagcgagttctagcgttttatgatgtgctaaagaaaaatggagttaactgtgtggtgcgtcaagagcacggaacagatattgatgcagcctgtggccagttacgttctaaaacgatgaaaaaagatcgcgaaaaggttacagcgacaaaa

SEQ ID NO: 154 - protein, 359 aa, Streptococcus pyogenes
MKPSIYSLTRDELIAWAVERGQKQFRATQIWDWLYKKRVQSFEEMTNISKDFVSILNDSFCVNPLKQRVVQESADGTVKYLFELPDGMLIETVLMRQHYGHSVCVTTQVGCNIGCTFCASGLIKKQRDLNSGEITAQIMLVQKYFDDRKQGERVSHVVVMGIGEPFDNYKNVMCFLRVINDDNGLAIGARHITVSTSGLAHKIRDFANEGVQVNLAVSLHAPNNDLRSSIMRVNRSFPLEKLFSAIEYYIEKTNRRVTFEYIMLNEVNDSIKQAQELADLTKTIRKLSYVNLIPYNPVSEHDQYSRSPKERVLAFYDVLKKNGVNCVVRQEHGTDIDAACGQLRSKTMKKDREKVTATK

SEQ ID NO: 155 - DNA, 513 bp, Streptococcus agalactiae
atgcttaaaagattacttactgaagatggggaattgacaaagattagtcgtcgtttcgtttggatgttagtgattatctattgtcttattattgtcaggatgtgttttgggcctcaaattatgattgagggggtatcaactccgaatgttcagcgcttcggaagaattgtagctcttttagtaccatttaattcttttcgtagtttagatcagctaactagctttaaagagattttttgggttattggtcaaaatgtagtgaatattttactgctgtttcctctcattatagggttactatccctaaagccaagtttacggaaatataaaagcgttatattacttgctttcttgatgtctattttcatagagtgtactcaagttgttttagatattttaatagatgctaatcgggtttttgaaatcgacgatctatggacaaataccttaggcggtcctttcgccctatggacttatcgaaacataaaaggttggcttctaactattagaaaa

SEQ ID NO: 156 - protein, 171 aa, Streptococcus agalactiae
MLKRLLTEDGELTKISRRFVWMLVIIYCLIIVRMCFGPQIMIEGVSTPNVQRFGRIVALLVPFNSFRSLDQLTSFKEIFWVIGQNVVNILLLFPLIIGLLSLKPSLRKYKSVILLAFLMSIFIECTQVVLDILIDANRVFEIDDLWTNTLGGPFALWTYRNIKGWLLTIRK

SEQ ID NO: 157 - DNA, 1743 bp, Streptococcus agalactiae
atgtctattataaaaaatttgtggtggttttttaaggaagaaaagaagcgctatcttattggaattttgtcattaagtttggttgcggtgttaaatcttatccctcctaaaatcatgggatcagttattgatgctattacaactggaaaattaacaagaccacaattgctctggaatttattaggtttggttttgtcagctttagctatgtatgggctgcgttatatttggcgtatgtatattttagggacttcttacaaattgggtcaagttgtcagataccgtttatttgaacattttacaaaaatgtctccttctttttatcagaaatatcgtacaggtgatttaatggcgcacgcgaccaacgacatcaattctctaacacgtcttgcaggaggaggagttatgtcagcagtggatgcctctatcacagcattagtaacgcttatcaccatgttctttactatttcgtggcaaatgacattaattgcggttatccctttgcccttaatggccttagcaactagtaaattggggcgaaaaacccatgaaaccttcaaagaatctcaggcagccttttcagaattaaataataaagtgcaagaaagtgtctctggcgtcaaagtgactaaatcatttggttatcaagaacaagaaattgcttcttttcaagaggttaatcagatgactttcgtgaagaacatgcggaccatgacttatgatgtcatgtttgatcctttagttcttctttttataggtgcctcctacgtattaacattggctatgggagcttttatgatttcaaaaggtcaagttactgttggtgacttggtaacatttgtgacgtatttagatatgttggtatggcccttgatggcgattggtttcttgttcaatatggtacagcgtggtagtgtttcttataaccgtattaatagcctacttgagcaagaatcggatataactgaccctttaaatcctatcagacctgttgtcaatggaacattaagatatgatattgatttctttagatacgacaatgaagaaaccttagccgatattcatttcaccttagaaaaaggtcaaaccttaggtttggtaggtcaaacgggatcagggaagacaagtcttattaagttattgctacgtgaacatgatgtgactcagggaaaaattactttaaataaacatgatatacgtgattatcgattgtctgagttacgtcaactaatcggttatgttcctcaagatcagtttttatttgctaccagtattttagaaaatgttcgctttggaaatccaactctatctatcaatgctgttaaaaaagcaactaaattggctcatgtttacgatgacattaaacagatgccagcaggatttgagactctaattggagaaaaaggagtctcattatctggtggacaaaaacaaaggattgcgatgagtcgtgccatgattttagatccagatattcttattttggatgattctctatcagcagtggacgctaaaacggaacatgccattattgaaaatcttaaaacgaatcgtcaagggaaatcgactattatttcagcacatcgattatcagctgttgtgcacgcagaccttatcttagttatgcaagacggcagagtcatcgagcgaggtcagcatcaagagttgctaaataaaggtggttggtatgctgaaacgtatgcctcacagcaattagaaatggaggaagcatttgatgaagtc

SEQ ID NO: 158 - protein, 581 aa, Streptococcus agalactiae
MSIIKNLWWFFKEEKKRYLIGILSLSLVAVLNLIPPKIMGSVIDAITTGKLTRPQLLWNLLGLVLSALAMYGLRYIWRMYILGTSYKLGQVVRYRLFEHFTKMSPSFYQKYRTGDLMAHATNDINSLTRLAGGGVMSAVDASITALVTLITMFFTISWQMTLIAVIPLPLMALATSKLGRKTHETFKESQAAFSELNNKVQESVSGVKVTKSFGYQEQEIASFQEVNQMTFVKNMRTMTYDVMFDPLVLLFIGASYVLTLAMGAFMISKGQVTVGDLVTFVTYLDMLVWPLMAIGFLFNMVQRGSVSYNRINSLLEQESDITDPLNPIRPVVNGTLRYDIDFFRYDNEETLADIHFTLEKGQTLGLVGQTGSGKTSLIKLLLREHDVTQGKITLNKHDIRDYRLSELRQLIGYVPQDQFLFATSILENVRFGNPTLSINAVKKATKLAHVYDDIKQMPAGFETLIGEKGVSLSGGQKQRIAMSRAMILDPDILILDDSLSAVDAKTEHAIIENLKTNRQGKSTIISAHRLSAVVHADLILVMQDGRVIERGQHQELLNKGGWYAETYASQQLEMEEAFDEV

SEQ ID NO: 159 - DNA, 1785 bp, Streptococcus pyogenes
gtgatgaaaacagcacgttttttctggttttattttaaacgctatcgtttctcatttactgtcattgctgttgccgttatcttagcaacttatttacaagtaaaagctcctgtcttcttaggagagtccttgactgagttgggaaaaatcggtcaggcttattacgttgctaagatgagtggccagacacattttagccctgatttatcagcttttaatgccgtgatgtttaagcttttgatgacttatttctttactgttttagctaatctaatatatagtttcttacttacacgtgttgtctcacattcgactaaccgcatgcgcaagggcttatttggtaaattagaacgtttaaccgtcgccttttttgaccgccataaagatggggagattctttctcgtttcacgagtgatttggataatattcaaaactcgctgaaccaatccttgattcaagtggtgactaatattgccctttacatcggcctggtctggatgatgtttaggcaagatagccgtttagctttgttaaccatcgcatcaaccccagttgctctcatttttttagtgattaacatccgtttggcaagaaaatacaccaatatccaacagcaagaagtcagtgctttaaatgcttttatggatgaaaccatttcaggacaaaaggctattattgtacaaggtgtccaagaagatacgatgacagcctttttaaagcataatgaaagggttcgacaagccaccttcaaacgccgtctgttctcaggacaattatttccagtcatgaatggaatgagccttattaacacggctatcgtgatttttgtcggttcaacaattgtcctcagtgacaaatctatgccagcagcggcagcgcttggtttagtggttacttttgtacaatattcccagcaatattaccaacccatgatgcaaatcgcgtctagttggggagaattgcagctggcctttaccggtgctcaccgtattcaagaaatgtttgatgaaaccgaagaagttcgtccacaaaatgcaccagcgttcaccagcttaaaagaagcagtggcgattaaccacgtcgattttgggtatcttcctgggcaaaaagttttatcagatgtgtcaatcgttgcacccaagggcaaaatgattgccgtggttggaccgacaggttctggaaagaccactattatgaacttgattaaccgtttctacgatgtggatgcaggttcgattacctttgatggccgtgatattcgtgactacgatttggatagtcttcgtcaaaaggtagggattgtgttgcaagagtcagttcttttttcaggaaccattacggataatattcgttttggtgatcagaccattagtcaagacatggttgaaactgctgcgcgtgcgacccatattcatgactttatcatgtccttaccaaaagggtacaatacctatgtctcagatgatgacaatgtcttttcaacaggtcaaaagcagttgatttctattgctaggacgctactgactgaccctgaagtgttgattttggatgaggccacttcaaatgttgatacggttaccgaaagtaaaattcaacgggccatggaagctatcgtggcaggtcgaactagctttgtcattgctcaccgcctcaaaaccattttaaatgccgatcacattattgtgttgaaagatggcaaggtcattgagcaaggaaatcatcatgagctattgcatcaaaaaggcttttatgccgaattgtatcacaatcaatttgtctttgaa

SEQ ID NO: 160 - protein, 595 aa, Streptococcus pyogenes
VMKTARFFWFYFKRYRFSFTVIAVAVILATYLQVKAPVFLGESLTELGKIGQAYYVAKMSGQTHFSPDLSAFNAVMFKLLMTYFFTVLANLIYSFLLTRVVSHSTNRMRKGLFGKLERLTVAFFDRHKDGEILSRFTSDLDNIQNSLNQSLIQVVTNIALYIGLVWMMFRQDSRLALLTIASTPVALIFLVINIRLARKYTNIQQQEVSALNAFMDETISGQKAIIVQGVQEDTMTAFLKHNERVRQATFKRRLFSGQLFPVMNGMSLINTAIVIFVGSTIVLSDKSMPAAAALGLVVTFVQYSQQYYQPMMQIASSWGELQLAFTGAHRIQEMFDETEEVRPQNAPAFTSLKEAVAINHVDFGYLPGQKVLSDVSIVAPKGKMIAVVGPTGSGKTTIMNLINRFYDVDAGSITFDGRDIRDYDLDSLRQKVGIVLQESVLFSGTITDNIRFGDQTISQDMVETAARATHIHDFIMSLPKGYNTYVSDDDNVFSTGQKQLISIARTLLTDPEVLILDEATSNVDTVTESKIQRAMEAIVAGRTSFVIAHRLKTILNADHIIVLKDGKVIEQGNHHELLHQKGFYAELYHNQFVFE

SEQ ID NO: 161 - DNA, 1740 bp, Streptococcus agalactiae
ttgatgaagtctaatcaatggcaagtctttaagagattaatctcctatttacgcccttataaatggtttacagtattagctctatctctcttattgttgacgactgttgttaaaaatattattcctttaattgcttcacattttattgatcactatctgacaaatgttaatcaaacagcagttcttattttagtgggatattattcaatgtatgtcttgcagaccttaattcaatattttgggaatctcttttttgcgcgtgtttcttatagtattgttagagatattcgtagagatgcttttgctaatatggaaaggcttggcatgtcttattttgataggacaccggcaggatctatagtgtcacgtattactaatgatactgaagcaatatctgatatgttttcgggtattttatcgagttttatctcggcgatatttatttttacagttactctgtacactatgttgatgctagacattaaactaacaggacttgtcgctcttttattacctgttatctttatattagtgaatgtctatcggaaaaaatcagtcactgtcattgctaaaacgagaagtttacttagtgatatcaacagtaaattatcagaaagtattgaaggaattcgcattgtacaggcttttggtcaagaagagcgcttgaagactgaatttgaggaaattaacaaagagcatgttgtgtatgccaatcgttctatggctcttgatagtctcttcttaagaccggcgatgtctcttttaaaactcctagcatatgctgttcttatggcttattttggatttacaggagttaaaggaggtcttacggcaggattgatgtatgcttttattcagtacgttaatcgtctctttgaccctttaattgaagtaacgcaaaatttttcaaccttacaaacatcaatggtatcagcagggcgtgtgtttgatttgattgatgaaacaggttttgaaccaagccaaaaaaatacagaagcttttgtgagagaaggaaatatcgaatttaaaaatgtatcattctcatatgatggaaaaaaacaaatccttgataatgtttcttttagtgttaaaaaaggtgaaacgattgcttttgtaggagcgacaggttctggaaaatcatctattattaatgtctttatgaggttttacgaatttcaatctggacaagttttattagatgggaaggatattagggattactcacaagaacaattgcgaaagaatattggactcgtcttacaagacccctttttatatcatggcactattaaatctaatatcaaaatgtaccaagacatcaccgatcaagaggtacaggacgcagcagagtttgttgatgctgatcaatttattcagaagttgccagataagtacgatgcagctgtttcagaacgtgggtcaagtttttcgactggacaacgccaactattggcgtttgccagaactgtggctagtaaacctaaaattttaatcttagatgaagcgacagcaaatattgattcggaaacagagcagattgtacaagattcgttagcaaaaatgcgtcaaggtcgaacaacaattgccattgctcaccgcttatcaaccattcaagatgctaattgtatctatgttcttgatagaggaaagataattgaaagtgggaatcacgagtctttattagacctaaaagggacttattatcgtatgtaccaattacaagctggcatgatggaggtc

SEQ ID NO: 162 - protein, 580 aa, Streptococcus agalactiae
MMKSNQWQVFKRLISYLRPYKWFTVLALSLLLLTTVVKNIIPLIASHFIDHYLTNVNQTAVLILVGYYSMYVLQTLIQYFGNLFFARVSYSIVRDIRRDAFANMERLGMSYFDRTPAGSIVSRITNDTEAISDMFSGILSSFISAIFIFTVTLYTMLMLDIKLTGLVALLLPVIFILVNVYRKKSVTVIAKTRSLLSDINSKLSESIEGIRIVQAFGQEERLKTEFEEINKEHVVYANRSMALDSLFLRPAMSLLKLLAYAVLMAYFGFTGVKGGLTAGLMYAFIQYVNRLFDPLIEVTQNFSTLQTSMVSAGRVFDLIDETGFEPSQKNTEAFVREGNIEFKNVSFSYDGKKQILDNVSFSVKKGETIAFVGATGSGKSSIINVFMRFYEFQSGQVLLDGKDIRDYSQEQLRKNIGLVLQDPFLYHGTIKSNIKMYQDITDQEVQDAAEFVDADQFIQKLPDKYDAAVSERGSSFSTGQRQLLAFARTVASKPKILILDEATANIDSETEQIVQDSLAKMRQGRTTIAIAHRLSTIQDANCIYVLDRGKIIESGNHESLLDLKGTYYRMYQLQAGMMEV

SEQ ID NO: 163 - DNA, 603 bp, Streptococcus agalactiae
gtgtataatgaggtcaaagtgcaaggaaaggtctataaaatgttactattggtagataattacgattcttttacctataatttaaagcaatatttaagtgtctataaagaggtattcgtcataaaaaatgatgttcctaacctttttttattagctgagagcgcagaagccatcgtcttatcacctggaccaggacacccaaaggatgctgggaaaatggtagaattaatcaatcagtttataggaaagaaacctattctaggtatctgtttggggcatcaagcgcttgccgagtgcttgggtgggcgattaaatttagcaaatcacgttatgcatggtaaacaaagttgggtaacaataaacgaccatactagtttgtttaagggaattgatagtccaacccaagttatgcgttatcattcattggtagtgactgatttaccagagaatattgctgttattgcacgatcaaatgaggataatgaaatcatggcattccattgccccagcttaaaggtatatgcgatgcagtttcatcctgagtcaatcgggagtattgatggaatgaaaatgattgaaaactttttgacgttaattaatgac

SEQ ID NO: 164 - protein, 201 aa, Streptococcus agalactiae
MYNEVKVQGKVYKMLLLVDNYDSFTYNLKQYLSVYKEVFVIKNDVPNLFLLAESAEAIVLSPGPGHPKDAGKMVELINQFIGKKPILGICLGHQALAECLGGRLNLANHVMHGKQSWVTINDHTSLFKGIDSPTQVMRYHSLVVTDLPENIAVIARSNEDNEIMAFHCPSLKVYAMQFHPESIGSIDGMKMIENFLTLIND

SEQ ID NO: 165 - DNA, 564 bp, Streptococcus pyogenes
atgatactcttaattgataattacgattcatttacctacaacctcgcccaatatttaagtgaatttgacgagacgattgtcttgtataaccaagacccaaacttatatgacatggccaaaaaagctaacgctctagtcctctcacctggtcctggttggcccaaggaagccaaccaaatgccaaaactcattcaagacttttaccaaacaaaacctatcttaggagtgtgtctgggacaccaagctatcgctgaaactttagggggaaccttacgcttggccaaacgcgtcatgcatgggagacaaagcaccattgaaacgcaaggccctgctagtctttttcgctccctgccacaagagatcaccgtcatgcgctaccattccatcgttgtggatcagttaccaaaaggttttagcgtaaccgctagagactgtgacgatcaagaaatcatggcatttgaacaccacaccctgccactttttgggctacaatttcacccagaaagcatcggaactcctgatggcatgaccatgattgccaacttcatcgcagccattccccgt

SEQ ID NO: 166 - protein, 188 aa, Streptococcus pyogenes
MILLIDNYDSFTYNLAQYLSEFDETIVLYNQDPNLYDMAKKANALVLSPGPGWPKEANQMPKLIQDFYQTKPILGVCLGHQAIAETLGGTLRLAKRVMHGRQSTIETQGPASLFRSLPQEITVMRYHSIVVDQLPKGFSVTARDCDDQEIMAFEHHTLPLFGLQFHPESIGTPDGMTMIANFIAAIPR

SEQ ID NO: 167 - DNA, 537 bp, Streptococcus agalactiae
atgaaaacaagaacaactacctatattgcactcatggttgcactacttattgttttaggttttatcccagggatcccattaggtttcattccagtcccaattgttttacaaaatcttggtgttatgctggcaggtgctctgcttggtagtaggaagggtttcctagctgtggctattttcttgctcttagttgctattggtgcaccatttttaccaggaggacggtcaggtctcgtaacgctgtttgggccaacagcaggctatctgctgacttatccatttgcagctttttttatcggcctagggcttgagaaagtgaaaacaacaaaactctgggttcaattccttattatttggatatttggcgtactattgattgatatttgtggtagcatcgttctttcctttcaaacttctctacccttaactaaatcactattttctaaccttatttttattcctggggataccttaaaagcatccatttgcttgattatttatcgtaaatttgcaaacagattaactcatctatacaac

SEQ ID NO: 168 - protein, 179 aa, Streptococcus agalactiae
MKTRTTTYIALMVALLIVLGFIPGIPLGFIPVPIVLQNLGVMLAGALLGSRKGFLAVAIFLLLVAIGAPFLPGGRSGLVTLFGPTAGYLLTYPFAAFFIGLGLEKVKTTKLWVQFLIIWIFGVLLIDICGSIVLSFQTSLPLTKSLFSNLIFIPGDTLKASICLIIYRKFANRLTHLYN

SEQ ID NO: 169 - DNA, 537 bp, Streptococcus pyogenes
atgtttacaaccaaagaacttgttaaggtggctatgatgaccactttgattattattttaggctttattcctgctatcccgctaggctttatcccagtccctattgttttacaaaacttaggtgtcatgttggctggattgatgctgggtggtaaaaagggaaccttatctgttttcttatttttagtgattggccttttcttacctgttttctcaggctcaagaacaaccattccagtattgatggggccatctgctggctatgttattgcctaccttcttgtgcctattgtcttttcattactttaccgcaattggttctcaaaaagcacgccattagcattcctagctcttttaatctcaggagttgtactggttgatgttctgggtgctatctggttgtcagcctacactggcatgtctcttgtgacatcgcttttatcaaacttggtctttattccaggagataccatcaaagcaatcattgcgaccattatcgctgttaaatacaaagatagttttttgaatacaaaacag

SEQ ID NO: 170 - protein, 179 aa, Streptococcus pyogenes
MFTTKELVKVAMMTTLIIILGFIPAIPLGFIPVPIVLQNLGVMLAGLMLGGKKGTLSVFLFLVIGLFLPVFSGSRTTIPVLMGPSAGYVIAYLLVPIVFSLLYRNWFSKSTPLAFLALLISGVVLVDVLGAIWLSAYTGMSLVTSLLSNLVFIPGDTIKAIIATIIAVKYKDSFLNTKQ

SEQ ID NO: 171 - DNA, 120 bp, Streptococcus agalactiae
gtgactaatgattcaaaattctcaaaatggacctctcgtccagcgcttaatcttaattccttgaaaggaaaaacaaaacgcaacatggccataatttttaagcatttaatgggagtcaaa

SEQ ID NO: 172 - protein, 40 aa, Streptococcus agalactiae
MTNDSKFSKWTSRPALNLNSLKGKTKRNMAIIFKHLMGVK

SEQ ID NO: 173 - DNA, 1023 bp, Streptococcus agalactiae
atgctattattaatttcgttaaaggaggctatcatgtcatttcaaacaaattatatccatttggctgacgaaatattatctggaaagactagcatttcttatgaacaagcgctggaaattctaaatagcgatgagaactggtgggaaatctacgctgctgccttataccttaaaaatcaagttagccgaaataatattcgccttaacgttttattaagtgctaagcaaggactttgtgcagaaaattgtggttactgttctcaatctaaagaaagcactgctgacattgataaatttggtctgcttcctcaaaatgtcattctaaaacaggctattgtcgctcatcaaaatggtgctagcgtcttttgtattgcgatgagtggaactaagcctagcaagagagaaattgagcagttatgtcaagtcatccctgaaatcaaaaaaagcctccctctagaaatatgccttaccgctggttttttggatagagaacaacttcatcagctaaaacaagcaggaattgaccgtatcaatcataatctcaacacccccgaagaaaactaccccaacattgcaacgacgcatagcttcaaagatcgttgtgatactttagaaagaattcacaatgaagacattgatgtttgttctggattcatttgtggtatgggagagagcgatgaggggctcatcacattagctttcagactaaaagagctggacccctattctatccctgtcaattttttacttgctgttgaaggaacacctcttggaaaatataactatttgactcccattaaatgcttaaaaattatggccatgttgcgttttgtttttcctttcaaggaattaagattaagcgctggacgagaggtccattttgagaattttgaatcattagtcaccttacttgttgactcaacttttttgggaaattacctaacagagggcggtcgcaatcaacataccgatattgaattcttggaaaaattacaactaaatcatactaaaaaggaattaatt

SEQ ID NO: 174 - protein, 341 aa, Streptococcus agalactiae
MLLLISLKEAIMSFQTNYIHLADEILSGKTSISYEQALEILNSDENWWEIYAAALYLKNQVSRNNIRLNVLLSAKQGLCAENCGYCSQSKESTADIDKFGLLPQNVILKQAIVAHQNGASVFCIAMSGTKPSKREIEQLCQVIPEIKKSLPLEICLTAGFLDREQLHQLKQAGIDRINHNLNTPEENYPNIATTHSFKDRCDTLERIHNEDIDVCSGFICGMGESDEGLITLAFRLKELDPYSIPVNFLLAVEGTPLGKYNYLTPIKCLKIMAMLRFVFPFKELRLSAGREVHFENFESLVTLLVDSTFLGNYLTEGGRNQHTDIEFLEKLQLNHTKKELI

SEQ ID NO: 175 - DNA, 528 bp, Streptococcus agalactiae
atgatatactggtcttatattttgacgggagataagatgaaaaaactatttaaaaaagcgatagctatgtgccgagatttgccgcttaattttgtaattgttgaacttagtttgtatcaaagagaggatggctcatctgataatattaaatggatttctaagagaattcttgaggtaacggtaactgatcagcaatggatttaccatttgaggatgcttaatttaccaaaacttaagccaatgtcactagcatccagtgactgtcctgcaagggaagagaaggctagtcttatttcaatagaagaatgtcaaaaattcactagcttagtgcgagataaaaatccttttcaccaaggggaagcagctattgtgcctgcggctctattattggaaaaaataatggaagttagaaaaggaaaaataaaggagattcatttgacttttttatctccagtaagggtgaatcaagaattctcagtgcaagtagtggataacacagtgattatttttcagcatcaaatattatgg

SEQ ID NO: 176 - protein, 176 aa, Streptococcus agalactiae
MIYWSYILTGDKMKKLFKKAIAMCRDLPLNFVIVELSLYQREDGSSDNIKWISKRILEVTVTDQQWIYHLRMLNLPKLKPMSLASSDCPAREEKASLISIEECQKFTSLVRDKNPFHQGEAAIVPAALLLEKIMEVRKGKIKEIHLTFLSPVRVNQEFSVQVVDNTVIIFQHQILW

SEQ ID NO: 177 - DNA, 99 bp, Streptococcus agalactiae
ttgtttaatgcacgatgctgctgcatttctaacgcttcagagtcagaaaacagaattccggattgttcacattgtagaagtagcaggagatcccaagct

SEQ ID NO: 178 - protein, 33 aa, Streptococcus agalactiae
MFNARCCCISNASESENRIPDCSHCRSSRRSQA

SEQ ID NO: 179 - DNA, 1113 bp, Streptococcus agalactiae
atgaagaatagagatgtttatattggttttgggctacgaacacctatcggtataaaagggaagcaatttaaacattaccgtccagaacttttaggagcacaccttttaaatcaaataaaaaaaatagaatcagaatctaacattgatagtattatttgtgggaacacagttggtactgggggcaatattggtcgtttgatgactcttttttctgattatgaatcctatattccagtacaaacgattgatatgcagtgtgcttcatcaagttctgccttgttttttggttatctaaaaatcagtaccggtattaatgaaaaagttcttgttggggggattgaaagtagttctcttcaacctatgagacgttatgctaaagaagataatcgtaacggagaatatacagttgctcagttttctcctgactcttatgctgaaactgtaatgttagaaggggcccagagagtctgtcaaaaatatggttttagaagagaaatgttagataaattggcattcttgagccataaacgcgccttaacagctaaacaaggtggctatttagaagaggtaatcttaccaatggaagggatgcgagatcaaggcgttagaaaactaaaagaaacattttttcaaaaattaccaagattgatggaaaattcacctttgctcactattggaaatgtttgtttaatgcacgatgctgctgcatttctaacgcttcagagtcagaaaacagaattccggattgttcacattgtagaagtagcaggagatcccaagcttagtccagaattggttcacacggctacggaaaaactattaacagaaactcatactaaaatatcggattatgatgcaattgaatggaatgaaccatttgcagcgattgatgctctatttaatcattattatcctgaagagagagaaaaattcaatatttttggagggacattagcttacggacacccttatgcctgctcaggaattattaatatccttcatcttatgcaggcattaaaatataaaaataaacctatgggtctaactgccattgcaggggcaggaggagtcggaatggccatatcaatagagtacttaggagttaagaatgct

SEQ ID NO: 180 - protein, 371 aa, Streptococcus agalactiae
MKNRDVYIGFGLRTPIGIKGKQFKHYRPELLGAHLLNQIKKIESESNIDSIICGNTVGTGGNIGRLMTLFSDYESYIPVQTIDMQCASSSSALFFGYLKISTGINEKVLVGGIESSSLQPMRRYAKEDNRNGEYTVAQFSPDSYAETVMLEGAQRVCQKYGFRREMLDKLAFLSHKRALTAKQGGYLEEVILPMEGMRDQGVRKLKETFFQKLPRLMENSPLLTIGNVCLMHDAAAFLTLQSQKTEFRIVHIVEVAGDPKLSPELVHTATEKLLTETHTKISDYDAIEWNEPFAAIDALFNHYYPEEREKFNIFGGTLAYGHPYACSGIINILHLMQALKYKNKPMGLTAIAGAGGVGMAISIEYLGVKNA

SEQ ID NO: 181 - DNA, 1146 bp, Streptococcus pyogenes
atgacggatgtttatattgctgcaggccttagaacccctatcggtttagtagggaaacaatttgctaaagaacaaccagaaatccttggagcaaagctcatcaacgctttacaaaataagtatccagttcccattgaccaagtgatttgtggcaataccgtcggaacgggtggtaatattgggcgcttgatgaccctgtattctcatttaggagaatctgtctctgctttgacggttgatatgcagtgtgcatcagctggtgcagctctttccgtgggttatgctaaaatcaaggcaggtatggcaagcaaccttttagtgggagggattgaaagcagctccttacaacctgaatcggtatatgcttcagctgattggcgccaaggagcctacaaggtagctcagttttctccagatagtatcagcccttttgcgatgattgaaggggcagaacgagtggcaagagagcatggctttacaaaggagtatttgaatcactggacattgagaagtcatcaaaaggctagttattgccaggagcaagccctgttagctgatcttattctagacctgtcaggagccagtgatcaaggtattcgaccgcgcttgtcaagtaaggtgttgtcaaaggtaccccctatcttaggagaaggtcacgtgattagtgcagccaatgcctgcctaacccatgatgctgctgcctttttacagctaagtagtcagccttcagcttttaaactgattgatgtggtagaagtagcaggagacccacagcgtagccctttaatggtgattaaggctagtcaagtccttttggaaaaacatggtctagggatggcagatatgacagcgattgaatggaacgaagcctttgccgttattgatggtctatttgaaacccattatccagatttattggaccgctataatatatttggtggtgcattagcttatggtcatccctatggtgcctcagcagccattataatattgcacttaatgagggctttagagattaaaaatggacgctatggaatagctgctatagcagcagctggtggccaagggtttgctgttttactaaaatatcataaggagtttagtcatgctgacaaagctagaatattgggcaaagcaatgcccaaa

SEQ ID NO: 182 - protein, 382 aa, Streptococcus pyogenes
MTDVYIAAGLRTPIGLVGKQFAKEQPEILGAKLINALQNKYPVPIDQVICGNTVGTGGNIGRLMTLYSHLGESVSALTVDMQCASAGAALSVGYAKIKAGMASNLLVGGIESSSLQPESVYASADWRQGAYKVAQFSPDSISPFAMIEGAERVAREHGFTKEYLNHWTLRSHQKASYCQEQALLADLILDLSGASDQGIRPRLSSKVLSKVPPILGEGHVISAANACLTHDAAAFLQLSSQPSAFKLIDVVEVAGDPQRSPLMVIKASQVLLEKHGLGMADMTAIEWNEAFAVIDGLFETHYPDLLDRYNIFGGALAYGHPYGASAAIIILHLMRALEIKNGRYGIAAIAAAGGQGFAVLLKYHKEFSHADKARILGKAMPK

SEQ ID NO: 183 - DNA, 1227 bp, Streptococcus agalactiae
atgcttgaatcattgaaaacgatagttaaaaccaatagcgataaaaagttatttgatggtgatttacaggtcagttatggagaattttataacttagtaagacaagatatggcgtcacaagacaataggaaacatgtgattagcacacactctctgcttaaccaattagtaagatttgtttcaaagttatgtcaaaaagctcttcctattatttgtaaacctaaccttactcataatgaaataagtcgattagaaaaagaagtgcagtatgctcctcaactagctgattttggtgttctttcttctgggactacagctgatgctaaactattgtggaggagcttcacttcgtggtctgatttttttagcattcagaatgcttatttttcggtcacttccaatagcaaactgtttattcaaggtgatttttcatttactggtaacttaaatttagcgctatcccttttattactggggggaacacttgttgtcacacagaaaaattctgtaaaatactggcagactttatgggaaaaaactggtgtaacgcatctatatctgctccctagttatctcaagttagtggaacaatatagcaaggagactgcgttagacaataaaactattattacctcttcgcaatatgtctctgactcattactggaaggtttatatagaaagcatcctaaagtgtcagtgaaaatcttctatggtgctagtgagctcaattatgtgtcatggtacgatggtcgtgatatccgagataagccacagtatgttggagaaatcgttccaaatgtagctgttaggattaaagagggaagaatttttgtaaaaacaccgtatagtatctgtggcctttcaagtgaatattgtgctggtgattatggtgaactgatagatggcaaattatatctatttggccgtggtggtgattggtgcaatcaatcgggcattaagctctatttacctagattaatcgaaaaaataaaaacatgcccttatatcaaggatgcagtagcatttacaaaagagagtcaaagtcatggacaagagtcacattgctgtattgttttaattgaaaatcagatgcaacaagagtgtttgaagtggttatcggaacattttgaaaagaagtatgggtttaagcattatcatattgtatctaaaattcctttgatgccatctggaaaaattgattatcaacaactcaaaagacagttagca

SEQ ID NO: 184 - protein, 409 aa, Streptococcus agalactiae
MLESLKTIVKTNSDKKLFDGDLQVSYGEFYNLVRQDMASQDNRKHVISTHSLLNQLVRFVSKLCQKALPIICKPNLTHNEISRLEKEVQYAPQLADFGVLSSGTTADAKLLWRSFTSWSDFFSIQNAYFSVTSNSKLFIQGDFSFTGNLNLALSLLLLGGTLVVTQKNSVKYWQTLWEKTGVTHLYLLPSYLKLVEQYSKETALDNKTIITSSQYVSDSLLEGLYRKHPKVSVKIFYGASELNYVSWYDGRDIRDKPQYVGEIVPNVAVRIKEGRIFVKTPYSICGLSSEYCAGDYGELIDGKLYLFGRGGDWCNQSGIKLYLPRLIEKIKTCPYIKDAVAFTKESQSHGQESHCCIVLIENQMQQECLKWLSEHFEKKYGFKHYHIVSKIPLMPSGKIDYQQLKRQLA

SEQ ID NO: 185 - DNA, 1245 bp, Streptococcus pyogenes
atgctgacaaagctagaatattgggcaaagcaatgcccaaataaaaaagctatcgtagccgatcagataagcttgacttatcaagagctatggcaagcggttttaataaaggatcagacaataaaagacagtgtaccatatatcatcagtcatagtcgctatcttaatcagttactctcttttttacgaggattaaaagaaggcagttgtcctatcattttacaccctaatatctcaggtacatttcagcagcaaataaaacacgtcgatggtgagcttcttaaaaaagctgattttgctgttttgagttcgggaacaactggcaaagcaaaattattttggcgtcgtctatcaacttggacgagactttttgattatcaaaataaggtgtttggtatgactggtaatagttgtctattcttacatggtagttttagttttactggcaatcttaacttagcattagctcaactatgggccgggggatgtctggttttaagccaaaagctgtctttgaaaacgtggttaagcttatggcaagcaaaaaaggtgagtcacctttaccttttaccgacctacctaaatcgcttgctaccttatttgactaagaacaacatgactgcgactcacttattgacctcttcgcaaatgatatcacaagaattactaagacattattacaaaaaatttcctcagcttgaaattgtcattttctacggggctagtgaattatcttttataacgtggtgtaatggcagagctgctgtcaaaattaatggtttggtaggacagccctttcctgatgtgtctatcagtttcaaagataaggaaatttttgtagagactccttatagtgtagaaggaatgtcacaaccatacagtgtttcagacttaggaaaaatgagcccagcgggtttaattttagaagggcgacaagatgactgggttaatcaacgaggagtgaaatgccacctgcctagcctagttgaactcgctcaccaagcgccaaacgtcaaagaagcgcacgctttaaagataggaaaaggagaaaacgaaaccctaatattagtattagttttgactaagaaggattgcctagcacctattaaagactttttagctctttatttaaactctggacaacttcccaagtactatcttgtgattgattgtttgcctttaaaagataatggtaaaattaatcgagaagttcttttaaataaaatacccaaacagtggcttagt

SEQ ID NO: 186 - protein, 415 aa, Streptococcus pyogenes
MLTKLEYWAKQCPNKKAIVADQISLTYQELWQAVLIKDQTIKDSVPYIISHSRYLNQLLSFLRGLKEGSCPIILHPNISGTFQQQIKHVDGELLKKADFAVLSSGTTGKAKLFWRRLSTWTRLFDYQNKVFGMTGNSCLFLHGSFSFTGNLNLALAQLWAGGCLVLSQKLSLKTWLSLWQAKKVSHLYLLPTYLNRLLPYLTKNNMTATHLLTSSQMISQELLRHYYKKFPQLEIVIFYGASELSFITWCNGRAAVKINGLVGQPFPDVSISFKDKEIFVETPYSVEGMSQPYSVSDLGKMSPAGLILEGRQDDWVNQRGVKCHLPSLVELAHQAPNVKEAHALKIGKGENETLILVLVLTKKDCLAPIKDFLALYLNSGQLPKYYLVIDCLPLKDNGKINREVLLNKIPKQWLS

SEQ ID NO: 187 - DNA, 630 bp, Streptococcus agalactiae
atgttatcaaaagcaaaatcacgatatattatccgtgagattattaagttatttccagatgctaaacctagcttagactttactaatgtctttgagcttttggtagctgtaatgctatcagctcaaacaactgatgcagctgttaataaagttacacccgccctttttgaacgctttccaaatcctttagttttggcacaagctgatcccaaagagattgaaccctatatttctaaaattgggctttaccgtaataaagctcgattcttaaatcaatgcgctaaacaattgatagagcattttgatggaaaagtcccccgaactcgtcaagagctagaaagtttggctggcgttggaaggaaaacggctaacgtggtcatgagtgttggatttggtattccggcttttgccgtagatactcatgtcactcggatttgtaaacaccaccagatttgcaaacagtcggcttctccactggaaattgagaaacgagtcatggaggttttaccaccagaagagtggctagctgcacatcaatccatgatttattttggtcgtgcaatttgtcatcctaaaaatccaaaatgcgaccagtacccacaactttatcactttcctgataatttaaag

SEQ ID NO: 188 - protein, 210 aa, Streptococcus agalactiae
MLSKAKSRYIIREIIKLFPDAKPSLDFTNVFELLVAVMLSAQTTDAAVNKVTPALFERFPNPLVLAQADPKEIEPYISKIGLYRNKARFLNQCAKQLIEHFDGKVPRTRQELESLAGVGRKTANVVMSVGFGIPAFAVDTHVTRICKHHQICKQSASPLEIEKRVMEVLPPEEWLAAHQSMIYFGRAICHPKNPKCDQYPQLYHFPDNLK

SEQ ID NO: 189 - DNA, 654 bp, Streptococcus pyogenes
atgagaattggaaaagcaagattagcaaaagtcctgaccatcattggtcaaatgtttcctgaggctaagggagagttagactgggaaacaccttttcaattgttgattgcggtgattttatcagctcaaacgacagataaggccgtcaataaggtaactcctggactatggcagtcttatccagaaatagaagacttagcttttgctgaactttctgatgttgaaaatgctctgagaacgattggactctataaaaataaggccaaaaatatcattaaaactgctcaggctattcgtgatgattttaagggtcaagtgccaaaaacccacaaagagcttgaaagtttaccgggtgttggccgaaaaacagccaatgtggtgctggcagaggtttatggtgttccagctattgcggttgatactcatgtggctagagtctcaaagaggctcaatatttcatcgccagatgccgatgtcaagcagattgaagcagatttgatggctaaaattccaaagaaagattggattattactcaccatcgattgattttttttggacgctaccattgtttagccaaaaaaccaaaatgtgagatttgtcccgttcagtcttactgcaagtactatcaagatacttatggaaaatcgaaagcc

SEQ ID NO: 190 - protein, 218 aa, Streptococcus pyogenes
MRIGKARLAKVLTIIGQMFPEAKGELDWETPFQLLIAVILSAQTTDKAVNKVTPGLWQSYPEIEDLAFAELSDVENALRTIGLYKNKAKNIIKTAQAIRDDFKGQVPKTHKELESLPGVGRKTANVVLAEVYGVPAIAVDTHVARVSKRLNISSPDADVKQIEADLMAKIPKKDWIITHHRLIFFGRYHCLAKKPKCEICPVQSYCKYYQDTYGKSKA

SEQ ID NO: 191 - DNA, 207 bp, Streptococcus agalactiae
atgaaagttttattcgatgtgcagaatcttttgaaaaaatttggtatttatgtttatattggtaaacgtctttatgatatcgaagttatgaagattgaattgcaacgtctctacgataatggtctgataagtagagatgattatttaaaagcagaactgattttaagaagagagcacagactagaattggagaaggaaaataaaaaa

SEQ ID NO: 192 - protein, 69 aa, Streptococcus agalactiae
MKVLFDVQNLLKKFGIYVYIGKRLYDIEVMKIELQRLYDNGLISRDDYLKAELILRREHRLELEKENKK

SEQ ID NO: 193 - DNA, 219 bp, Streptococcus pyogenes
ttgctaaaatctacttatatgaaaacactatatgatgtgcaacaattgctaaaaaactttggcatttttgtttaccttggcaaacgtctttatgatattgaaatgatgaagattgaacttcagcgtctctatgatagcggcttattggataagagggattacttaaatgcggagttaattttgcgacgtgagcatagattagaattggaaaaagaagga

SEQ ID NO: 194 - protein, 73 aa, Streptococcus pyogenes
LLKSTYMKTLYDVQQLLKNFGIFVYLGKRLYDIEMMKIELQRLYDSGLLDKRDYLNAELILRREHRLELEKEG

SEQ ID NO: 195 - DNA, 966 bp, Streptococcus agalactiae
atgagtaagaaattattgggaattgacctcggaggaacgaccattaaatttggtatcttgacgcttgagggagaagtacaagaaaaatgggcaattgagaccaatactttagaaaacggaagacatatcgtttctgatatcgttgaatctctcaaacatcgtttgagcctctatggattaacaaaagatgactttctcggtatcggtatgggttctccaggagctgttgatagaactagtaaaacagtaacaggtgcttttaatctaaattgggctgatactcaagaagtaggttcagttattgaaaaagaagttggaattccattttttattgataacgatgctaatgttgcagcacttggtgaacgctgggtaggtgctggtgccaataatcccgacgttgttttcgtaaccctcggaacaggagtaggtggaggtgttatcgcagatggtaacctcatccatggtgttgcaggagcaggtggagaaattgggcatatgattgttgatccagaaaatggatttacgtgcacatgtggtaacaaaggctgccttgagacagttgcatcagcgacaggtgttgttagagtagcacgtcaactcgcagaacaatatgagggttcgtctgccattaaagcagcgattgacaacggtgatactgttacaagtaaagatatttttatagcagcagaagatggggataaatttgctaattctgttgttgaacgtgtatcacgttaccttggactggcagcagctaatatttcaaatattttaaaccctgattctgtggttattggtggcggtgtctcagcagcaggtgaatttttacgtagtcgcgttgagaaatactttgtcacatttgctttcccacaagttaaaaagtcaactaaaattaagattgctgaactaggtaatgatgctggtattattggtgcagcaagcttagccaatcaacaagcaagt

SEQ ID NO: 196 - protein, 322 aa, Streptococcus agalactiae
MSKKLLGIDLGGTTIKFGILTLEGEVQEKWAIETNTLENGRHIVSDIVESLKHRLSLYGLTKDDFLGIGMGSPGAVDRTSKTVTGAFNLNWADTQEVGSVIEKEVGIPFFIDNDANVAALGERWVGAGANNPDVVFVTLGTGVGGGVIADGNLIHGVAGAGGEIGHMIVDPENGFTCTCGNKGCLETVASATGVVRVARQLAEQYEGSSAIKAAIDNGDTVTSKDIFIAAEDGDKFANSVVERVSRYLGLAAANISNILNPDSVVIGGGVSAAGEFLRSRVEKYFVTFAFPQVKKSTKIKIAELGNDAGIIGAASLANQQAS

SEQ ID NO: 197 - DNA, 969 bp, Streptococcus pyogenes
atgagtcaaaaattactggggattgatttaggtggtaccaccattaaatttggaattttaacagcagcaggagaagtccaagaaaaatgggcaattgagactaatattttagaaggaggcaaacatattgtccctgatatcatcgcttccatcaaacatcgcttagacttgtatggtctaagcagtgctgactttgtgggaattggtatgggatcaccaggagcggttgaccgtgatactaatacagttactggggcattcaaccttaattggaaagaaacccaagaagtcggttccgttgttgaaaaagaattgggcattccttttgccattgacaatgatgccaatgtggctgcccttggtgaacgttgggtaggtgctggtgaaaataacccagatgtcgtcttcatgacacttggaacaggtgtcggtggaggcattattgctgatggtaacttgattcatggtgttgcaggagcaggtggtgaaatcggccacatgattgttgagccagaaaatggctttgcttgtacttgtggctcacacggctgtttggaaacagtagcttcagcaacaggagttgtcaaagtggcacgtttactggcagaagcctacgaaggggattcagccatcaaagcagctattgacaatggtgaaggtgttaccagtaaagacattttcatggcggctgaagcaggggattcctttgctgattctgttgtggaaaaggttggttactaccttggccttgcttcagcaaatatttccaatatcttgaatccagactcagtggttatcggtgggggtgtgtcagcagcaggagaatttctacgctcacgtattgaaaaatactttgtgaccttcactttcccacaagtgaggtattcaactaaaattaagattgcagaacttggcaatgatgctggaattatcggtgcagctagccttgctcgacaatttatcacaaaa

SEQ ID NO: 198 - protein, 323 aa, Streptococcus pyogenes
MSQKLLGIDLGGTTIKFGILTAAGEVQEKWAIETNILEGGKHIVPDIIASIKHRLDLYGLSSADFVGIGMGSPGAVDRDTNTVTGAFNLNWKETQEVGSVVEKELGIPFAIDNDANVAALGERWVGAGENNPDVVFMTLGTGVGGGIIADGNLIHGVAGAGGEIGHMIVEPENGFACTCGSHGCLETVASATGVVKVARLLAEAYEGDSAIKAAIDNGEGVTSKDIFMAAEAGDSFADSVVEKVGYYLGLASANISNILNPDSVVIGGGVSAAGEFLRSRIEKYFVTFTFPQVRYSTKIKIAELGNDAGIIGAASLARQFITK

SEQ ID NO: 199 - DNA, 378 bp, Streptococcus agalactiae
atggatatgtctgttattttaattattgttattcttctggcttttgttgcttgggcatcttggaattattggagggttcgtagggcagctaaatttttagataacgagtcttttcaaaaagaaatgtcacgaggacagttaattgatatccgagaagctggtgcttttcatagaaagcatattctcggagcacgtaacattccagcaagtcaatttaaagttgccttatcggctttgcgcaaagataaacctgtcctcttatatgacgcaagccgtggtcaatctattccaaggattgttttgttactcagaaaagaaggttttaatcaactttacgtgttaaaggacggtttcaattactggacgggtagagttaag

SEQ ID NO: 200 - protein, 126 aa, Streptococcus agalactiae
MDMSVILIIVILLAFVAWASWNYWRVRRAAKFLDNESFQKEMSRGQLIDIREAGAFHRKHILGARNIPASQFKVALSALRKDKPVLLYDASRGQSIPRIVLLLRKEGFNQLYVLKDGFNYWTGRVK

SEQ ID NO: 201 - DNA, 387 bp, Streptococcus pyogenes
atgtctccaatcacacttatcttatggttacttcttgtcggcattgttggttattatacatggaactatttctcttttcgaaaaatggcaaagcaggttgataacgagacttttaaagacgtgatgcgtcaaggtcaattgattgatttacgagagccagcggcttttagaactaagcatattttaggagctcgaaattttccagcgcaacaatttgatgctgctattaagggactacgcaaggacaaacctgttcttatttacgaaaatatgcgtccccagtaccgtgtgcctgcggtcaaaaaacttaaaaaagctggctttgaagacgtttatgtcttaaaagacggtattgattattgggatggcaaagttaaacaaacaacc

SEQ ID NO: 202 - protein, 129 aa, Streptococcus pyogenes
MSPITLILWLLLVGIVGYYTWNYFSFRKMAKQVDNETFKDVMRQGQLIDLREPAAFRTKHILGARNFPAQQFDAAIKGLRKDKPVLIYENMRPQYRVPAVKKLKKAGFEDVYVLKDGIDYWDGKVKQTT

SEQ ID NO: 203 - DNA, 1839 bp, Streptococcus agalactiae
atgacaaatttaagaacagatatccgtaacgttgcgatcattgcccacgttgaccacggtaaaacaactctcgttgatgaattattaaaacaatcacatactcttgatgagcgtaaagagcttgaagaacgtgcaatggattcaaatgatatcgaaaaagaacgtggtatcaccattcttgcaaaaaatacagccgtagcatacaacgatgttcgtatcaatattatggacacacctggtcacgcggactttggtggtgaagttgagcgtattatgaaaatggttgatggtgttgttttagtcgttgatgcctacgaaggaacaatgccacaaacacgttttgttttgaagaaagctcttgaacaaaacttaattccaatcgttgttgtaaataaaattgataagccgtcagctcgtccatcagaggttgttgatgaagttcttgaactatttattgagctcggtgctgatgatgatcaactagatttccctgttgtttatgcttcagctatcaatggaacatcttcaatgtcagatgatccttcagatcaagaaaaaacaatggcaccgatttttgatactatcattgatcacattccagccccagttgacaactcggaagaaccacttcaattccaagtttctcttcttgattacaatgattttgtaggacgtattggtattggacgtgttttccgcgggactgtcaaagttggagatcaagttactctttcaaaacttgatggtacaactaaaaacttccgcgtaacaaaactttttggtttctttggacttgaacgtaaagaaatccaagaggctaaagcgggtgatttaatcgctgtttctggtatggaagatatcttcgttggtgagacagtaactccgacagatgctattgaaccactaccagttttacgtattgacgagccaacacttcaaatgactttcttggtgaataattcaccatttgcaggtcgcgaaggtaaatggattacgtcacgtaaggttgaagaacgtcttttagcagaattacaaacagacgtttctttacgtgttgacccaacagattcgccagataaatggacggtttcagggcgtggagaattacatttatctatccttattgaaacaatgcgtcgtgagggatatgaacttcaagtatcacgtccagaagttatcatcaaagaaattgatggtgttcaatgcgagccgtttgagcgtgttcaaattgatactccagaagaatatcagggtgctattatccaaagtttgtcagagcgtaaaggtgatatgcttgatatgcagatggttggtaatggtcaaacgcgtttgattttcttgattcctgcacgtggtttgattggttattcaacagagtttctttcaatgacacgtggatatggtatcatgaatcatacttttgaccagtatctaccggttgttcaaggagaaattggtggtcgtcatcgtggtgccttggtttctattgaaaatggtaaagcaactacatattcaattatgcgtattgaagaacgtgggactatctttgtaaatccaggtatagaagtttatgaaggaatgattgttggtgagaattctcgtgataatgacctcggagtcaatattacaactgctaaacaaatgacaaatgtccgttcagcaactaaagatcaaactgcagtcatcaagacgcctcgtatccttactttagaagagtcacttgaatttttagcagatgatgagtacatggaagtaactcctgagtctattcgtcttcgtaaacaaattttaaataaagcagcacgtgacaaagctaataaaaagaaaaaatcagctgaa

SEQ ID NO: 204 - protein, 613 aa, Streptococcus agalactiae
MTNLRTDIRNVAIIAHVDHGKTTLVDELLKQSHTLDERKELEERAMDSNDIEKERGITILAKNTAVAYNDVRINIMDTPGHADFGGEVERIMKMVDGVVLVVDAYEGTMPQTRFVLKKALEQNLIPIVVVNKIDKPSARPSEVVDEVLELFIELGADDDQLDFPVVYASAINGTSSMSDDPSDQEKTMAPIFDTIIDHIPAPVDNSEEPLQFQVSLLDYNDFVGRIGIGRVFRGTVKVGDQVTLSKLDGTTKNFRVTKLFGFFGLERKEIQEAKAGDLIAVSGMEDIFVGETVTPTDAIEPLPVLRIDEPTLQMTFLVNNSPFAGREGKWITSRKVEERLLAELQTDVSLRVDPTDSPDKWTVSGRGELHLSILIETMRREGYELQVSRPEVIIKEIDGVQCEPFERVQIDTPEEYQGAIIQSLSERKGDMLDMQMVGNGQTRLIFLIPARGLIGYSTEFLSMTRGYGIMNHTFDQYLPVVQGEIGGRHRGALVSIENGKATTYSIMRIEERGTIFVNPGIEVYEGMIVGENSRDNDLGVNITTAKQMTNVRSATKDQTAVIKTPRILTLEESLEFLADDEYMEVTPESIRLRKQILNKAARDKANKKKKSAE

SEQ ID NO: 205 - DNA, 1839 bp, Streptococcus pyogenes
atgactaacttaagaaacgatatccgtaacgtagcgattattgcccacgttgaccacggaaaaacaacacttgtagatgaattattaaaacaatcccatactcttgatgagcgtaaagagcttcaagagcgtgccatggattccaatgaccttgaaaaagaacgtgggattacaatccttgcgaaaaatacggcagtagcctataacgatgttcgtattaacatcatggataccccaggacacgcggacttcggtggtgaagttgaacgtatcatgaaaatggttgacggggttgttcttgttgtggatgcctacgaaggaacaatgccccagacgcgtttcgtattgaaaaaagcacttgagcaaaaccttatcccgatcgttgtggtgaacaagattgacaaaccttcagctcgtccagcagaagttgtagatgaagtgcttgaattattcatcgaacttggtgccgatgatgagcaattggaattcccagttgtttacgcatcagctattaatggaacatcatcattatcagatgaccctgctgaccaagagcatactatggcaccgatctttgatacgattattgatcatattccagcgccagttgataattcagatgagcctttgcaattccaagtgtcacttttggactacaacgatttcgtaggtcgtatcggtatcggtcgtgttttccgtggtactgttaaagtgggtgaccaagtaactctttcaaaacttgatggtaccactaaaaacttccgtgttacaaaactgtttggtttcttcggtttggaacgtcgtgaaattcaagaagctaaagcaggtgacttgattgctgtttcaggtatggaagatatctttgttggagaaaccattacaccaactgactgtgtggaagctctgccaattcttcgtattgatgagccaacacttcagatgactttcttggtcaataactctccttttgcaggtcgtgaaggtaaatggatcacgtcacgtaaggttgaagaacgtcttttagcagaattgcaaacagacgtgtcacttcgtgttgacccaacagattcgccagataaatggacggtttcagggcgtggagaattgcatttatctatcctcattgaaaccatgcgccgtgaaggctatgaacttcaagtatcacgtccagaagttatcatcaaagaaattgatggtgtcaaatgtgaaccgtttgagcgtgttcaaattgatacaccagaagaatatcagggtgcaatcatccagtctctttcagaacgtaaaggggatatgcttgatatgcagatggttggtaatggtcaaacgcgtttgattttcttgattcctgcacgtggtttgattggttattcaacagagtttctttcaatgacacgtggatatggtatcatgaatcatacttttgatcagtatctaccggttgttcaaggagaaatcggtggccgtcatcgtggtgccttggtttctattgaaaatgggaaagcaacgacatattcaatcatgcgtattgaagaacgtggaactatctttgtcaatccaggtacagaagtttacgaagggatgattgttggtgaaaactcacgtgataacgaccttggtgttaacattacaacagctaagcaaatgacaaatgtccgttcagcgactaaagatcaaactgcagttatcaagacgcctcgtatcctaacgcttgaagaatcattagagttcttgaatgacgacgaatacatggaagtaacgccagaatctatccgcttgcgtaaacaaatcttgaataaagctgcgcgtgataaagctaataaaaagaaaaaatcagccgaa

SEQ ID NO: 206 - protein, 613 aa, Streptococcus pyogenes
MTNLRNDIRNVAIIAHVDHGKTTLVDELLKQSHTLDERKELQERAMDSNDLEKERGITILAKNTAVAYNDVRINIMDTPGHADFGGEVERIMKMVDGVVLVVDAYEGTMPQTRFVLKKALEQNLIPIVVVNKIDKPSARPAEVVDEVLELFIELGADDEQLEFPVVYASAINGTSSLSDDPADQEHTMAPIFDTIIDHIPAPVDNSDEPLQFQVSLLDYNDFVGRIGIGRVFRGTVKVGDQVTLSKLDGTTKNFRVTKLFGFFGLERREIQEAKAGDLIAVSGMEDIFVGETITPTDCVEALPILRIDEPTLQMTFLVNNSPFAGREGKWITSRKVEERLLAELQTDVSLRVDPTDSPDKWTVSGRGELHLSILIETMRREGYELQVSRPEVIIKEIDGVKCEPFERVQIDTPEEYQGAIIQSLSERKGDMLDMQMVGNGQTRLIFLIPARGLIGYSTEFLSMTRGYGIMNHTFDQYLPVVQGEIGGRHRGALVSIENGKATTYSIMRIEERGTIFVNPGTEVYEGMIVGENSRDNDLGVNITTAKQMTNVRSATKDQTAVIKTPRILTLEESLEFLNDDEYMEVTPESIRLRKQILNKAARDKANKKKKSAE

SEQ ID NO: 207 - DNA, 1365 bp, Streptococcus agalactiae
atgggacgagtaatgaaaacaataacaacatttgaaaataaaaaagttttagtccttggtttagcacgatctggagaagctgctgcacgtttgttagctaagttaggagcaatagtgacagttaatgatggcaaaccatttgatgaaaatccaacagcacagtctttgttggaagagggtattaaagtggtttgtggtagtcatcctttagaattgttagatgaggatttttgttacatgattaaaaatccaggaataccttataacaatcctatggtcaaaaaagcattagaaaaacaaatccctgttttgactgaagtggaattagcatacttagtttcagaatctcagctaataggtattacaggctctaacgggaaaacgacaacgacaacgatgattgcagaagtcttaaatgctggaggtcagagaggtttgttagctgggaatatcggctttcctgctagtgaagttgttcaggctgcgaatgataaagatactctagttatggaattatcaagttttcagctaatgggagttaaggaatttcgtcctcatattgcagtaattactaatttaatgccaactcatttagattatcatgggtcttttgaagattatgttgctgcaaaatggaatatccaaaatcaaatgtcttcatctgattttttggtacttaattttaatcaaggtatttctaaagagttagctaaaactactaaagcaacaatcgttcctttctctactacggaaaaagttgatggtgcttacgtacaagacaagcaacttttctataaaggggagaatattatgtcagtagatgacattggtgtcccaggaagccataacgtagagaatgctctagcaactattgcggttgctaaactggctggtatcagtaatcaagttattagagaaactttaagcaattttggaggtgttaaacaccgcttgcaatcactcggtaaggttcatggtattagtttctataacgacagcaagtcaactaatatattggcaactcaaaaagcattatctggctttgataatactaaagttatcctaattgcaggaggtcttgatcgcggtaatgagtttgatgaattgataccagatatcactggacttaaacatatggttgttttaggggaatcggcatctcgagtaaaacgtgctgcacaaaaagcaggagtaacttatagcgatgctttagatgttagagatgcggtacataaagcttatgaggtggcacaacagggcgatgttatcttgctaagtcctgcaaatgcatcatgggacatgtataagaatttcgaagtccgtggtgatgaattcattgatactttcgaaagtcttagaggagag

SEQ ID NO: 208 - protein, 455 aa, Streptococcus agalactiae
MGRVMKTITTFENKKVLVLGLARSGEAAARLLAKLGAIVTVNDGKPFDENPTAQSLLEEGIKVVCGSHPLELLDEDFCYMIKNPGIPYNNPMVKKALEKQIPVLTEVELAYLVSESQLIGITGSNGKTTTTTMIAEVLNAGGQRGLLAGNIGFPASEVVQAANDKDTLVMELSSFQLMGVKEFRPHIAVITNLMPTHLDYHGSFEDYVAAKWNIQNQMSSSDFLVLNFNQGISKELAKTTKATIVPFSTTEKVDGAYVQDKQLFYKGENIMSVDDIGVPGSHNVENALATIAVAKLAGISNQVIRETLSNFGGVKHRLQSLGKVHGISFYNDSKSTNILATQKALSGFDNTKVILIAGGLDRGNEFDELIPDITGLKHMVVLGESASRVKRAAQKAGVTYSDALDVRDAVHKAYEVAQQGDVILLSPANASWDMYKNFEVRGDEFIDTFESLRGE

SEQ ID NO: 209 - DNA, 1356 bp, Streptococcus pyogenes
atgaaagtgataagtaattttcaaaacaaaaaaatattaatattggggttagccaaatcgggcgaagcagcagcaaaattattgaccaaacttggtgctttagtgactgttaatgatagtaaaccatttgaccaaaatccagcggcacaagccttgttggaagaggggattaaggtcatttgtggtagccacccagtagaattattagatgagaactttgagtacatggttaaaaaccctgggattccttatgataatcctatggttaaacgcgcccttgcaaaggaaattcccatcttgactgaagtagaattggcttatttcgtatctgaagcgcctattatcgggattacaggatcaaacgggaagacaaccacaacgacaatgattgccgatgttttgaatgctggcgggcaatctgcactcttatctggaaacattggttatcctgcttcaaaagttgttcaaaaagcaattgctggtgatactttggtgatggaattgtcctcttttcaattagtgggagtgaatgcttttcgccctcatattgctgtcatcactaatttaatgccgactcacctggactatcatggcagttttgaggattatgttgctgctaaatggatgattcaagctcagatgacagaatcagactaccttattttaaatgctaatcaagagatttcagcaactctagctaagaccaccaaagcaacagtgattcctttttcaactcaaaaagtggttgatggagcttatctgaaggatggaatactctattttaaagaacaggcgattatagctgcaactgacttaggtgtcccaggtagccacaacattgaaaatgccctagcaactattgcagttgccaagttatctggtattgctgatgatattattgcccagtgcctttcacattttggaggcgttaaacatcgtttgcaacgggttggtcaaatcaaagatattaccttctacaatgacagtaagtcaaccaatattttagccactcaaaaagctttatcaggttttgataacagtcgcttgattttgattgctggcggtctagatcgtggcaatgaatttgacgatttggtgccagaccttttaggacttaagcagatgattattttgggagaatccgcagagcgtatgaagcgagctgctaacaaagcagaggtctcttatcttgaagctagaaatgtggcagaagcaacagagcttgcttttaagctggcccaaacaggcgatactatcttgcttagcccagccaatgctagctgggatatgtatcctaattttgaggttcgtggggatgaatttttggcaacctttgattgtttaagaggagatgcc

SEQ ID NO: 210 - protein, 452 aa, Streptococcus pyogenes
MKVISNFQNKKILILGLAKSGEAAAKLLTKLGALVTVNDSKPFDQNPAAQALLEEGIKVICGSHPVELLDENFEYMVKNPGIPYDNPMVKRALAKEIPILTEVELAYFVSEAPIIGITGSNGKTTTTTMIADVLNAGGQSALLSGNIGYPASKVVQKAIAGDTLVMELSSFQLVGVNAFRPHIAVITNLMPTHLDYHGSFEDYVAAKWMIQAQMTESDYLILNANQEISATLAKTTKATVIPFSTQKVVDGAYLKDGILYFKEQAIIAATDLGVPGSHNIENALATIAVAKLSGIADDIIAQCLSHFGGVKHRLQRVGQIKDITFYNDSKSTNILATQKALSGFDNSRLILIAGGLDRGNEFDDLVPDLLGLKQMIILGESAERMKRAANKAEVSYLEARNVAEATELAFKLAQTGDTILLSPANASWDMYPNFEVRGDEFLATFDCLRGDA

SEQ ID NO: 211 - DNA, 1074 bp, Streptococcus agalactiae
atggggaaaaaaattgtttttacaggtggtggtacggtaggtcatgtaacactaaacctaatattaatccccaaatttatcaaagatggttgggaagtacattatattggtgataaaaatggcatagaacatgaacaaattaatcagtctggacttgatatcacatttcactctatagctactgggaaactacgtcgctatttttcatggcaaaatatgttagatgtctttaaagtaggggttggcgttcttcaatcgattgctattattgctaaacttagaccccaagccttattttcaaaagggggatttgtttcagtacctcctgtagtagctgcacgcctattaaaagttcctgtttttgttcatgaatcagatttatcaatggggttagcaaataagattgcttataaatttgcgactattatgtatacgacttttgaacaatctaaagatttaatcaaaactaagcatattggtgctgtaacaaaagtcatggattgtaaaaagtcgtttgaaaatactgacttaactagtataaaagaagccttcgatccaaacctaaagaccttactatttattggaggatcagcaggtgcaaaagtattcaatgattttattactcaaacacctgagctggaagaaaaatataatgttatcaatatttcaggcgattcttctctcaatcgattgaagaagaacctttatcgcgtggattatgttacagacctttatcagcctttaatgaatttagcagatgtggttgttacacgaggtggctctaatactatttttgaattagtagctatgaaaaaacttcatcttattatccctcttggacgtgaagcgagccgaggtgaccaattagagaatgctgcttattttgaagaaaagggctacgcattgcagttaccagaatctgaattaaacataaatacacttgagaaacagataaatttattaatttctaacagtgagagttacgaaaaaaacatgtcacaatcatctgaaataaaatctcaagatgaattttatcaattattaattgatgatatggcaaaagtaacaaaagga

SEQ ID NO: 212 - protein, 358 aa, Streptococcus agalactiae
MGKKIVFTGGGTVGHVTLNLILIPKFIKDGWEVHYIGDKNGIEHEQINQSGLDITFHSIATGKLRRYFSWQNMLDVFKVGVGVLQSIAIIAKLRPQALFSKGGFVSVPPVVAARLLKVPVFVHESDLSMGLANKIAYKFATIMYTTFEQSKDLIKTKHIGAVTKVMDCKKSFENTDLTSIKEAFDPNLKTLLFIGGSAGAKVFNDFITQTPELEEKYNVINISGDSSLNRLKKNLYRVDYVTDLYQPLMNLADVVVTRGGSNTIFELVAMKKLHLIIPLGREASRGDQLENAAYFEEKGYALQLPESELNINTLEKQINLLISNSESYEKNMSQSSEIKSQDEFYQLLIDDMAKVTKG

SEQ ID NO: 213 - DNA, 1101 bp, Streptococcus pyogenes
ttgtttaagaggagatgcctaatgcctaagaagattttatttacaggtggtggaactgtaggtcatgtcaccttgaacctcattctcataccaaaatttatcaaggacggttgggaagtacattatattggtgataaaaatggcattgaacatacagaaattgaaaagtcaggccttgacgtgacctttcatgctatcgcgacaggcaagcttagacgctatttttcatggcaaaatctagctgatgtttttaaggttgcacttggcctcctacagtctctctttattgttgccaagcttcgccctcaagcccttttttccaaaggtggttttgtctcagtaccgccagttgtggctgctaaattgcttggtaaaccagtctttattcatgaatcagatcggtcaatgggactagcaaacaagattgcctacaaatttgcaactaccatgtataccacttttgagcaggaagaccagttgtctaaagttaaacaccttggagcggtgacaaaggttttcaaagatgccaaccaaatgcctgaatcaactcagttagaggcggtgaaagagtattttagtagagacctaaaaaccctcttgtttattggtggttcggcaggggcgcatgtgtttaatcagtttattagtgatcatccagaattgaagcaacgttataatatcatcaatattacaggagaccctcaccttaatgaattgagttctcatctgtatcgagtagattatgttaccgatctctaccaacctttgatggcgatggctgaccttgtagtgacaagagggggctctaatacactttttgagctactggcaatggctaagctacacctcatcgttcctcttggtaaagaagctagccgtggcgatcagttagaaaatgccacttattttgagaagaggggctacgctaaacaattacaggaacctgatttaactttgcataattttgatcaggcaatggctgatttgtttgaacatcaggctgattatgaggctactatgttggcaactaaggagattcagtcaccggacttcttttatgaccttttgagagctgatattagctccgcgattaaggagaag

SEQ ID NO: 214 - protein, 367 aa, Streptococcus pyogenes
LFKRRCLMPKKILFTGGGTVGHVTLNLILIPKFIKDGWEVHYIGDKNGIEHTEIEKSGLDVTFHAIATGKLRRYFSWQNLADVFKVALGLLQSLFIVAKLRPQALFSKGGFVSVPPVVAAKLLGKPVFIHESDRSMGLANKIAYKFATTMYTTFEQEDQLSKVKHLGAVTKVFKDANQMPESTQLEAVKEYFSRDLKTLLFIGGSAGAHVFNQFISDHPELKQRYNIINITGDPHLNELSSHLYRVDYVTDLYQPLMAMADLVVTRGGSNTLFELLAMAKLHLIVPLGKEASRGDQLENATYFEKRGYAKQLQEPDLTLHNFDQAMADLFEHQADYEATMLATKEIQSPDFFYDLLRADISSAIKEK

SEQ ID NO: 215 - DNA, 1134 bp, Streptococcus agalactiae
atgcctaagaagaaatcagataccccagaaaaagaagaagttgtcttaacggaatggcaaaagcgtaaccttgaatttttaaaaaaacgcaaagaagatgaagaagaacaaaaacgtattaacgaaaaattacgcttagataaaagaagtaaattaaatatttcttctcctgaagaacctcaaaatactactaaaattaagaagcttcattttccaaagatttcaagacctaagattgaaaagaaacagaaaaaagaaaaaatagtcaacagcttagccaaaactaatcgcattagaactgcacctatatttgtagtagcattcctagtcattttagtttccgttttcctactaactccttttagtaagcaaaaaacaataacagttagtggaaatcagcatacacctgatgatattttgatagagaaaacgaatattcaaaaaaacgattatttcttttctttaatttttaaacataaagctattgaacaacgtttagctgcagaagatgtatgggtaaaaacagctcagatgacttatcaatttcccaataagtttcatattcaagttcaagaaaataagattattgcatatgcacatacaaagcaaggatatcaacctgtcttggaaactggaaaaaaggctgatcctgtaaatagttcagagctaccaaagcacttcttaacaattaaccttgataaggaagatagtattaagctattaattaaagatttaaaggctttagaccctgatttaataagtgagattcaggtgataagtttagctgattctaaaacgacacctgacctcctgctgttagatatgcacgatggaaatagtattagaataccattatctaaatttaaagaaagacttcctttttacaaacaaattaagaagaaccttaaggaaccttctattgttgatatggaagtgggagtttacacaacaacaaataccattgaatcaacccctgttaaagcagaagatacaaaaaataaatcaactgataaaacacaaacacaaaatggtcaggttgcggaaaatagtcaaggacaaacaaataactcaaatactaatcaacaaggacaacagatagcaacagagcaggcacctaaccctcaaaatgttaat

SEQ ID NO: 216 - protein, 378 aa, Streptococcus agalactiae
MPKKKSDTPEKEEVVLTEWQKRNLEFLKKRKEDEEEQKRINEKLRLDKRSKLNISSPEEPQNTTKIKKLHFPKISRPKIEKKQKKEKIVNSLAKTNRIRTAPIFVVAFLVILVSVFLLTPFSKQKTITVSGNQHTPDDILIEKTNIQKNDYFFSLIFKHKAIEQRLAAEDVWVKTAQMTYQFPNKFHIQVQENKIIAYAHTKQGYQPVLETGKKADPVNSSELPKHFLTINLDKEDSIKLLIKDLKALDPDLISEIQVISLADSKTTPDLLLLDMHDGNSIRIPLSKFKERLPFYKQIKKNLKEPSIVDMEVGVYTTTNTIESTPVKAEDTKNKSTDKTQTQNGQVAENSQGQTNNSNTNQQGQQIATEQAPNPQNVN

SEQ ID NO: 217 - DNA, 1146 bp, Streptococcus pyogenes
atggcaaaagataaagagaaacaaagtgatgacaagctcgttttgacagagtggcaaaagcgtaacattgaatttttaaagaaaaagaagcagcaagctgaggaagaaaaaaaactcaaagagaaattattgagtgataaaaaagcgcagcagcaagctcaaaatgcttctgaagcggttgagcttaaaactgatgagaaaactgatagtcaggaaattgagtcagaaacgacgtcaaaacctaaaaaaaccaaaaaagttagacaacccaaggaaaaaagcgcgacacaaatcgcttttcaaaaatccttgcctgttcttttgggggcgctcttactcatggcggtgtctatttttatgatcactccttatagcaaaaagaaagagttttctgtaagaggaaaccatcaaacgaaccttgacgaattaatcaaagctagcaaagtcaaagcatctgactattggttaacgctgttaacttcgcctggtcagtatgaacgaccgattcttcgtactattccatgggtgaaatctgtacatctctcttaccaatttcctaatcactttctatttaacgttattgaatttgaaatcatcgcttatgcacaagttgaaaacggttttcagcctattttggagaatggaaaacgtgtggacaaggtcagggcatcagaactaccgaaatctttcttgattcttaatttaaaagatgagaaagcgatccaacagttagttaagcaattaacgacattacctaaaaaattagtcaagaatatcaagtcagtgtctcttgcaaattccaaaacgacagcggatttactacttattgaaatgcatgacggtaatgtagttagagtaccgcagtcacaactcacattgaaacttccctattatcaaaaattgaaaaaaaaccttgaaaatgatagtatagtggatatggaagtgggaatttatactacaacacaggagattgaaaatcaacctgaagttcctcttacgcctgaacaaaacgcagctgataaagaaggagataagcctggtgaacatcaggaacagacagacaatgattcagaaacgccagcaaatcagagtagtcctcagcaaacaccaccatccccagaaacggtcctcgaacaggcccatggc

SEQ ID NO: 218 - protein, 382 aa, Streptococcus pyogenes
MAKDKEKQSDDKLVLTEWQKRNIEFLKKKKQQAEEEKKLKEKLLSDKKAQQQAQNASEAVELKTDEKTDSQEIESETTSKPKKTKKVRQPKEKSATQIAFQKSLPVLLGALLLMAVSIFMITPYSKKKEFSVRGNHQTNLDELIKASKVKASDYWLTLLTSPGQYERPILRTIPWVKSVHLSYQFPNHFLFNVIEFEIIAYAQVENGFQPILENGKRVDKVRASELPKSFLILNLKDEKAIQQLVKQLTTLPKKLVKNIKSVSLANSKTTADLLLIEMHDGNVVRVPQSQLTLKLPYYQKLKKNLENDSIVDMEVGIYTTTQEIENQPEVPLTPEQNAADKEGDKPGEHQEQTDNDSETPANQSSPQQTPPSPETVLEQAHG

SEQ ID NO: 219 - DNA, 1371 bp, Streptococcus agalactiae
atggctagaaatggcttttttactggtttggatataggaacaagctcgattaaagttttagttgcagaatttattgcaaatgaaatgaatgtaattggggttagcaacgtccctagttccggtgtaaaagatggtataattattgatattgaggcagcagcaactgcaatcaaagaggcggtaaaacaagctgaggagaaagcaggcatcaccattgacaaaatcaatgttggattaccagcaaatcttctccaaattgaaccaactcaaggaatgattcctgttcctaatgaatcaaaagaaattaaggatgaagatgtcgaaagtgttgttaaatcagcattgactaaaagcattactcctgaaagagaagttatttcattgattccgcttgaattcattgtagatggtttccaagggattagagaccctagagggatgatggggattcgccttgagatgcgtggtcttatctatactggaccaacaactatccttcataatcttcgtaaaactgttgaacgagcaggtataaaagtagagcatgttgtgatcgcccctctagccttagcaaaatcagttctaaacgaaggtgaacgtgagtttggtgcaactgtgattgatatgggaggcggacaaacaacagtcgcttctatgcgtaatcaagaattgcaatatactaatatttattctgaaggtagcgattatgttaccaaagatatttctaaagtgctacgtacaacagtagaaatcgccgaagcattgaaattcaactttggacaagctaatgttgaagaagcaagtacttctgatacagttcaagttaatgttgttggtaacgaggaacctgttgaaattacagaaagctatctttcgcaaattatttcaggacgtattcgtcaaattttagaacatgtcaaacaagacttgggtagaggtcgtttacttgatttacctggtggtattattcttgttggaggtggtgcaattatgccaggagttgtcgaggttgctcaacaaatttttggaactagagttaaattgcacgttccaaaccaagtaggtattcgcaatccaatgtttgctaatgttattagtatcgttgattatgtaggaatgatgtcagaagttgacattatcgcacaacatgctgtaactggcgacgaaatgctaagacataaaccagtcgactttgattataaagaaaaaacaaatacaatgtcgacaatgccttattctgagccgttaacctcttctatggaagattctaatttagaaccaatccgagcaagagaaaacgctcaagagcctactgagcctaaagctaatattggtgagcgcatcagaggaatttttggaagtatgtttgac

SEQ ID NO: 220 - protein, 457 aa, Streptococcus agalactiae
MARNGFFTGLDIGTSSIKVLVAEFIANEMNVIGVSNVPSSGVKDGIIIDIEAAATAIKEAVKQAEEKAGITIDKINVGLPANLLQIEPTQGMIPVPNESKEIKDEDVESVVKSALTKSITPEREVISLIPLEFIVDGFQGIRDPRGMMGIRLEMRGLIYTGPTTILHNLRKTVERAGIKVEHVVIAPLALAKSVLNEGEREFGATVIDMGGGQTTVASMRNQELQYTNIYSEGSDYVTKDISKVLRTTVEIAEALKFNFGQANVEEASTSDTVQVNVVGNEEPVEITESYLSQIISGRIRQILEHVKQDLGRGRLLDLPGGIILVGGGAIMPGVVEVAQQIFGTRVKLHVPNQVGIRNPMFANVISIVDYVGMMSEVDIIAQHAVTGDEMLRHKPVDFDYKEKTNTMSTMPYSEPLTSSMEDSNLEPIRARENAQEPTEPKANIGERIRGIFGSMFD

SEQ ID NO: 221 - DNA, 1335 bp, Streptococcus pyogenes
ttggacattggaacaagctcgataaaagttttagtagcagaatttatttctggtgagatgaacgtcattggtgttagtaatgttccaagtaccggcgtaaaagatggcataataatcgatatagaggcagctgcgactgccatcaaaactgcggtagaacaagcagaagaaaaagcagggatgacaattgaaaaggttaatgttgggctaccggcaaaccttcttcaaattgaaccaacacaaggaatgattcctgtcccaagtgagtctaaagagataaaagatgaggatgttgatagcgttgttaaatcggctttaacaaaaagtatcacaccagaacgagaggttatctctttagttccagaagagttcattgtggatggctttcagggcattcgagatccacgtggtatgatggggattagattagagatgcgcgggcttatttatactggaccaagcaccattttacataatctgcgtaaaacggtagaaagagcaggcattaaagttgaaaacatcattatttctccgttagctatggctaaaaccattttaaacgaaggtgagcgcgagtttggagctactgtaattgatatgggaggtggacagacaactgtcgcttctatgcgagcacaagaattgcagtataccaatatatatgccgaaggcggcgaatacattactaaagatatatcaaaagtattaaaaacgtctttggctattgcagaagcacttaagtttaattttggtcaagcggagatatcagaagctagtataactgaaacagtaaaagttgatgtggtaggtagtgaagagcctgttgaggtaactgaacgttatttatctgaaattatttcagcgcgtattcgtcatattttagatcgtgtgaagcaagatttggaaagaggtcgtttactagacttaccaggaggcattgttttgattggtggcggtgcaatcatgcctggagtggtagaaattgcacaagaaatctttggagtaactgtaaagctccatgttccaaaccaagtcggtattagaaatccaatgttttcaaacgttatcagtttggtagaatatgttggtatgatgtctgaagtagacgttttagcacaaactgcagtttcaggagaagaacttttgcgacgcaagcctatcgatttcagtggccaagaatcttatttaccagattatgatgattcaagaagaccagaatcgaccattggctatgaacaacaagcgtcacaaacagcatatgattcacaagttccgagtgatcctaaacaaaaaatttcagaacgtgttcgtggcatatttgggagtatgtttgat

SEQ ID NO: 222 - protein, 445 aa, Streptococcus pyogenes
LDIGTSSIKVLVAEFISGEMNVIGVSNVPSTGVKDGIIIDIEAAATAIKTAVEQAEEKAGMTIEKVNVGLPANLLQIEPTQGMIPVPSESKEIKDEDVDSVVKSALTKSITPEREVISLVPEEFIVDGFQGIRDPRGMMGIRLEMRGLIYTGPSTILHNLRKTVERAGIKVENIIISPLAMAKTILNEGEREFGATVIDMGGGQTTVASMRAQELQYTNIYAEGGEYITKDISKVLKTSLAIAEALKFNFGQAEISEASITETVKVDVVGSEEPVEVTERYLSEIISARIRHILDRVKQDLERGRLLDLPGGIVLIGGGAIMPGVVEIAQEIFGVTVKLHVPNQVGIRNPMFSNVISLVEYVGMMSEVDVLAQTAVSGEELLRRKPIDFSGQESYLPDYDDSRRPESTIGYEQQASQTAYDSQVPSDPKQKISERVRGIFGSMFD

SEQ ID NO: 223 - DNA, 1278 bp, Streptococcus agalactiae
atggtattttcatttgatacagcatcagtacaaggtgcagttattaaagttattggtgttggaggcggtggcggtaacgctattaaccgcatgattgacgaaggtgtcgctggcgttgagtttattgcagcaaatactgatattcaagccttaagtagctcaaaagctgaaactgtcattcaacttggtccaaaattaactcgcggacttggtgcaggaggacaacctgaagttggtcgtaaagcagctgaagaaagtgaagaagttttaacagaagcacttactggcgctgatatggtatttatcacagcaggtatggggggcggatctggtacaggtgcggctccagttattgcacgtattgcaaagagtttaggagcacttacagtagcggtcatcacacgtccttttggctttgagggtaataaacgttctaacttcgctatcgaaggtattcaagaattaagagaacaagttgatacactgcttatcatttcaaataataatcttcttgaaattgtagataagaagacaccattgcttgaagctcttagtgaagcagataatgttttacgtcaaggtgttcaaggtattacggatttgattactaacccaggtttaattaaccttgactttgcagatgttaaaacagttatggcaaataaaggtaatgcactgatgggaattggtatcggttctggtgaggaacgtattactgaagctgctcgaaaagcaatttattcaccacttcttgaaacaacgattgatggagcagaagacgttattgtcaatgttaccggcggtatggatatgacacttactgaagcagaggaagcatcagagattgttagccaagcagcaggtaaaggtgtcaatatttggttaggtacttcaattgacatggatatgaaagacgaaatccgcgtaacagttgttgcaacaggtgtacgtaaagataaaactaatcaagtatctggttttacaacatcagctccaactaatcaagcaccttcagaacgtcaaagtacttcaaattcaaactttgatcgtcgtggcaactttgatatgacagagtctcgcgaaatgccaactcaacaaaatcagcctcatgcacaaaatcagcaacaaagttctgcttttggtaattgggaccttcgtcgtgataatatttcacgtccgacagaaggtgaacttgatagcaagttgtctatgtcaacgttttcagaaaatgatgatatggatgatgaacttgaaacacctccattctttaaaaaccgt

SEQ ID NO: 224 - protein, 426 aa, Streptococcus agalactiae
MVFSFDTASVQGAVIKVIGVGGGGGNAINRMIDEGVAGVEFIAANTDIQALSSSKAETVIQLGPKLTRGLGAGGQPEVGRKAAEESEEVLTEALTGADMVFITAGMGGGSGTGAAPVIARIAKSLGALTVAVITRPFGFEGNKRSNFAIEGIQELREQVDTLLIISNNNLLEIVDKKTPLLEALSEADNVLRQGVQGITDLITNPGLINLDFADVKTVMANKGNALMGIGIGSGEERITEAARKAIYSPLLETTIDGAEDVIVNVTGGMDMTLTEAEEASEIVSQAAGKGVNIWLGTSIDMDMKDEIRVTVVATGVRKDKTNQVSGFTTSAPTNQAPSERQSTSNSNFDRRGNFDMTESREMPTQQNQPHAQNQQQSSAFGNWDLRRDNISRPTEGELDSKLSMSTFSENDDMDDELETPPFFKNR

SEQ ID NO: 225 - DNA, 1317 bp, Streptococcus pyogenes
atggcattttcatttgatactgcatcaattcaaggtgcaattataaaagtaattggagtcggcggaggtggcggaaatgccattaatcgtatgattgatgaaggtgttgctggtgtcgagttcatcgcagcaaacacagacattcaggcattaagctcatcaaaagctgaaacggttattcaactaggccctaaattaactcgtggacttggtgctggaggacaacctgaagtaggacgtaaagctgctgaagaaagcgaagaaattttaacagaagctcttacaggagcggacatggtatttattactgccggtatgggtggtggctctgggacaggggctgcaccggttattgctcgtatcgctaaaagtttgggagccttgacagtagctgttgttactcgcccgtttggttttgaaggtaacaaacgtggtaattttgctattgaaggtatcgaagaactacgtgaacaagttgatactttgttaattatttcaaataataaccttcttgagattgttgataaaaagacacctttattagaagcacttagtgaagctgataatgttttacgccagggagttcaagggataaccgacttaattactagtcctggccttatcaatctcgattttgccgacgtgaaaacagttatggcaaataaagggaatgccttgatggggattgggattggctctggagaagagcgcattgttgaggcggcgcgtaaggcaatctattcacccctattagaaacgactattgatggtgcacaagacgttattgtgaacgttacaggaggtctcgacatgacacttacagaagctgaagaagcctctgaaattgttgggcaagctgctggtcaaggcgttaacatttggttaggaacatctattgatgatactatgaaagatgacatccgtgtgactgttgtagcaactggagtgcgccaagaaaaagccgaacaagtttcaggttttcgtcagcctaggacttttacccaaaccaacgcgcagcaagtagcgggtgcacaatatgcatcagatcaagcaaaacagtcggttcaaccagggtttgatcgtcgctcaaattttgattttgacatgggggagtctcgcgagataccaagtgcacaaaaggtaatttctaatcataatcaaaatcaaggttctgcttttggaaattgggatttgagacgtgataatatttctcgtccaacagaaggtgaattggataaccatcttaatatgtcaacgttctcagctaacgatgacagtgatgatgaattagaaacgcctccattctttaaaaaccgt

SEQ ID NO: 226 - protein, 439 aa, Streptococcus pyogenes
MAFSFDTASIQGAIIKVIGVGGGGGNAINRMIDEGVAGVEFIAANTDIQALSSSKAETVIQLGPKLTRGLGAGGQPEVGRKAAEESEEILTEALTGADMVFITAGMGGGSGTGAAPVIARIAKSLGALTVAVVTRPFGFEGNKRGNFAIEGIEELREQVDTLLIISNNNLLEIVDKKTPLLEALSEADNVLRQGVQGITDLITSPGLINLDFADVKTVMANKGNALMGIGIGSGEERIVEAARKAIYSPLLETTIDGAQDVIVNVTGGLDMTLTEAEEASEIVGQAAGQGVNIWLGTSIDDTMKDDIRVTVVATGVRQEKAEQVSGFRQPRTFTQTNAQQVAGAQYASDQAKQSVQPGFDRRSNFDFDMGESREIPSAQKVISNHNQNQGSAFGNWDLRRDNISRPTEGELDNHLNMSTFSANDDSDDELETPPFFKNR

SEQ ID NO: 227 - DNA, 672 bp, Streptococcus agalactiae
atgatgaatttacaagaaaataaaacagcgatttttgacaatgttagtaaattagcactaaaagcaggtcgcgctcatgaatcagttcatatcgtagctgtaacaaaatatgttaactgtcaaacaacagaagcgcttattagaacaggtgttaatcatatcggtgaaaatcgtgttgataaatttcttgaaaaatatcaagcattaaaagatgaaaagcttacatggcatctcattggtagtttacaacgtcgaaaagttaaagatgtcattaattatgttgattattttcatgctttagattctgttaagttagcagctgagattcaaaaacatgctcaaaaactaattaaatgttttctacaagttaatatatcacgagaagacagtaagcatggttttactattgagcaaatagatgatgcactgaacttaatttctcggtacgataaaattgaacttatcggcatcatgactatggctcccttaaaagcaactaaagaggaaatatcatcaatttttgaagagactgagagtcttaggaaaaggcttcaagctaggaacatagaacgaatgccgtttacagaattaagcatgggcatgagtagagattatgatattgctattcaaaatggatcaacatttgtaaggataggaacttcattctttaaa

SEQ ID NO: 228 - protein, 224 aa, Streptococcus agalactiae
MMNLQENKTAIFDNVSKLALKAGRAHESVHIVAVTKYVNCQTTEALIRTGVNHIGENRVDKFLEKYQALKDEKLTWHLIGSLQRRKVKDVINYVDYFHALDSVKLAAEIQKHAQKLIKCFLQVNISREDSKHGFTIEQIDDALNLISRYDKIELIGIMTMAPLKATKEEISSIFEETESLRKRLQARNIERMPFTELSMGMSRDYDIAIQNGSTFVRIGTSFFK

SEQ ID NO: 229 - DNA, 669 bp, Streptococcus pyogenes
atggatttactgacaaataaaaagaaaatttttgagactatccgcttatctacagaggcagcaaataggactaatgatagtgtttcagttattgctgtaacaaaatatgtggatagtacaattgcaggtcagcttatcgaagcaggaattgagcacattgccgaaaaccgtgttgataaatttcttgaaaagtatgatgcgttaaagtatatgccagtaaagtggcatttaattggtaccttacaacgtcgtaaagtcaaggaagttatcaattatgttgattattttcacgctctagattctgtgagattagctttggaaatcaacaagagagctgaccatcctgtgaagtgttttctacaagttaatatttctaaagaagagagtaaacatggttttaacatttctgagattgatgaagcgattggagaaataggtaagatggagaagatacagttagttggtttaatgactatggcaccagcaaatgccagtaaagaaagtattataactatttttcgacaagcaaatcaattaagaaaaaacttgcagttaaaaaaaagaaagaatatgccttttacagaattgagcatgggcatgagtaacgattatccaattgctattcaagaaggctcaacttttattcggattggtagagctttctttcac

SEQ ID NO: 230 - protein, 223 aa, Streptococcus pyogenes
MDLLTNKKKIFETIRLSTEAANRTNDSVSVIAVTKYVDSTIAGQLIEAGIEHIAENRVDKFLEKYDALKYMPVKWHLIGTLQRRKVKEVINYVDYFHALDSVRLALEINKRADHPVKCFLQVNISKEESKHGFNISEIDEAIGEIGKMEKIQLVGLMTMAPANASKESIITIFRQANQLRKNLQLKKRKNMPFTELSMGMSNDYPIAIQEGSTFIRIGRAFFH

SEQ ID NO: 231 - DNA, 615 bp, Streptococcus agalactiae
atggaggggaatatggcattaaaagatagatttgacaaaattatttcttattttgacactgacgatgtaagtgaaaatgaagtacacgaagtacaagagagaacttcagtgcaaagagattccagagcagctacagcacaggaagcttctcagcgtagtcatatgactaactccgcagaggaagagatgattggtagtcgtccgagaacttatacctatgatcctaatcgtcaggagagacaaagggtacagagagacaatgcttatcagcaagctactcctagggttcaaaataaagactcagttcgacaacagagagaacaagtaacaattgctctgaagtatccccgtaagtatgaggatgcacaagaaattgttgatttacttatcgttaatgaatgtgtcttgattgattttcaatatatgcttgatgcgcaagcacgacgttgcttggattatattgatggtgcaagtagagtattatatggttcattacaaaaggttgggagttcaatgtttctattaacaccagccaatgttatggttgatattgaggagatgaatattccaaagactggtcaagagacgagttttgattttgatatgaagagacga

SEQ ID NO: 232 - protein, 205 aa, Streptococcus agalactiae
MEGNMALKDRFDKIISYFDTDDVSENEVHEVQERTSVQRDSRAATAQEASQRSHMTNSAEEEMIGSRPRTYTYDPNRQERQRVQRDNAYQQATPRVQNKDSVRQQREQVTIALKYPRKYEDAQEIVDLLIVNECVLIDFQYMLDAQARRCLDYIDGASRVLYGSLQKVGSSMFLLTPANVMVDIEEMNIPKTGQETSFDFDMKRR

SEQ ID NO: 233 - DNA, 666 bp, Streptococcus pyogenes
atggagaataagatggcttttaaagatacatttaacaagatgatttcttattttgacacggatgaggttaacgaagttgaagaagatgttgcagcatcaactgataacgttattccaagatcacaacaatcagtcagagcaagtagtcatccaaaacaagaacctagaaacaatcacgtacaacaagatcatcaagcgagatcccaagaacagacaaggtcacaaatgcatccaaaacatggcacttctgaacgctattatcagcagtctcagccaaaagaaggccatgaaatggttgacagaagaaaacggatgagcacttctagtattgcaaatcgccgtgagcagtatcaacaatcaacttgttcagatcaaacaactattgccttaaagtatcctcgtaaatatgaggatgctcaagaaattgtggatcttttaatagttaatgaatgcgttttgattgattttcagtttatgctagatgctcaggctagacggtgtttagattttattgatggtgctagtaaagtgctctatggtagcttacaaaaggtcggctcttcaatgtacttactggctccgtcaaatgtatccgtcaatatagaagaaatgactatcccacatactacacaagatattggctttgattttgatatgaaaaggcgg

SEQ ID NO: 234 - protein, 222 aa, Streptococcus pyogenes
MENKMAFKDTFNKMISYFDTDEVNEVEEDVAASTDNVIPRSQQSVRASSHPKQEPRNNHVQQDHQARSQEQTRSQMHPKHGTSERYYQQSQPKEGHEMVDRRKRMSTSSIANRREQYQQSTCSDQTTIALKYPRKYEDAQEIVDLLIVNECVLIDFQFMLDAQARRCLDFIDGASKVLYGSLQKVGSSMYLLAPSNVSVNIEEMTIPHTTQDIGFDFDMKRR

SEQ ID NO: 235 - DNA, 786 bp, Streptococcus agalactiae
atgacgttagatgatatttatcagcattttcgaccagaagagtatgcgtttatccataaaatagaccatttagctcaatatgtcgaaaacacctattcgtttattaccactgaatttctaaatcctagggaatttaaaatactcgaaagtgttctagagaggcgaggtagtcattattacacttctggtcagtattttcaaacagaatatgttaaagtaataatagcaccggaatactatcagttagatatggctgattttaaccttagcctaattgaaataaagtataatgctaaatttaatcaccttacccatgctaaaattatgggaactttactgaattacttaggtgtaaaacgatcaattttaggggatatcctagttgaagaaggctgtgctcaggttttggtcgatagtcaaatgacaaatcaccttgttcattcagttacaaaaattggaactgctagtgtacaattagctgaagttcccttgtccaaacttctaactcccaaacaagatattcaaaaactaactgttattgcttccagtttacgtcttgataaaattttagcaacgattttaaagatttcacgaacacagtcgacgaaattgattgaggcagataaagtcaaggtcaattatgcaaccgtcaatcgagtttctgaacaattagtagagggggatttgattagtgttagaggatatggtcgatttacgttgaaccataacctagggttaactaaaaatcaaaaatataagttagaagtagacaaaatgatacataac

SEQ ID NO: 236 - protein, 262 aa, Streptococcus agalactiae
MTLDDIYQHFRPEEYAFIHKIDHLAQYVENTYSFITTEFLNPREFKILESVLERRGSHYYTSGQYFQTEYVKVIIAPEYYQLDMADFNLSLIEIKYNAKFNHLTHAKIMGTLLNYLGVKRSILGDILVEEGCAQVLVDSQMTNHLVHSVTKIGTASVQLAEVPLSKLLTPKQDIQKLTVIASSLRLDKILATILKISRTQSTKLIEADKVKVNYATVNRVSEQLVEGDLISVRGYGRFTLNHNLGLTKNQKYKLEVDKMIHN

SEQ ID NO: 237 - DNA, 789 bp, Streptococcus pyogenes
atggttagtcatagtaagatttatcagcattttcaccaagaagaatatccttttattgatagaatgtctgatatgattaatagagttgaagattactatcttttagaagttactgagtttttaaatcctagagaagtgatgattttaaaaagtttgattgctttaacagatctaaaaatgttcgtatcaacagattactacccaagcgaatatggtcgtgtcattattgcacctggttactatgacttagaacaaagtgattttcaaatagctttagtagagataagttatcaggcaaagtttaatcagttgacacatagtcaaattttaggaactttaattaatgaattaggagtaaagcgaaatttatttggagatgtttttgttgaaatgggatatgcccagctcatgattaagcgggagttattggattattttttaggaacaattactaaaatagctaaaactagtgtgaaattaagagaagttaactttgatcagttaattaggtctattgataacagccagaccctggatattctagtttctagttttcgattagatggtgtagttgctactatcttaaaaaaatctcgaacgcaagttatagcattaattgaagcaaataagattaaggtaaactatcgagttgctaataaagcttcagataatctagtcataggggatatggtgagtatcagaggtcacgggcgttttactcttttagcagataatggagtgaccaaacatggcaaacaaaaaataacactaagtaaaatgatacataaa

SEQ ID NO: 238 - protein, 263 aa, Streptococcus pyogenes
MVSHSKIYQHFHQEEYPFIDRMSDMINRVEDYYLLEVTEFLNPREVMILKSLIALTDLKMFVSTDYYPSEYGRVIIAPGYYDLEQSDFQIALVEISYQAKFNQLTHSQILGTLINELGVKRNLFGDVFVEMGYAQLMIKRELLDYFLGTITKIAKTSVKLREVNFDQLIRSIDNSQTLDILVSSFRLDGVVATILKKSRTQVIALIEANKIKVNYRVANKASDNLVIGDMVSIRGHGRFTLLADNGVTKHGKQKITLSKMIHK

SEQ ID NO: 239 - DNA, 768 bp, Streptococcus agalactiae
atgccacttacagcacttgaaattaaagataaaacattttcatcaaaatttcgcggttatagcgaagaagaagttaatgaatttttagagattgttgttgacgattacgaggacttgattagacgtaatcgtgagcaagagcaatacattaaagatttagaagagaaaatcgcttacttcaacgaaatgaaggaatcgttaagtcaatcagttattttagctcaagaaactgctgagcgtgtgaaaatttcagcacaggatgaagcatctaacctaatggggaaagctacatttgatgctcaacatttaattgatgaggctaaattaaaagcaaatcaaatccttcgagatgcgacagatgatgctaagcgtgttgctatagaaacagaagatttgaaacgtcaatcacgtgttttccaccaacgtttgctttctgagttagaagggcagctaaaattagctaactcatctgcttgggaagaattgttgaaaccaacagctatttatcttcaaaattctgatgcttctttcaaagaagttgttgaaaaagttcttgatgaagatgatgctttaccagtggtggatgacactgagtcatttgatgctactcgtcaattctcaccagatgaaatggaagaattacagcgtcgtgttgaagaaagtaacaaacaacttgaagagtcaggtttattagatactaataatttccaaatggaagaaccgatcaatttaggtgaaactcaaacttttaaattaaatattgaagat

SEQ ID NO: 240 - protein, 256 aa, Streptococcus agalactiae
MPLTALEIKDKTFSSKFRGYSEEEVNEFLEIVVDDYEDLIRRNREQEQYIKDLEEKIAYFNEMKESLSQSVILAQETAERVKISAQDEASNLMGKATFDAQHLIDEAKLKANQILRDATDDAKRVAIETEDLKRQSRVFHQRLLSELEGQLKLANSSAWEELLKPTAIYLQNSDASFKEVVEKVLDEDDALPVVDDTESFDATRQFSPDEMEELQRRVEESNKQLEESGLLDTNNFQMEEPINLGETQTFKLNIED

SEQ ID NO: 241 - DNA, 756 bp, Streptococcus pyogenes
atggcacttacaacgctagaaattaaagataaaacttttaagacaaaattccgaggatactgtgaagaagaagtcaatgaattccttgatattgttgttgatgattacgaagctcttgtacgtaaaaatcgtgataacgaagcaagaattaaagatcttgaagaaaaattatcttactttgatgaaatgaaagagtcacttagccagtctgtaatcttagctcaagaaacagctgaaaaagtgaaagcaacggctaatgcggaagcaacaaacttggttagtaaagcgacttatgatgctcagcatttattagatgaatctaaagctaaagccaatcaaatgttgcgtgatgcaactgatgaggctaagcgagttgcgattgaaacagaagaactaaagcgtcaaacacgtgtgttccaccaacgtttaatctcatctattgagtcacaattaagcttatcaaattcacctgaatgggatgaactgctacaaccgactgcaatctatcttcaaaattctgacgatgcttttaaggaagtcgtgaagaccgttcttaatgaagacattcctgaatctgatgatagtgcctcttttgatgcaacacgtcagtttactccagaagagttagaagaattgcaacgtcgtgttgatgaaagcaataaggagttagaggcttaccaacttgactctcaatctgattctacgactgagccagaggtaaatctcagtgaaacacaaacgtttaaattaaatatc

SEQ ID NO: 242 - protein, 252 aa, Streptococcus pyogenes
MALTTLEIKDKTFKTKFRGYCEEEVNEFLDIVVDDYEALVRKNRDNEARIKDLEEKLSYFDEMKESLSQSVILAQETAEKVKATANAEATNLVSKATYDAQHLLDESKAKANQMLRDATDEAKRVAIETEELKRQTRVFHQRLISSIESQLSLSNSPEWDELLQPTAIYLQNSDDAFKEVVKTVLNEDIPESDDSASFDATRQFTPEELEELQRRVDESNKELEAYQLDSQSDSTTEPEVNLSETQTFKLNI

SEQ ID NO: 243 - DNA, 2790 bp, Streptococcus agalactiae
atgaaattaaaagaaaccttgaatttaggacaaacagcttttccaatgcgtgcagggcttccaaataaggaacctcaatggcaagaagcatgggatcaagctgacatttataaaaaacgtcaagcattgaatgaaggaaaaccagcctttcaccttcatgacggacctccctatgctaatgggaatattcatgtaggacatgcactaaataaaatttcgaaagacattattgtacgttcaaaatcaatgtcaggttttcgagctccttatgtgcctggttgggatactcatggactcccaattgagcaagtattagctaaaaaaggggttaaacgtaaagaaatggacttggctgaataccttgaaatgtgtcgtgattatgctctcagccaagttgacaaacaacgtgatgattttaaacgtctgggcgtttctgccgattgggaaaatccttatattacactaacaccagattatgaagcagatcaagtacgtgttttcggtgctatggcagataaaggatatatctatcgtggtgctaaaccagtgtattggtcatggtcatcagagtctgcccttgctgaggctgaaatcgaatatcatgatattgattcgacatcactctactatgccaataaagttaaagatggtaagggaattcttgatacagatacctatatcgtcgtttggacgacaacaccatttactgtaacagcttcacgcggtttaacagtaggaccagatatggagtatgttgtagttgtaccagtaggtagtgagcgtaaataccttcttgcagaggttcttgtagatagtctcgctgctaagtttggctgggaaaactttgaaattgtgactcatcacactggtaaagaacttaatcacattgttacagaacatccatgggatacagaagtagaagagttggttatccttggagaccatgttacaacagattctggtacaggtattgtccacacggctcctggttttggtgaagatgactataacgttggtattgctaatggacttgatgttgtagttaccgtagatagtcgtggtttgatgatggaaaatgctggtcctgattttgaaggtcaattctatgacaaagtaacaccacttgtaaaagaaaaattgggagatcttcttttagccagcgaagttatcaaccactcatatccatttgactggcgtacgaaaaagccaatcatttggcgtgcggttccacaatggtttgcctctgtttcgaaattccgtcaagaaatcctcgatgaaattgaaaagacaaatttccaacctgagtggggtaaaaaacgtctttataacatgatccgtgaccgtggcgactgggtaatctcacgtcaacgtgcttggggtgttccacttccaattttttatgcagaagatggtacagctatcatgacaaaagaagtgactgatcacgttgcagatttatttgctgaatacggctcaatcgtttggtggcaacgtgatgctaaggaccttctaccagcaggttatactcatccaggttcacctaatggtctctttgagaaagaaacagacatcatggatgtttggtttgattctggttcatcatggaatggggtaatgaatgctcgtgaaaacctttcctatccagcagatctttatcttgaaggttctgatcaataccgtggttggttcaactcatcactaattacatcagttgctgttaatggtcacgctccatacaaagcagtcttatctcaaggttttgtacttgatggtaaaggtgagaaaatgtctaaatctctaggaaatacaattcttcctagtgatgttgaaaaacaatttggtgcggaaatcttgcgtctgtgggtaacttctgttgactcaagtaatgatgttcgtatttcaatggatatcttaaaacaaacatcagaaacttatcgtaagatcaggaatacattgcgtttcttgattgcaaatacttccgattttaatcctaaacaagatgcagtagcctatgaaaatttaggtgccgttgatcgttatatgactattaaatttaatcaagttgtggatacaatcaacaaagcttatgctgcttatgattttatggcaatttataaagctgtcgttaacttcgtaacagttgatctatcagcattttaccttgattttgcaaaagatgtggtttacattgaagcggctaacagtccagaacgacgtcgtatgcaaactgttttctatgatattttagttaaacttacaaaacttttgactccgattctaccacatactgctgaagaaatttggtcatacctcgaacatgaggaggaggagtttgttcaattagcagaaatgcctgttgcacagacattctctggtcaagaagaaattcttgaagagtggtcagcattcatgacgttacgaacacaagctcaaaaagctctcgaagaagcacgtaacgctaaagttattggtaaatctctagaagcacatttaacaatttatgctagtcaagaagtgaaaacgttattaacagcgttaaatagcgatattgcactcttgatgattgtctcacaattaacaattgctgatgaagcagacaaaccagctgactcagtatcatttgaaggtgttgcatttactgttgaacacgctgaaggtgaagtctgcgaacgctcacgccgtattgatccaaccacaaagatgcgttcgtatggtgtagctgtttgtgatgctagtgcagcaattattgagcaatattatcctgaagcagtagctcaaggttttgaagct

SEQ ID NO: 244 - protein, 930 aa, Streptococcus agalactiae
MKLKETLNLGQTAFPMRAGLPNKEPQWQEAWDQADIYKKRQALNEGKPAFHLHDGPPYANGNIHVGHALNKISKDIIVRSKSMSGFRAPYVPGWDTHGLPIEQVLAKKGVKRKEMDLAEYLEMCRDYALSQVDKQRDDFKRLGVSADWENPYITLTPDYEADQVRVFGAMADKGYIYRGAKPVYWSWSSESALAEAEIEYHDIDSTSLYYANKVKDGKGILDTDTYIVVWTTTPFTVTASRGLTVGPDMEYVVVVPVGSERKYLLAEVLVDSLAAKFGWENFEIVTHHTGKELNHIVTEHPWDTEVEELVILGDHVTTDSGTGIVHTAPGFGEDDYNVGIANGLDVVVTVDSRGLMMENAGPDFEGQFYDKVTPLVKEKLGDLLLASEVINHSYPFDWRTKKPIIWRAVPQWFASVSKFRQEILDEIEKTNFQPEWGKKRLYNMIRDRGDWVISRQRAWGVPLPIFYAEDGTAIMTKEVTDHVADLFAEYGSIVWWQRDAKDLLPAGYTHPGSPNGLFEKETDIMDVWFDSGSSWNGVMNARENLSYPADLYLEGSDQYRGWFNSSLITSVAVNGHAPYKAVLSQGFVLDGKGEKMSKSLGNTILPSDVEKQFGAEILRLWVTSVDSSNDVRISMDILKQTSETYRKIRNTLRFLIANTSDFNPKQDAVAYENLGAVDRYMTIKFNQVVDTINKAYAAYDFMAIYKAVVNFVTVDLSAFYLDFAKDVVYIEAANSPERRRMQTVFYDILVKLTKLLTPILPHTAEEIWSYLEHEEEEFVQLAEMPVAQTFSGQEEILEEWSAFMTLRTQAQKALEEARNAKVIGKSLEAHLTIYASQEVKTLLTALNSDIALLMIVSQLTIADEADKPADSVSFEGVAFTVEHAEGEVCERSRRIDPTTKMRSYGVAVCDASAAIIEQYYPEAVAQGFEA

SEQ ID NO: 245 - DNA, 2799 bp, Streptococcus pyogenes
atgaaattaaaagagacacttaatctaggaaaaacagcctttccaatgcgcgcaggtcttcctaataaagagccacaatggcaagcagcttgggaacaagcagagctttacaaaaaacgtcaagaattgaatgcaggtaagcctgcctttcatcttcatgatggacctccatacgctaacggcaatattcacgttgggcatgcccttaataaaatttcaaaagatatcattgtgcgttctaagtccatgtctggctttcaagcgccttatgtacctggttgggacacacacggccttccaatcgaacaagtcttggctaagcaaggaatcaaacgtaaggagatggatttagcagaataccttgagatgtgtcgtcaatacgctttaagtcaggttgataaacagcgagatgatttcaaacggttaggtgtttcggcagactgggaaaatccttatgtcactttggacccacagtttgaagctgatcaaattcgtgtttttggagcgatggctgaaaaaggttacatctatcgtggtgctaaacctgtttattggtcatggtcttcagaatcggccttggcagaggctgaaattgaataccatgacatcgattcaacctctttatactacgccaataaagttaaagatggtaaaggtatccttgatactaatacgtatatcgttgtttggaccacaacaccatttaccgttacagcatcacgcggtttgactgttggtcctgatatggattatcttgtggtgaaacctgctggttcagaccgtcaatatgttgtggcagaaggtcttttggatagccttgctggaaaatttggctgggaatcttttgaaactttagctagccataaaggagctgatttagagtacattgtgacagaacacccatgggatactgacgtagaagaattggttatccttggtgaccatgttacccttgagtcagggacagggattgtccacacagcaccaggttttggtgaggatgactacaatgttgggacaaaatacaaactggaagttgctgtgactgttgatgaacgtggcctaatgatggaaaatgcaggtccagatttccacggacaattttataacaaggtaacgccgattgtcattgataaacttggtgatcttttattggcacaagaagtgatcaatcactcttacccatttgactggcggacgaaaaaaccaatcatctggcgtgctgtaccgcaatggtttgcttctgtttctgatttccgtcaagatattttggatgaaattgaaaaaacaacctttcatccatcatggggtgaaacacgcctttacaatatgattcgtgatcgtggcgactgggttatttctcgtcaacgtgcttggggagttccgcttcctatcttctatgccgaagatggcacagctattatgactaaagaagtgacagatcatgtggctgatttgttccaagaaaatggatcaatcatttggtggcaaaaagaagctaaagacctattaccagagggcttcactcatccagggtcaccaaatggcgagtttacaaaagaaactgatatcatggacgtttggtttgactctggttcttcttggaatggagtcatgaatactaaagaaaatctttcctatccagcggatctatacttagaaggctctgaccagtatcgtggttggttcaattcatccttaattacatctgtggctgttaatgggcatgctccatataaggctattttatcgcaaggctttgttcttgatggtaagggcgaaaaaatgtctaaatcaaaaggcaatatcatttctcctaatgatgtggctaaacaatatggtgcagatattcttcgactttgggtagcttctgtggataccgataatgatgtccgtgtttctatggagatccttggtcaagtctctgaaacttaccgtaaaatccgtaacacccttcgcttcttgattgctaatacatctgatttcaaccctgctacggatacagtagcttatgcagatttaggaactgttgataagtacatgacaattgtctttaatcagttggtagcaacgattactgacgcttatgagcgttatgactttatggctatttacaaagcagtggtgaactttgttacggttgatttatcagccttctatcttgattttgctaaagacgttgtctatattgaagctgccaatagcttagaacgtcgtcgcatgcagacagtcttctatgatatcttggttaagattaccaagttattgacgccaatcttgcctcacactactgaagaaatctggtcttatctagagcatgagtcagaagcatttgttcaattggcagaaatgcctgtggcagaaaccttctcggctcaagaggatattttagaagcttggtcagctttcatgactttgcgtactcaagctcaaaaagctttggaagaagcgcgaaatgctaagattatcggtaaatcattggaagcccatttgaccatctacgctagtgaagaagtgaaaaccttattgactgctttagacagcgatattgctttgcttttgatcgtgtctcaattaaccattgctgacttggcagatgcgcctgcggatgcagtggcatttgaaggtgttgcctttatagtagaacatgccataggtgaagtttgtgagcgttcacgtcgcatcgacccaactactcgcatgcgttcttacaatgcatttgtctgtgatcacagcgctaaaatcattgaagaaaatttcccagaagctgtggctgaagggtttgaagagagtggcaaa

SEQ ID NO: 246 - protein, 933 aa, Streptococcus pyogenes
MKLKETLNLGKTAFPMRAGLPNKEPQWQAAWEQAELYKKRQELNAGKPAFHLHDGPPYANGNIHVGHALNKISKDIIVRSKSMSGFQAPYVPGWDTHGLPIEQVLAKQGIKRKEMDLAEYLEMCRQYALSQVDKQRDDFKRLGVSADWENPYVTLDPQFEADQIRVFGAMAEKGYIYRGAKPVYWSWSSESALAEAEIEYHDIDSTSLYYANKVKDGKGILDTNTYIVVWTTTPFTVTASRGLTVGPDMDYLVVKPAGSDRQYVVAEGLLDSLAGKFGWESFETLASHKGADLEYIVTEHPWDTDVEELVILGDHVTLESGTGIVHTAPGFGEDDYNVGTKYKLEVAVTVDERGLMMENAGPDFHGQFYNKVTPIVIDKLGDLLLAQEVINHSYPFDWRTKKPIIWRAVPQWFASVSDFRQDILDEIEKTTFHPSWGETRLYNMIRDRGDWVISRQRAWGVPLPIFYAEDGTAIMTKEVTDHVADLFQENGSIIWWQKEAKDLLPEGFTHPGSPNGEFTKETDIMDVWFDSGSSWNGVMNTKENLSYPADLYLEGSDQYRGWFNSSLITSVAVNGHAPYKAILSQGFVLDGKGEKMSKSKGNIISPNDVAKQYGADILRLWVASVDTDNDVRVSMEILGQVSETYRKIRNTLRFLIANTSDFNPATDTVAYADLGTVDKYMTIVFNQLVATITDAYERYDFMAIYKAVVNFVTVDLSAFYLDFAKDVVYIEAANSLERRRMQTVFYDILVKITKLLTPILPHTTEEIWSYLEHESEAFVQLAEMPVAETFSAQEDILEAWSAFMTLRTQAQKALEEARNAKIIGKSLEAHLTIYASEEVKTLLTALDSDIALLLIVSQLTIADLADAPADAVAFEGVAFIVEHAIGEVCERSRRIDPTTRMRSYNAFVCDHSAKIIEENFPEAVAEGFEESGK

SEQ ID NO: 247 - DNA, 300 bp, Streptococcus agalactiae
atgagactaattaatacaaccagtagtcatcctgaactagttcgaaatcaactccaaaatacagatgcaaaattagtggaagtctattcagctggcaacaccgatgtcgtttttacaaaagcacctaaacattatgaattattaatttcaaacaaatatcgtgctatcaaagatgaagaattagaagctattcgtgagttcttcttaaagcgtaaaatagatcaatctattattattcaagagcagatgaaatcactccatactgccaagttaattgaaatttcatatccaacaacagca

SEQ ID NO: 248 - protein, 100 aa, Streptococcus agalactiae
MRLINTTSSHPELVRNQLQNTDAKLVEVYSAGNTDVVFTKAPKHYELLISNKYRAIKDEELEAIREFFLKRKIDQSIIIQEQMKSLHTAKLIEISYPTTA

SEQ ID NO: 249 - DNA, 300 bp, Streptococcus pyogenes
atgagactcatcaataccactagcagtcacccagaactcatcaaaaatcagctaaaaaacaccgatgcctatttagtcgaagtatactcagcaggaaatacagatgtcatttttacccaagcaccaaaacattacgaactacttatttcaaataaataccgtgccatcaaggaggatgaacttgatatcattcgcgaattttttttaaaacgtaaaattgatcctaaaattgttattcctggacaatcaaaaacacttcacacgaataaccttattgaaatttcatttcaaacttctgta

SEQ ID NO: 250 - protein, 100 aa, Streptococcus pyogenes
MRLINTTSSHPELIKNQLKNTDAYLVEVYSAGNTDVIFTQAPKHYELLISNKYRAIKEDELDIIREFFLKRKIDPKIVIPGQSKTLHTNNLIEISFQTSV

SEQ ID NO: 251 - DNA, 453 bp, Streptococcus agalactiae
atgactaatcctactttcggtgaaaaaatagataatgtaaactataggtcacgatttggtgtctatgctattattccaaatccaactcatgataaaattattttagtacaggcacctaatggtgcttggtttcttccaggtggggaaattgaagaaaatgaaaatcacctagaagctttaactcgtgagttaattgaagaattaggttattccgcaacaattggccattactatggtcaagctgatgaatatttttactctagacaccgtgatacttactactataatcccgcctatatttatgaagttactgcctatcataaggatcaagcgccactagaagatttcaaccatctagcctggtttcctatccaagaagctaaagaaaagctaaaacgaggaagccatagatggggtgtccaagcttgggaaaaaaatcaccattctaggaaa

SEQ ID NO: 252 - protein, 151 aa, Streptococcus agalactiae
MTNPTFGEKIDNVNYRSRFGVYAIIPNPTHDKIILVQAPNGAWFLPGGEIEENENHLEALTRELIEELGYSATIGHYYGQADEYFYSRHRDTYYYNPAYIYEVTAYHKDQAPLEDFNHLAWFPIQEAKEKLKRGSHRWGVQAWEKNHHSRK

SEQ ID NO: 253 - DNA, 453 bp, Streptococcus pyogenes
atgatgattccaacatttggacataaaaatgcacataaagactatgtcacacgttacggtgtctatgctatcattcccaatcacgaacaaacaaaaattattcttgttcaagctcctaatggttcctggtttttacctggtggtgaaattgaagcaggtgaaggtcagcttcaggccctagagcgtgaactgattgaagaacttggtttttctgctactattggttcatattacggtcaggcagatgaatatttctactctcgccatcgtgatacccacttctaccatcctgcctatctttatgaagtaactgcatttcaagccgtttctaagcccttagaagattttaataacttaggttggttttctcctatcgaggcaattgctaaattaaaacgagagagccatcaatggggagtcaaggaatggcaaaaaaagcatcattctactaac

SEQ ID NO: 254 - protein, 151 aa, Streptococcus pyogenes
MMIPTFGHKNAHKDYVTRYGVYAIIPNHEQTKIILVQAPNGSWFLPGGEIEAGEGQLQALERELIEELGFSATIGSYYGQADEYFYSRHRDTHFYHPAYLYEVTAFQAVSKPLEDFNNLGWFSPIEAIAKLKRESHQWGVKEWQKKHHSTN

SEQ ID NO: 255 - DNA, 2259 bp, Streptococcus agalactiae
atgctctgtcaaaactgcaaactaaacgaatcaactattcatttgtatacaaatgttaatggaaaacaaaagcaagttgatctttgtcaaaattgctaccaaattattaaaactgaccctaataatccacttttttcaggtttaaatcatgtttcacatgcgcctggtggcatcaatcctttctttgatgatttctttggagatttaaataatttcagagcctttaatggccaagatttaccaaacactcctcctacacaatcaggaggaaaccgaggtggaggaaacggtaatggacgaaataataatcgcaaccaaactgcaactccttctcaagccaaagggattctagaagaatttggtatcaatgtcactgaaatagcccgccatggtgatattgaccctgttattggacgtgactcagaaattattcgtgttatcgaaatccttaatcgtcgtacaaaaaataatcctgtacttattggcgaacccggcgttgggaaaactgccgttgttgaaggacttgctcagaaaattgttgatggtaatgtgcctcataaacttcaaggcaaacaagttattcgtttggatgttgtgagtctagtacaaggaacgggcattcgtggtcaatttgaagaacgcatgcaaaagttgatggaagaaattcgtcaacgtcaagatgttattctattcatagatgaaattcacgaaatagttggagctggtacagctggcgaaggtagtatggatgcaggtaatattttaaaacctgcccttgcacgtggagaattacaactagtaggtgctactactctcaatgaatatcgtattatcgaaaaggacgctgccttagaacgccgtatgcaacctgtaaaagtcgatgagccttctgttgaagaaaccattactattttgaaaggtatccaaaaaaaatacgaagattatcatcatgtaaaatataataatgatgccatagaagcagctgcagtactatctaatcgttatatccaggaccgctttttacctgataaagcaatagacttattagatgaagctggttctaaaatgaacctaacactaaattttgttgatccaaaagaaattgatcaacgtctcattgaagcagaaaatttaaaagcgcaagcgactcgtgaagaagattacgaacgtgcagcttacttccgtgaccagattgcaaaatataaagaaatgcaacaacaaaaggtcgacgatcaagatacacctattattaccgaaaaaacaattgagcacatcattgaagaaaaaacgaatatccctgttggtgatttaaaagaaaaagaacaatctcaattaattaatctcgcagatgacttgaaacaacatgtgatcggccaggatgacgctgtcgttaagattgcaaaagctattcgtcgtaatcgagttggtcttggtagcccaaaccgtcctattggttcctttttatttgtaggaccaaccggcgttggtaaaactgaactttctaaacaactagcaattgagctctttggttcagctgatagtatgattcgttttgatatgtcagagtacatggaaaagcatgctgttgctaaattagtcggagcgcctccaggatacgtgggatacgaggaagctggacaattaactgaaaaggttcgtcgaaatccttactcgctcatccttctagatgaaattgaaaaagctcatcctgatgtcatgcatatgttcttgcaggtccttgatgacggtcgattaacagatggacaaggaagaactgttagttttaaagataccattatcatcatgacctcaaatgctggttctggtaaaactgaagcaagcgttggctttggtgcctcacgagaaggtagaacgaattccgtactaggtcaactaggtaacttcttcagccctgaatttatgaaccgctttgacggtattattgaattcaaggctttagataaagagaatctcctcaatatcgttgatattatgttatctgacgttaatgcacgtctcgccatcaatggtattcatctagatgtcactgataaagtgaaagaaaaattggttgatttaggttacgatcccaaaatgggagcacgtccattacgtcgtaccattcaagaacatattgaagatgctatcacagattactatcttgagaatccaagcgaaaaagaacttcgtgctattatgactagcaatggaaatatcataataaaatcttctaaaaaaactgaagaaagtacaaaaggt

SEQ ID NO: 256 - protein, 753 aa, Streptococcus agalactiae
MLCQNCKLNESTIHLYTNVNGKQKQVDLCQNCYQIIKTDPNNPLFSGLNHVSHAPGGINPFFDDFFGDLNNFRAFNGQDLPNTPPTQSGGNRGGGNGNGRNNNRNQTATPSQAKGILEEFGINVTEIARHGDIDPVIGRDSEIIRVIEILNRRTKNNPVLIGEPGVGKTAVVEGLAQKIVDGNVPHKLQGKQVIRLDVVSLVQGTGIRGQFEERMQKLMEEIRQRQDVILFIDEIHEIVGAGTAGEGSMDAGNILKPALARGELQLVGATTLNEYRIIEKDAALERRMQPVKVDEPSVEETITILKGIQKKYEDYHHVKYNNDAIEAAAVLSNRYIQDRFLPDKAIDLLDEAGSKMNLTLNFVDPKEIDQRLIEAENLKAQATREEDYERAAYFRDQIAKYKEMQQQKVDDQDTPIITEKTIEHIIEEKTNIPVGDLKEKEQSQLINLADDLKQHVIGQDDAVVKIAKAIRRNRVGLGSPNRPIGSFLFVGPTGVGKTELSKQLAIELFGSADSMIRFDMSEYMEKHAVAKLVGAPPGYVGYEEAGQLTEKVRRNPYSLILLDEIEKAHPDVMHMFLQVLDDGRLTDGQGRTVSFKDTIIIMTSNAGSGKTEASVGFGASREGRTNSVLGQLGNFFSPEFMNRFDGIIEFKALDKENLLNIVDIMLSDVNARLAINGIHLDVTDKVKEKLVDLGYDPKMGARPLRRTIQEHIEDAITDYYLENPSEKELRAIMTSNGNIIIKSSKKTEESTKG

SEQ ID NO: 257 - DNA, 2280 bp, Streptococcus pyogenes
atgctgtgtcaaaattgtaatttaaacgaatctactattcatctttatacaagtgttaatggaaaacaaagacaggttgatctctgtcaaaattgttatcaaatcatgaaatccgatcctgccaattctattttaaatggcctaaccccaggatatagagcacaagatagatccacaagtcctttctttgatgacttttttggtgatttgaataattttagagcttttggtaatcttccaaataccccacctactcaggcagggcaaaatggaaatggcggaggacgctatggtggtaactacaacggacaacgacctgctcagccacaaacaccaaatcagcaagcaaagggcttgttagaagagtttgggattaatgtcacagatattgcaagaaatggtaatattgatcctgttattggtcgtgacgaagagattacacgcgttatcgagatcctcaaccgccgtactaaaaataatcctgtgctaattggtgagcctggagttggtaaaactgctgttgtagaaggtttggctcaaaaaattattgatggtactgttcctcaaaaactccaaggcaagcaagtgattcgtcttgatgtggttagcctcgttcagggaacaggtatccgtggtcagtttgaagagcgcatgcaaaaattaatggaagaaattcgcaatcgcaaggatgtgattctctttattgatgaaattcatgagattgtcggtgctggttctgcaggagacggcaatatggatgctggtaatattttaaaaccagccttggcccgtggtgagttgcaactcgttggtgctactacattaaatgaataccgtattattgaaaaagacgctgccttagaacgacgtatgcaacccgttaaagttgatgaaccttctgttgaggaaaccatcacgattttaaaaggtatccaaccgaaatacgaagactatcatcatgtcaaatatagcccagccgctattgaagctgccgctcatttatctaaccgctatattcaagaccgttttcttcctgataaggctattgaccttctggacgaagctggttccaaaatgaatctaaccctcaactttgttgatcctaaagaaattgacaaacgtcttattgaagctgagaatctcaaggcgcaagctactcgagacgaagactatgaacgcgcagcttatttccgcgatcaaattacaaaatacaaagaaatgcaggctcaaaaagtcgatgagcaagatattcccatcattactgaaaaaaccattgaagctattgtagagcaaaaaactaatattccagttggggacttaaaagaaaaggaacagtctcaactcgtaaacttagccaatgatctgaaagcacacgtgatcgggcaagacgatgctgttgataaaatcgctaaggctattcgtcgtaaccgtgtgggattaggaactccaaatcgccctattggttctttcttattcgttggaccgactggggttggtaaaactgaattgtctaaacaactagccattgaactctttggttcgacaaacaatatgattcgctttgacatgtccgaatacatggaaaaacacgctgtcgccaaattagtcggggctcctccaggttatatcggctatgaagaagctggacagctaaccgaacaagttcgtcgcaatccatattcacttattctcttagatgaggtggaaaaagcccatcctgacgtcatgcacatgttcttacaagttcttgatgatggccgtttaacagatggtcaaggacgaacagtcagcttcaaggacaccattattatcatgacctctaatgccggaacaggtaaaagcgaagcttctgtcggatttggtgctgctagagaaggacggacaagttctgtccttggtgaattaagcaacttcttcagcccagagtttatgaatcgtttcgatggtattattgaattcaaagctttatctaaagagcatttgctgcatatcgttgatttaatgctggaagatgttaatgagcgcttaggctataatgggattcatcttgatgtgacacaaaaggtcaaagaaaaattagtagatttaggctatgatcctaaaatgggcgctcggccgctccgtcgtactattcaagattatatcgaagatgccattacagactattatttagaacacccaactgaaaaacagttacgtgcactgatgacaaacagtgaaaatatcacgattaaagctgttaaagagggagattcttttcttaacgaagagtctctcgat

SEQ ID NO: 258 - protein, 760 aa, Streptococcus pyogenes
MLCQNCNLNESTIHLYTSVNGKQRQVDLCQNCYQIMKSDPANSILNGLTPGYRAQDRSTSPFFDDFFGDLNNFRAFGNLPNTPPTQAGQNGNGGGRYGGNYNGQRPAQPQTPNQQAKGLLEEFGINVTDIARNGNIDPVIGRDEEITRVIEILNRRTKNNPVLIGEPGVGKTAVVEGLAQKIIDGTVPQKLQGKQVIRLDVVSLVQGTGIRGQFEERMQKLMEEIRNRKDVILFIDEIHEIVGAGSAGDGNMDAGNILKPALARGELQLVGATTLNEYRIIEKDAALERRMQPVKVDEPSVEETITILKGIQPKYEDYHHVKYSPAAIEAAAHLSNRYIQDRFLPDKAIDLLDEAGSKMNLTLNFVDPKEIDKRLIEAENLKAQATRDEDYERAAYFRDQITKYKEMQAQKVDEQDIPIITEKTIEAIVEQKTNIPVGDLKEKEQSQLVNLANDLKAHVIGQDDAVDKIAKAIRRNRVGLGTPNRPIGSFLFVGPTGVGKTELSKQLAIELFGSTNNMIRFDMSEYMEKHAVAKLVGAPPGYIGYEEAGQLTEQVRRNPYSLILLDEVEKAHPDVMHMFLQVLDDGRLTDGQGRTVSFKDTIIIMTSNAGTGKSEASVGFGAAREGRTSSVLGELSNFFSPEFMNRFDGIIEFKALSKEHLLHIVDLMLEDVNERLGYNGIHLDVTQKVKEKLVDLGYDPKMGARPLRRTIQDYIEDAITDYYLEHPTEKQLRALMTNSENITIKAVKEGDSFLNEESLD

SEQ ID NO: 259 - DNA, 696 bp, Streptococcus agalactiae
atgtcaatgaatttttcatttttaccacaatattggtcctattttaattatggtgtgatggtaaccattatgatttcaacatgtgttgttttttttggaactattataggtgtgttaattgctttagtaaagcgtactaatttacattttctcacaatattagctaatttctatgtatgggtatttcgtgggacaccgatggtagttcaaattatgattgctttcgcatggatgcattttaacaatttaccaacgattagctttggtgttttagatttagattttacacgacttttacctggtatcattatcatttccttaaatagtggtgcctatatttcggaaattgtacgtgcagggattgaggctgtaccatctggacaaatagaagcagcttactcgttggggattcgacctaaaaatacacttcgctatgttatcttaccccaagcttttaaaaatattttacctgctctagggaatgaatttattacaattattaaagatagtgctctccttcaaactattggtgtcatggaattatggaacggagcacaatcagttgtaacggctacttactcaccagttgcaccgttattatttgcagcattttactatttaatgttgacaacgattctctcagctttgttaaaacaaatggagaaatatcttgggaaaggggtaaaaatagatggt

SEQ ID NO: 260 - protein, 232 aa, Streptococcus agalactiae
MSMNFSFLPQYWSYFNYGVMVTIMISTCVVFFGTIIGVLIALVKRTNLHFLTILANFYVWVFRGTPMVVQIMIAFAWMHFNNLPTISFGVLDLDFTRLLPGIIIISLNSGAYISEIVRAGIEAVPSGQIEAAYSLGIRPKNTLRYVILPQAFKNILPALGNEFITIIKDSALLQTIGVMELWNGAQSVVTATYSPVAPLLFAAFYYLMLTTILSALLKQMEKYLGKGVKIDG

SEQ ID NO: 261 - DNA, 684 bp, Streptococcus pyogenes
atggatttgtcatttttgcccaaatactgggcctactttaactacggtgtacttgtcaccattatgatttcagtcagcgttgtcttttttggaacccttattggtgtcttggtaaccctgattaagcgtagtcatgtgaagccgttgacctgggtcgttaatctttacgtttggatctttcggggaacacctatggtggttcaaatcatgattgcctttgcttggatgcattttaacaatatgcctactattggttttggggttttagacttggacttttcaagactacttcctggaattattatcatttcattgaatagcggtgcttatatttcagaaattgttagagcaggtattgaggctgtaccaaaagggcaattagaagcagcttattcactaggtattcgtcctcaaaatgccatgcgttatgtgattttgcctcaggcctttaaaaatattttgccagccttaggaaatgaatttattaccattattaaggatagtgctcttttacaaaccattggagtgatggaactttggaatggtgcccaatcggtggtaacggctacttattctccaatttcccctttactggtggctgctttttactacttaatggtcacaacagtgatggcacagttattggcagtcttagaacgtcacatggcgcaaggaggtaatcat

SEQ ID NO: 262 - protein, 228 aa, Streptococcus pyogenes
MDLSFLPKYWAYFNYGVLVTIMISVSVVFFGTLIGVLVTLIKRSHVKPLTWVVNLYVWIFRGTPMVVQIMIAFAWMHFNNMPTIGFGVLDLDFSRLLPGIIIISLNSGAYISEIVRAGIEAVPKGQLEAAYSLGIRPQNAMRYVILPQAFKNILPALGNEFITIIKDSALLQTIGVMELWNGAQSVVTATYSPISPLLVAAFYYLMVTTVMAQLLAVLERHMAQGGNH

SEQ ID NO: 263 - DNA, 1701 bp, Streptococcus agalactiae
atgtctcatatgaattataaagagatttatcaagagtggttagaaaacgactcactcggtaaagatattaagtcagatttagaagctattaaaggcgatgaatctgaaattcaggatcgtttttacaaaacattagaatttggaacggcgggattgagaggtaaacttggagcaggaaccaatcgtatgaatacttatatggtggggaaagcagcacaagcattagctaatacgattattgatcatggccctgaagctattgcacgtggaattgcagttagttatgatgtccgttatcaatctaaggaatttgcagaattaacttgttccattatggcagcaaatggtattaagtcttatatttataaagggattcgcccaacaccaatgtgctcatatgctattcgtgctctaggatgtgtttcgggtgtgatgattactgctagtcataatcctcaagcttataatggttataaggcatattggaaagaaggatctcagattttagatgatattgctgatcaaattgccaatcatatggatgctataaccgattatcagcaaattaagcaaataccctttgaagaggctctggcaagtggttcggcaagttatatcgatgagagtattgaagaagcatataaaaaagaagtgcttggtttaactattaatgatactaatattgataagtcagtccgggtagtttatactcctttaaatggcgtaggaaatttacctgtgcgcgaagttttaagacgccgtggttttgaaaatgtttatgtggtacctgagcaggaaatgcccgatcctgattttacaacggttggctatccaaaccctgaagttcctaaagcatttgcctattcagaatctctaggaaagtcagttgatgcagatatcttacttgccacagatccagattgtgaccgagtagcattggaagtcaaagatagtaagggagaatatattttcttaaatggtaataagataggggcacttctttcctattatattttttcacaacgatgtgccttagggaatttgccacatcatcctgtattggtaaaatccattgtaactggtgatctatcaaaagttattgcagataaatataatattgaaactgttgaaactttaacaggatttaaaaatatttgtggaaaagctaatgaatatgatatctcaaaggataaaacttatctctttggctatgaagaaagtattggtttttgctatggcacttttgtacgtgataaagatgctgtgagtgcttcaatgatggtagtagaaatgactgcctattataaagaacgagggcaaacacttttagacgttttgcaaaccatttacgataaatttggctattacaacgagcgccaattttctcttgagttagagggtgctgaggggcaagaacgtattagtcgtattatggaggattttagacaggacccaatattacaagtaggtgagatgacattggagaattctattgatttcaaggatggttataaggattttccaaagcaaaattgtttaaaatattattttaatgagggttcatggtatgctttaaggccgtcagggacggaacctaagataaaatgttacctttatacgattggttgtacagaagcagatagtttatcgaaacttaatgcaattgagtcggcttgtcgtgctaaaatgaatagtactaaa

SEQ ID NO: 264 - protein, 567 aa, Streptococcus agalactiae
MSHMNYKEIYQEWLENDSLGKDIKSDLEAIKGDESEIQDRFYKTLEFGTAGLRGKLGAGTNRMNTYMVGKAAQALANTIIDHGPEAIARGIAVSYDVRYQSKEFAELTCSIMAANGIKSYIYKGIRPTPMCSYAIRALGCVSGVMITASHNPQAYNGYKAYWKEGSQILDDIADQIANHMDAITDYQQIKQIPFEEALASGSASYIDESIEEAYKKEVLGLTINDTNIDKSVRVVYTPLNGVGNLPVREVLRRRGFENVYVVPEQEMPDPDFTTVGYPNPEVPKAFAYSESLGKSVDADILLATDPDCDRVALEVKDSKGEYIFLNGNKIGALLSYYIFSQRCALGNLPHHPVLVKSIVTGDLSKVIADKYNIETVETLTGFKNICGKANEYDISKDKTYLFGYEESIGFCYGTFVRDKDAVSASMMVVEMTAYYKERGQTLLDVLQTIYDKFGYYNERQFSLELEGAEGQERISRIMEDFRQDPILQVGEMTLENSIDFKDGYKDFPKQNCLKYYFNEGSWYALRPSGTEPKIKCYLYTIGCTEADSLSKLNAIESACRAKMNSTK

SEQ ID NO: 265 - DNA, 1701 bp, Streptococcus pyogenes
atgagtaatatgacttacaacgaggtatatcaagaatggttgcacaataatgatcttagtgatgatattaaagcagatttagcagccataaaagacaatgaggctgagattcaagatcgtttttacaaaacacttgaatttggaacagcagggctaagaggaaaacttggagcaggcaccaatcgcatgaatacctatatggttggtaaggcagcacaagctttagctaatactattattgatcatggacctgaagcggttaaaaagggcattgcggttagttatgatgttcgctatcaatctagaacatttgcagaattaacatgctctattatggcagctaacggtattaaggcgtacctttataaagggattcggccaacaccaatgtgttcgtacgctattcgtgctttgggatgtatttctggtgttatgattacggctagtcacaatccccaagcttacaatggttacaaagcttattggcaagaaggttctcaaattttggatgacattgcggatcaaattgcacaacacatggctgcactaactcagtatcaggaaatcaaacaaatgccttttgaaaaggctctggacagtggacttgttacttatattgatgagagtattgaagaagcatataaaaaagaagtgcttggtttaacgattaatgatactgacattgataagtcagtccgagtagtctatacccctttaaatggtgttgggaatctaccagtgcgtgaggttttaagacgccgcggttttgaaaatgtttatgtggtacctgagcaggaaatgcccgatcctgattttacaacagttggctatcctaatcccgaagtccctaaaacttttgcatattcagaaaaattaggtaaggcagttgatgctgatattttgattgcaactgatccagattgtgaccgtgtggctttagaagttaaaaatgcagtcggtgactatgtttttctcaatggcaataaaatcggagcgcttttatcttactatatcttttcacaacgatttgacttaggcaatttaccggctaatcctgttttagtgaaatccattgtaacaggagacttgtcacgggctattgctagccattatggtattgaaaccgttgaaacattgactggttttaagaatatttgtggcaaggcaaacgaatatgatgtgacgaaacaaaaaaactacctgtttggttatgaagaaagtattggtttttgctatggcacttttgttcgtgacaaagacgctgttagcgcctctatgatgattgtagaaatggcagcttactacaagaaaaaagggcagaatttactagatgttttgcagactatttatgcgacatttgggtattataatgaacgtcaaattgccttggagcttgaggggatagaaggacaaaaacgcattgcgaggataatggaagatttcagacagacaccaatagctagtgttgcagagatggcgttagacaagacaattgattttattgatggctatcaagattttccaaagcaaaactgtctcaaattttatttggatgatggttcttggtatgcacttagaccatcaggaacagagcctaaaataaaattttatttatatactattggccaaacacaagaaaatagtgcaacaaaattagatgctattgaagcagcgtgtcgcacaaaaataaatcaggttaat

SEQ ID NO: 266 - protein, 567 aa, Streptococcus pyogenes
MSNMTYNEVYQEWLHNNDLSDDIKADLAAIKDNEAEIQDRFYKTLEFGTAGLRGKLGAGTNRMNTYMVGKAAQALANTIIDHGPEAVKKGIAVSYDVRYQSRTFAELTCSIMAANGIKAYLYKGIRPTPMCSYAIRALGCISGVMITASHNPQAYNGYKAYWQEGSQILDDIADQIAQHMAALTQYQEIKQMPFEKALDSGLVTYIDESIEEAYKKEVLGLTINDTDIDKSVRVVYTPLNGVGNLPVREVLRRRGFENVYVVPEQEMPDPDFTTVGYPNPEVPKTFAYSEKLGKAVDADILIATDPDCDRVALEVKNAVGDYVFLNGNKIGALLSYYIFSQRFDLGNLPANPVLVKSIVTGDLSRAIASHYGIETVETLTGFKNICGKANEYDVTKQKNYLFGYEESIGFCYGTFVRDKDAVSASMMIVEMAAYYKKKGQNLLDVLQTIYATFGYYNERQIALELEGIEGQKRIARIMEDFRQTPIASVAEMALDKTIDFIDGYQDFPKQNCLKFYLDDGSWYALRPSGTEPKIKFYLYTIGQTQENSATKLDAIEAACRTKINQVN

SEQ ID NO: 267 - DNA, 852 bp, Streptococcus agalactiae
atgactgaattaatagatggtaaagccttatcacaaaaaatgcaggctgagttagggcgaaaagttgaaaggttaaaggaacagcatggtatcatacctggtttagctgtaatccttgttggggataatccagctagccaagtgtacgttcgaaataaagaacgctctgcattagaagctggttttaaaagtgagactctacgattatctgaatccatttctcaagaagaactgattgatattatccatcaatacaatgaagataaaagtatccatggtattttagttcaacttccgttaccacaacatattaacgataaaaaaattattttagcaatagatcctaagaaagatgttgatggtttccacccaatgaatacgggtcatctttggtcaggacgaccgatgatggtaccttgtacgccagctggtattatggagatgtttagagagtaccatgtggatttagagggaaaacatgctgttatcatcggaaggtccaatattgttggtaagccaatggcacaacttctccttgataaaaacgcaacagttactttgacacattcaagaactcgaaacctttctgaggtaacaaaggaggctgatatccttattgttgcgattggtcaggggcactttgttacaaaagacttcgttaaagaaggtgctgtggtgattgatgttggtatgaatcgcgatgaaaatggtaaattgattggagacgttgtatttgaacaagtggcagaagttgctagtatgataacacctgttcctgggggcgtaggacctatgacgattacaatgcttttggaacaaacttatcaagcagctcttagaagtgtgagtcta

SEQ ID NO: 268 - protein, 284 aa, Streptococcus agalactiae
MTELIDGKALSQKMQAELGRKVERLKEQHGIIPGLAVILVGDNPASQVYVRNKERSALEAGFKSETLRLSESISQEELIDIIHQYNEDKSIHGILVQLPLPQHINDKKIILAIDPKKDVDGFHPMNTGHLWSGRPMMVPCTPAGIMEMFREYHVDLEGKHAVIIGRSNIVGKPMAQLLLDKNATVTLTHSRTRNLSEVTKEADILIVAIGQGHFVTKDFVKEGAVVIDVGMNRDENGKLIGDVVFEQVAEVASMITPVPGGVGPMTITMLLEQTYQAALRSVSL

SEQ ID NO: 269 - DNA, 858 bp, Streptococcus pyogenes
atgtcaatgacagaactaattgatggtaaagccttagctcaaaagatgcaacaagagttagcagctaaagtcaacaatctaaaacaaaaaaaaggaattgtaccaggcttagccgttattcttgtaggtgatgatcctgctagtcaggtgtatgtccgtaataaagagcgtgcagctcttactgtaggttttaaaagtgagaccgttagattatcagaattcatttgtcaagaagagcttattgcagtaatcgaacgttacaatgcagataacactattcatggtattttagtgcagctacccctgccaaatcatattaatgataaaaaaattattctcgccattgatcccaaaaaagatgtggatggttttcacccgatgaatacaggtcacctttggtcaggacgtcccttgatggttccttgtactccatcagggattatggaattgcttcgagaatataatgttaaccttgaaggtaaacatgccgtcattattggcagatcgaatatcgttggaaaaccaatggcacagctcttactggacaaaaatgcaacagtcacgttgacacattcaagaacacgtcaattagaagaagtatgtcgctgtgcagatgtgttgattgtggcaatcggacaaggtcatttcataacaaaacaatatataaaagatggtgcgatagtgattgatgtaggaatgaaccgtgatgataatggcaagctaattggagatgtggcctttgatgaggtggcagaagttgcagcgaaaatcacccctgtaccaggaggtgtcggtcctatgacgattgctatgttgctagagcaaacttatcaatctgctctccgtagtactcataaa

SEQ ID NO: 270 - protein, 286 aa, Streptococcus pyogenes
MSMTELIDGKALAQKMQQELAAKVNNLKQKKGIVPGLAVILVGDDPASQVYVRNKERAALTVGFKSETVRLSEFICQEELIAVIERYNADNTIHGILVQLPLPNHINDKKIILAIDPKKDVDGFHPMNTGHLWSGRPLMVPCTPSGIMELLREYNVNLEGKHAVIIGRSNIVGKPMAQLLLDKNATVTLTHSRTRQLEEVCRCADVLIVAIGQGHFITKQYIKDGAIVIDVGMNRDDNGKLIGDVAFDEVAEVAAKITPVPGGVGPMTIAMLLEQTYQSALRSTHK

SEQ ID NO: 271 - DNA, 834 bp, Streptococcus agalactiae
atgattgttggtgaacaagaagcgagggcgttaattaagccacgccctaaatcaagccataaaggtgattatggtagtgttcttctgataggaggtttttatccctatggaggtgctattataatggcagctttggcctgtgtcaaaactggtgcaggattagttactgtagcaacccaaagttgcaatatcccctctttgcatagtcaactaccagaggtaatggcgtttgatagtgatgattacaaatggttggaaaaatcaattgttcaaagtgatgttattgtaattggtcctggattaggagtatcagaatcatctcgaaaaattttgaaccagaccatggagaagattcaatcacatcaaagtgtcatccttgacggatcagccttgactctgttatcagaaggtgcgtttccgcaaacaaaggctaaaaatttagtgttgacacctcatcaaaaagaatgggagcgattgtcaggtatcgctgtatcgcaacagacaaaagaaaatacccaaaccgctcttaaatcttttcccaaagggacgattttagtcgctaagagttcgcatacgcgtatttttcaagatttagacgaaaaagaaattatagtaggaggtccttaccaggcgactggagggatgggggatactttgtgtggtatgattgcaggtatgttagcgcaatttaaagaagcctctcctctagataaggtatcagtgggagtttatctacattcggcaattgctcaaggattatctaaagaagcctatgttgttctaccgacaacgattagtgatgagattccaaaagaaatggctagactatctaaa

SEQ ID NO: 272 - protein, 278 aa, Streptococcus agalactiae
MIVGEQEARALIKPRPKSSHKGDYGSVLLIGGFYPYGGAIIMAALACVKTGAGLVTVATQSCNIPSLHSQLPEVMAFDSDDYKWLEKSIVQSDVIVIGPGLGVSESSRKILNQTMEKIQSHQSVILDGSALTLLSEGAFPQTKAKNLVLTPHQKEWERLSGIAVSQQTKENTQTALKSFPKGTILVAKSSHTRIFQDLDEKEIIVGGPYQATGGMGDTLCGMIAGMLAQFKEASPLDKVSVGVYLHSAIAQGLSKEAYVVLPTTISDEIPKEMARLSK

SEQ ID NO: 273 - DNA, 1338 bp, Streptococcus agalactiae
atgtcagactatttatccgtgtcgacactgactaagtatttaaaattaaaatttgacaaagacccttatttagagagggtttatttaactgggcaagtgtctaattttcgtcgtcgcccaaaccatcaatatttctctttaaaagatgataaatcagtcattcaggcgacaatgtggtcaggtcacttcaaaaaattgggttttgaattagaggaagggatgaaggttaatgtagttggccgtgttcaactttatgaaccaagcggctcctactctattattgttgaaaaagcagaaccggatggtataggagctcttgctatccaatttgaacaactaaagaagaaactctctcaagcaggttattttgatgatcgtcataagcaattaattcctcaatttgttagaaaaataggagttgtgactagtccaagtggagccgttattcgggatattattacaacagtatctcgtcgatttccaggagtggaaatattacttttccccacaaaagttcaaggagagggcgcagctcaggaaatagcacaaactattgctttagctaacgagaaaaaggatttggatctattaattgttggccgtgggggaggttctattgaggacttatgggcatttaatgaagaatgtgttgtagaagctatttttgaatctcgtcttcccgttatttctagtgtcggacatgaaactgatacaactttagcagattttgtagccgatcgcagagcagcaactccaactgcagcagctgagcttgctacaccggttactaaaattgatatcttgtcttggattactgaacgtgaaaatagaatgtatcagtctagccttcgtcttatcaggacaaaagaggagaggttgcaaaaatcaaagcaatcagttatttttaggcaaccagagcgtctatatgatggtttccttcaaaaattagataacctaaatcagcagttaacatattctatgcgtgataaactacaaacagtaagacaaaagcaaggtttgcttcatcaaaaactgcaaggcatagatttaaaacagcgtattcatatttaccaagagcgtgttgtgcaaagtagacgactattatcaagtacaatgactagtcagtatgacagcaagctagcacgttttgaaaaggctcaagatgcgcttatatcattggatagttctagaattgtagcgcgtggttacgctattatcgaaaaaaaccatactttagtatctactactaatggaataaatgaaggagatcatttgcaagttaagatgcaagatggtcttttagaagttgaggtgaaggatgtcagacaagaaaacatt

SEQ ID NO: 274 - protein, 446 aa, Streptococcus agalactiae
MSDYLSVSTLTKYLKLKFDKDPYLERVYLTGQVSNFRRRPNHQYFSLKDDKSVIQATMWSGHFKKLGFELEEGMKVNVVGRVQLYEPSGSYSIIVEKAEPDGIGALAIQFEQLKKKLSQAGYFDDRHKQLIPQFVRKIGVVTSPSGAVIRDIITTVSRRFPGVEILLFPTKVQGEGAAQEIAQTIALANEKKDLDLLIVGRGGGSIEDLWAFNEECVVEAIFESRLPVISSVGHETDTTLADFVADRRAATPTAAAELATPVTKIDILSWITERENRMYQSSLRLIRTKEERLQKSKQSVIFRQPERLYDGFLQKLDNLNQQLTYSMRDKLQTVRQKQGLLHQKLQGIDLKQRIHIYQERVVQSRRLLSSTMTSQYDSKLARFEKAQDALISLDSSRIVARGYAIIEKNHTLVSTTNGINEGDHLQVKMQDGLLEVEVKDVRQENI

SEQ ID NO: 275 - DNA, 1353 bp, Streptococcus pyogenes
gtgaaaggtggcttgatggcagattatttaaccgtcactcatttgacgaaatatttaaaattaaaatttgaccgtgacccttatttggaacgggtttatctgactggtcaagtgtccaattttcgaaaacgaccaactcatcaatatttttccttaaaagatgaaagtgctgtgattcaagccaccatgtgggcaggagtctataaaaaactaggattcgacctagaagaaggcatgaaaattaatgtaattgggcgagtccaactttatgaacctagtggctcttactctatcgtgattgaaaaggcagagccagatggtataggtgccttggctttgcagtttgaacaattaaagaaaaaattaacggcagaaggttattttgagcaaaaacacaagcagcccttgccacagtttgtatcaaaaattggggtcattacaagtcctagtggtgctgtgattcgagatattatcacaaccgtttcacggcgttttccaggggttgagattttattattcccaactaaagtacaaggtgatggagccgcccaagaagtagtggctaatattcgaagagccaatcaaagagaggatttggacttgctcattgtcggccgtggaggtggctcgatagaagacctttgggccttcaacgaggaaatagtggttcaggctatctttgaatcgcaacttccagtgatttcgagtgtgggtcatgaaacagacacgactttagcggattttgtggcagatcgcagagcagccacaccaacagcagcagcagagttagcaacgcctattacaaaaacagatcttatgtcttggatagtagagcggcaaaatcgttcctatcaggcctgcttgaggcggattaagcaacggcaagagtgggtggataaactctcgcaatctgttatttttaggcaaccagaacgattatatgatgcctacctgcaaaaaattgatcgccttagcatgaccctgatgaatacgatgaaagatcgtctgagttccgccaaagaaaacaaggttcagttggaccatgccttggccaatagtcaattacagacaaaaatcgagcgataccaagaccgtgttgctaccgctaagcgtttactgatggctaatatggctagtcaatatgatagtcagctggctcgctttgaaaaagcacaggatgctttgctatcactggatgccagccgaattatcgcccgtggttatgcaatgattgaaaaaaatcaagcactggtagcctctgtaagtcagataacaaagggtgatcagttaaccattaagatgcgtgatggacaattagatgtagaggtaaaagatgtcaaaaacgaaaacatt

SEQ ID NO: 276 - protein, 451 aa, Streptococcus pyogenes
VKGGLMADYLTVTHLTKYLKLKFDRDPYLERVYLTGQVSNFRKRPTHQYFSLKDESAVIQATMWAGVYKKLGFDLEEGMKINVIGRVQLYEPSGSYSIVIEKAEPDGIGALALQFEQLKKKLTAEGYFEQKHKQPLPQFVSKIGVITSPSGAVIRDIITTVSRRFPGVEILLFPTKVQGDGAAQEVVANIRRANQREDLDLLIVGRGGGSIEDLWAFNEEIVVQAIFESQLPVISSVGHETDTTLADFVADRRAATPTAAAELATPITKTDLMSWIVERQNRSYQACLRRIKQRQEWVDKLSQSVIFRQPERLYDAYLQKIDRLSMTLMNTMKDRLSSAKENKVQLDHALANSQLQTKIERYQDRVATAKRLLMANMASQYDSQLARFEKAQDALLSLDASRIIARGYAMIEKNQALVASVSQITKGDQLTIKMRDGQLDVEVKDVKNENI

SEQ ID NO: 277 - DNA, 213 bp, Streptococcus agalactiae
atgtcagacaagaaaacatttgaagaaaatttacaggaattagagacaattgtctcacgtttagaaacaggtgatgttgccttagaagatgccattgctgaatttcaaaaaggaatgcttatttcaaaagagttacaaagaactttaaaagaagctgaagagacgcttgtaaaagtgatgcaagctgacggaacggaagtagaaatggatact

SEQ ID NO: 278 - protein, 71 aa, Streptococcus agalactiae
MSDKKTFEENLQELETIVSRLETGDVALEDAIAEFQKGMLISKELQRTLKEAEETLVKVMQADGTEVEMDT

SEQ ID NO: 279 - DNA, 213 bp, Streptococcus pyogenes
atgtcaaaaacgaaaacatttgaagaaaatttacaagatttagagactattgtgaacaaacttgaaaatggggatgtccctttggaagaagctatttcagaatttcaaaaaggaatgcttctctcaaaagaacttcaaaagaccttacaagcggcagaaaaaacactcgtcaaagtgatgcaagctgatggcacagaagtagatatggatgat

SEQ ID NO: 280 - protein, 71 aa, Streptococcus pyogenes
MSKTKTFEENLQDLETIVNKLENGDVPLEEAISEFQKGMLLSKELQKTLQAAEKTLVKVMQADGTEVDMDD

SEQ ID NO: 281 - DNA, 873 bp, Streptococcus agalactiae
ttgatggttactattgaaaaaattgatgaagctattcatcgttattacaaacagacacatagtgtcgtttctcctgatttgattaaggctatcctctactcagttgatggaggtgggaaacgtattcgtccacgcatccttttagaaattttagagggatttggagttgaactaatagatggtcattatgatgtggctgctgctttggagatgattcacaccggctcattaatccatgatgatttaccggcgatggataatgatgattttcgtcgtggccgcttaacaaaccataaaaagtttgatgaagctacagcggttttagctggagattccctttttttagacccatttgatttagttgtaaaagctggttttaaagctgatgttactgttaggttaatagagttattgtctatgtctgcgggtagttttggcatggttggtggacaaatgttagatatgaagggagaaaacaaagttttatctattgacgatttaagcttgattcatattaataaaacgggacgcctgttagcttatccctttgttgcagcaggtattttagctgagaagtcggaagaagtaaaaggaaaactgcatcaagctggccttttaatcggtcatgcttttcaagtacgtgatgatattttagatgtgactgctagttttgaagaattggggaagacaccaaataaagacattgtagcagaaaagacaacttatccaaatttattgggtttggataagtcacaggaaatacttgatgatactttgaaaaaagctcaggcaatttttcaaaatctagagaaaaaagctaactttaatgctagaaaaataatagatataatagagggattacggttgaatggc

SEQ ID NO: 282 - protein, 291 aa, Streptococcus agalactiae
MMVTIEKIDEAIHRYYKQTHSVVSPDLIKAILYSVDGGGKRIRPRILLEILEGFGVELIDGHYDVAAALEMIHTGSLIHDDLPAMDNDDFRRGRLTNHKKFDEATAVLAGDSLFLDPFDLVVKAGFKADVTVRLIELLSMSAGSFGMVGGQMLDMKGENKVLSIDDLSLIHINKTGRLLAYPFVAAGILAEKSEEVKGKLHQAGLLIGHAFQVRDDILDVTASFEELGKTPNKDIVAEKTTYPNLLGLDKSQEILDDTLKKAQAIFQNLEKKANFNARKIIDIIEGLRLNG

SEQ ID NO: 283 - DNA, 870 bp, Streptococcus pyogenes
atggacaaattagctagaattgacgaagccattcgtcgctactataagacgactagtaacggtgtatctgaagagttgattgatgctatcttgtattctgttgacagtggtggcaagcgcattcgcccacttatcttattagagatgattgagggatttggggtatcgttacagaatgctcattttgatttggctgcagctcttgaaatgattcatacaggaagtctgattcacgatgatttgccagccatggataatgatgattaccgacgtggcagactgaccaatcacaaacaatttggagaagccacggccattttggcgggagacagcttatttttagacccctttgggttaatagctcaagctgaattaaatagtgaggttaaagtagccttaatccaagaactttccctagcttcaggaacttttggcatggttggtggtcagatgttagatatgaaaggggaaaatcaagcattaagtcttcctcagttgtcactgattcacctcaataaaaccggaaaattattagcttttccttttaaagcagcagctcttataacagaacaggctatgactgttcgtcaacaactagagcaagcgggaatgctcatcgggcacgcctttcagattagggatgatattttagacgtgacagctagctttgaagatcttggaaaaacgcctaaaaaggacttattcgcagaaaaagctacttatccaagtttactggggttagaagcctcttaccaactgctgacagagagtttagatcaggctttgacgatttttcagacactagaaagcgatgtaggctttaagcctcaaataattacaaaactgatagaagggttacgacttaatgcc

SEQ ID NO: 284 - protein, 290 aa, Streptococcus pyogenes
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLAFPFKAAALITEQAMTVRQQLEQAGMLIGHAFQIRDDILDVTASFEDLGKTPKKDLFAEKATYPSLLGLEASYQLLTESLDQALTIFQTLESDVGFKPQIITKLIEGLRLNA

SEQ ID NO: 285 - DNA, 825 bp, Streptococcus agalactiae
atggctaaagagagggtagatgttcttgcctataaacagggactttttgatacacgagagcaagcgaaacgtggtgttatggcaggaatggtgattaacgttatcaatggagaacgttatgataaaccaggtgaaaaggttgcagacgatactgaattaaaactaaaaggtgaaaaactaaaatatgttagtagaggtggattgaaattagaaaaagctttacaagtttttgaaatttcagttgcagataagctaactatagatattggcgcctctacgggtggttttactgatgttatgctacaatcaggagcgcgtttagtttacgcagtagatgtaggaacaaatcaattagtttggaagttacgtcaggatcatcgtgttcgttctatggaacaatataattttaggtatgcccaaaaagaagatttcaaggagggactgcctgaatttgcatcgatagatgtctcatttatctctcttaatttgattttaccagctctaaaagaaattttagtggatggtggacaagtagtggcattaattaaaccacaatttgaagcaggtcgtgagcaaattggtaaaaatggtattgtcaaagacaagttggttcatgaaaaggttttgacaacagtgaccaatttcacgaaagattatggatatacggttaaacatcttgatttttcgcccattcaaggtggacatggaaatattgagtttttaatgcatttgcaaaagtgtcaagatccacaaaatcttgtgcttgaccaaatacaagatgttatagaaaaagcacataaggaatttaagaaaaatgaagaagag

SEQ ID NO: 286 - protein, 275 aa, Streptococcus agalactiae
MAKERVDVLAYKQGLFDTREQAKRGVMAGMVINVINGERYDKPGEKVADDTELKLKGEKLKYVSRGGLKLEKALQVFEISVADKLTIDIGASTGGFTDVMLQSGARLVYAVDVGTNQLVWKLRQDHRVRSMEQYNFRYAQKEDFKEGLPEFASIDVSFISLNLILPALKEILVDGGQVVALIKPQFEAGREQIGKNGIVKDKLVHEKVLTTVTNFTKDYGYTVKHLDFSPIQGGHGNIEFLMHLQKCQDPQNLVLDQIQDVIEKAHKEFKKNEEE

SEQ ID NO: 287 - DNA, 825 bp, Streptococcus pyogenes
atgcctaaagaaagagtagatgtgttagcctataagcaaggattatttgagaccagagagcaagctaagcgtggtgtcatggcaggcttagtggtctctgtgattaatggccaacgctatgacaagccaggtgacaaaattgacgatgggactgagttaaaacttaaaggtgaaaaactcaaatacgtcagtcgtggtggattaaaactggaaaaggggctgcacgtttttggtgtatcagttgctaatcaaattgggattgatattggcgcttcaacaggtggttttaccgatgttatgttacaagatggggccaaactagtctatgccgtcgacgttgggactaaccagttggtatggaaactcagacaagatccacgagtaagaagtatggaacagtataactttcgttatgctcagccagaagactttaatgagggacagcctgtatttgccagtattgatgtgtcctttatttctctcagcttgattttgccagccctgcataacgttttgtcagatcagggacaggttattgctctcattaaaccgcaatttgaagctgggcgcgagcagattggtaaaaaaggcatcgtcaaggacaaacagattcatgaaaaagtgattcaaaaggtcatggattttgcctcaggttacggatttacagttaagggacttgatttttctcctattcagggtggtcatggcaatatcgaatttttagctcatcttgctaagtcacagacacctgaaacgttagccccgcatttgattcagaaagttgttgccaaggcacataaggagtttgagaaacatgaaaaagag

SEQ ID NO: 288 - protein, 275 aa, Streptococcus pyogenes
MPKERVDVLAYKQGLFETREQAKRGVMAGLVVSVINGQRYDKPGDKIDDGTELKLKGEKLKYVSRGGLKLEKGLHVFGVSVANQIGIDIGASTGGFTDVMLQDGAKLVYAVDVGTNQLVWKLRQDPRVRSMEQYNFRYAQPEDFNEGQPVFASIDVSFISLSLILPALHNVLSDQGQVIALIKPQFEAGREQIGKKGIVKDKQIHEKVIQKVMDFASGYGFTVKGLDFSPIQGGHGNIEFLAHLAKSQTPETLAPHLIQKVVAKAHKEFEKHEKE

SEQ ID NO: 289 - DNA, 471 bp, Streptococcus agalactiae
atgaagaagagtgaacgtttaaatttaattaagcaaattgttcttaaccatgctgttgaaacacaacatgagttgttacgcagattggaagcttatggggtaactctaactcaagcaactatttcacgtgatatgaatgaaattggcattataaaagtgccatcagcaaaaggtcgctatatttacggtttgtcaaatgaaaacgaccctatctttacaactgctgtggcaaagcctattaaaacaagtattttatcaatatcagataagctactaggtttagagcaatttatcaatattaatgtcataccaggtaacagtcaattaattaaaaccttcataatgtcacattgtcaagaacatatttttagtttgacagctgacgataatagtctccttttgattgcaaaatcagaagcagatgctgatcacattcgtcaatcaatgattgcaatgttggagaaaaaagat

SEQ ID NO: 290 - protein, 157 aa, Streptococcus agalactiae
MKKSERLNLIKQIVLNHAVETQHELLRRLEAYGVTLTQATISRDMNEIGIIKVPSAKGRYIYGLSNENDPIFTTAVAKPIKTSILSISDKLLGLEQFININVIPGNSQLIKTFIMSHCQEHIFSLTADDNSLLLIAKSEADADHIRQSMIAMLEKKD

SEQ ID NO: 291 - DNA, 501 bp, Streptococcus pyogenes
ttgttgccaaggcacataaggagtttgagaaacatgaaaaagagtgaacgacttgaattaatcaaaaaaatggttttgacgcatccaattgagacgcaacatgacctcttaagattattggcagagcatgggttagaattaacccaggctactatttcaagagacatgaatgaaattggtatagtaaagattccttctggcagtggacgttacatctatggtctttctcaagatagtggaaaaaagatcgttcaaggacctagatcgataaagagcactattttagctgtatctgacaaaacaaaaggtttagaacaacacctctatttaaaagtcgtacctggcaatagtaaattaatcaaacgttatttattagcagatttttcaaaagctatttttagtcttattgctgatgatgatagtttattgttaattgcaaagtctccttcagaagcagatatgatacgccaagaaattttgctttggatgcagggtataacc

SEQ ID NO: 292 - protein, 167 aa, Streptococcus pyogenes
LLPRHIRSLRNMKKSERLELIKKMVLTHPIETQHDLLRLLAEHGLELTQATISRDMNEIGIVKIPSGSGRYIYGLSQDSGKKIVQGPRSIKSTILAVSDKTKGLEQHLYLKVVPGNSKLIKRYLLADFSKAIFSLIADDDSLLLIAKSPSEADMIRQEILLWMQGIT

SEQ ID NO: 293 - DNA, 123 bp, Streptococcus agalactiae
atggaagttttatcttccttacgtgaaaaagcagatttaatagctaacatcaatcgagataactctcctcctgaagccacttttaccaatggcttaaagccctctccgggattcgttgaaata

SEQ ID NO: 294 - protein, 41 aa, Streptococcus agalactiae
MEVLSSLREKADLIANINRDNSPPEATFTNGLKPSPGFVEI

SEQ ID NO: 295 - DNA, 1656 bp, Streptococcus agalactiae
atgcttttagaaatttctattaagaatttcgctattatcgaagaaatttcacttaattttgaaacaggaatgactgttttaactggtgagactggtgcagggaaatctatcattattgatgctatgaatatgatgttaggatcccgtgctagcgttgaagtgattcgccatggtgctaacaaagcagaaattgaaggatttttctctgttgaaaaaaatcaatcattagtccaattattggaagaaaatggcattgaattagcagatgaattaattattcgccgagaaatctttcaaaatgggcgcagcgttagtcgaattaatgggcaaatggtgaatttgtcaacactaaaagctgtggggcattatttggtagacatttatggtcagcatgaccaagaggaactaatgaaacctaacatgcacattctgatgttagatgaatttggtaatacagaatttaatgtcataaaagaacgttatcaaagtctttttgatgcttatcgtcagcttcgtaaacgcgtattggataagcaaaaaaatgaacaagagaataaatcacgtattgaaatgctagaatttcaaatagcagaaattgagtctgtagcccttaaatcagatgaagaccaaacgctactcaagcaacgtgataaattaatgaatcataagaatattgcagatactttgacaaatgcatatcttatgttagataacgaagagttttcaagtttatcgaatgttcgttctgcaatgaatgaccttatggctttagaagaatttgatcgagaatataaagatctttccaccaatctttcagaagcttactacgttattgaagaagttactaaacgtttaggtgacgttatcgatgatttagattttgacgctggtttactacaagaaattgaaaatagactagatgttattaacacaataacgcgaaaatatggcggtgatgtgaatgatgttttagactattttgataacattactaaagaatatagtctattgacaggtagtgaagagtcctcagatgctttagaaaaagaattaaagattttagaacacgatttgattgaatcagcaaatcaattaagtttagagcgccataagctagctaaacaattggaaaatgaaatcaaacaagaattaacagagctttatatggagaaagctgatttccaagttcaatttacaaaaggaaaatttaataaagaagggaacgaaatcgttgaattttatatttcaacgaatcccggagagggctttaagccattggtaaaagtggcttcaggaggagagttatctcgattgatgttagctattaaatctgctttttcacgtaaggaagataaaacttccattgtatttgatgaggtggatacaggagtttctggtcgcgtggcccaggctatcgctcaaaaaattcacaagattggtagtcatggacaagttttagcaatttctcatttagctcaggttattgcaatagcggattaccaatattttattgaaaaaatttccagtgactcttcaacagtttcaacggtaaggcttttaagctatgaagaacgtgtagaagaaatcgctaaaatgttggcaggaaacaatgtaacagacactgcacgtactcaagctaaagaattacttggtagt

SEQ ID NO: 296 - protein, 552 aa, Streptococcus agalactiae
MLLEISIKNFAIIEEISLNFETGMTVLTGETGAGKSIIIDAMNMMLGSRASVEVIRHGANKAEIEGFFSVEKNQSLVQLLEENGIELADELIIRREIFQNGRSVSRINGQMVNLSTLKAVGHYLVDIYGQHDQEELMKPNMHILMLDEFGNTEFNVIKERYQSLFDAYRQLRKRVLDKQKNEQENKSRIEMLEFQIAEIESVALKSDEDQTLLKQRDKLMNHKNIADTLTNAYLMLDNEEFSSLSNVRSAMNDLMALEEFDREYKDLSTNLSEAYYVIEEVTKRLGDVIDDLDFDAGLLQEIENRLDVINTITRKYGGDVNDVLDYFDNITKEYSLLTGSEESSDALEKELKILEHDLIESANQLSLERHKLAKQLENEIKQELTELYMEKADFQVQFTKGKFNKEGNEIVEFYISTNPGEGFKPLVKVASGGELSRLMLAIKSAFSRKEDKTSIVFDEVDTGVSGRVAQAIAQKIHKIGSHGQVLAISHLAQVIAIADYQYFIEKISSDSSTVSTVRLLSYEERVEEIAKMLAGNNVTDTARTQAKELLGS

SEQ ID NO: 297 - DNA, 1662 bp, Streptococcus pyogenes
gtgatgttattagaaatttctattaaaaattttgctattattgatgaaatttccctaaattttgaaaatggtatgacggttttgacgggtgaaactggagcaggaaagtctattatcattgatgctatgaatatgatgcttggtgcgcgtgctagtacagaagtgattcgtcgtggagctaataaagcagaaattgaggggttcttttcggtagatgctaccccagaactggttgcgtgtctggaatcatcaggtattgctatggaagaagaactgattattcgccgagatatctttgccaatggcagaagcgtgagccgcattaatggtcagatggttaacctagccaccttaaaacaggtcggacagtttttggtagatattcatgggcaacatgaccaagaagaattaatgcgaccacagctccaccagcaaattttggacgcttttggtgataaggcttttgagcaattgaaagagaattatcagcttatttttgatcgttataaaagcttgcgtcgccaggttattgacaaacaaaaaaatgaaaaggaacacaaagatcgtattgatatgttggcctttcagatagcagaaattgaagctgctgccttgagtcgaggtgaggacgaccggttaaatcaagaacgtgatcgcttaatgaaccacaaacaaattgctgataccctgaccaatgcctacgtcatgctagataatgacgatttttcaagtctatccaatattcgctctagcatgaatgacttactatcaattgagcagtttgattcagagtacaaagggatgtcgacttcgatttctgaagcctattatattcttgaagaagtgagcaagcaattatcagataccattgaccaactggattttgatggtgggcgattacaggaaattgaatttcgcttggatatactcaatagcttaactcgtaaatacggtggtaatgtgaatgatgtgcttgactactacgataatatcgtcaaagaataccagctattaacaggagatgacttgtcttcaggggatctagaggcagaattgaaaagcttggaaaaacaattggttgctgctgcttcggagttaagtgtctctcgccatcaattggcggagcaattagaagctgagattaaagctgaacttaaggaactttatatggaaaaagcagatttcaaagttcactttaccacatcaaaatttaatcgtgatggtaatgaaagcttggaattttacatctctactaatccaggcgaaggattcaagccccttgtcaaggtggcttctggaggagagttatcacgccttatgttagccatcaaggctgctatttctagaaaagaagataagacgagtattgtttttgatgaagtagatacaggtgtttctggtcgcgttgcgcaagccattgcccaaaaaatttataaaattgggcgacatgggcaagttctcgctatttcacacttacctcaagttattgctattgctgattatcagtattttatttctaaagaaagtaaagaagagtccaccgtttctaaggtaaggttattaactcctgaagaacgtgtggaagaaattgctagcatgattgcaggaacagatatgacacaagctgctcttacgcaggctcgtgaactacttgccaaacat

SEQ ID NO: 298 - protein, 554 aa, Streptococcus pyogenes
VMLLEISIKNFAIIDEISLNFENGMTVLTGETGAGKSIIIDAMNMMLGARASTEVIRRGANKAEIEGFFSVDATPELVACLESSGIAMEEELIIRRDIFANGRSVSRINGQMVNLATLKQVGQFLVDIHGQHDQEELMRPQLHQQILDAFGDKAFEQLKENYQLIFDRYKSLRRQVIDKQKNEKEHKDRIDMLAFQIAEIEAAALSRGEDDRLNQERDRLMNHKQIADTLTNAYVMLDNDDFSSLSNIRSSMNDLLSIEQFDSEYKGMSTSISEAYYILEEVSKQLSDTIDQLDFDGGRLQEIEFRLDILNSLTRKYGGNVNDVLDYYDNIVKEYQLLTGDDLSSGDLEAELKSLEKQLVAAASELSVSRHQLAEQLEAEIKAELKELYMEKADFKVHFTTSKFNRDGNESLEFYISTNPGEGFKPLVKVASGGELSRLMLAIKAAISRKEDKTSIVFDEVDTGVSGRVAQAIAQKIYKIGRHGQVLAISHLPQVIAIADYQYFISKESKEESTVSKVRLLTPEERVEEIASMIAGTDMTQAALTQARELLAKH

SEQ ID NO: 299 - DNA, 834 bp, Streptococcus agalactiae
atgagtaaaatcaaaattgtaacggattcttccattaccattgaaccagaacttattaaagagcttgacattacagttgttcccttgtcagttatgatagatggtaccttgtattcagacaatgacttaaaagcacaaggggaattcttgaacctaatgcgtggaagtaaggaattgccaaaaacaagtcaaccacctgtaggtgtttttgcagaaatttatgaaaaattaatgaatgaaggtgtggaacatatcattgcaattcatttaacgcatacactatcaggaactattgaagcatcacgccagggagctaatattgctggtgcagatgttacagttattgattctacttttacagaccagtgtcaaaaattccaggttgtagaagctgcgaaattagctaaagagggagctgatttagataccatcttggctcgtgtggaagaagtacgccagaagtcagaattatttattggcgtatcgacccttgaaaatttagtaaaaggtggtcgtattggacgtgtaacgggtcttctaagttcattgcttaatataaaagtaattatggagctaacaaaccatgaattagtaccgattgttaaaggtcgcggtctaaagaccttcagcaaatggttagataattttgttgaaagtgcccaaacacgaaaaattgctgaaattggcatctcctactgtggtaaagctgatatggctaataactttagagaaaaactagctgttctaggtgctcctatatccgttttagaaactggctcaatcatccaaactcatactggtgaggatgcatttgctgttatggttcgttatgaa

SEQ ID NO: 300 - protein, 278 aa, Streptococcus agalactiae
MSKIKIVTDSSITIEPELIKELDITVVPLSVMIDGTLYSDNDLKAQGEFLNLMRGSKELPKTSQPPVGVFAEIYEKLMNEGVEHIIAIHLTHTLSGTIEASRQGANIAGADVTVIDSTFTDQCQKFQVVEAAKLAKEGADLDTILARVEEVRQKSELFIGVSTLENLVKGGRIGRVTGLLSSLLNIKVIMELTNHELVPIVKGRGLKTFSKWLDNFVESAQTRKIAEIGISYCGKADMANNFREKLAVLGAPISVLETGSIIQTHTGEDAFAVMVRYE

SEQ ID NO: 301 - DNA, 849 bp, Streptococcus pyogenes
atggaaaaatacatgggaactataaaaattgttacagattcatcaataactattgaaccagaattaattaaagctttagatattactgtagtacctttatctgtcatgattgatagcaaattatattctgataatgatttaaaagaagaaggtcattttttgagccttatgaaggctagcaaatcccttcccaaaaccagtcagccaccggttggtctctttgctgaaacttacgaaaatttggtcaaaaaaggagtaactgacattgttgctattcacctctcaccagctttatcaggtactattgaagcttcccgtcagggggctgaaatcgctgaggcacctgttacagttttagattcaggatttactgatcaagccatgaaatttcaggtcgttgaggcagcaaagatggcaaaagcgggtgctagtttgaatgagattttggctgctgttcaagctatcaaatcaaaaacagagctctacattggtgtatctaccttagaaaatttagtaaaaggaggtcgtattggtcgtgtgacgggtgttttgagctcgctacttaatgtcaaagttgttatggcacttaaaaatgatgagttaaaaacgcttgtcaaaggtcgaggtaataaaacatttacgaaatggttagatagttacctcgctaaaaatagtcatcgcccgattgcagagatagctatttcttatgctggtgaagctagcctggcattaaccttaaaagaaagaatcgcagcttattacaaccactctatttcggttttagaaacaggctctatcatccaaacacatacaggagaaggagcttttgcggttatggttcgttatgaa

SEQ ID NO: 302 - protein, 283 aa, Streptococcus pyogenes
MEKYMGTIKIVTDSSITIEPELIKALDITVVPLSVMIDSKLYSDNDLKEEGHFLSLMKASKSLPKTSQPPVGLFAETYENLVKKGVTDIVAIHLSPALSGTIEASRQGAEIAEAPVTVLDSGFTDQAMKFQVVEAAKMAKAGASLNEILAAVQAIKSKTELYIGVSTLENLVKGGRIGRVTGVLSSLLNVKVVMALKNDELKTLVKGRGNKTFTKWLDSYLAKNSHRPIAEIAISYAGEASLALTLKERIAAYYNHSISVLETGSIIQTHTGEGAFAVMVRYE

SEQ ID NO: 303 - DNA, 867 bp, Streptococcus agalactiae
gtgaggatgcatttgctgttatggttcgttatgaataagaaaaaaatacttaccggactttctttttttctggtaagtcttcttttatcttttgggattttttccttgatcattccaaaatcaaatcctaaattaacaaaaaaagacttcctaacaaagaaagttatcccacttaactatgttgctcttggagattctctgaccgaaggtgtgggcgatacaacctctcaaggtggttttgttccactgctatcagaatcactccataatcgatactcttaccaagtgacttctgttaattatggtgtgtctgggaatactagtcaacaaattttaaaacgtatgacgacagatcctcaaatcgaaaaagatttagagaaagctgatttattgacgctaactgttggtggtaatgatgtcttggctgttattcgtaaagagctcagtcatttatcactaaattcctttgagaaaccagcagaagcatataaggaacgtttgaaagaaatccttgcaaaagcaagacaagataatcctaaattgcctatttatgttttaggcatttataatcctttttacctaaactttccacaattaactaaaatgcaaaccgttattgataattggaataaagctacaaaagaagtagttgatgcttcagaaaatgtttattttgtcccaattaatgaccgcctttataagggaataaatggtaaagagggtattacagagtcatcaaatagtcaggcaagtatcactaatgatgctctctttactggagaccattttcatcccaataatattggctatcaaatcatgtctaacgccgttatggagaaaataaatgaaacaagaaaaaactggccg

SEQ ID NO: 304 - protein, 289 aa, Streptococcus agalactiae
MRMHLLLWFVMNKKKILTGLSFFLVSLLLSFGIFSLIIPKSNPKLTKKDFLTKKVIPLNYVALGDSLTEGVGDTTSQGGFVPLLSESLHNRYSYQVTSVNYGVSGNTSQQILKRMTTDPQIEKDLEKADLLTLTVGGNDVLAVIRKELSHLSLNSFEKPAEAYKERLKEILAKARQDNPKLPIYVLGIYNPFYLNFPQLTKMQTVIDNWNKATKEVVDASENVYFVPINDRLYKGINGKEGITESSNSQASITNDALFTGDHFHPNNIGYQIMSNAVMEKINETRKNWP

SEQ ID NO: 305 - DNA, 858 bp, Streptococcus agalactiae
ttgcggttatggttcgttatgaataatcgtcatttatttagtgggatatttttctttgttattagtttatgtctggcctttttattgctaaatattattatccctaagtcaaattcacgtttgaaaaagagtgattttctgaaaaaagaacaagtagctatccaatatgttgctataggagattcattgacagaaggagtaggtgatctaactcatcaaggtggttttgttcctttgttaacgaatgatctcagtgaatattttaaggctaatgttaatcatcaaaattacggcgtatctggtgataccagtcaacaaattcttgataggatgataaaacaaaagcagatacagttatctttaaaaaaagcagatataatgacgttaaccgttggtggtaatgatgttatggcagttattcggaagaatttagcggatttgcaagtttctagttttagaaagccagctcgtcagtatcaaaaacgattaagacagattatcgagttagccagaaaagataataaagatcttcctatttttattttaggcatctataatccgttttatttgaattttccagaactaactgatatgcaaaaagtgattgatgactggaataccaaaactaaggaggttgttggagaatacgatcgtgtgtactttgtgccaataaatgacctcttgtataaagggataaatggacaagaaggaattgttcattcttcaggagatcaaactacaattgtcaatgatgccttgtttactggggaccattttcacccaaataatactggctatcaaatcatgtcaaatgcagtaatggagaaaattaaaaagcatgaaaaaaaaatcaaacct

SEQ ID NO: 306 - protein, 286 aa, Streptococcus agalactiae
LRLWFVMNNRHLFSGIFFFVISLCLAFLLLNIIIPKSNSRLKKSDFLKKEQVAIQYVAIGDSLTEGVGDLTHQGGFVPLLTNDLSEYFKANVNHQNYGVSGDTSQQILDRMIKQKQIQLSLKKADIMTLTVGGNDVMAVIRKNLADLQVSSFRKPARQYQKRLRQIIELARKDNKDLPIFILGIYNPFYLNFPELTDMQKVIDDWNTKTKEVVGEYDRVYFVPINDLLYKGINGQEGIVHSSGDQTTIVNDALFTGDHFHPNNTGYQIMSNAVMEKIKKHEKKIKP

SEQ ID NO: 307 - DNA, 600 bp, Streptococcus agalactiae
atgaaacaagaaaaaactggccgtaatttaaatttctggaaatgggcatttctcttattgttggcaattaacctttccttcacagcagtgattgcaagtcgcttaattcaagtacgtgagcctaatacaggaaaaatttcgactggggtacaagataaagtaaaagtaggtacttttacgaccaataagtcgcaactgaataagacaattgcactttatttaaaacaatatcaaactaagaagatgaattataagatttatgctgcttcatcttctatactatttgaaggctcttatcaattattaggttatgaagtgcctttatacatctattttgaaccttatcgtttaacaaatggcgctgttcaacttaaagtgacctcattttcagtaggaactcttccgcttccagaaaaagatgtgttacaatatataaaatcatcttataaattgccaaactttgtagatataaaacctaaaaaatcggttattaatattaatttgcaagatttaaaaaataaagaaggtatttatttgaaagcgactgcaattgatttagtaaacgataattttagtttcgatatttttaagaaaaagccc

SEQ ID NO: 308 - protein, 200 aa, Streptococcus agalactiae
MKQEKTGRNLNFWKWAFLLLLAINLSFTAVIASRLIQVREPNTGKISTGVQDKVKVGTFTTNKSQLNKTIALYLKQYQTKKMNYKIYAASSSILFEGSYQLLGYEVPLYIYFEPYRLTNGAVQLKVTSFSVGTLPLPEKDVLQYIKSSYKLPNFVDIKPKKSVININLQDLKNKEGIYLKATAIDLVNDNFSFDIFKKKP

SEQ ID NO: 309 - DNA, 585 bp, Streptococcus pyogenes
atgaaaaaaaaatcaaaccttaattggtggaagtggagcttcttatgtctgcttgcttttaataccgcctttttgatggttattgcaagtcgtctcattcaagtaagagaacctgagtcagaactgattgctaaaaaaccagttaaaaatatcaaaattggtacatttgttacaaccagagaacagcttaacgaaactgtagcaagttatcttaaagattatcagactgaaaaaatgtcttataaattttatgcgacatcttcttctattttgtttgaaggaacttatcaattattagggtatgaagtccctttatatatctattttcaacctcatcgtctagaaaatggagctgtccaactacaggtgatctctttttcagtgggaactctgccactcccagaaaaagatgttttgcagtatttgaaatcaagctacaaattgccaagctttgttaaagtgatgccaaatcaatcagctatcgttgttaatttacaagatatccaaaatgatgctaaggtttatttaaaagccaagaaaattgatttatttaatgatgaaatcagttttaacatctataagaaa

SEQ ID NO: 310 - protein, 195 aa, Streptococcus pyogenes
MKKKSNLNWWKWSFLCLLAFNTAFLMVIASRLIQVREPESELIAKKPVKNIKIGTFVTTREQLNETVASYLKDYQTEKMSYKFYATSSSILFEGTYQLLGYEVPLYIYFQPHRLENGAVQLQVISFSVGTLPLPEKDVLQYLKSSYKLPSFVKVMPNQSAIVVNLQDIQNDAKVYLKAKKIDLFNDEISFNIYKK

SEQ ID NO: 311 - DNA, 156 bp, Streptococcus agalactiae
  misc_feature (1)..(156): n = a, c, g, or t
atggctaacaaacaagatttaattgcaaaagtagcagaagctacagaattaactaaaaaagattcagcagcagcagtagatgcagtttttgcagctgtagcagattaccttgctgaaggtgaaaaagtacaattaatcggttnnnnnttaattaat

SEQ ID NO: 312 - protein, 52 aa, Streptococcus agalactiae
  misc_feature (1)..(52): Xaa = Any Amino Acid
MANKQDLIAKVAEATELTKKDSAAAVDAVFAAVADYLAEGEKVQLIGXXLIN

SEQ ID NO: 313 - DNA, 273 bp, Streptococcus pyogenes
atggctaacaaacaagatttaatcgcaaaggttgcagaagcaactgaattgactaaaaaagattcagcagcagcagttgatgccgtgttttctacaatcgaagctttccttgctgaaggtgaaaaagtacaattgatcggttttggtaacttcgaagtacgcgaacgtgcagctcgtaaaggtcgtaacccacaaactggtgcagaaattgaaattgcagcttcaaaagttccagccttcaaagctggtaaagctcttaaagacgctgttaaa

SEQ ID NO: 314 - protein, 91 aa, Streptococcus pyogenes
MANKQDLIAKVAEATELTKKDSAAAVDAVFSTIEAFLAEGEKVQLIGFGNFEVRERAARKGRNPQTGAEIEIAASKVPAFKAGKALKDAVK

SEQ ID NO: 315 - DNA, 1404 bp, Streptococcus agalactiae
ttggctactaaagtagatgtttcaaaagatggcttaacttatacagctacattacgtaaaggcttgaagtggtcagatggcagtaaacttactgcaaaggattttgtttattcatggcaacgtttagttgatcctaaaacagcttcacaatatgcttaccttgctgttgaagggcatgtgcttaatgccgataaaatcaacgaaggacaagagaaagacttgaataagctaggtgttaaggcggaaggcgatgacaaagttgttattactttatctagtccgtctccacaatttatctactaccttgcattcactaacttcatgccacaaaaacaagaagttgttgaaaaatatggaaaagattacgcaactacttcaaaaaatacagtttactcaggaccatatactgttgaaggttggaatggttcgaatggtactttcacgctgaagaaaaacaaaaattattgggacgctaaaaatgtaaaaacaaaagaagttcgcatccagactgttaaaaaaccagataccgccgttcaaatgtataaacgtggtgagttagatgcagctaatatctcaaatacttctgctatttatcaagctaataagaataataaagatgtcacagatgttctagaagcgaccactgcctatatggaatataatactactggttctgtgaaagggcttgataatgttaagattcgtcgcgccttaaacttagcaactaaccgtaaaggagttgttcaagcagccgttgatacaggctcaaaaccggcaattgcttttgcacctactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgctcctgctgccaaaaactctgttgactatatcaagtctacttgggaagctgctcttccaggacttactgttgaagaaaaatttgtaacctttaaacaacgcttagaagacagtagaaaacaaaactttgacatcgtagtttctctttggggtggggattatccagaaggatcaactttctacggcctctttaagtcagattcacaaaataacgatggaaaatttgctaacaaggactatgatgctgcttataacaaggcaatttctgaagatgcgatgaaaccagcagaatcagcgaaggactataaagaagcagagaaaattttatttgagcaaggtgcttataacccactctacttccgtagtggtaaaggtttacaaaatccaaaattaaaaggtgttattcgtaatactacaggtttgtcaatagactttacacatgcttataaaaataat

SEQ ID NO: 316 - protein, 468 aa, Streptococcus agalactiae
MATKVDVSKDGLTYTATLRKGLKWSDGSKLTAKDFVYSWQRLVDPKTASQYAYLAVEGHVLNADKINEGQEKDLNKLGVKAEGDDKVVITLSSPSPQFIYYLAFTNFMPQKQEVVEKYGKDYATTSKNTVYSGPYTVEGWNGSNGTFTLKKNKNYWDAKNVKTKEVRIQTVKKPDTAVQMYKRGELDAANISNTSAIYQANKNNKDVTDVLEATTAYMEYNTTGSVKGLDNVKIRRALNLATNRKGVVQAAVDTGSKPAIAFAPTGLAKTPDGTDLAKYVAPGYEYNKTEAAKLFKEGLAESGLTKLKLTITADADAPAAKNSVDYIKSTWEAALPGLTVEEKFVTFKQRLEDSRKQNFDIVVSLWGGDYPEGSTFYGLFKSDSQNNDGKFANKDYDAAYNKAISEDAMKPAESAKDYKEAEKILFEQGAYNPLYFRSGKGLQNPKLKGVIRNTTGLSIDFTHAYKNN

SEQ ID NO: 317 - DNA, 1977 bp, Streptococcus pyogenes
gtgacttttatgaagaaaagtaaatggttggcagctgtaagtgttgcgatcttgtcagtatccgctttggcagcttgtggtaataaaaatgcttcaggtggctcagaagctacaaaaacctacaagtacgtttttgttaacgatccaaaatcattggattatattttgactaatggcggtggaacgactgatgtgataacacaaatggttgatggtcttttggaaaacgatgagtatggtaatttagtaccatcacttgctaaagattggaaggtttcaaaagacggtctgacttatacttatactcttcgcgatggtgtctcttggtatacggctgatggtgaagaatatgccccagtaacagcagaagattttgtgactggtttgaagcacgcggttgacgataaatcagatgctctttacgttgttgaagattcaataaaaaacttaaaggcttaccaaaatggtgaagtagattttaaagaagttggtgtcaaagcccttgacgataaaactgttcagtatactttgaacaagcctgaaagctactggaattcaaaaacaacttatagtgtgcttttcccagttaatgcgaaatttttgaagtcaaaaggtaaagattttggtacaaccgatccatcatcaatccttgttaatggtgcttacttcttgagcgccttcacctcaaaatcatctatggaattccataaaaatgaaaactactgggatgctaagaatgttgggatagaatctgttaaattgacttactcagatggttcagacccaggttcgttctacaagaactttgacaagggtgagttcagcgttgcacgactttacccaaatgaccctacctacaaatcagctaagaaaaactatgctgataacattacttacggaatgttgactggagatatccgtcatttaacatggaatttgaaccgtacttctttcaaaaacactaagaaagaccctgcacaacaagatgccggtaagaaagctcttaacaacaaggattttcgtcaagctattcagtttgcttttgaccgagcgtcattccaagcacaaactgcaggtcaagatgccaaaacaaaagccttacgtaacatgcttgtcccaccaacatttgtgaccattggagaaagtgattttggttcagaagttgaaaaggaaatggcaaaacttggtgatgaatggaaagacgttaacttagctgatgctcaagatggtttctataatcctgaaaaagcaaaagctgagtttgcaaaagccaaagaagctttaacagctgaaggtgtaaccttcccagttcaattagattaccctgttgaccaagcaaacgcagcaactgttcaggaagcccagtctttcaaacaatctgttgaagcatctcttggtaaagagaatgtcattgtcaatgttcttgaaacagaaacatcaactcacgaagcccaaggcttctatgctgagaccccagaacaacaagactacgatatcatttcatcatggtggggaccagactatcaagatccacggacctaccttgacatcatgagtccagtaggtggtggatctgttatccaaaaacttggaatcaaagcaggtcaaaataaggatgttgtggcagctgcaggccttgatacctaccaaactcttcttgatgaagcagcagcaattacagacgacaacgatgcgcgctataaagcttacgcaaaagcacaagcctaccttacagataatgccgtagatattccagttgtggcattgggtggcactccacgagttactaaagccgttccatttagcgggggcttctcttgggcagggtctaaaggtcctctagcatataaaggaatgaaacttcaagacaaacctgtcacagtaaaacaatacgaaaaagcaaaagaaaaatggatgaaagcaaaggctaagtcaaatgcaaaatatgctgagaagttagctgatcacgttgaaaaa

SEQ ID NO: 318 - protein, 659 aa, Streptococcus agalactiae
VTFMKKSKWLAAVSVAILSVSALAACGNKNASGGSEATKTYKYVFVNDPKSLDYILTNGGGTTDVITQMVDGLLENDEYGNLVPSLAKDWKVSKDGLTYTYTLRDGVSWYTADGEEYAPVTAEDFVTGLKHAVDDKSDALYVVEDSIKNLKAYQNGEVDFKEVGVKALDDKTVQYTLNKPESYWNSKTTYSVLFPVNAKFLKSKGKDFGTTDPSSILVNGAYFLSAFTSKSSMEFHKNENYWDAKNVGIESVKLTYSDGSDPGSFYKNFDKGEFSVARLYPNDPTYKSAKKNYADNITYGMLTGDIRHLTWNLNRTSFKNTKKDPAQQDAGKKALNNKDFRQAIQFAFDRASFQAQTAGQDAKTKALRNMLVPPTFVTIGESDFGSEVEKEMAKLGDEWKDVNLADAQDGFYNPEKAKAEFAKAKEALTAEGVTFPVQLDYPVDQANAATVQEAQSFKQSVEASLGKENVIVNVLETETSTHEAQGFYAETPEQQDYDIISSWWGPDYQDPRTYLDIMSPVGGGSVIQKLGIKAGQNKDVVAAAGLDTYQTLLDEAAAITDDNDARYKAYAKAQAYLTDNAVDIPVVALGGTPRVTKAVPFSGGFSWAGSKGPLAYKGMKLQDKPVTVKQYEKAKEKWMKAKAKSNAKYAEKLADHVEK

SEQ ID NO: 319 - DNA, 948 bp, Streptococcus agalactiae
ttgctatttttagcaattctaagaaaaggaaatgatatgattaaatatattttaaagcgtgttgctattttgttagtaacgctatgggttgtcataaccctatcgttctttctgatgcagatccttccaggaacaccctacaataatccaaaactcactgaagaaatgatcgcattgcttaataaacagtatggtttagacaagcctgtatggcaacaatatttgacttacctttggaatgtacttcatggtgactttggaacgagttatcaatcagtgaatcagccagtatcacgtatgattagcttgagattaggagtttcagtacatctaggtgttcaggctctcgtatttggtgttttaggcggtattttggtaggagctatttcggcacgtcataagaatgataaagtcgatggtatcttaagtgttattgcaacgctagggatttctatgccttcatttatcattggtatcttattattagactattttggatttaagtggaacttgttgcctttatcaggttgggggactttctctcaaaccattttaccttctttagctctaggactccctacattagcatctgtttcacgcttcttccgtagtgaaatgattgaaactttaaattctgattatgtgcaactagctcgttcaaaaggtatgacaattcgtcaagtaactcgaaaacatgcttaccgtaattctatgattccaattttaactctaattggccctttggcggcgggtctgttaactggttctgcactaattgagcagattttctcgattccaggaattgggcagcagtttgttacttcgattccaacaaaagactatcctgttattatggggacaaccattgtttatgcagtaatgttgatggttgctatcttgataacagacgttgttattagtatcgtagacccacgtgttcgcttgcag

SEQ ID NO: 320 - protein, 316 aa, Streptococcus agalactiae
MLFLAILRKGNDMIKYILKRVAILLVTLWVVITLSFFLMQILPGTPYNNPKLTEEMIALLNKQYGLDKPVWQQYLTYLWNVLHGDFGTSYQSVNQPVSRMISLRLGVSVHLGVQALVFGVLGGILVGAISARHKNDKVDGILSVIATLGISMPSFIIGILLLDYFGFKWNLLPLSGWGTFSQTILPSLALGLPTLASVSRFFRSEMIETLNSDYVQLARSKGMTIRQVTRKHAYRNSMIPILTLIGPLAAGLLTGSALIEQIFSIPGIGQQFVTSIPTKDYPVIMGTTIVYAVMLMVAILITDVVISIVDPRVRLQ

SEQ ID NO: 321 - DNA, 1029 bp, Streptococcus agalactiae
atggcagataaaaacagaacatttaaacttgtaggtgcaggatcttctagcacacaagaaaaaattgaaaagcctgctctttcgtttatgcaagatgcgtggcgtcgcttgaaaaaaaacaaattagcagtagtttcactctatttattagctcttttacttactttttcgttagcctcaaatttatttgtaactcagaaggatgctaatgggtttgattcgaaaaaagtaactacatatcgcaacttaccacctaaattgagttcaaaccttcctttttggaatggtagcattaagtacgctggaaatacagaatctacagacgcttataagtctcaaaatgtccctgaaaaagttaagtatgctttaggtacagattctctagggagaagtgttgctaagcgcatcatcgtaggtattcggatttccttacttgtagctattgcagctacattcattgatttaattatcggtgttacatacggtcttgtttcaggttttgctggaggacgccttgatacattaatgcaacgtatcgtagaggtaatttcatcaattccaaacttagttatcgttacaatgttaggtttggtccttggtaacggtattacggctattattatctctattgcttttaccggatggacttctatgtctcgtcaggtaaggaatttaaccctatcatatcgagaaagagagtttgtgcttgctgcacgttcacttggggaaagtccaattaaaatagccttcaaacatattttacctaacatttctggtattatcattgtacaaattatgatgacaatcccaagtgctattatgtatgaagcggtactttcagcaatcaatttaggtgttaaaccaccgacagcttcattaggatcattgatttcagatgcacaagaaaatttacaatattatccatatcaagttatcttgccagctttagcattggtaatgatttcattggcatttattttgcttggtgatgggttgcgagatgcttttgatccaaaatctagcgatgaa

SEQ ID NO: 322 - protein, 343 aa, Streptococcus agalactiae
MADKNRTFKLVGAGSSSTQEKIEKPALSFMQDAWRRLKKNKLAVVSLYLLALLLTFSLASNLFVTQKDANGFDSKKVTTYRNLPPKLSSNLPFWNGSIKYAGNTESTDAYKSQNVPEKVKYALGTDSLGRSVAKRIIVGIRISLLVAIAATFIDLIIGVTYGLVSGFAGGRLDTLMQRIVEVISSIPNLVIVTMLGLVLGNGITAIIISIAFTGWTSMSRQVRNLTLSYREREFVLAARSLGESPIKIAFKHILPNISGIIIVQIMMTIPSAIMYEAVLSAINLGVKPPTASLGSLISDAQENLQYYPYQVILPALALVMISLAFILLGDGLRDAFDPKSSDE

SEQ ID NO: 323 - DNA, 924 bp, Streptococcus pyogenes
atggaatcgattgataaatctaaatttcgatttgttgagcgcgatagtgaagcctccgaagtgattgatacccctgcttattcttactggaaatcagtgtttcgtcagtttttttctaaaaaatctacagtctttatgctcgtaattttagtgacagtcttgatgatgagctttatttatccaatgtttgccaactacgactttaatgacgttagtaatatcaatgacttttcaaagcgttatatttggccaaatgcagagtactggtttggaaccgacaaaaatgggcaatctctgtttgatggtgtttggtatggggcacgtaattctattttaatctcagttatagcgacactaattaatatcaccattggggtagtgttaggagccatatggggagtttctaaagcatttgataaagttatgattgaaatttataacattatctcaaatatcccttctatgcttattatcattgttttgacctattcattaggtgcaggattttggaatttgattctagctttctgtatcactggatggattggtgtcgcctactccatccgtgttcaaatcttgcgttaccgtgatttagaatacaaccttgctagtcaaactttgggaacaccaatgtacaagattgctgttaagaacctcctgcctcaattggtttcagttatcatgactatgttgtcacaaatgctaccagtttatgtatcttctgaggccttcttatccttctttgggattggtttaccaaccaccactccaagtttaggacgttttattgctaattattcaagcaacttaacaacaaatgcctacctcttttggattcccttagtaacattgattttagtatcgttaccactatacattgtcggacaaaacttggctgatgccagtgacccacgttcacataga

SEQ ID NO: 324 - protein, 308 aa, Streptococcus pyogenes
MESIDKSKFRFVERDSEASEVIDTPAYSYWKSVFRQFFSKKSTVFMLVILVTVLMMSFIYPMFANYDFNDVSNINDFSKRYIWPNAEYWFGTDKNGQSLFDGVWYGARNSILISVIATLINITIGVVLGAIWGVSKAFDKVMIEIYNIISNIPSMLIIIVLTYSLGAGFWNLILAFCITGWIGVAYSIRVQILRYRDLEYNLASQTLGTPMYKIAVKNLLPQLVSVIMTMLSQMLPVYVSSEAFLSFFGIGLPTTTPSLGRFIANYSSNLTTNAYLFWIPLVTLILVSLPLYIVGQNLADASDPRSHR

SEQ ID NO: 325 - DNA, 1044 bp, Streptococcus agalactiae
atggaaaaagaaactattttaagtgttaataatcttcatgttgacttccacacatatgctggagaagtaaaagcaattcgtgatgtcaactttgaattaaaaaaaggtgagactcttgcaatcgttggtgaatctggttcaggaaaatctgtaactaccagaactttaattggtttaaatgctaaaaattcagagatatcagggaatgttcaatttaaggggcgtaaccttgttgaactatcagaagaagagtggactaaggtacgcgggaatgagatttctatgattttccaagaccctatgactagtttggatccaacgatgaaaattggcatgcaaatagcagaaccaatgatgattcatcaaaaaatttcaaaaaaggatgctttaaaattagctcttgagctaatgaaagatgtaggtatcccaaatgctgaagagcatattaatgattacccacatcagtggtctggaggaatgcgccaacgtgcggttatagcgattgctttagctgctgatcctgaaattcttattgctgatgaaccaacgactgctttagatgtaacaattcaagcacaaattttgaacttaatgaaaaaaattcaagcagaacgagactcctccattgttttcataactcatgacttaggggtcgttgcagggatggcagaccgtgtagcagttatgtatgcagggaaaattgttgaatttggaactgttgatgaagtcttttataatccacaacatccatatacttggggattattgaattcaatgccgacaaccgacacagaatcaggtagtttagagtcaattccgggaacaccaccagatttgttgaacccacctaaaggagatgcatttgcagctcgtaatgaatttgcattagatattgatcatgaagaagaaccaccgtacttcaaagtttcagaaacacatttcgctgctacatggcttttagatgaaagatcacctaaggtgcttcctccattaccgatccaaaaacgttgggaaaaatggaacgagattgaagggaggaaagcc

SEQ ID NO: 326 - protein, 348 aa, Streptococcus agalactiae
MEKETILSVNNLHVDFHTYAGEVKAIRDVNFELKKGETLAIVGESGSGKSVTTRTLIGLNAKNSEISGNVQFKGRNLVELSEEEWTKVRGNEISMIFQDPMTSLDPTMKIGMQIAEPMMIHQKISKKDALKLALELMKDVGIPNAEEHINDYPHQWSGGMRQRAVIAIALAADPEILIADEPTTALDVTIQAQILNLMKKIQAERDSSIVFITHDLGVVAGMADRVAVMYAGKIVEFGTVDEVFYNPQHPYTWGLLNSMPTTDTESGSLESIPGTPPDLLNPPKGDAFAARNEFALDIDHEEEPPYFKVSETHFAATWLLDERSPKVLPPLPIQKRWEKWNEIEGRKA

SEQ ID NO: 327 - DNA, 930 bp, Streptococcus agalactiae
atgactgaaaatcgaaaaaaattagttgaagtcaaaaatgtttctttgaccttcaataaaggaaaagctaatgaagtgagagcaattgataatgttagttttgacatttatgaaggtgaagtgtttggattagttggggaatctggatcaggaaagacaaccgttggacgttcaattttaaaactttatgatatttctgatggagaaattacctttaatggagaagtgatctcacatctgaaaggtaaagcattacatagttttcgtaaagacgctcagatgatttttcaggatcctcaggctagcttaaacggccgtatgaagattcgtgatatcgtagcagaaggtttagatatacataaattagctaaatcaaaatcagatcgtgatagtaaagttcaggccctattagatcttgtagggttaaataaagatcatttaacacgttatccgcatgaattttcaggtggacaacgacaacgtatcgggattgcacgtgctttagcagtagagcctaaatttatcattgctgatgaaccaatatctgccttagatgtttcaatccaagcacaagttgttaatttaatgcaaaaattgcaaagagaacaaggattgacttatttgtttatcgcacatgatttgtctatggtaaaatacatttcagatcgtatcggtgttatgcattgggggaaactgttagaagttggaacatctgatgatgtttataacaatccaatccacccttatacgaagagtctattatcagctattccagaaccagatccggagagtgaacgtcaacgtgttcaccagccgtataatccagctattgagcaagacggacaagaacgtcaaatgcacgagattacccctggtcattttgttttatctacaccccaagaagctgaagaatataaaaaacaaatatta

SEQ ID NO: 328 - protein, 310 aa, Streptococcus agalactiae
MTENRKKLVEVKNVSLTFNKGKANEVRAIDNVSFDIYEGEVFGLVGESGSGKTTVGRSILKLYDISDGEITFNGEVISHLKGKALHSFRKDAQMIFQDPQASLNGRMKIRDIVAEGLDIHKLAKSKSDRDSKVQALLDLVGLNKDHLTRYPHEFSGGQRQRIGIARALAVEPKFIIADEPISALDVSIQAQVVNLMQKLQREQGLTYLFIAHDLSMVKYISDRIGVMHWGKLLEVGTSDDVYNNPIHPYTKSLLSAIPEPDPESERQRVHQPYNPAIEQDGQERQMHEITPGHFVLSTPQEAEEYKKQIL

SEQ ID NO: 329 - DNA, 921 bp, Streptococcus pyogenes
atgtctgagaaattagtcgaagtaaaagacctagaaatttccttcggagaaggaaagaaaaaatttgttgcagttaaaaatgctaatttctttattaaaaaaggagaaaccttttctttagttggagaatctgggagtggtaaaacaacaattggtcgtgctattattggtttgaacgatactagttcaggtcaaattttatacgatgggaaagtaattaatggcagaaaatcaaaatcagaagccaatgagctcattcgtaaaattcaaatgattttccaagatcccgctgctagtttgaatgaacgggcaaccgttgactacatcatttcagaaggtctttataactttaatctgtttaaaacagaggaagaacgtaaagaaaaaattaagaacatgatggccgaagttggtttgctatcagagcatttgacgcgctaccctcatgaattttcaggaggtcaacgtcagcggatcggtatcgctagagccctagtaatgaaccctgaattcgttattgctgatgaaccgatttcagctttggacgtttccgttcgcgcacaggtcttgaatcttcttaaaagaatgcaagccgaaaaaggtttgacttatctcttcattgcccatgatctttcagtcgttcgctttatttcagatcgtattgcggttatccataaaggggttattgtagaagttgcagaaacagaagaactgtttaataacccaattcatccctacacccaatctttgttatcagccgtgcctatcccagatccaattttagagcgtcaaaaagaacttgttgtctatcatccagaccaacatgattatacattagataagccatcaatggttgaaatcaaaccaaatcactttgtttgggcaaaccaagcagaaattgaaaaatatcaaaaagaattg

SEQ ID NO: 330 - protein, 307 aa, Streptococcus pyogenes
MSEKLVEVKDLEISFGEGKKKFVAVKNANFFIKKGETFSLVGESGSGKTTIGRAIIGLNDTSSGQILYDGKVINGRKSKSEANELIRKIQMIFQDPAASLNERATVDYIISEGLYNFNLFKTEEERKEKIKNMMAEVGLLSEHLTRYPHEFSGGQRQRIGIARALVMNPEFVIADEPISALDVSVRAQVLNLLKRMQAEKGLTYLFIAHDLSVVRFISDRIAVIHKGVIVEVAETEELFNNPIHPYTQSLLSAVPIPDPILERQKELVVYHPDQHDYTLDKPSMVEIKPNHFVWANQAEIEKYQKEL

SEQ ID NO: 331 - DNA, 102 bp, Streptococcus agalactiae
atgacaaaaaacaataaatctgtcagcgagacagaaaagagcaaagctcaaacttttaatgagagtttgatcctggctcaggacgaacgctggcggcgtgcc

SEQ ID NO: 332 - protein, 34 aa, Streptococcus agalactiae
MTKNNKSVSETEKSKAQTFNESLILAQDERWRRA

SEQ ID NO: 333 - DNA, 141 bp, Streptococcus agalactiae
gtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggct

SEQ ID NO: 334 - protein, 47 aa, Streptococcus agalactiae
MTVTNQKGTANYVPAAAVIRRSRALSGFIGRKASAGGSLSLKLKAVA

SEQ ID NO: 335 - DNA, 120 bp, Streptococcus agalactiae
ttgtacgctttggaaactggaggacttgagtgcagaaggggagagtggaattccatgtgtagcggtgaaatgcgtagatatatggaggaacaccggtggcgaaagcggctctctggtctg

SEQ ID NO: 336 - protein, 40 aa, Streptococcus agalactiae
MYALETGGLECRRGEWNSMCSGEMRRYMEEHRWRKRLSGL

SEQ ID NO: 337 - DNA, 105 bp, Streptococcus agalactiae
gtggcgaaagcggctctctggtctgtaactgacgctgaggctcgaaagcgtggggagcaaacaggattagataccctggtagtccacgccgtaaacgatgagtgc

SEQ ID NO: 338 - protein, 35 aa, Streptococcus agalactiae
MAKAALWSVTDAEARKRGEQTGLDTLVVHAVNDEC

SEQ ID NO: 339 - DNA, 99 bp, Streptococcus agalactiae
gtgctaggtgttaggccctttccggggcttagtgccgcagctaacgcattaagcactccgcctggggagtacgaccgcaaggttgaaactcaaaggaat

SEQ ID NO: 340 - protein, 33 aa, Streptococcus agalactiae
MLGVRPFPGLSAAANALSTPPGEYDRKVETQRN

SEQ ID NO: 341 - DNA, 99 bp, Streptococcus agalactiae
ttgaaactcaaaggaattgacgggggcccgcacaagcggtggagcatgtggtttaattcgaagcaacgcgaagaaccttaccaggtcttgacatccttc

SEQ ID NO: 342 - protein, 33 aa, Streptococcus agalactiae
MKLKGIDGGPHKRWSMWFNSKQREEPYQVLTSF

SEQ ID NO: 343 - DNA, 159 bp, Streptococcus agalactiae
ttgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagc

SEQ ID NO: 344 - protein, 53 aa, Streptococcus agalactiae
MLVAIIKLGTLARLPVINRRKVGMTSNHHAPYDLGYTRATMVGTTSRKPVTAS

SEQ ID NO: 345 - DNA, 171 bp, Streptococcus agalactiae
ttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattg

SEQ ID NO: 346 - protein, 57 aa, Streptococcus agalactiae
MFSFERSCGALAQLGERLLCTQEVSGSIPLGSIESKGSNCSLKIEYLYQIPRSRNRL

SEQ ID NO: 347 - DNA, 849 bp, Streptococcus agalactiae
atgaaaatttttgagaaagctcctgccaaacttaatttaggattagatattaaaggacgatgtgacgatggttatcatgaattagctatgattatggttagtattgatcttaatgactacgttaccatttctgagctaaaggaagattgtattgttatcgattctgatagtagcaaaatgcctttaaataatgataatgatgtgtttaaagctgcagatataatcaaaaatcaatatggtattaataaaggtgttcatattagattagaaaaatccattcctgtctgtgcaggactggggggtggttctactgatgctgctgctacaataagagctcttaatcgattatggaatcttcaaatggactatgacgaaatggttgctattggttttaaaattggtagtgatgttccttattgtcttggtgggggatgttcgttagtattaggtaaaggtgaaattgttaaacccttaccgacattgagaccatgttggatagttctggttaagccggattttggtatttcaactaaatccatttttagagatattgattgtaagtctataagtagagttgatattgatttattaaagtctgctattttgtcatcagattatcagttaatggtcaaatctatgggaaattcactcgaggatattacaattactaaaaatccagttataagtacaataaaagaacgtatgttaaattctggagccgatgttgcattaatgacaggaagtggaccaactgttttttcaatgtgttctacagagaaaaaagctgatcgtgtttttaatagtatgaaaggtttttgcaaagaagtttataaagttaggttgttgaga

SEQ ID NO: 348 - protein, 283 aa, Streptococcus agalactiae
MKIFEKAPAKLNLGLDIKGRCDDGYHELAMIMVSIDLNDYVTISELKEDCIVIDSDSSKMPLNNDNDVFKAADIIKNQYGINKGVHIRLEKSIPVCAGLGGGSTDAAATIRALNRLWNLQMDYDEMVAIGFKIGSDVPYCLGGGCSLVLGKGEIVKPLPTLRPCWIVLVKPDFGISTKSIFRDIDCKSISRVDIDLLKSAILSSDYQLMVKSMGNSLEDITITKNPVISTIKERMLNSGADVALMTGSGPTVFSMCSTEKKADRVFNSMKGFCKEVYKVRLLR

SEQ ID NO: 349 - DNA, 156 bp, Streptococcus pyogenes
atgatggatattggtataccgattggtagtgatgtgccttattgcttgctttcaggttgtgcccaagtcactggtaaaggtgaagtggtttgtcgcattttggggctgttatcgtcttgggtggttttggttaaaccagattttggtatctcgact

SEQ ID NO: 350 - protein, 52 aa, Streptococcus pyogenes
MMDIGIPIGSDVPYCLLSGCAQVTGKGEVVCRILGLLSSWVVLVKPDFGIST

SEQ ID NO: 351 - DNA, 441 bp, Streptococcus agalactiae
atgacagttttagaacaaaaattagaccatttagtgagtcaaatcttgcttaaagcagaaaatcaacatgaattattgtttggtacttgtcaaagtgatgttaaattgactaatacgcaagaacacattctgatgcttttatcacaagagcagttgacaaattctgatttagctaagaagttaaatattagtcaggcagctgtaactaaagcagtaaaaagtttaatttctcaggatatgttgaaagcgaataaagattctaaagatgctcgtattacttattttgagttatctgaacttgctaaacccattgcagatgaacacacacatcatcatgacaatacgttaggggtttacggaagattagtaaatcatttttcaaaggacgaaaaggtcgttttagaacgttttcttgatcttttctctagagaattagaaggg

SEQ ID NO: 352 - protein, 147 aa, Streptococcus agalactiae
MTVLEQKLDHLVSQILLKAENQHELLFGTCQSDVKLTNTQEHILMLLSQEQLTNSDLAKKLNISQAAVTKAVKSLISQDMLKANKDSKDARITYFELSELAKPIADEHTHHHDNTLGVYGRLVNHFSKDEKVVLERFLDLFSRELEG

SEQ ID NO: 353 - DNA, 441 bp, Streptococcus pyogenes
atggggattttagaaaaaaaacttgataacttagtaaatactattttattaaaagcagaaaatcagcatgagttattatttggagcttgtcaaagtgacgttaagcttactaatacgcaagaacatattttaatgttactatctcagcaacgtctcactaatacagatttggctaaggcattaaatattagtcaggcggcagtaactaaggctatcaagagtttggtcaaacaagacatgttagcaggaactaaggatacggttgatgctagggtgacttattttgaattaaccgagttagctaagcctattgcgtcagaacatacccatcatcatgatgaaaccttaaatgtttacaaccgtttattacaaaaattctccgcgaaagaattagagattgtagataagtttgtaacagtttttgctgaggaattagaaggg

SEQ ID NO: 354 - protein, 147 aa, Streptococcus pyogenes
MGILEKKLDNLVNTILLKAENQHELLFGACQSDVKLTNTQEHILMLLSQQRLTNTDLAKALNISQAAVTKAIKSLVKQDMLAGTKDTVDARVTYFELTELAKPIASEHTHHHDETLNVYNRLLQKFSAKELEIVDKFVTVFAEELEG

SEQ ID NO: 355 - DNA, 708 bp, Streptococcus agalactiae
atgcgatatattacagttagtggtcttacttttcagtacgatagcgatcctgtgctggaaggggttaattaccatttagacagtggggagtttgttaccttaacaggtgaaaatggggctgctaaatcaactttaataaaggctactttaggtattttaacgcccaaagtgggtacagttaatatctctaaagaaaacaaagaaggaaaaaaattacgtattgcctatttacctcaacagattgcaagttttaacgctggctttccatcgtcagtttatgaatttgtgaaatctggacgataccctagaaatggttggtttagaagactgactaaacatgatgaagaacatattagggttagtttagaagctgttggtatgtgggataatcgccataaaaagataggaagtttatctggcggtcaaaagcagagggctgtcattgctaggatgtttgcttctgatccagatatttttgtattggatgagccaacaactggtatggacgcagggactactgagaaattttatgagttaatgcatcataatgctcataagcatggtaagtctgttttgatgattactcacgatcctgatgaagtaaaggggtatgctgaccgaaatattcatcttgttaggaaccaatctttaccatggcgttgtttcaatgtccatacaaacgaaatggaggttgaatcagatgctact

SEQ ID NO: 356 - protein, 236 aa, Streptococcus agalactiae
MRYITVSGLTFQYDSDPVLEGVNYHLDSGEFVTLTGENGAAKSTLIKATLGILTPKVGTVNISKENKEGKKLRIAYLPQQIASFNAGFPSSVYEFVKSGRYPRNGWFRRLTKHDEEHIRVSLEAVGMWDNRHKKIGSLSGGQKQRAVIARMFASDPDIFVLDEPTTGMDAGTTEKFYELMHHNAHKHGKSVLMITHDPDEVKGYADRNIHLVRNQSLPWRCFNVHTNEMEVESDAT

SEQ ID NO: 357 - DNA, 717 bp, Streptococcus pyogenes
atgagatacatatcagtgaaaaatctctcctttcaatatgaaagtgagccagttttagaagggatcacttatcatttagatagtggagaatttgtcaccatgaccggtgaaaatggtgctgcaaagtcaaccttaataaaagcaaccttaggaattttacaaccaaaggctggacgagttactattgctaaaaaaaataaagacggtaaacaattaagaattgcttacttgccgcagcaagtagctagctttaacgctggttttccatccaccgtttacgagtttgtcaaatcaggtcgctacccacgtagtggttggtttagacatttgaacaaacacgatgaagagcatgtgcaagcaagcttagaagcagtcggcatgtgggaaaaccgtcataagagaattggtagtttatcaggtggtcaaaaacaacgtgtggttattgcccgtatgtttgcttctgaccctgatatttttgtgctagacgagccaacaacgggaatggatagcggtactactgataccttttatgaactgatgcaccacagtgcacatcaacatgggaaatccgttctgatgattacccatgacccagaagaagtgaaggcttatgctgatcggaacattcatttagtcagaaaccaaaaacttccttggcgttgtttcaacattcatgaagctgaaacagatgacgaaaaaggaggtcatggtcatgct

SEQ ID NO: 358 - protein, 239 aa, Streptococcus pyogenes
MRYISVKNLSFQYESEPVLEGITYHLDSGEFVTMTGENGAAKSTLIKATLGILQPKAGRVTIAKKNKDGKQLRIAYLPQQVASFNAGFPSTVYEFVKSGRYPRSGWFRHLNKHDEEHVQASLEAVGMWENRHKRIGSLSGGQKQRVVIARMFASDPDIFVLDEPTTGMDSGTTDTFYELMHHSAHQHGKSVLMITHDPEEVKAYADRNIHLVRNQKLPWRCFNIHEAETDDEKGGHGHA

SEQ ID NO: 359 - DNA, 117 bp, Streptococcus agalactiae
ttgtatacagtacgcaaatactctaatacaactgccgccaaagtaacaacgaaaatagttgaccatgtaggcgagatacctaaaacaacgcctaatgcaacaccggctaaggaaacg

SEQ ID NO: 360 - protein, 39 aa, Streptococcus agalactiae
MYTVRKYSNTTAAKVTTKIVDHVGEIPKTTPNATPAKET

SEQ ID NO: 361 - DNA, 843 bp, Streptococcus agalactiae
atgtccatacaaacgaaatggaggttgaatcagatgctacttgatatgctttcctatgattttatgcaacgagcgctcttagcagttgtggctattagtatttttgctccaattttaggcatcttcctaattttacgtcgtcagagtttgatgagtgatactttgagtcacgtttccttagccggtgttgcattaggcgttgttttaggtatctcgcctacatggtcaactattttcgttgttactttggcggcagttgtattagagtatttgcgtactgtatacaaacattatatggaaatatcaactgctatcctgatgtcgatggggttggctatatctttaatcgttatgagtaaagctcataatgttggtaatgtcagtcttgaacagtatttatttggttctattattactattgggaaggaacaagtgattgctttgtttgttattgcattaatcacttttattttaaccatcctatttattagaccaatgtatatattaacgtttgatgaggatacagcttttgtagatggattgcctgtgcgtacaatgtctattttgttcaatgttgttacaggtattgctattgcattaacaattcctgccgcaggtgctctattggtgtcaactattatggttttaccagctagtattgctatgcggttaggtcgaaattttaaaactgttatttttctgggtatgttaattggatttgtgggaatggtagctggtattttcctttcgtattattgggagacacctgctagtgcaacaataacgatgatttttattggcattttcctattagttagcttagtaggcttgcttcgcaaacgt

SEQ ID NO: 362 - protein, 281 aa, Streptococcus agalactiae
MSIQTKWRLNQMLLDMLSYDFMQRALLAVVAISIFAPILGIFLILRRQSLMSDTLSHVSLAGVALGVVLGISPTWSTIFVVTLAAVVLEYLRTVYKHYMEISTAILMSMGLAISLIVMSKAHNVGNVSLEQYLFGSIITIGKEQVIALFVIALITFILTILFIRPMYILTFDEDTAFVDGLPVRTMSILFNVVTGIAIALTIPAAGALLVSTIMVLPASIAMRLGRNFKTVIFLGMLIGFVGMVAGIFLSYYWETPASATITMIFIGIFLLVSLVGLLRKR

SEQ ID NO: 363 - DNA, 819 bp, Streptococcus pyogenes
atggtcatgcttgatattttattctatgatttcatgcaacgggcggtaatggcggtagttgccattagtatttttgctccgattttaggtattttccttattttacgtcgtcaaagtttgatgagcgatacccttagtcatgtttctttggctggggtagcgcttggggtagtccttggtatttcaccaaccatcactactattattgttgtggttttagctgctattttgttagaatacctgcgtgtagtttacaaacactacatggagatttcaacggcgattttgatgtcacttggcttggccctatctctgattattatgagtaagtcgcatagttcatcaagcatgagtttagaacaatacctttttggatcgatcatcacgattagtatggaacaagttgtcgccttgtttgctattgctgcgattattttaatcttgaccgttctcttcattagaccgatgtacattctgacctttgatgaagatactgcttttgtagatggtttgcccgttcgcttgatgtctgttctattcaatatcgtcactggggttgctattgctttgaccattccagcagcaggagcacttttggtttctaccattatggtcttgccagcaagtatcgcaatgagattgggtaaaaactttaaaacagttatcttactgggaattgtcatcggttttagcggtatgttatctggtattttcttatcttatttctttgaaacgccagctagtgccactattaccatgattttcattagtattttcctcttagttagtctaggtggaatgcttaaaaaacggttattt

SEQ ID NO: 364 - protein, 273 aa, Streptococcus pyogenes
MVMLDILFYDFMQRAVMAVVAISIFAPILGIFLILRRQSLMSDTLSHVSLAGVALGVVLGISPTITTIIVVVLAAILLEYLRVVYKHYMEISTAILMSLGLALSLIIMSKSHSSSSMSLEQYLFGSIITISMEQVVALFAIAAIILILTVLFIRPMYILTFDEDTAFVDGLPVRLMSVLFNIVTGVAIALTIPAAGALLVSTIMVLPASIAMRLGKNFKTVILLGIVIGFSGMLSGIFLSYFFETPASATITMIFISIFLLVSLGGMLKKRLF

SEQ ID NO: 365 - DNA, 501 bp, Streptococcus agalactiae
gtgactccaatatacgaaggaaataatttagtacctagccgagttgaacttcagtatgttggaattgataaacaaggaaaacttctagaaatcaaattaggcggcggcaaagaacaagttgatgaatacggcgtcacaactgttacattagaaaatacgtctccactcgcaaaaattgattacaaaactggtatgctaatcaaagaagatgggaaacaggcagaagaaggtgaagatccaaatagcgatgctgatgaaaacgaagcagctattgaaagtgcatctgatatagaagaaaatactaacactaatacttctgaatcagatacaaataatgtagctccccaaaatagaatcgtctacgttgcaaataagggtcgttcaaatacttattggtatagtttagaaaacataaaaaatgcaaataccgctaatatcgttcaaatgactgaacaagaagcgttaaatcaacacaaacatcacagcactactgaagcacaa

SEQ ID NO: 366 - protein, 167 aa, Streptococcus agalactiae
MTPIYEGNNLVPSRVELQYVGIDKQGKLLEIKLGGGKEQVDEYGVTTVTLENTSPLAKIDYKTGMLIKEDGKQAEEGEDPNSDADENEAAIESASDIEENTNTNTSESDTNNVAPQNRIVYVANKGRSNTYWYSLENIKNANTANIVQMTEQEALNQHKHHSTTEAQ

SEQ ID NO: 367 - DNA, 804 bp, Streptococcus pyogenes
atggatatgtctaaatcaaatcgtcgtacttggcaaggtttagttgttattttaatagctattctcaccacttttaccacaagtactgttacggcagccagaaaaattagaaatttccctgataccacggaaattttgttaggaacgaaggcgactgagacaccaggaatcttaccattcactggtagctaccaattagttttgggcgatcttgacaatctgcaaaggccaaccttcgcacacatccagctaaaagatcaagatgagcctaatattaaacgaaaaggacttaaattcaatcctcctggctggcataattacaaattgactgacgctaatggaaaaacaacttggttaatggaccgtggccatttagttggttaccaatttagcggcttaaatgacgagcctaaaaacctagttacaatgacaaaatatcttaatactggctttagtgacaaaaatcctttaggaatgctctattatgaaaatagattagatagctggttagctctacaccctaacttctggctagactataaagttactcctgtttatcataaaaatgagttagttcctcgccaagtagttctacagtatgttggaattgatgaaaatggagatctacttcaaattaagttaggtagtgaaaaagaaagtgtagacaactttggagtaacatcagttacattagataacgtatctcctttagctgaattggattaccaaacaggaatgatgctagattcaactcaaaacgaagaagatagtaatttagaaaccgaagagtttgaagaagcggct

SEQ ID NO: 368 - protein, 268 aa, Streptococcus pyogenes
MDMSKSNRRTWQGLVVILIAILTTFTTSTVTAARKIRNFPDTTEILLGTKATETPGILPFTGSYQLVLGDLDNLQRPTFAHIQLKDQDEPNIKRKGLKFNPPGWHNYKLTDANGKTTWLMDRGHLVGYQFSGLNDEPKNLVTMTKYLNTGFSDKNPLGMLYYENRLDSWLALHPNFWLDYKVTPVYHKNELVPRQVVLQYVGIDENGDLLQIKLGSEKESVDNFGVTSVTLDNVSPLAELDYQTGMMLDSTQNEEDSNLETEEFEEAA

SEQ ID NO: 369 - DNA, 1257 bp, Streptococcus agalactiae
atgaatatttttgatgaactcaaagaacgtggactcgtttttcagacaactgacgaagatgctttacgcaaagctcttgaagaaggttctgtctcttactatactggctacgatcctacggctgacagccttcatcttggacatttagttgctattttaacctctcgtcgcttacaacttgctggtcacaagccttatgcacttgtgggaggcgcaactggacttattggggacccttcatttaaagatgttgagcgcagtttacaaacaaagaaaactgtagttagttggggtaataaaatccgcggtcaattatctaattttctagagtttgaaacaggtgataacaaagctgtattggtaaataattatgattggttcagcaatattagtttcattgatttcttacgagatgttggtaaatattttactgtcaattatatgatgagtaaagaatctgttaaaaaacgtatcgaaacagggatttcctatactgaatttgcttatcaaattatgcaaggatatgacttttacgaattaaataagaactataatgtcactttgcaaattggtggttctgaccaatggggcaacatgactgctggaaccgaacttattagacgaaaatcaaatggtgtatctcatgttatgactgttccattgataacagattctacaggaaaaaaattcggaaaatctgaaggaaatgctgtttggcttgatgctgacaaaacctctccttatgaaatgtaccaattttggctcaatgttatggatgctgatgccgttcgcttccttaagatttttacattcctaagccttaaagaaatagaagatatacgtattcaattcgaggaagcacctcaccaacgcttagcacaaaaaacactagcacgtgaagttgtaactcttgttcatggtgaaaaagcttataaggaggccgttaatatcacggaacagctatttgctggcaatataaaaggattgtctgttaaagagctcaaacaaggtttacgtggagtaccaaattatcacgttcagacggaagataacctcaatatcatagaccttctagtcacttcaggagttgtcaattctaaacgtcaagctcgagaagatgtctccaatggagctatttatattaatggagatcgtattcaagatttagaatatactatctcagaaaatgataagcttgaaaatgaaattacagtcattcgtcgtggaaagaaaaaatactttgtattaaactttaaa

SEQ ID NO: 370 - protein, 419 aa, Streptococcus agalactiae
MNIFDELKERGLVFQTTDEDALRKALEEGSVSYYTGYDPTADSLHLGHLVAILTSRRLQLAGHKPYALVGGATGLIGDPSFKDVERSLQTKKTVVSWGNKIRGQLSNFLEFETGDNKAVLVNNYDWFSNISFIDFLRDVGKYFTVNYMMSKESVKKRIETGISYTEFAYQIMQGYDFYELNKNYNVTLQIGGSDQWGNMTAGTELIRRKSNGVSHVMTVPLITDSTGKKFGKSEGNAVWLDADKTSPYEMYQFWLNVMDADAVRFLKIFTFLSLKEIEDIRIQFEEAPHQRLAQKTLAREVVTLVHGEKAYKEAVNITEQLFAGNIKGLSVKELKQGLRGVPNYHVQTEDNLNIIDLLVTSGVVNSKRQAREDVSNGAIYINGDRIQDLEYTISENDKLENEITVIRRGKKKYFVLNFK

SEQ ID NO: 371 - DNA, 1254 bp, Streptococcus pyogenes
atgaatatttttgaagaactcaaagctcgtggcttggtctttcaaacgactgatgaacaagcccttgtcaaagcattaacagaagggcaagtatcctattataccggttatgatccaaccgctgacagccttcatctgggccatctagtggctatcttaacatctcgtcgcttgcaactagcagggcacaaaccttacgctcttgtggggggtgccacaggtttaattggtgatccttcctttaaagatgcagagcgcagccttcaaaccaaagaaacagttttggagtggagtgacaagattaaagggcagttgtctactttccttgattttgaaaatggtgataataaagcagagcttgtcaacaactacgactggttctcgcaaatcagctttattgacttcctccgtgatgtcggtaaatacttcaccgttaactacatgatgagtaaagactctgttaaaaaacgcattgaaacaggcatttcttacactgagtttgcttaccaaatcatgcagggctacgacttctacgaactcaatgacaagcataatgtaaccttacaaattggcggctctgaccagtggggtaatatgacagctggtactgaattgctccgcaaaaaggctgataaaactgggcacgtcatgactgtaccactcatcactgactcaaccgggaaaaaattcggtaaatcagaaggtaatgctgtctggcttgatgccgataagacgtctccttacgagatgtaccaattctggttaaatgtcatggatgatgatgcagtgcgtttcttgaaaatcttcaccttcttatctctagatgagattgcagaaattgaaactcaatttaatgccgctcgtcacgagcgtctcgctcaaaaaaccttggcacgcgaagtggttaccttggttcatggcgaagaagcttataaacaagctcttaacattaccgagcagttatttgctggaaacatcaaaaatctttctgccaatgaattaaaacaaggattgagcaatgtaccaaattatcacgttcaatcaatagacaatcataatattgtcgagattttagtagctgctaagatttccccatcaaaacgccaggcgcgtgaagacgtgcaaaatggagcaatctacattaacggagaccgcgttcaagatttagattaccaattaagtaatgatgataaaattgatgatcaattaaccgttattcgccgcggtaagaaaaaatacgctgttctcacttac

SEQ ID NO: 372 - protein, 418 aa, Streptococcus pyogenes
MNIFEELKARGLVFQTTDEQALVKALTEGQVSYYTGYDPTADSLHLGHLVAILTSRRLQLAGHKPYALVGGATGLIGDPSFKDAERSLQTKETVLEWSDKIKGQLSTFLDFENGDNKAELVNNYDWFSQISFIDFLRDVGKYFTVNYMMSKDSVKKRIETGISYTEFAYQIMQGYDFYELNDKHNVTLQIGGSDQWGNMTAGTELLRKKADKTGHVMTVPLITDSTGKKFGKSEGNAVWLDADKTSPYEMYQFWLNVMDDDAVRFLKIFTFLSLDEIAEIETQFNAARHERLAQKTLAREVVTLVHGEEAYKQALNITEQLFAGNIKNLSANELKQGLSNVPNYHVQSIDNHNIVEILVAAKISPSKRQAREDVQNGAIYINGDRVQDLDYQLSNDDKIDDQLTVIRRGKKKYAVLTY

SEQ ID NO: 373 - DNA, 2295 bp, Streptococcus agalactiae
atgtttaaaggtaataagaagttgaatagttctaaattaggtgattacacaccacttgaatttggttctatttttttaagaattgtaaagcttttatcagatttcatctatgttattattttactatttgttatgctcggagtaggacttgcagtagggtatcttgctagtcaagttgactctgttaaagtaccaagtaaaaatagtttagtgacacaagttaatacacttactagggtgtctaggttaacttattctgataaatcacaaatttcagagattgccactgatttacaacgtacaccagtggcaaaggatgctatatctgataatattaaaaaggctatcattgcaacagaggacgaaaatttcaatgaccataaaggtgtagttcccaaagccgtactacgtgctgcagcgggatctgttctggggtttggagagagtagcggtggttcaacgctgacacaacaattattaaagcagcaaattttgggagatgatccgtcatttaaacgcaaatcaaaagaaattatttatgctctagcattagagcgttacatggataaggattcgattttatcagattatttaaatgtatcaccgtttggtcgcaataacaaaggacagaatattgcaggtattgaagaagcagcacaagggatttttggagtttccgcaaaagatttaacaattcctcaggcagctttccttgcaggtttaccgcaaagtcctattgtatattctccttatactgcagatgcccagttgaaatcagataaagatcttagttttggtataaagcgccaaaaaaatgtgttatacaatatgtatagaacgagagctttaaccaaagatgagtacaaatcctacaaagattatgacatcaaaaaagattttatcaaacctgcagtggcgacaacaaatcatcatgattatctttactactcggcattatctgaagctcaaaaagtgatgtacaattacctcattaaaaaggataatgtttcagagcatgatttaaaaaatgatgagactagagcgacgtacagacaccgcgctattgaagagattcaacagggagggtatactattaaaactactatcaataaatctgtttatcaagccatgcaggatgctgcagctcaatacggagggttgttagatgatggtactggcaaggttcaaatgggaaatgtactaacggacaattctagtggtgctattataggatttattggtggtcgtaactatagtgagaatcaaaataaccatgcttttgatacggcacgctctccagggtcaagtattaaaccgatattaccttacggaattgctattgatcaagggatgttaggaagtggtagtgttctttcaaattatccaacgacatattcaagtggcgaaaagattatgcatgcggatgaagaaggtactgctatggttaaccttcaagagtcattggacatttcttggaacattccagctttctggacttacaagatgctacgagatcgaggcgttgatgtaaaaaactatatggagaaattagactatccaattgaaaactttggtatagaaagtttaccacttggtggtggtattgatacgtcagttgctcagcaaacaaacctttatcaaatgattgcaaatggtggtgtttatcataagcagtatatgatagaaagtatagaggatagtaatgggaaagtgatttataatcacgaaagtaaacctgtccgtgtcttttcgaaagcaacagctactatcttacagcagctattacatggaccaattaactccggaaagactacaacctttaaaaatcgcttacaaggtttaaatagtggtttagctggggtagattggattggaaaaacgggtactactaactcaacttctgatgtttggttgatgctttctacacctaaagtgactttaggtggatgggcaggacatgataataatgcctctttagcgaaattgacaggttacaataataatgctaattatatggctcacttggttaatgctattaataatgcagatggcaatacttttggtaagtcagaaaggtttagacttgatgatagcgttataaaagctaaagttcttaagtctacaggtttacagccaggtgtagtaacagtaaacggtcgtcgaatcactgttggaggtgaaagcacaacaagttattgggcaaaaaatggacctggaacgatgacctatcgttttgctattgggggaactgatagtgattatcaaaaagcttggtctactttgggtggaaaacga

SEQ ID NO: 374 - protein, 765 aa, Streptococcus agalactiae
MFKGNKKLNSSKLGDYTPLEFGSIFLRIVKLLSDFIYVIILLFVMLGVGLAVGYLASQVDSVKVPSKNSLVTQVNTLTRVSRLTYSDKSQISEIATDLQRTPVAKDAISDNIKKAIIATEDENFNDHKGVVPKAVLRAAAGSVLGFGESSGGSTLTQQLLKQQILGDDPSFKRKSKEIIYALALERYMDKDSILSDYLNVSPFGRNNKGQNIAGIEEAAQGIFGVSAKDLTIPQAAFLAGLPQSPIVYSPYTADAQLKSDKDLSFGIKRQKNVLYNMYRTRALTKDEYKSYKDYDIKKDFIKPAVATTNHHDYLYYSALSEAQKVMYNYLIKKDNVSEHDLKNDETRATYRHRAIEEIQQGGYTIKTTINKSVYQAMQDAAAQYGGLLDDGTGKVQMGNVLTDNSSGAIIGFIGGRNYSENQNNHAFDTARSPGSSIKPILPYGIAIDQGMLGSGSVLSNYPTTYSSGEKIMHADEEGTAMVNLQESLDISWNIPAFWTYKMLRDRGVDVKNYMEKLDYPIENFGIESLPLGGGIDTSVAQQTNLYQMIANGGVYHKQYMIESIEDSNGKVIYNHESKPVRVFSKATATILQQLLHGPINSGKTTTFKNRLQGLNSGLAGVDWIGKTGTTNSTSDVWLMLSTPKVTLGGWAGHDNNASLAKLTGYNNNANYMAHLVNAINNADGNTFGKSERFRLDDSVIKAKVLKSTGLQPGVVTVNGRRITVGGESTTSYWAKNGPGTMTYRFAIGGTDSDYQKAWSTLGGKR

SEQ ID NO: 375 - DNA, 2310 bp, Streptococcus pyogenes
atgaggtattttatggtgaaatggaacacgaaacaaaagcgtataagtcatcaaagattaggtctcttggatttggggccggtgctattacgtacgttgagactactgtctaactttttttatattgttatcttcctttttggaatgatgggatttggtatggcatttgggtatttggctagtcagattgaatctgttaaggtaccaagtaaagaaagtttagtcaaacaagttgaatcattaacgatgatttcgcaaatgaactattctgataatagtttaatttctactttagatacggatttacttcgaacaccagtagctaatgatgcgatttcagagaatatcaaaaaagctattgtatcaacagaagacgaacattttcaagaacataaaggtatcgtgccaaaagctgtttttcgggcaacattggcttctgtattgggatttggagaagctagtggaggttcgaccttaacacagcaattagtcaagcaacaagttttgggagacgatcccacatttaagcgcaagtctaaggagatcgtttacgctcttgccttagagcgttatatgtccaaagacaatatcttatgtgattatcttaatgtttcaccttttggccgtaacaacaagggtcaaaatattgctggtgttgaagaagctgcgcgtggcatttttggcgtttctgccaaagatttaacggtgccacaggcagcatttttggcgggtcttccgcagagtcctattgtttactctccttatttgtcaacgggacaactgaaatcagaaaaggacatggcttatggcatcaagcgtcagcaaaatgttctctttaacatgtaccgtacaggtgttctgtctaaaaaagaatacgaggactataaggcttatccgattcaaaaggattttattcaaccgggaagtgcaatagtaaataatcacgattacctttattacacggtgttagcggatgctaagaaagccatgtatagctatttgattaagcgagataaggtgtctagtcgtgacttgaaaaatgacgagactaaggctgcttatgaagagagagccttaacagaattgcaacagggtggctataccatcaccacaaccattaataagcctatttacaatgcgatgcagacagcggcagctcagtttggtggcttgttagatgatggcactggtacagttcaaatgggaaatgtcttgacagacaatgcgactggtgctgtgttaggttttgttggtggtagagattatgctctgaatcaaaataatcatgctttcaatacagttagatcgccaggttctagcattaaaccgataatcgcttatggtcctgctattgatcaaggtttaatggggagtgctagcgttttgtctaattacccaacaacttactcgagtggccaaaaaatcatgcatgctgatagtgaaggaacagccatgatgccacttcaagaggccctaaatacttcttggaacatcccagctttttggacacagaaattactgcgtgaaaaaggtgtcgatgtcgaaaattatatgacaaaaatgggttataagattgcagactactcgattgaaagtttacctctagggggcggtattgaagtctcggttgctcaacaaaccaatgcttaccaaatgctttcaaacaatggcttatatcaaaagcaatatattgtagataagattactgctagcgatggtacagtcgtttacaaacatgaaaataagccaattcgtattttttctgcagcaacagctacgattttacaagaattgttgagaggtccgattacttcaggcgctacgactactttcaagaaccgtttggcggctattaatccgtggcttgctaatgctgattggattggtaagaccggaacaactgagaattatacggatgtttggctagtcctgtctactccaaaagttactttaggcggttgggcaggacatgatgacaatacctcattagcgccattaacaggatataacaataattctaattatcttgcctatttagctaatgccattaatcaggccgatcccaatgttattggagtagggcaacgcttcaacttagatccaggagtcattaaggcgaatgtcttgaagtcaacaggtttacaaccaggaactgttaatgtcaatggacatactttttctgttggtggagaaatgaccaccagtctatggtcccaaaaaggaccgggggctatgacttaccgatttgctattggtggcacggatgccgattatcaaaaagcctgggggaacttcgggttcagaaaaaat

SEQ ID NO: 376 - protein, 770 aa, Streptococcus pyogenes
MRYFMVKWNTKQKRISHQRLGLLDLGPVLLRTLRLLSNFFYIVIFLFGMMGFGMAFGYLASQIESVKVPSKESLVKQVESLTMISQMNYSDNSLISTLDTDLLRTPVANDAISENIKKAIVSTEDEHFQEHKGIVPKAVFRATLASVLGFGEASGGSTLTQQLVKQQVLGDDPTFKRKSKEIVYALALERYMSKDNILCDYLNVSPFGRNNKGQNIAGVEEAARGIFGVSAKDLTVPQAAFLAGLPQSPIVYSPYLSTGQLKSEKDMAYGIKRQQNVLFNMYRTGVLSKKEYEDYKAYPIQKDFIQPGSAIVNNHDYLYYTVLADAKKAMYSYLIKRDKVSSRDLKNDETKAAYEERALTELQQGGYTITTTINKPIYNAMQTAAAQFGGLLDDGTGTVQMGNVLTDNATGAVLGFVGGRDYALNQNNHAFNTVRSPGSSIKPIIAYGPAIDQGLMGSASVLSNYPTTYSSGQKIMHADSEGTAMMPLQEALNTSWNIPAFWTQKLLREKGVDVENYMTKMGYKIADYSIESLPLGGGIEVSVAQQTNAYQMLSNNGLYQKQYIVDKITASDGTVVYKHENKPIRIFSAATATILQELLRGPITSGATTTFKNRLAAINPWLANADWIGKTGTTENYTDVWLVLSTPKVTLGGWAGHDDNTSLAPLTGYNNNSNYLAYLANAINQADPNVIGVGQRFNLDPGVIKANVLKSTGLQPGTVNVNGHTFSVGGEMTTSLWSQKGPGAMTYRFAIGGTDADYQKAWGNFGFRKN

SEQ ID NO: 377 - DNA, 3573 bp, Streptococcus agalactiae
ttggcaggacatgaagttcagtacggaaaacaccgtacacgtcgtagcttttcaagaattaaggaagttcttgatttaccaaacttaattgaaattcaaactgattcattccaagattttcttgatgctggcttgaaagaagtatttgaggatgtacttccaatttcaaactttacagatactatggatcttgaatttgttggttatgaattaaaagaacctaaatatactttggaagaagctcgtatccatgatgctagctactcagcacctatttttgttactttccgtttagttaataaagaaactggtgaaattaaaactcaagaagttttctttggtgattttccaattatgactgaaatgggtactttcatcatcaatggtggtgaacgtatcattgtttcacaattagtccgttctcctggtgtttactttaatgataaggtagataaaaatggaaaagttggttatgggtcaactgttatccctaaccgtggagcttggttggaacttgagacagacgcaaaagatattgcttatacacgtatcgaccgcacacgtaaaattccatttacaacactagtccgtgcacttggtttctctggagacgatgaaattgttgacatctttggtgacagtgaacttgttcgcaatactattgaaaaagacattcataaaaatccaagtgattctcgtacagatgaagcacttaaagaaatctatgaacgtcttcgtccaggtgaaccaaaaactgcagacagctcacgtagtcttttagttgcacgtttctttgatccacgtcgttatgacttagcggctgttggtcgttataagattaataaaaaactgaatcttaaaacacgcctattgaaccaaacaatcgctgaaaatttagttgatggtgaaacaggagagattcttgttgaagctggaaccgttatgacacgagatgtcattgattcaattgcagagcatatcgatggagacttaaacaagtttgtctacacaccaaatgattatgctgtagttactgaaccagttattcttcaaaaattcaaagttgttgctccaactgatccagaccgtgttgttactattgttggaaactcaaatcctgaagataaagttcgtgccttaactcctgcagatattttagcagagatgtcatacttcttaaaccttgcagagggtatcggtaaggtagatgacattgaccatttaggtaaccgtcgtattcgtgcagttggtgaattacttgcgaaccaattccgtatcggacttgctcgtatggaacgcaatgtccgcgaacgtatgtctgtacaagacaatgaagtcttgacacctcaacaaatcattaacattcgtccagtgactgccgccgttaaagaattctttggttcatcacagctgtcacaattcatggaccaacacaaccctctatcagaattgtcgcacaaacgccgtctctctgccttaggacctggtggtttgacacgtgaccgtgctggatatgaagttcgtgacgtgcactatacccactatgggcgcatgtgtccgattgaaacacctgaaggtccaaacattggtttgattaataacttatcttcatttggacacctcaataaatatggatttattcaaacaccatatcgtaaagtagatcgttctactggtgcggtaacgaacgaaattgtttggttgactgctgatgaagaagatgaatttacagttgcacaagccaactctaagcttaacgaagacggtacatttgcagaagaaatcgttatgggtcgtcatcaaggtaataaccaagagtttccttcaagcattgttgactttgttgacgtgtcacctaagcaagtagttgctgtcgcaacagcatgtattcctttcttggaaaatgatgactctaaccgtgccttgatgggtgccaacatgcaacgtcaggctgtgccattgattgatccaaaagcaccatatgttggtactggtatggagtatcaagcagcccacgattcaggtgcagctgtgattgctaaacatgatggtcgtgttattttttcagatgctgaaaaagttgaagtgcgtcgcgaagatggttctcttgatgtttatcatgttcaaaaattccgccgttcaaactcaggtactgcttataaccaacgtaccttagttaaagttggtgatctcgttgaaaaaggtgattttatcgccgacggaccatctatggaaaatggtgaaatggctcttggacaaaacccagttgttgcttatatgacttgggaaggttataacttcgaggatgccgttatcatgagtgagcgccttgtgaaagaagatgtctatacatctgttcacttggaagaattcgaatctgaaacgcgtgatacaaagcttgggcctgaagaaattactcgtgaaattccaaatgttggtgaagattcactacgtgatctcgatgaaatgggaattatccgcattggtgctgaggtaaaagaaggtgacattcttgttggtaaggtaacacctaagggtgaaaaggacttatctgctgaagaacgtctcttgcatgccatttttggtgataaatcacgtgaagttcgtgatacttcactacgtgtacctcacggtggcgatggagtagttcgtgacgttaaaatctttactcgtgcaaatggtgatgaattgcaatcaggtgttaatatgcttgtccgcgtttatatcgctcaaaaacgtaaaatcaaagtcggtgataagatggccggtcgtcacggaaacaaaggtgtcgtctcacgtattgttcctgttgaagatatgccttacttaccagatggaacgccagttgatatcatgttgaacccacttggggtgccatcacgtatgaatatcggacaagttatggagcttcatttaggtatggctgctcgtaatttaggtattcatattgcaacgccagtctttgatggggcttcttcagaagacctttgggaaactgttcaagaagcaggtatggattcagatgctaagactgttctttatgatggtcgtactggtgaaccattcgataaccgtgtgtcagttggtgtcatgtacatgatcaaacttcaccacatggttgatgataaacttcatgcccgttcagtaggaccatactcacttgttactcaacaaccacttggaggtaaagctcaatttggtggacaacgttttggtgagatggaggtttgggcgcttgaagcttatggtgcttcaaatgttcttcaagaaattttaacatacaaatctgatgatgttacaggacgtcttaaagcttatgaagctatcacaaaaggtaagccaattccaaaaccaggtgttccagaatcattccgtgttcttgtaaaagaattgcaatcacttggtcttgatatgcgtgtccttgatgaagatgacaacgaagttgaactccgtgatcttgatgaaggtgaagatgatgatgtgatgcacgttgatgaccttgaaaaagcacgtgtgaaacaagaagctgaagaaaaacaagctgaacaagtatctgaagtcgttcaagaagat

SEQ ID NO: 378 - protein, 1191 aa, Streptococcus agalactiae
MAGHEVQYGKHRTRRSFSRIKEVLDLPNLIEIQTDSFQDFLDAGLKEVFEDVLPISNFTDTMDLEFVGYELKEPKYTLEEARIHDASYSAPIFVTFRLVNKETGEIKTQEVFFGDFPIMTEMGTFIINGGERIIVSQLVRSPGVYFNDKVDKNGKVGYGSTVIPNRGAWLELETDAKDIAYTRIDRTRKIPFTTLVRALGFSGDDEIVDIFGDSELVRNTIEKDIHKNPSDSRTDEALKEIYERLRPGEPKTADSSRSLLVARFFDPRRYDLAAVGRYKINKKLNLKTRLLNQTIAENLVDGETGEILVEAGTVMTRDVIDSIAEHIDGDLNKFVYTPNDYAVVTEPVILQKFKVVAPTDPDRVVTIVGNSNPEDKVRALTPADILAEMSYFLNLAEGIGKVDDIDHLGNRRIRAVGELLANQFRIGLARMERNVRERMSVQDNEVLTPQQIINIRPVTAAVKEFFGSSQLSQFMDQHNPLSELSHKRRLSALGPGGLTRDRAGYEVRDVHYTHYGRMCPIETPEGPNIGLINNLSSFGHLNKYGFIQTPYRKVDRSTGAVTNEIVWLTADEEDEFTVAQANSKLNEDGTFAEEIVMGRHQGNNQEFPSSIVDFVDVSPKQVVAVATACIPFLENDDSNRALMGANMQRQAVPLIDPKAPYVGTGMEYQAAHDSGAAVIAKHDGRVIFSDAEKVEVRREDGSLDVYHVQKFRRSNSGTAYNQRTLVKVGDLVEKGDFIADGPSMENGEMALGQNPVVAYMTWEGYNFEDAVIMSERLVKEDVYTSVHLEEFESETRDTKLGPEEITREIPNVGEDSLRDLDEMGIIRIGAEVKEGDILVGKVTPKGEKDLSAEERLLHAIFGDKSREVRDTSLRVPHGGDGVVRDVKIFTRANGDELQSGVNMLVRVYIAQKRKIKVGDKMAGRHGNKGVVSRIVPVEDMPYLPDGTPVDIMLNPLGVPSRMNIGQVMELHLGMAARNLGIHIATPVFDGASSEDLWETVQEAGMDSDAKTVLYDGRTGEPFDNRVSVGVMYMIKLHHMVDDKLHARSVGPYSLVTQQPLGGKAQFGGQRFGEMEVWALEAYGASNVLQEILTYKSDDVTGRLKAYEAITKGKPIPKPGVPESFRVLVKELQSLGLDMRVLDEDDNEVELRDLDEGEDDDVMHVDDLEKARVKQEAEEKQAEQVSEVVQED

SEQ ID NO: 379 - DNA, 3564 bp, Streptococcus pyogenes
ttggcaggacatgaagttcgatacggaaaacaccgtacacgtcgtagcttttcaagaatcaaagaagttcttgatttaccaaatttgattgaaattcaaactgactcattccaagatttcctcgattcaggtttgaaagaagtatttgaagatgtacttcctatttcaaactttacggatactatggaacttgaatttgttggttacgaatttaaagaacctaaatatacccttgaagaagctcgtatccacgatgcaagttattctgcaccaatctttgttaccttccgtttggtcaataaagaaactggtgagattaaaactcaagaagtcttctttggtgatttcccaatcatgacggaaatgggtacctttattatcaatggtggtgaacgtatcatcgtttctcagttggtgcgttctccaggtgtttatttcaacgataaagttgataaaaacggtaaagttggttacggatcaacagtgattcctaaccgtggggcttggttggaattagagactgactcaaaagacattgcctacactcgtattgaccgtacccgtaagattccattcacaaccttggttcgtgcccttggtttctcaggtgatgatgaaattgttgatatctttggtgaaagcgaccttgttcgtaataccattgaaaaagacattcacaaaaatccaagtgattctcgtacagacgaagcccttaaagaaatttacgagcgtcttcgtccaggtgagccaaaaactgcagatagctctcgtagtcttttgattgcgcgtttctttgatgcacgtcgttacgatttggctgcggttggtcgttacaaagtgaacaaaaaacttaatatcaagactcgtcttttgaaccaaatcattgctgaaaaccttgtggatgctgaaactggcgaaattttggtagaagctggaactgagatgactcgtagcgtcatcgaatccatcgaagaacaccttgacggtgatttgaacaagtttgtttacacaccaaatgattacgctgtggttactgaaccagttgtccttcaaaagttcaaggttgtgtcaccaattgatcctgatcgtgtagtaactattgttggtaatgccaatccagatgataaggttcgtgcattgacacctgctgatattttggcagaaatgtcttacttcttgaaccttgctgaaggtcttggaaaagttgacgatattgaccacttgggtaaccgtcgtatccgtgccgttggtgaattgcttgccaaccaattccgcatcggtcttgctcgtatggagcgtaacgtgcgtgagcgtatgtctgttcaagacaacgatgtgttaacaccacaacaaatcatcaatatccgtcctgtcacagcagctgtcaaagaattcttcggttcgtctcagttgtcacagttcatggaccaacacaacccattgtcagagttgtctcacaaacgtcgtttatctgccttaggacctggtggtttgacacgtgaccgtgctggttatgaggttcgtgacgtgcattacacgcactatggccgtatgtgtccgattgaaacacctgaaggaccaaacattggtttgattaataacttgtcttcatttggacatcttaataaatatggtttcatccaaacaccttaccgtaaggttgaccgtgcgactggtacggtaactaacgagattgtttggttgactgccgacgaagaagacgaatacacagttgcacaggccaattcgaaactaaacgaagatggcacttttgctgaagaaatcgttatgggtcgtcaccaaggtaataaccaagaattttctgcaagtgttgttgatttcgttgacgtttcccctaaacaggtagttgctgttgcgacggcatgtattcctttcttggaaaacgatgactccaaccgtgccctcatgggtgccaacatgcaacgtcaggctgtgccattgattgatccaaaagcaccatatgttggtactggtatggaatatcaagctgcccatgactcaggcgctgcggtgattgctcagcaaaatggtaaagttgtcttttctgatgctgaaaaagtggaaatccgtcgtcaagatggctcgcttgatgtttaccacattaccaaattccgtcgttcaaactcaggaacagcctataaccaacgcacccttgttaaagtaggagacattgttgaaaaaggtgatttcatcgctgatggaccttctatggaaaatggtgaaatggctcttggacaaaacccagtcgttgcttacatgacttgggaaggttataactttgaggatgccgttatcatgagtgagcgccttgtgaaagaagatgtctacacatctgttcacttggaagaattcgaatctgaaacgcgtgatacaaaacttggccctgaagaaatcactcgggaaatcccaaatgttggtgaagaagccctcaaagaccttgacgaaatgggcattatccgtatcggtgctgaggttaaagaaggcgacatcttagtaggtaaagtcacacctaaaggtgaaaaagacctttctgctgaagaacgtttacttcacgccatctttggggataaatcgcgtgaagtgcgtgatacctcacttcgtgtccctcacggtggtgatggtatcgttcgtgatgtgaaaatctttacacgcgctaacggcgatgaattgcaatcaggtgttaatatgcttgtgcgtgtttacatcgctcaaaaacgtaaaatcaaggtcggagataaaatggccggtcgtcacggaaacaagggtgtcgtttcacgtattgtaccagttgaagacatgccataccttccagacggaacaccagttgacatcatgttgaaccctcttggggtgccatcacggatgaatattggtcaggttatggaacttcaccttggtatggctgctcgtaatcttggtattcacattgcaacacctgtctttgacggggcttcatcagaagacctttgggacactgttcgtgaagctggtatggatagcgatgctaagacggtcctttatgatggtcgcaccggtgaaccatttgacaaccgtgtatccgttggtgtcatgtatatgatcaaacttcaccacatggttgatgataaacttcatgcccgttctgtaggaccatactcacttgttacccaacagccacttggtggtaaagctcaatttggtggacaacgttttggtgagatggaggtttgggcccttgaagcttatggtgcatcaaatgttcttcaagaaatcttgacctacaagtcagatgacgtcacaggacgtttgaaagcctatgaagcgattactaaaggtaaaccaattccaaaaccaggtgtaccagaatccttccgtgttcttgtaaaagaattgcaatcgcttggtcttgatatgcgtgtgcttgacgaggatgataatgaagtggaacttcgtgatcttgatgaaggtgaagacgatgacattatgcatgttgacgatctcgagaaggcacgtgaaaaacaagctcaagaaactcaagaagtttctgaaacaactgacgaaaaa

SEQ ID NO: 380 - protein, 1188 aa, Streptococcus pyogenes
LAGHEVRYGKHRTRRSFSRIKEVLDLPNLIEIQTDSFQDFLDSGLKEVFEDVLPISNFTDTMELEFVGYEFKEPKYTLEEARIHDASYSAPIFVTFRLVNKETGEIKTQEVFFGDFPIMTEMGTFIINGGERIIVSQLVRSPGVYFNDKVDKNGKVGYGSTVIPNRGAWLELETDSKDIAYTRIDRTRKIPFTTLVRALGFSGDDEIVDIFGESDLVRNTIEKDIHKNPSDSRTDEALKEIYERLRPGEPKTADSSRSLLIARFFDARRYDLAAVGRYKVNKKLNIKTRLLNQIIAENLVDAETGEILVEAGTEMTRSVIESIEEHLDGDLNKFVYTPNDYAVVTEPVVLQKFKVVSPIDPDRVVTIVGNANPDDKVRALTPADILAEMSYFLNLAEGLGKVDDIDHLGNRRIRAVGELLANQFRIGLARMERNVRERMSVQDNDVLTPQQIINIRPVTAAVKEFFGSSQLSQFMDQHNPLSELSHKRRLSALGPGGLTRDRAGYEVRDVHYTHYGRMCPIETPEGPNIGLINNLSSFGHLNKYGFIQTPYRKVDRATGTVTNEIVWLTADEEDEYTVAQANSKLNEDGTFAEEIVMGRHQGNNQEFSASVVDFVDVSPKQVVAVATACIPFLENDDSNRALMGANMQRQAVPLIDPKAPYVGTGMEYQAAHDSGAAVIAQQNGKVVFSDAEKVEIRRQDGSLDVYHITKFRRSNSGTAYNQRTLVKVGDIVEKGDFIADGPSMENGEMALGQNPVVAYMTWEGYNFEDAVIMSERLVKEDVYTSVHLEEFESETRDTKLGPEEITREIPNVGEEALKDLDEMGIIRIGAEVKEGDILVGKVTPKGEKDLSAEERLLHAIFGDKSREVRDTSLRVPHGGDGIVRDVKIFTRANGDELQSGVNMLVRVYIAQKRKIKVGDKMAGRHGNKGVVSRIVPVEDMPYLPDGTPVDIMLNPLGVPSRMNIGQVMELHLGMAARNLGIHIATPVFDGASSEDLWDTVREAGMDSDAKTVLYDGRTGEPFDNRVSVGVMYMIKLHHMVDDKLHARSVGPYSLVTQQPLGGKAQFGGQRFGEMEVWALEAYGASNVLQEILTYKSDDVTGRLKAYEAITKGKPIPKPGVPESFRVLVKELQSLGLDMRVLDEDDNEVELRDLDEGEDDDIMHVDDLEKAREKQAQETQEVSETTDEK

SEQ ID NO: 381 - DNA, 3678 bp, Streptococcus agalactiae
atgatgataaatcgaagaaaggtaaaactagtggttgacgtaaatcgttttaaaagtatgcaaatcacattagcatcaccaagtaaggtccgttcatggtcttatggtgaagttaaaaaacctgaaacaatcaactaccgcacattgaaaccagaacgtgaaggactttttgatgaagttatttttggtccaacaaaagattgggaatgtgcgtgtggaaaatacaaacgtattcgttacaaaggaatcatttgtgaccgttgtggcgttgaagtaacccgtgcaaaagttcgtcgcgaacgtatgggacatatcgagttaaaagcaccagtatctcatatctggtatttcaaaggtatcccatcgcgtatggggctcacattggatatgagtcctcgtgcacttgaagaagttatttattttgcggcttatgttgttatcgatccaatggacacaccattagaaccgaagtcactccttactgagcgtgaataccgtgaaaaacttcaagagtacggttacggttcgtttgttgctaaaatgggtgctgaagccattcaagatcttcttaaacgcgttgatttagatgcagaaatcgcagttcttaaagaggagttgaaatcagcgacaggtcaaaaacgtgtgaaagcagttcgtcgtctggatgtgttagatgcctttaaaaaatctggaaataaaccagaatggatggttcttaacattttaccggttatcccaccggatcttcgtccgatggttcaattagatggtggtcgttttgcggcatcagacttgaatgacctttaccgccgtgttattaaccgtaacaatcgtttggcacgtttgttggaattaaatgctcctggcatcatcgttcaaaatgaaaaacgtatgttacaagaagctgttgatgcgcttatcgacaatggtcgtcgtggtcgtccaattaccggaccaggtagtcgtcctttgaaatcattaagccatatgcttaaaggtaaacaaggtcgtttccgccaaaacttgcttggtaaacgtgttgacttctctggacgttccgttattgctgttggtccaacactcaaaatgtaccaatgtggtgtaccacgtgaaatggctattgagctcttcaaaccttttgtaatgcgtgaaatcgttgctcgtgacctcgcagggaacgttaaagcagctaaacgtatggttgaacgtggggacgagcgtatttgggacatcttagaagaagttattaaagagcacccagtacttctaaaccgtgcacctactcttcacagattaggtatccaagcgtttgaacctgtccttattgatggtaaggcgcttcgtcttcacccacttgtatgtgaggcctacaatgctgactttgatggagaccaaatggccatccacgttccattgtctgaagaagcccaagcagaagctcgtcttttgatgcttgctgcagagcacatccttaaccctaaagatggtaagccagtcgtaacaccatctcaggacatggttttaggaaattactacctgactatggaagatgctggtcgtgaaggtgaaggcatgattttcaaagatcatgacgaagcagttatggcatatcaaaatggttatgttcatttacatacacgtgttggtatcgctgttgattcaatgccgaataagccttggacagaagagcaaaaacataaaatcatggttacaacagttggtaagattctcttcaacgatatcatgcctgaagatttaccgtacttaattgaacctaataatgcaaacttgacagaaaaaactccagataaatacttcttagagccaggtcaggatattcaagcagttattgataacttagagattaatattccctttaagaagaaaaatcttggtaatattatcgcagaaacttttaaacgtttccgtacaacagaaacttctgctttccttgaccgtttgaaggaccttggatattatcattcaacacttgctggtttgactgtgggtattgctgatatcccagttattgacaataaagctgagattattgatgcagctcaccacagagttgaagatatcaataaagccttccgtcgaggtttgatgactgaagaagatcgttatgttgctgttacaacaacatggcgtgaagctaaagaagcacttgaaaaacgtcttattgagacacaagatccaaagaaccctatcgttatgatgatggactcaggagctcgtggtaacatctcaaacttctcacaacttgccggtatgcgtggtttgatggctgctcctaacggacgtatcatggaattgccaatcttatcaaacttccgtgaaggtcttagtgttttggaaatgttcttctcaactcacggtgcgcgtaaaggtatgactgatacggcccttaagacagccgactcaggttaccttactcgtcgtttggttgacgttgcccaagatgttattattcgtgaagatgactgtggaacagaccgcggtttgacaatcacagcaattacagatggtaaagaggttactgagacacttgaagagcgtttgataggacgttatactaagaagtcaatcaaacatcctgagacaggtgaaattctcgttggtgcagataccttaattactgaagatatggctgctaaagttgttaaagcgggcgttgaggaagtaactatccgatcagtatttacatgtaacactcgccatggtgtttgtcgtcactgttacggtattaacttggcaacaggtgatgctgttgaggttggtgaagcagttggtactattgcagctcaatctatcggtgaaccagggacacagcttacaatgcgtaccttccataccggtggtgttgcttcaaatactgatattacacaaggtctcccacgtatccaagaaatctttgaagcacgtaaccctaaaggtgaggcagttattactgaagttaagggtgaagtcgttgcaattgaagaagactcttcaacacgtactaagaaagtattcgttaaaggtcagacaggtgagggagaatacgttgttccatttacagcacgtatgaaagttgaagttggtgatgaagtagctcgtggtgcggccttaactgaaggatctatccaaccaaaacgtctccttgaagttcgtgatactttatctgttgaaacgtacctacttgctgaagtacaaaaagtttaccgtagccaaggggtagaaatcggagataaacacgttgaggtaatggttcgtcaaatgctccgtaaagttcgtgtcatggatccaggagatacagatcttcttccaggtacacttatggatatttcagactttacagatgctaacaaagatattgttatttctggtggaatccctgcgacaagccgtcctgtccttatgggtattactaaggcttcccttgaaactaattcattcttatcagctgcatccttccaagaaacaacacgtgtccttacagatgctgctatccgtggtaagaaagatcacttacttggtcttaaagaaaatgttattatcggtaaaatcattccagcgggtactggtatggctcgttaccgtaatattgaaccacttgctgttaatgaagttgagattattgaaggaactcctgttgatgcagaagttacggaagtatcaacacctacaacagaagat

SEQ ID NO: 382 - protein, 1226 aa, Streptococcus agalactiae
MMINRRKVKLVVDVNRFKSMQITLASPSKVRSWSYGEVKKPETINYRTLKPEREGLFDEVIFGPTKDWECACGKYKRIRYKGIICDRCGVEVTRAKVRRERMGHIELKAPVSHIWYFKGIPSRMGLTLDMSPRALEEVIYFAAYVVIDPMDTPLEPKSLLTEREYREKLQEYGYGSFVAKMGAEAIQDLLKRVDLDAEIAVLKEELKSATGQKRVKAVRRLDVLDAFKKSGNKPEWMVLNILPVIPPDLRPMVQLDGGRFAASDLNDLYRRVINRNNRLARLLELNAPGIIVQNEKRMLQEAVDALIDNGRRGRPITGPGSRPLKSLSHMLKGKQGRFRQNLLGKRVDFSGRSVIAVGPTLKMYQCGVPREMAIELFKPFVMREIVARDLAGNVKAAKRMVERGDERIWDILEEVIKEHPVLLNRAPTLHRLGIQAFEPVLIDGKALRLHPLVCEAYNADFDGDQMAIHVPLSEEAQAEARLLMLAAEHILNPKDGKPVVTPSQDMVLGNYYLTMEDAGREGEGMIFKDHDEAVMAYQNGYVHLHTRVGIAVDSMPNKPWTEEQKHKIMVTTVGKILFNDIMPEDLPYLIEPNNANLTEKTPDKYFLEPGQDIQAVIDNLEINIPFKKKNLGNIIAETFKRFRTTETSAFLDRLKDLGYYHSTLAGLTVGIADIPVIDNKAEIIDAAHHRVEDINKAFRRGLMTEEDRYVAVTTTWREAKEALEKRLIETQDPKNPIVMMMDSGARGNISNFSQLAGMRGLMAAPNGRIMELPILSNFREGLSVLEMFFSTHGARKGMTDTALKTADSGYLTRRLVDVAQDVIIREDDCGTDRGLTITAITDGKEVTETLEERLIGRYTKKSIKHPETGEILVGADTLITEDMAAKVVKAGVEEVTIRSVFTCNTRHGVCRHCYGINLATGDAVEVGEAVGTIAAQSIGEPGTQLTMRTFHTGGVASNTDITQGLPRIQEIFEARNPKGEAVITEVKGEVVAIEEDSSTRTKKVFVKGQTGEGEYVVPFTARMKVEVGDEVARGAALTEGSIQPKRLLEVRDTLSVETYLLAEVQKVYRSQGVEIGDKHVEVMVRQMLRKVRVMDPGDTDLLPGTLMDISDFTDANKDIVISGGIPATSRPVLMGITKASLETNSFLSAASFQETTRVLTDAAIRGKKDHLLGLKENVIIGKIIPAGTGMARYRNIEPLAVNEVEIIEGTPVDAEVTEVSTPTTED

SEQ ID NO: 383 - DNA, 3639 bp, Streptococcus pyogenes
gtggttgacgtaaatcgttttaaaagtatgcaaatcacattagcctcaccaagtaaggtccgttcatggtcttatggtgaagttaaaaaacctgaaacaatcaactaccgtacattaaaaccagaacgtgaaggactctttgacgaagtcatctttggtccaacaaaagactgggaatgtgcgtgtggtaagtacaaacgtatccgttataaagggatcgtttgtgatcgctgtggggttgaggtaactcgtgctaaagtacgtcgtgaacgtatgggtcacattgagttaaaagctcctgtatcacatatctggtatttcaaagggattccatctcgtatgggattgactcttgatatgagtcctcgtgcccttgaagaagtgatctattttgcggcttatgtggtcattgatccaaaagatacaccgcttgaaccaaaatcattattaacagaacgtgaataccgtgaaaaactacaagagtatggtcatgggtcatttgtcgctaagatgggtgctgaagccattcaagatctcttgaaacgtgtggacttggcagctgaaatcgctgaattaaaagaagagttgaaatctgcttctggtcaaaaacggattaaagcagttcgtcgtttagacgtccttgatgcctttaacaaatctggaaataaaccagaatggatggttcttaacatcctgccggttattccaccagatcttcgtccgatggttcaattggatggtggtcgttttgcggcatcagacttgaatgacttgtaccgtcgtgtgattaaccgtaataaccgtttggcacgtttgttagaacttaatgcccctggcatcattgttcaaaatgaaaaacgaatgcttcaagaagccgttgatgctttgattgataatggtcgtcgtggtcgtccaatcactggaccaggaagtcgtccattgaaatcattgagccacatgcttaaaggtaaacaagggcgtttccgtcaaaacttgcttggtaaacgtgtagacttctctggacgttccgttatcgctgttggtccaacccttaaaatgtatcaatgtggtgtcccacgtgaaatggctatcgagctttttaaaccatttgtaatgcgcgaaattgttgccaaagaatatgctggtaacgttaaagccgctaaacgtatggttgaacgtggcgacgaacgcatctgggatatcttagaagaagttatcaaagaacacccagtcctacttaaccgcgcaccgactcttcacagacttggtattcaggcttttgaacccgttcttattgacggtaaggcacttcgtcttcacccacttgtgtgtgaggcctacaatgccgacttcgatggagaccaaatggccattcacgtgccactttcagaagaagcacaagctgaagctcgtcttttgatgcttgctgcagagcacatcttgaaccctaaagatggtaaaccagttgttactccatctcaggatatggttcttggtaactactatcttacgatggaagatgctggtcgcgaaggcgaaggtatgattttcaaggataaagacgaagctgtgatggcatatcgtaatggttatgctcatcttcatagtcgtgtgggtatcgctgttgacagcatgccaaacaaaccttggaaagacaatcaaagacataaaatcatggtgacaactgttggtaagattctctttaacgatatcatgccagaggaccttccttacctccaagagccaaacaatgccaacttgacagaaggaacacctgataaatacttccttgaacctggtcaagacatccaagaagtgattgatcgcttagacatcaatgtgccatttaagaagaaaaacctcggtaacatcattgcggaaaccttcaaacgtttccgtacaacagaaacatcagccttccttgaccgcttgaaagaccttggttactaccactcaacccttgctggtttgacagtgggtatcgctgacattcctgttattgataataaagctgaaatcattgatgctgctcaccatcgtgttgaagaaattaacaaagccttccgtcgtggtttgatgacagatgatgaccgttatgttgccgttacaacaacatggcgtgaagctaaagaagcccttgaaaaacgtctgattgaaacacaagatcctaagaacccaatcgttatgatgatggactcaggagctcgtggtaacatctcaaacttctcacagcttgctggtatgcgtggtttgatggctgctcctaacggacgcatcatggaacttcctatcttgtcaaacttccgtgaaggtttgagcgttttggaaatgttcttctcaacccacggtgcacgtaaagggatgaccgatacggcccttaaaacagccgactcaggttaccttactcgtcgtttggttgacgttgcccaagatgttatcattcgtgaggacgattgtggcactgatcgtggtcttcttatccgtgctattacagatggtaaagaagttaccgaaacgcttgaagagcgtcttcaaggtcgttacacacgtaaatcagtcaaacaccctgaaactggtgaagtcttgattggtgctgaccaattaatcactgaagacatggctcgtaagattgttgatgcaggtgttgaagaagtgaccattcgttctgtctttacctgtgcgactcgtcatggtgtctgccgtcactgttatggtatcaacttggcaactggtgatgctgttgaagtgggtgaagcagttggtactattgctgcccaatctatcggtgagcctggtactcagcttaccatgcgtaccttccacacgggtggtgtagcctcaaataccgatatcacccagggtcttcctcgtattcaagagatctttgaagcacgtaatcctaaaggggaagcggtcattactgaagtgaaagggaatgtcgtcgagattgaagaagatgcgtcaactcgtaccaagaaagtctacgttcaaggaaaaactggcatgggcgaatatgtcataccatttacagcacgtatgaaagttgaagttggcgacgaagttaatcgcggagctgcccttacagaagggtcaattcaaccgaaacgtctccttgaagtgcgtgataccttgtcagttgaaacgtaccttcttgcagaagtacaaaaagtttaccgtagccaaggggtagaaatcggagacaaacacgttgaggtaatggttcgccaaatgcttcgtaaagttcgtgtcatggatccaggtgatacagacctccttccaggtacacttatggatatttctgatttcacagatgctaacaaagatattgttatctctggtggtattcctgcgacatctcgtcctgttcttatgggtattactaaggcttcccttgaaaccaattccttcttatcagctgcatccttccaagaaacaactcgtgttcttacagatgctgctatccgtggtaaaaaagatcatcttcttggtcttaaagaaaatgttatcattggtaaaatcatcccagctggtactggtatggctcgttaccgtaacattgaaccacaagcgatgaatgagattgaagtgattgatcatacagaagtctcagcagaagccgtttttacagcagaagcagaa

SEQ ID NO: 384 - protein, 1213 aa, Streptococcus agalactiae
VVDVNRFKSMQITLASPSKVRSWSYGEVKKPETINYRTLKPEREGLFDEVIFGPTKDWECACGKYKRIRYKGIVCDRCGVEVTRAKVRRERMGHIELKAPVSHIWYFKGIPSRMGLTLDMSPRALEEVIYFAAYVVIDPKDTPLEPKSLLTEREYREKLQEYGHGSFVAKMGAEAIQDLLKRVDLAAEIAELKEELKSASGQKRIKAVRRLDVLDAFNKSGNKPEWMVLNILPVIPPDLRPMVQLDGGRFAASDLNDLYRRVINRNNRLARLLELNAPGIIVQNEKRMLQEAVDALIDNGRRGRPITGPGSRPLKSLSHMLKGKQGRFRQNLLGKRVDFSGRSVIAVGPTLKMYQCGVPREMAIELFKPFVMREIVAKEYAGNVKAAKRMVERGDERIWDILEEVIKEHPVLLNRAPTLHRLGIQAFEPVLIDGKALRLHPLVCEAYNADFDGDQMAIHVPLSEEAQAEARLLMLAAEHILNPKDGKPVVTPSQDMVLGNYYLTMEDAGREGEGMIFKDKDEAVMAYRNGYAHLHSRVGIAVDSMPNKPWKDNQRHKIMVTTVGKILFNDIMPEDLPYLQEPNNANLTEGTPDKYFLEPGQDIQEVIDRLDINVPFKKKNLGNIIAETFKRFRTTETSAFLDRLKDLGYYHSTLAGLTVGIADIPVIDNKAEIIDAAHHRVEEINKAFRRGLMTDDDRYVAVTTTWREAKEALEKRLIETQDPKNPIVMMMDSGARGNISNFSQLAGMRGLMAAPNGRIMELPILSNFREGLSVLEMFFSTHGARKGMTDTALKTADSGYLTRRLVDVAQDVIIREDDCGTDRGLLIRAITDGKEVTETLEERLQGRYTRKSVKHPETGEVLIGADQLITEDMARKIVDAGVEEVTIRSVFTCATRHGVCRHCYGINLATGDAVEVGEAVGTIAAQSIGEPGTQLTMRTFHTGGVASNTDITQGLPRIQEIFEARNPKGEAVITEVKGNVVEIEEDASTRTKKVYVQGKTGMGEYVIPFTARMKVEVGDEVNRGAALTEGSIQPKRLLEVRDTLSVETYLLAEVQKVYRSQGVEIGDKHVEVMVRQMLRKVRVMDPGDTDLLPGTLMDISDFTDANKDIVISGGIPATSRPVLMGITKASLETNSFLSAASFQETTRVLTDAAIRGKKDHLLGLKENVIIGKIIPAGTGMARYRNIEPQAMNEIEVIDHTEVSAEAVFTAEAE

SEQ ID NO: 385 - DNA, 363 bp, Streptococcus agalactiae
atgtatcaagttgtaaaaatgtttggtgattgggaaccatggtggtttattgaaggttgggaggaagatattactgaaattgctgagtatgataccttatcagaagctttgctctattttcaagaggagtgggataggggacaggaaaagtggccttattttcaaagtaagtctagtttgttggcaacgttttggagtataaaagaaaaacgttggtgtgaagaatgtgatgagtacctccaacagtatcattccttaatgttattgaaagaatggcaagaaattcctaaggaagaatctattgagcgatttgaagtatttaataagatagctgagttgccatcggcatgttctttaaatttg

SEQ ID NO: 386 - protein, 121 aa, Streptococcus agalactiae
MYQVVKMFGDWEPWWFIEGWEEDITEIAEYDTLSEALLYFQEEWDRGQEKWPYFQSKSSLLATFWSIKEKRWCEECDEYLQQYHSLMLLKEWQEIPKEESIERFEVFNKIAELPSACSLNL

SEQ ID NO: 387 - DNA, 363 bp, Streptococcus pyogenes
atgtatcaagtaattaaaatgtatggtgattgggagccttggtggttcatcgatggatggcaagacgatattatagatgagcaacaatttagtgactggcaagaagcgcttgattattttaatcaagaatggcagcgcatgaaagctatttttcctagttatcatagtcaaaagaatttgttagctactttttgggaaaaagaagataaaagatggtgcgaggactgtgacgaagatttgcagcagtttcattctcttttactccttaaaaataaagatattgtaccaagcaataattatatccctgaatttgaacaacgaaatgattcaccacaggtagcttatctttgcaagttaaacctt

SEQ ID NO: 388 - protein, 121 aa, Streptococcus pyogenes
MYQVIKMYGDWEPWWFIDGWQDDIIDEQQFSDWQEALDYFNQEWQRMKAIFPSYHSQKNLLATFWEKEDKRWCEDCDEDLQQFHSLLLLKNKDIVPSNNYIPEFEQRNDSPQVAYLCKLNL

SEQ ID NO: 389 - DNA, 969 bp, Streptococcus agalactiae
atggttcaatcattagcaaagcaagtcattcatcaggcagtagaagtaaatgctcaagatatttatatcattcccaaaggtgattgttatgaactctatatgcgtattgatgatgaaaggcggtttattgatgtttttgagtttaataggatggctagtcttattagtcactttaaatttgtggcaggcatgaacgttggagaaaaaagacgaagtcaattaggttcttgtgactatgaactgtcagagggaagactggtttcattacgactatcgagtgtgggagattatcgtggtcaagaatctttagttattcgtattttgtattcaggtcatcaggacttaaaatattggtttgataatataaagcaaatgaaggaagtactgggtataagagggctatatcttttttccggccctgtggggagtggtaaaacaactctcatgtatcaattagcttcagaagtatttaaaaataagcaaattatcacgattgaagatccggtagaaatcaagaatgacaagatgttacaactccaattgaatgaggatattggaatgacttatgatgctttaatcaaactgtctttacggcatcgtccagatattttaattatcggagagattagagatcaagcgacggcccgtgctgttattcgtgcaagtttaacgggagtgatggttttttctactattcatgctaaaagtattcccggagtctatgataggcttatagaattaggggttaactatcaagagttagaaaatagtctaaaattaatagcatatcaacgtttaattggaggaggaagcctaattgactttgagacaggtaattttaaaaaacactcatcagacaagtggaatagacaagtggatatcttggctgaagaaggacatatcagtaagaaacaggcacaagtcgaaaaaattatccctcaagaaacaacggaaagtagtccaactttt

SEQ ID NO: 390 - protein, 323 aa, Streptococcus agalactiae
MVQSLAKQVIHQAVEVNAQDIYIIPKGDCYELYMRIDDERRFIDVFEFNRMASLISHFKFVAGMNVGEKRRSQLGSCDYELSEGRLVSLRLSSVGDYRGQESLVIRILYSGHQDLKYWFDNIKQMKEVLGIRGLYLFSGPVGSGKTTLMYQLASEVFKNKQIITIEDPVEIKNDKMLQLQLNEDIGMTYDALIKLSLRHRPDILIIGEIRDQATARAVIRASLTGVMVFSTIHAKSIPGVYDRLIELGVNYQELENSLKLIAYQRLIGGGSLIDFETGNFKKHSSDKWNRQVDILAEEGHISKKQAQVEKIIPQETTESSPTF

SEQ ID NO: 391 - DNA, 936 bp, Streptococcus pyogenes
atggtacaagcattagcaaaagctattctagcaaaagctgaacaggttcatgcacaagatatttatattttgccaagagcagatcaatatgatctttttttacgaataggagatgaaaggagattagttgatgtttatcagagcgatcggatggctcctcttattagtcactttaaattcgttgcaggaatgatagttggtgaaaagagacgttgtcaggtgggttcatgtgattataagcttagtaaagataagcagttatctttgcgcttatctagcgtgggtgattatcgcgggcaagaaagcttagtgattcgtctgcttcatcatcaaaataaaagtgtacattattggtttgatggattgacaaaagtagccaatcaggttggcggtagagggttgtatttatttgcaggaccagttgggtctgggaagacaaccttgatgtaccagctgatttcgaattatcatcaagaagcacaggttattagtatagaagatcctgtagaaattaaaaatcaccaaattttacaattacaagtgaatgatgatattggtatgacttatgacaatttgatcaaactgtctttacgccatcgaccagatattttagttattggtgagattcgagatagtcaaacagcaagagccgttattagggctagtctaacaggtgccatggttttttcaacggttcacgctaaaagtatctcgggtgtttatgcaagattgttagaacttggtgtaacgaaagcagaactgtctaattgcttagcattaattgcttaccaaaggttacttaatggaggagcattgattgactctactcaaaacgaatttgaatattattcctcatcgaactggaatcaacaaattgatcagcttcttgaggcaggacatctcaatcccaagcaagctaagcttgaaaaaattatc

SEQ ID NO: 392 - protein, 312 aa, Streptococcus pyogenes
MVQALAKAILAKAEQVHAQDIYILPRADQYDLFLRIGDERRLVDVYQSDRMAPLISHFKFVAGMIVGEKRRCQVGSCDYKLSKDKQLSLRLSSVGDYRGQESLVIRLLHHQNKSVHYWFDGLTKVANQVGGRGLYLFAGPVGSGKTTLMYQLISNYHQEAQVISIEDPVEIKNHQILQLQVNDDIGMTYDNLIKLSLRHRPDILVIGEIRDSQTARAVIRASLTGAMVFSTVHAKSISGVYARLLELGVTKAELSNCLALIAYQRLLNGGALIDSTQNEFEYYSSSNWNQQIDQLLEAGHLNPKQAKLEKII

SEQ ID NO: 393 - DNA, 900 bp, Streptococcus agalactiae
atggtcaccttcttaaagaggagtaagttattgtctgattgttatacagatagtatgaataaggcattattagagggaaaagatttatcaaaaatgttaggagagttaggtttttctgacactgttatcacacaggttgcattagctgatttgcatggtaacatttcaaggagcctactaaagattgagtcttatttagctaatcttttgttagttagaaaaaaagtaatagaagtagctacttacccattgatattattgtcttttctggtgctaattatgattggccttaggaattatttaatgccccaattaggagaaaataattttgcaactagactgattacaaatgtgccgaatattttcttattacttttagcagttgtacttatttttagtttaatattttatattattcaaaagcgattgtcgcgcattaaagtagcttgttttttaacaacaattcccttagttggatcatatgttaagctttatttaactgcttactatgcccgtgagtggggaaatttattaagtcaaggtattgaattggaccaaattgttaaagtaatgcaaaatcagaaatccaaactttttagggaaataggatatgacatggaagaaggttttctatcaggtaaagcatttcaccaaaaagtattagactatccgtttttcttaactgagcttagtttaatgattgaatatggccaagttaaggcgaaattaggaacagagttagatatatatgctgatgagaagtgggaggatttttttacaaaattagctagagcgacccagttaatccaacccgttatttttatttttgtagctcttatcattgttatgatttatgcagcaatgctgttaccaatgtatcaaaatatggagatattatca

SEQ ID NO: 394 - protein, 300 aa, Streptococcus agalactiae
MVTFLKRSKLLSDCYTDSMNKALLEGKDLSKMLGELGFSDTVITQVALADLHGNISRSLLKIESYLANLLLVRKKVIEVATYPLILLSFLVLIMIGLRNYLMPQLGENNFATRLITNVPNIFLLLLAVVLIFSLIFYIIQKRLSRIKVACFLTTIPLVGSYVKLYLTAYYAREWGNLLSQGIELDQIVKVMQNQKSKLFREIGYDMEEGFLSGKAFHQKVLDYPFFLTELSLMIEYGQVKAKLGTELDIYADEKWEDFFTKLARATQLIQPVIFIFVALIIVMIYAAMLLPMYQNMEILS

SEQ ID NO: 395 - DNA, 1032 bp, Streptococcus pyogenes
ttgatcagcttcttgaggcaggacatctcaatcccaagcaagctaagcttgaaaaaattatctagtaaacatcagcataaattcattcaattactagctaatcttttatctacaggatttagcttcgcagaggttattgcttttttaaaaagaagccagttgcttcagctagattatgttcttaaaatggaagagtctttattaaaaggacaaggcttagcagatatgttgtcgggtttaggtttttcagatgctattcttactcaaattagtttagctgatagacacggtaatattgaaacaacattagtagcgattcaacattacttgaaccaaatggcaaggatcagacgaaaaactgttgaagttatcacctatcctcttattcttttactttttctttttgtgatgatgctagggttgagacgctatttagtccctcaattagaaactcaaaatcagataacttactttcttaaccattttcctgccttctttataggtttttgctcaggtcttattttgttgttcgggatggtatggctacgatggcgatctcaaagccgcttgaaactctatagtcggctaagccgttatccttttttaggtaaactgttaaaacaatacttaactagttattatgctagagaatggggtacgttaataggtcaaggtcttgatttgatgactattttagacattatggccattgagaaatcctcactaatgaaagaattagctgaggacatcagaatgagtctgcttgaagggcaagcctttcacattaaagtagctacctaccctttttttaaaaaagaattaagtttaatgattgaatacggtgaaatcaaatcgaaactgggggctgagttggaaatctatgcccaggaaagctgggaacaattttttagtcagctttatcaagtgacacaacttattcaaccagctatttttttagtagttgctgtgacaatcgtcatgatttatgcggcaatcctattaccaatttaccaaaatatgggaggtattttt

SEQ ID NO: 396 - protein, 344 aa, Streptococcus pyogenes
LISFLRQDISIPSKLSLKKLSSKHQHKFIQLLANLLSTGFSFAEVIAFLKRSQLLQLDYVLKMEESLLKGQGLADMLSGLGFSDAILTQISLADRHGNIETTLVAIQHYLNQMARIRRKTVEVITYPLILLLFLFVMMLGLRRYLVPQLETQNQITYFLNHFPAFFIGFCSGLILLFGMVWLRWRSQSRLKLYSRLSRYPFLGKLLKQYLTSYYAREWGTLIGQGLDLMTILDIMAIEKSSLMKELAEDIRMSLLEGQAFHIKVATYPFFKKELSLMIEYGEIKSKLGAELEIYAQESWEQFFSQLYQVTQLIQPAIFLVVAVTIVMIYAAILLPIYQNMGGIF

SEQ ID NO: 397 - DNA, 453 bp, Streptococcus agalactiae
atgaaaaatttattgttaaaatgtaaggataagaaggttaaagcatttacacttttagaatgtttggtagcattggttacaatcacaggagctttactagtttatcaaggactgacaaaattgttggctcaacagatagtagtgatgtcttcttccagtcagtctgaatgggtgttattaactcagcaactaaatgcagaatttgaaggcgctcatctggaatatttaagacagaacaaactttatttacgtaagcaagataagattgtaacctttggcaaatctaataaagatgatttccgtaagacaggttatgatggtcgaggttatcaaccaatggtttatgggttagacaattgtcaaatgagtcagaccaaaagtatggtaaaacttgttttttattttaaggacgggttaaaaaggacattttactatgattttaaagaagaaact

SEQ ID NO: 398 - protein, 151 aa, Streptococcus agalactiae
MKNLLLKCKDKKVKAFTLLECLVALVTITGALLVYQGLTKLLAQQIVVMSSSSQSEWVLLTQQLNAEFEGAHLEYLRQNKLYLRKQDKIVTFGKSNKDDFRKTGYDGRGYQPMVYGLDNCQMSQTKSMVKLVFYFKDGLKRTFYYDFKEET

SEQ ID NO: 399 - DNA, 432 bp, Streptococcus pyogenes
ttgagtaaacaattaagtaacataaaagcttttacccttctagaggcgttaatagccttactcgtgatatcagggtctttattggtttatcaaggtttgacccgaaccctccttaaacatagccattatctagcccgtcatgatcaagataattggctcttattttctcatcaattgcgagaggagttaagtggagcaaggttttacaaagtagctgataataaactatacgttgaaaaaggaaagaaagtactagcttttggccaatttaaaagtcatgattttcgaaaatcagctagtaatggaaaagggtatcaacccatgttatttggaatatcacgtagtcatattcacatagagcagtcacagatttgcattactttaaagtggaaaagtgggttagaaaggactttttattatgcctttcaagac

SEQ ID NO: 400 - protein, 144 aa, Streptococcus pyogenes
LSKQLSNIKAFTLLEALIALLVISGSLLVYQGLTRTLLKHSHYLARHDQDNWLLFSHQLREELSGARFYKVADNKLYVEKGKKVLAFGQFKSHDFRKSASNGKGYQPMLFGISRSHIHIEQSQICITLKWKSGLERTFYYAFQD

SEQ ID NO: 401 - DNA, 972 bp, Streptococcus agalactiae
atgaattttgaaaaaattgagacagcctatgagctgattttagaaaatatccaaacgattgagaaccaattaaaaactcatatttatgatgccttaattgaacagaactcttattaccttggttcaagttgtgatttagatatggttgtggtgaataaccaaaaattacgtcaacttgacttaagtcaagaagaatggcgtcgcactttccagttcatttttatcaaatctgcgcaaacagagcaattacaagctaatcatcagtttacgccagatagtattggttttatcttgttatttcttttggaagaattaacgagtcaagagacagtggatgtcttggaaattggaagtggaactgggaatttagctcagactctcctcaataacagctcgaaagagttaaattatatgggcattgaagttgatgatcttttgattgatctatcagcaagcattgctgaaattataggttctagtgcccaatttatccaagaggatgctgttagaccacaaattttgaaagaaagcgatgtaatcattagtgatttaccagttggctattatcctaatgatggtattgctaaacgatatgctgtatcaagttctaaagagcacacctatgctcaccatctattgatggagcaatctcttaaatatttgaaaaaagatggaatcgctatatttttagcacccgaaaaccttttaacaagtccacaaagtgatttgctgaaggagtggttaaaaggatatgcagatgtcattgccgttttaactctaccagaaactatttttggaagtcgtcaaaatgcgaaatctatatttgttctcaagaagcaagcagaacaaaaaccagaaacctttgtatatccgctgacagatttgcaaaatcgtgagaatatggcaaacttcattgaaaattttcaaaaatggagcagagaaaatagtcattactcaaaaaatatgataaaa

SEQ ID NO: 402 - protein, 324 aa, Streptococcus agalactiae
MNFEKIETAYELILENIQTIENQLKTHIYDALIEQNSYYLGSSCDLDMVVVNNQKLRQLDLSQEEWRRTFQFIFIKSAQTEQLQANHQFTPDSIGFILLFLLEELTSQETVDVLEIGSGTGNLAQTLLNNSSKELNYMGIEVDDLLIDLSASIAEIIGSSAQFIQEDAVRPQILKESDVIISDLPVGYYPNDGIAKRYAVSSSKEHTYAHHLLMEQSLKYLKKDGIAIFLAPENLLTSPQSDLLKEWLKGYADVIAVLTLPETIFGSRQNAKSIFVLKKQAEQKPETFVYPLTDLQNRENMANFIENFQKWSRENSHYSKNMIK

SEQ ID NO: 403 - DNA, 996 bp, Streptococcus pyogenes
gtgacacttcttttcatttcaagtgtaatttggtatgataaggttatgacttttgaaaaaattgaagaagcttatcagctgctcttagagaactgtcaactaattgaaaatgatctaaaaacacatatatacgatgccattgttgaacaaaactccttttatttaggggctgagggagctagtcctcaagttgctcaaaatagtgataaactgaaagccttgtgcctgacaaaagaagaatggcgtaaggcctaccagtttctttttattaaggcagctcagactgagcaactccaagccaaccatcagttcacaccagatgctattggcttcattctgctgtatcttttggaacaattgagtgataaagatagcttagaggtacttgagattggaagtggaacagggaacctagcccaaacccttctcaacaacacgagcaagagccttgattatgtagggattgaacttgatgatctcttgattgatctgtcagccagtattgctgagataatggattcttcagctcattttattcaagaagatgcggtaaggcctcaattactaaaagaaagtgacattgtcatcagtgacttaccagttggttattatcctaacgatgatattgccaaacggtacaaggtggctagttcagataagcatacctatgcccatcatttattaatggaacagtctttaaaatacttgaaaaaagacggttttgcgatttttctggcaccagtcaatttattgacgagccctcagagccagttgttgaaacagtggttaaaagattatgctcaggtggtgaccttgattacgctaccagattctatttttggtcatccctcaaatgccaagtccattattgtcttacaaaaacaaacagaccacccaatggaaacctttgtctatccaattcgggatttgaagcttgcagagaatattcatgattttatggaaaatttcaaaaaatggaaactgagtaatgtcaat

SEQ ID NO: 404 - protein, 332 aa, Streptococcus pyogenes
VTLLFISSVIWYDKVMTFEKIEEAYQLLLENCQLIENDLKTHIYDAIVEQNSFYLGAEGASPQVAQNSDKLKALCLTKEEWRKAYQFLFIKAAQTEQLQANHQFTPDAIGFILLYLLEQLSDKDSLEVLEIGSGTGNLAQTLLNNTSKSLDYVGIELDDLLIDLSASIAEIMDSSAHFIQEDAVRPQLLKESDIVISDLPVGYYPNDDIAKRYKVASSDKHTYAHHLLMEQSLKYLKKDGFAIFLAPVNLLTSPQSQLLKQWLKDYAQVVTLITLPDSIFGHPSNAKSIIVLQKQTDHPMETFVYPIRDLKLAENIHDFMENFKKWKLSNVN

SEQ ID NO: 405 - DNA, 1191 bp, Streptococcus agalactiae
atgtcaaaaacaatagcaattaatgctggaagttcaagtttgaaatggcaattatatgaaatgccagaggagaaagtagttgccaaagggattatcgaacgtattggtttgaaagattctatttcgactgtaaaatttgacgataaaaaagatgaacaaattttagatatcgtagatcatacccaagctgttaaaattcttttagaagatctaacaaaacatggtattatcaaagactttaatgaaattacaggtgttggtcatcgtgtcgttgctggtggtgaatattttaaagagtctgctttagtagatgataaagttgtagaacaggttgaagaattatcagctttagctccactccacaacccagcagctgcagcagggattcgtgcgtttagagaaatcttaccagatatcacgagtgtatgtgtatttgatacagccttccatacaacaatgcaacctcatacctacttatatccaatcccacaaaagtactatactgattataaagtacgtaaatacggtgcacacgggacaagccaccaatacgttgcacaagaagcagctaagcaattaggacgtcctttagaagaattaaaattaatcacagcacatgtgggtaatggtgtttctattacagcaaattatcatggacagtctattgatacatcaatgggattcacaccacttgcaggaccaatgatgggaacacgttcaggagacattgatcctgcgattatcccttatcttgtagctaatgatccagaattggaagatgcagcagctgttgttaatatgcttaacaaacaatcaggattgcttggagtatcaggaacttcaagtgatatgcgagatattgaagcaggtcttcaaagtaaagatccaaatgcagtgttagcctataatgtctttattgaccgtattaagaaatttattggacaatacttggcagtattaaatggcgcggatgctattatttttactgcaggtatgggagaaaatgcgccattaatgcgtcaagatgttatcgcaggattatcatggtttggcattgaacttgatccagaaaaaaatgtttttggttattttggagatatcacaaaaccagattcaaaagtgaaggttttagttattcctactgatgaagaattaatgattgcgcgtgacgttgagcgccttaaagctaaa

SEQ ID NO: 406 - protein, 397 aa, Streptococcus agalactiae
MSKTIAINAGSSSLKWQLYEMPEEKVVAKGIIERIGLKDSISTVKFDDKKDEQILDIVDHTQAVKILLEDLTKHGIIKDFNEITGVGHRVVAGGEYFKESALVDDKVVEQVEELSALAPLHNPAAAAGIRAFREILPDITSVCVFDTAFHTTMQPHTYLYPIPQKYYTDYKVRKYGAHGTSHQYVAQEAAKQLGRPLEELKLITAHVGNGVSITANYHGQSIDTSMGFTPLAGPMMGTRSGDIDPAIIPYLVANDPELEDAAAVVNMLNKQSGLLGVSGTSSDMRDIEAGLQSKDPNAVLAYNVFIDRIKKFIGQYLAVLNGADAIIFTAGMGENAPLMRQDVIAGLSWFGIELDPEKNVFGYFGDITKPDSKVKVLVIPTDEELMIARDVERLKAK

SEQ ID NO: 407 - DNA, 1194 bp, Streptococcus pyogenes
atgtcaaagacaattgcaattaatgcaggtagttctagtttaaaatggcaactttatcagatgccagaagaagcagtgttagcacaaggaattattgagcgtatcggtctcaaggattctatttcaacagttaagtacgatggcaaaaaagaagagcaaattcttgatattcacgatcatacagaagctgttaaaatcttattgaacgatttgattcactttggaatcattgcagcttatgatgaaattacaggagttggacaccgtgttgttgctggtggtgaacttttcaaagaatccgttgtggttaatgacaaagttcttgaacagattgaagaattatccgttttagctccacttcacaatcctggagcggcggcagggattcgtgccttccgtgatattttgccagatattaccagtgtttgtgtgtttgacacgtcatttcacactagcatggcaaagcatacttacctttacccaattcctcaaaaatattatacggactacaaggttcgtaaatatggggcgcatgggacaagtcataaatatgtagcgcaagaagctgctaaaatgcttggtcgtccattagaagaattaaaactaattactgctcatattggaaatggtgtctcaattacagctaattaccacggtaaatcagttgatacctcgatgggctttacaccacttgctggtcctatgatgggaacacgttctggtgacattgacccagctatcattccttatttaattgagcaagacccagagttaaaagacgctgctgacgttgttaatatgttaaacaaaaaatcaggtcttagtggggtgtcaggcatttctagtgatatgcgtgatatcgaggctggtttacaagaagataatccagatgctgttttagcttacaatatctttattgatcgcattaaaaaatgcattggtcaatattttgctgttttgaatggagcagatgctttggtctttacagctggtatgggtgaaaatgcaccattgatgcgtcaagatgttattggtggcttaacatggttcggaatggacattgatcctgagaaaaatgtttttggataccgtggtgacatttcaactcctgagtcaaaagtgaaggtgcttgttatctcaacagacgaagaattgtgcatcgcgcgtgacgttgaacgtttaaaaaatacaaaa

SEQ ID NO: 408 - protein, 398 aa, Streptococcus pyogenes
MSKTIAINAGSSSLKWQLYQMPEEAVLAQGIIERIGLKDSISTVKYDGKKEEQILDIHDHTEAVKILLNDLIHFGIIAAYDEITGVGHRVVAGGELFKESVVVNDKVLEQIEELSVLAPLHNPGAAAGIRAFRDILPDITSVCVFDTSFHTSMAKHTYLYPIPQKYYTDYKVRKYGAHGTSHKYVAQEAAKMLGRPLEELKLITAHIGNGVSITANYHGKSVDTSMGFTPLAGPMMGTRSGDIDPAIIPYLIEQDPELKDAADVVNMLNKKSGLSGVSGISSDMRDIEAGLQEDNPDAVLAYNIFIDRIKKCIGQYFAVLNGADALVFTAGMGENAPLMRQDVIGGLTWFGMDIDPEKNVFGYRGDISTPESKVKVLVISTDEELCIARDVERLKNTK

SEQ ID NO: 409 - DNA, 204 bp, Streptococcus agalactiae
atgaaaaattctctacaaaagttacgaaaatctaggaaattaagtcaagcagaacttgcagttgcacttggagttactaggcaaactattatttctctagaaaaagagaaatacacggcatctttggagctagcatttaagatagcgcgttattttgataaacaaattgaggaagtttttatttatacagaaagtgaaggagga

SEQ ID NO: 410 - protein, 68 aa, Streptococcus agalactiae
MKNSLQKLRKSRKLSQAELAVALGVTRQTIISLEKEKYTASLELAFKIARYFDKQIEEVFIYTESEGG

SEQ ID NO: 411 - DNA, 228 bp, Streptococcus pyogenes
atgaaggagatggcaatggaggttattcttaaaaatcggctcaaagaattacgagctagagatggaattaatcaaacggaaatggctaaactggcaggagtatcgaggcagaccatcagtctcattgagcgtaacgagtacaccccatcagttataattgccatgaaaattgcaaaggtatttcaggaaccagttgaagaggtgtttcgtctagtggaggtcgaggaa

SEQ ID NO: 412 - protein, 76 aa, Streptococcus pyogenes
MKEMAMEVILKNRLKELRARDGINQTEMAKLAGVSRQTISLIERNEYTPSVIIAMKIAKVFQEPVEEVFRLVEVEE

SEQ ID NO: 413 - DNA, 675 bp, Streptococcus agalactiae
ttggaggtttttgtgtcatttattattagaaaaggcaaaattttagctttgctaatagcatttttagttattaatcaacttgttcctatattggctgtgtggctcctaaagaatcactatcaaacgccttttactagtatattgttgattggcttagaattacttattattgctcttttcctttattatgccaaggttaaacaaataatcagatggaaagcattattgacaaggaaagcattagttactattctcttaggttggttatcattgagggttccacaaattattggttacctcattatgactatgcaaggggttaaagatacagcaaatcaaacagtaattatggaattaacaaagcaacttccactagctttgatgttaatttttgccataattggtgcccctattatggaagaaattatatttcgctatattatccctaaagaactttttgcgaaacatcaaaaatggggttttgtcatcggtactttagcttttgctcttattcattccccttctgatataggtagttttattatttatgctgggatgggtgctattttatcttttgtttattataaaactgagcacttagaatatagtataatgattcattttattaacaatgctcttgcttatagcgtgttaatcagtacaatgatgaataac

SEQ ID NO: 414 - protein, 225 aa, Streptococcus agalactiae
MEVFVSFIIRKGKILALLIAFLVINQLVPILAVWLLKNHYQTPFTSILLIGLELLIIALFLYYAKVKQIIRWKALLTRKALVTILLGWLSLRVPQIIGYLIMTMQGVKDTANQTVIMELTKQLPLALMLIFAIIGAPIMEEIIFRYIIPKELFAKHQKWGFVIGTLAFALIHSPSDIGSFIIYAGMGAILSFVYYKTEHLEYSIMIHFINNALAYSVLISTMMNN

SEQ ID NO: 415 - DNA, 693 bp, Streptococcus pyogenes
atgaaaggattcattaattatttaaaaatagcagtgctcattattctggctatggttttcaatgtccttccgatgattttattgcaaaagcaacacgatattcctatggtacttaattggggaattggtattttctacttggttattgttggaagtgtccttattgtattatggggtctttatcaagctaagcaagacacttttattaaacagcaaaaaatgagattggttgactggggttatttagcattattttggttaatcatccgtgtgatagctattgtaggtacccttgttaaccagctatggtctggtcaacaagtgagtgctaatgatgctgcaatacataccttagctagacttatcaaaggtggtttcccgctttatactgccctatttgtacttgtgatagcttttatcgctcctattatggaagaactagtctttagaggatttcctatgattgatctcttcaaaggaaaatcacttaaggtggcaggtttagtgacctctcttgtttttgctttaccacatgccaccaatagtgttgaatttatcatgtacagctgtatgggcatttttctctttgttgcctatcaaagacgaggaaacttaaaagatgctatcttgttacatatttttaataacttgattgaagtcattttgttaatgtcaataggcttaggagtcata

SEQ ID NO: 416 - protein, 231 aa, Streptococcus pyogenes
MKGFINYLKIAVLIILAMVFNVLPMILLQKQHDIPMVLNWGIGIFYLVIVGSVLIVLWGLYQAKQDTFIKQQKMRLVDWGYLALFWLIIRVIAIVGTLVNQLWSGQQVSANDAAIHTLARLIKGGFPLYTALFVLVIAFIAPIMEELVFRGFPMIDLFKGKSLKVAGLVTSLVFALPHATNSVEFIMYSCMGIFLFVAYQRRGNLKDAILLHIFNNLIEVILLMSIGLGVI

SEQ ID NO: 417 - DNA, 768 bp, Streptococcus agalactiae
atgaaaattggaattatcggcgtcggaaaaatggccagtgcaattattcaaggcctcaaacaaacccaacatgacattatcatatccggatcttgcttagagcgttcaaaagaaattgcagaaagacttgatgttacttacgccgaatctcatcagtcattaatcaatcaagctgatattatcatgttaggtattaaacctcaactatttgaaaaggttcttcttccacttgatatcacaaaaccaatcatctcaatggcagcaggaatctccttagcgcgtttaagccaattaactcgttctgatttaccattgattcgtattatgccaaatattaacgcacaaatacttcaaagttgcacagctatttgttacaacaatcatgtatcagatgagttacgacaattagccaaagaaattacggatagttttggaagtagctttgatatagcagaaaccaattttgataccttcactgctctagcaggttctagccctgcctatatctatctatttatagaagccttagctaaagcaggtgtaaaatatggatttccaaaagaacaagcactctctattgtaggacagactgtcttagcttctagtcaaaacctattacaaggacaaaatagcacctctgacttaatcgacaacatttgtagcccaggcggaactactattgctggccttttagacttagaaaaaaatggtctgacgcatagtgttatttctgccattgatgctactattgagaaagcaaaaaaactt

SEQ ID NO: 418 - protein, 256 aa, Streptococcus agalactiae
MKIGIIGVGKMASAIIQGLKQTQHDIIISGSCLERSKEIAERLDVTYAESHQSLINQADIIMLGIKPQLFEKVLLPLDITKPIISMAAGISLARLSQLTRSDLPLIRIMPNINAQILQSCTAICYNNHVSDELRQLAKEITDSFGSSFDIAETNFDTFTALAGSSPAYIYLFIEALAKAGVKYGFPKEQALSIVGQTVLASSQNLLQGQNSTSDLIDNICSPGGTTIAGLLDLEKNGLTHSVISAIDATIEKAKKL

SEQ ID NO: 419 - DNA, 768 bp, Streptococcus pyogenes
atgaaaattggcattattggtgttggcaaaatggctagcgctatcatcaaaggccttaaacaaacaccccatgaacttatcatttcaggatcatctttagaacggtccaaggaaattgcggagcagttagcactgccttatgctatgtcccaccaagaccttattgaccaggttgatcttgttattttaggcatcaagcctcaactatttgaaacggtactcaaaccgcttcacttcaaacagcctattatatctatggcagcaggcatttcccttcaacgactagcaacattcgtaggacaagaccttccgctgctacgtatcatgccaaacatgaatgcacaaattctccaaagcagtaccgctttaacgggaaatgctttggtgtcccaggaattacaagcacgtgttcgagacttaacagatagctttggtagcacatttgatattagtgaaaaggattttgacacctttaccgctttagcagggtcaagtcctgcctatatttatctctttattgaggctttggctaaggctggcgtcaagaatggcatacctaaagcaaaggcgctggagattgttactcaaacagtattggctagcgccagcaatctcaagaccagttctcaaagtccgcacgatttcattgacgctatttgtagccccggtggcacaactattgctggtctgatggagttagaacgccttggcctcacagctactgtcagctctgccattgacaaaaccatcgataaagctaaaagcttg

SEQ ID NO: 420 - protein, 256 aa, Streptococcus pyogenes
MKIGIIGVGKMASAIIKGLKQTPHELIISGSSLERSKEIAEQLALPYAMSHQDLIDQVDLVILGIKPQLFETVLKPLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGIPKAKALEIVTQTVLASASNLKTSSQSPHDFIDAICSPGGTTIAGLMELERLGLTATVSSAIDKTIDKAKSL

SEQ ID NO: 421 - DNA, 1065 bp, Streptococcus agalactiae
atgtcagatttatttaacaaaattaaaaccgtaactgagcttgatgggattgctggctatgaacacaatatccgcaacttccttcgtcaagaaataactcctttagttgatcaagttgagacagacggacttggtggaatttttggagttaaaaatactcatgagactaatgctcctaaagtcatggttgctgcccatatggatgaagtcggctttatggttagtcatattcagccagatggaacatttcgtgtacttgaggttggaggatggaatcccctagtagtcagctcacaacgctttaccctctacacacgttctggtgatgctattcctgttatatcaggctcagttcctcctcactttcttcgtggacaaagcggtggaacaacattacccaaaattagtgacattgtttttgatggaggattcacagataaaaatgaagctgaaagctttggcattgctcctggcgatatcattgttcctaaatctgaaaccattttaactgcaaatcaaaaacatattatgtcaaaagcttgggataatcgctatggtgtgcttatggtgaccgaattgctaaaaagcttaaaagatcaaagtcttagcaacacacttattgctggggcaaatgttcaagaagaagtcggacttcgtggcgcacatgtttcaacaactaaattcaacccagatatcttcttagctgtcgattgttccccagctggagatatttatggggaacaaggcaaaataggagagggaaccttaatccgtttttatgatcccggacatatcatgcttaaagatatgagagatttcttacttacaacagctgaagaagcaggtataaaataccaatattatgctgcaaatggtggtaccgatgctggggctgctcacctaaaaaatagtggtattccttctacaactatcggtgtctgtgcacgctacattcattctcatcaaacactctacgctatggatgattttctacaagcacaagcttaccttcaggccatcgttaacaaattagaccgctcgacggtggatattattaaaggttat

SEQ ID NO: 422 - protein, 355 aa, Streptococcus agalactiae
MSDLFNKIKTVTELDGIAGYEHNIRNFLRQEITPLVDQVETDGLGGIFGVKNTHETNAPKVMVAAHMDEVGFMVSHIQPDGTFRVLEVGGWNPLVVSSQRFTLYTRSGDAIPVISGSVPPHFLRGQSGGTTLPKISDIVFDGGFTDKNEAESFGIAPGDIIVPKSETILTANQKHIMSKAWDNRYGVLMVTELLKSLKDQSLSNTLIAGANVQEEVGLRGAHVSTTKFNPDIFLAVDCSPAGDIYGEQGKIGEGTLIRFYDPGHIMLKDMRDFLLTTAEEAGIKYQYYAANGGTDAGAAHLKNSGIPSTTIGVCARYIHSHQTLYAMDDFLQAQAYLQAIVNKLDRSTVDIIKGY

SEQ ID NO: 423 - DNA, 1065 bp, Streptococcus pyogenes
atgacagacttattctcaaaaatcaaagaagttaccgaactggatggcattgcgggctatgaacatagcgttcgtgactacctacgcaccaaaataaccccgctggttgaccgtgttgaaacagacgggcttggtggcatttttggtatcagagatagtaaagctgaaaaagccccccgtattttagtagctgcgcacatggacgaagtcggttttatggtcagtgatatcaaagttgacggaacgctacgcgtggttggtatcggtggttggaacccacttgttgtcagttcacaacggtttaccctttacacacgcactggccaagttattccccttatttcaggatcggtacctccccattttttacgtggggcaaatggctctgctagtctaccacatatcgaagatattgtgtttgatggtggctttacggataaggcagaagctgaaagatttggtattacaccgggtgatattattatccctcaatctgaaacgatcctaacagccaatcaaaaaaatattatttcaaaagcttgggacaatcgctatggcgttctcatgataacagaaatgcttgaagcgttaaaaggacaagaccttaacaacaccctaattgcaggtgctaacgttcaagaagaagttggtctgcgcggagcccacgtctcaaccaccaagttcgaccctgaactctttttcgcagtagattgttcgcctgctggtgatatttatggcaatcctggaacaatcggagatggtaccttgttgcgtttctacgacccaggccatgtcatgctcaaagatatgcgcgacttcttactgactactgctgaggaagctggtgtcaatttccaatactattgtggcaagggaggcacagatgcaggtgctgcacaccttcaaaatggtggtgtcccatcaacaaccatcggagtctgtgcacgctacattcactctcatcaaaccctctacgctatggatgatttcgtagaagcccaagccttcttacaagccattatcaaaaaactggatcgctcaaccgttgacttgattaaatgttac

SEQ ID NO: 424 - protein, 355 aa, Streptococcus pyogenes
MTDLFSKIKEVTELDGIAGYEHSVRDYLRTKITPLVDRVETDGLGGIFGIRDSKAEKAPRILVAAHMDEVGFMVSDIKVDGTLRVVGIGGWNPLVVSSQRFTLYTRTGQVIPLISGSVPPHFLRGANGSASLPHIEDIVFDGGFTDKAEAERFGITPGDIIIPQSETILTANQKNIISKAWDNRYGVLMITEMLEALKGQDLNNTLIAGANVQEEVGLRGAHVSTTKFDPELFFAVDCSPAGDIYGNPGTIGDGTLLRFYDPGHVMLKDMRDFLLTTAEEAGVNFQYYCGKGGTDAGAAHLQNGGVPSTTIGVCARYIHSHQTLYAMDDFVEAQAFLQAIIKKLDRSTVDLIKCY

SEQ ID NO: 425 - DNA, 90 bp, Streptococcus agalactiae
atggttaatcattcaaacagaaagaaaaaacatgaaagaaaaattattagtacctgctttaaattgtttgctaggtctactcttcctagg

SEQ ID NO: 426 - protein, 30 aa, Streptococcus agalactiae
MVNHSNRKKKHERKIISTCFKLFARSTLPR

SEQ ID NO: 427 - DNA, 318 bp, Streptococcus agalactiae
gtgtctaattccggggggtatggtataataacagttatgaaaaataaaaaaatcttatttgggactggccttgctggtgtgggtttactggcagctgctggttataccctaactaaaaaagtaacagattataaacgtcagcaaatcactcagaccttaagagaattttttagtcagatgggtgatattcaggtattttattttaatgaatttgaatctgatattaaaatgaccagtggtggtcttgtcttggaagatggcagaattttcgaattcatttatcgtcaaggtgttcttgattatgtggaggtgagcaaa

SEQ ID NO: 428 - protein, 106 aa, Streptococcus agalactiae
MSNSGGYGIITVMKNKKILFGTGLAGVGLLAAAGYTLTKKVTDYKRQQITQTLREFFSQMGDIQVFYFNEFESDIKMTSGGLVLEDGRIFEFIYRQGVLDYVEVSK

SEQ ID NO: 429 - DNA, 291 bp, Streptococcus pyogenes
atgagggatatgagtaaaaagaaaataggtatgatttcaggtatctttggatttagtttagctattggcctaggaatagttatcaaagattattgccaagacaggcagcgtcgacaaatgacaagggatttacgcacctttttttcacctttaggacaaatcgaagttttatatatcaatccttgtcaggtcaaacaagattatatttcaggtggggttgttatgtcaaacggcaaacagtaccaattcacctatcacagtcgacaaattagttttgaggaggacaaggga

SEQ ID NO: 430 - protein, 97 aa, Streptococcus pyogenes
MRDMSKKKIGMISGIFGFSLAIGLGIVIKDYCQDRQRRQMTRDLRTFFSPLGQIEVLYINPCQVKQDYISGGVVMSNGKQYQFTYHSRQISFEEDKG

SEQ ID NO: 431 - DNA, 321 bp, Streptococcus agalactiae
atgattttaccagaatcttatgaagaaatagcagcctatattgatagcactaagaaagttgttttcttttttacagcagattggtgtccagattgtcaatttatatatccagtaatgccatcaattgaaaaagatttctcagattttgtctttgtacgtgttaatcgtgatgactatatagaattagctcagcagtggaatatttttgggattccgagtttcgttgttgtggaaaatggtcaggaactgggtcgtttggttaataagaatcgcaaaacaaaggctgaaattactaaatttctcgctgaaattaactataaa

SEQ ID NO: 432 - protein, 107 aa, Streptococcus agalactiae
MILPESYEEIAAYIDSTKKVVFFFTADWCPDCQFIYPVMPSIEKDFSDFVFVRVNRDDYIELAQQWNIFGIPSFVVVENGQELGRLVNKNRKTKAEITKFLAEINYK

SEQ ID NO: 433 - DNA, 315 bp, Streptococcus pyogenes
atgatcagaccgacttcttatgagtcattagcgactcttattgaaaaagaagataagctggtgttattttttacggcagactggtgtccagactgtcaatttatttatcctattatgccagaaattgaagcagaacttacagatatgacttttgtttgtgttaatcgtgatcagtttatagaggtagcacaaaagtggaatatttttggtattcctagttttgtcgtgattgaaaaaggtcaggaagtagggcgtctggttaacaaaatgagaaagacaaaaactgagattatgcattttttagctgcttatcaa

SEQ ID NO: 434 - protein, 105 aa, Streptococcus pyogenes
MIRPTSYESLATLIEKEDKLVLFFTADWCPDCQFIYPIMPEIEAELTDMTFVCVNRDQFIEVAQKWNIFGIPSFVVIEKGQEVGRLVNKMRKTKTEIMHFLAAYQ

SEQ ID NO: 435 - DNA, 624 bp, Streptococcus agalactiae
atgatttttacttataatagagagcatgttggtgataccttaatggttattgttaaggatagtcaaggagctaagctagatgttgatcgtcgcggacaagtagcacgcgtctatctgcaagatagtaaagaaacagttgcttggaatatctttgaagtgtcaagtttaattgttattgagggagcaggtcaaataactttatctgatcaagatattaaaatccttaatgcagaactactgaaagaaggattcgaagactctcttgttaataatattgaacctacatttgttgtggcgcaaattaaagaaataattgatcatccagatagtgaccatttacatatctgtcaagcagaaatcaacgatgggaagacggtccaaatcgtttgtggggcacctaatgcttcagtaggtcttaaaacagttgcagctcttccaggagctatgatgccaaatggtagccttattttcccaggaaaacttcgtggagaagatagctttggaatgttatgtagtgctcgcgagttagctcttccaaatgctcctcaagtcagaggtatcattgaattatctgatcaggtaattgttggagagtctttcgacgccaataaacattggaaaaat

SEQ ID NO: 436 - protein, 208 aa, Streptococcus agalactiae
MIFTYNREHVGDTLMVIVKDSQGAKLDVDRRGQVARVYLQDSKETVAWNIFEVSSLIVIEGAGQITLSDQDIKILNAELLKEGFEDSLVNNIEPTFVVAQIKEIIDHPDSDHLHICQAEINDGKTVQIVCGAPNASVGLKTVAALPGAMMPNGSLIFPGKLRGEDSFGMLCSARELALPNAPQVRGIIELSDQVIVGESFDANKHWKN

SEQ ID NO: 437 - DNA, 624 bp, Streptococcus pyogenes
atgatttttgcatacaataaagaacaagttggcgatgtcttgatggttatcttacaagacaccaaagatatcaaacgtcaagtagaacgaaaaggcaaagtagcccgtgtttttgcagaagaaagcggcaaaacccttgcttggaatatctttgaagcgtcaagcttgattactattgaaggcaatggacagatttttttgacagacgagaaccttgcaagattaaatgcagagcttgctaaggaaggattttcagaaaggcttgaaccgattgtgggacctgtttttgtggttggtcaaattgttgagatggtggctcatccagatagcgaccatcttaatatctgccaagtggctattggtgaagatcaaacggttcaaatcgtagcgggcgcaccaaatgctgcgcttggtttaaaaacgattgttgccttaccaggtgctataatgccaaatggtagtctgattttcccaggaaaattgcgtggtgaagaaagttatggtatgatgtgctctcctcgtgagttagccttgccaaatgcaccgcaaaaacgtggcattattgaatttgatgagtcagctgtggtaggagaagcttttgacccagccaaacattggaaaggt

SEQ ID NO: 438 - protein, 208 aa, Streptococcus pyogenes
MIFAYNKEQVGDVLMVILQDTKDIKRQVERKGKVARVFAEESGKTLAWNIFEASSLITIEGNGQIFLTDENLARLNAELAKEGFSERLEPIVGPVFVVGQIVEMVAHPDSDHLNICQVAIGEDQTVQIVAGAPNAALGLKTIVALPGAIMPNGSLIFPGKLRGEESYGMMCSPRELALPNAPQKRGIIEFDESAVVGEAFDPAKHWKG

SEQ ID NO: 439 - DNA, 714 bp, Streptococcus agalactiae
atgacaaatgtaactagttataaagaaatgctggctaaaccttggggaaaaatacaatatgaaataacttttgctcaattaagccatatcaaaaatcagaacgttttagattttggagctggtttttgtctcaccgaacaacatctagcaaaagaaaacaatgtaactgctattgaacccaatcctaaactgctttacgataatcaaagtgacaatatttataaaatcctaggttcctacgaagcattaagagatttgcctgatcaaagctttgatactattatttgtcataatgttcttgaatatatagacaaacataatcatcctgcttattttgacgaattttctcgacttctaaaacccaatggagaactatctctcatcaaacataatataaccggtaaaatattacaatcagttatttttagcaatgatacctccactgcgatggaactcttaacaggagaagcaaactttaaaagtgccagttttgaccagggaaatatttataccttagaagaactaaaacaaaatacaaatttattagttgaacgttatcagggtattcgtaccttctattcattacaaccaaaccattttaaaactgaaactggttggctaaacaaaatgcttgctatcgagctaagtgttgctgacaaagctccttataaagatattgcttttttgcaacacatcacacttaaaaagtcattg

SEQ ID NO: 440 - protein, 238 aa, Streptococcus agalactiae
MTNVTSYKEMLAKPWGKIQYEITFAQLSHIKNQNVLDFGAGFCLTEQHLAKENNVTAIEPNPKLLYDNQSDNIYKILGSYEALRDLPDQSFDTIICHNVLEYIDKHNHPAYFDEFSRLLKPNGELSLIKHNITGKILQSVIFSNDTSTAMELLTGEANFKSASFDQGNIYTLEELKQNTNLLVERYQGIRTFYSLQPNHFKTETGWLNKMLAIELSVADKAPYKDIAFLQHITLKKSL

SEQ ID NO: 441 - DNA, 393 bp, Streptococcus agalactiae
atgtataataaagttattatgattgggcgtctaacagcaaagcctgagatggtaaaaacaccaactgacaagtcagtgacgcgtgcaactgttgctgttaatagacgctttaaaggaagtaatggtgagcgtgaagcagattttattaatgtggttatgtggggtcgtctagcggaaacccttgcgagctatgggacaaagggctctttaatttcaatagatggtgaattgcgtacgcgcaagtacgaaaaggatggtcaaacgcactatatcactgaagtattagcatcatcatttcagttgctagaaagccgtgcccaacgtgctatgcgtgaaaataacgtttctggtgatttgtcagatttagtattggaagaagaggagctccccttt

SEQ ID NO: 442 - protein, 131 aa, Streptococcus agalactiae
MYNKVIMIGRLTAKPEMVKTPTDKSVTRATVAVNRRFKGSNGEREADFINVVMWGRLAETLASYGTKGSLISIDGELRTRKYEKDGQTHYITEVLASSFQLLESRAQRAMRENNVSGDLSDLVLEEEELPF

SEQ ID NO: 443 - DNA, 393 bp, Streptococcus pyogenes
atgtataataaagtgatagcaatcggtcgtttggtagctaaaccagaattggtaaaaacagctacggataagcatgtagcacgtctctctttagctgttaatcgaagatttaaaaatgcttctggagagcgagaagctgattttatttcagttgttgtttggggaaagttagcagaaactctggtttcttatgctagcaaaggtagtttgatgtctattgatggcgaacttaggacccgcaagtatgataaagatgggcaagtgcattatgtgacagaagttctctgccaatcatttcaactgcttgaaagtcgtgctcagcgcgctatgagagaaaataatgttactaatgatctagttgatttagtcttagaagaagatactcttcccttt

SEQ ID NO: 444 - protein, 131 aa, Streptococcus pyogenes
MYNKVIAIGRLVAKPELVKTATDKHVARLSLAVNRRFKNASGEREADFISVVVWGKLAETLVSYASKGSLMSIDGELRTRKYDKDGQVHYVTEVLCQSFQLLESRAQRAMRENNVTNDLVDLVLEEDTLPF

SEQ ID NO: 445 - DNA, 726 bp, Streptococcus agalactiae
ttgcttttcacagaaagcaacctttttttattgaaaatagaaaggcaaacgattacaataaaggggatagaaagcaggtttaagatggaaaaagtcattatttttgatatggacggcgttattgttgattccgagtacacgtttttagataataagacagaaatgttacgtgaggagggtattgatacggacgtctcgtatcaataccagtacatggggactacttttgaattcatgtggcaagctatgaaagaggagtttggcttaccgaaaacagtaaaagagtatattgctgagatgaacagacgtcgacaagcgattgtggcgcgtgatggtgttaggcccatcaaaggagctcagcgactgattcattggttacaccaacatggctatcgcttagcagttgcgtcctcatctccaatggtagatattaagcgtaatctaaaagagttgggtgtgacagaatgctttgaatacatggttacaggagaagatgtatcgtcttctaaaccagcaccagatgtttttcttagagctgcagagcttttagatgtagaccctaaagtttgtatagttatagaagatacaagaaatgggagtttagctgctaaggcagcaggaatgtattgctttggctttgctaatcctgattatccaccgcaagatttatcaatggcagacaaggttatttcagattatcaagatatctatatttatcttccggag

SEQ ID NO: 446 - protein, 242 aa, Streptococcus agalactiae
MLFTESNLFLLKIERQTITIKGIESRFKMEKVIIFDMDGVIVDSEYTFLDNKTEMLREEGIDTDVSYQYQYMGTTFEFMWQAMKEEFGLPKTVKEYIAEMNRRRQAIVARDGVRPIKGAQRLIHWLHQHGYRLAVASSSPMVDIKRNLKELGVTECFEYMVTGEDVSSSKPAPDVFLRAAELLDVDPKVCIVIEDTRNGSLAAKAAGMYCFGFANPDYPPQDLSMADKVISDYQDIYIYLPE

SEQ ID NO: 447 - DNA, 654 bp, Streptococcus pyogenes
atgttgatgattaaaggaattatttttgatatggacggtgttttatttgatacagaacctttttatctgaggcgacgagaagatttttttaagacaaagggaattcccattgatcatttgaactctaaagattttattgggggcaatcttcaagaattatggaaagagttgttaggtaaaaatagggatgatgctatcgttaaggcaattacaactgactatgacgcttacaaacaagcgcataagcctccttatcaaaaactgttgattacagaagtgaactcttgtcttgaacagttggaaaaacaaggtattaaactggctgtggcatcaaactcgaagcgtcaggatgttttgttggcgttggagacaacgcaaataaaagattattttgaaataatcctagcgcgtgaagatgtttctagaggcaaaccttatccagatatttataataaagcagtacaaaaactaggattacaaaaaaaacaactgcttgtagtagaggacagccaaaaaggcattgctgccgccaaagcagccaatctgacagtttttgccattaccgactaccgatatggcattgatcagagtcaagctgatcacaagatagatcatttaggacaactgtgtgtaaaaatcggttgttttggatcg

SEQ ID NO: 448 - protein, 218 aa, Streptococcus pyogenes
MLMIKGIIFDMDGVLFDTEPFYLRRREDFFKTKGIPIDHLNSKDFIGGNLQELWKELLGKNRDDAIVKAITTDYDAYKQAHKPPYQKLLITEVNSCLEQLEKQGIKLAVASNSKRQDVLLALETTQIKDYFEIILAREDVSRGKPYPDIYNKAVQKLGLQKKQLLVVEDSQKGIAAAKAANLTVFAITDYRYGIDQSQADHKIDHLGQLCVKIGCFGS

SEQ ID NO: 449 - DNA, 102 bp, Streptococcus agalactiae
ttggtggacctctggttggatcaattgttggttttattggaggagttcatcgcttttttcaaggaagcttttcaggttctttctatattgtcagttcagttc

SEQ ID NO: 450 - protein, 34 aa, Streptococcus agalactiae
MVDLWLDQLLVLLEEFIAFFKEAFQVLSILSVQF

SEQ ID NO: 451 - DNA, 138 bp, Streptococcus agalactiae
gtggaacctaaactatttaaaatcatcattggaatgacaatcattttgacaagttcccatcctgtaaaaatgccaacaaatagcatctggatactttcggcaataatactaattaaaataacttggcttgttgaaggg

SEQ ID NO: 452 - protein, 46 aa, Streptococcus agalactiae
MEPKLFKIIIGMTIILTSSHPVKMPTNSIWILSAIILIKITWLVEG

SEQ ID NO: 453 - DNA, 1743 bp, Streptococcus agalactiae
atgttgatggtgttgttattccaaaggctaggaattattatgattttagcctttttattggtaaataatagttattttagacagttaattgaagagcggtctaaacgtgaaacggtagtccttgtcatcattttcggcttgtttgttattatatctaatataacaggaattgaaataaaaggggatcgaagtttggtcgagcgcccttttctaacaacgatttctcattctgactcacttgctaatacaaggactttagttattacaacggcaagtttggttggtggacctctggttggatcaattgttggttttattggaggagttcatcgcttttttcaaggaagcttttcaggttctttctatattgtcagttcagttctagtcggcattgttagcggaaagattggtgataagcttaaggaaaaccatctctacccttcaacaagccaagttattttaattagtattattgccgaaagtatccagatgctatttgttggcatttttacaggatgggaacttgtcaaaatgattgtcattccaatgatgattttaaatagtttaggttccacacttttccttgcgattttgaaaacttatttgtcaaatgaaagtcagttacgcgcagttcaaacgagagatgttcttgaattgactcgacagactctgccctaccttagacaaggtttgacaccgcaatctgctaggagcgtttgcgaaattataaagaggcatactaactttgatgctgtgggattaacagatcggtcaaacgtattagctcatattggtgttggccatgatcaccatattgcaggacaaccggtcaaaacagacttatctaaaagtgttatttttgatggcgaaccaagaattgcgcaagataaagcggcgatttcttgtccagatcacaactgtcagttaaattctgctattgtagttcctctaaaaataaatgataaaactgtgggtgccttaaaaatgtactttgcaggagataagacaatgtctgaggtggaggaaaacctagtccttggtttagcgcaaatattttcaggacaactggcaatggggataacagaggaacaaaataagttagccagtatggcagagataaaggctttacaagcacaaatcaaccctcatttcttctttaatgccattaacacaattagtgcattaatccgtattgattctgataaagcacgttatgcactgatgcagttaagtactttttttagaacaagtttgcagggtggtcaggatcgtgaggtaacgcttgagcaagaaaaatcacatgtggatgcttatatgaatgttgaaaaattacgtttccctgataaatatcagttatcttatgatattagtgcaccagaaaaaatgaagttaccaccttttggtttacaggtactggtagagaatgcagttcgacatgctttcaaagaacgtaagacggacaaccatatattggttcaaataaagccagatggtcattattattgtgtttctgttagtgacaatggacaaggaatctcagatactatcattgataaattaggtcaagaaacagttgcagagagtaagggtacaggtactgctctagttaatctaaataacaggctgaatttattatatggtagtgtaagttgccttcatttttcgagcgacaagaatggtacaaaagtttggtatcgaatacctaatagaataagggaggatgagcatgaaaattttaattct

SEQ ID NO: 454 - protein, 581 aa, Streptococcus agalactiae
MLMVLLFQRLGIIMILAFLLVNNSYFRQLIEERSKRETVVLVIIFGLFVIISNITGIEIKGDRSLVERPFLTTISHSDSLANTRTLVITTASLVGGPLVGSIVGFIGGVHRFFQGSFSGSFYIVSSVLVGIVSGKIGDKLKENHLYPSTSQVILISIIAESIQMLFVGIFTGWELVKMIVIPMMILNSLGSTLFLAILKTYLSNESQLRAVQTRDVLELTRQTLPYLRQGLTPQSARSVCEIIKRHTNFDAVGLTDRSNVLAHIGVGHDHHIAGQPVKTDLSKSVIFDGEPRIAQDKAAISCPDHNCQLNSAIVVPLKINDKTVGALKMYFAGDKTMSEVEENLVLGLAQIFSGQLAMGITEEQNKLASMAEIKALQAQINPHFFFNAINTISALIRIDSDKARYALMQLSTFFRTSLQGGQDREVTLEQEKSHVDAYMNVEKLRFPDKYQLSYDISAPEKMKLPPFGLQVLVENAVRHAFKERKTDNHILVQIKPDGHYYCVSVSDNGQGISDTIIDKLGQETVAESKGTGTALVNLNNRLNLLYGSVSCLHFSSDKNGTKVWYRIPNRIREDEHENFNS

SEQ ID NO: 455 - DNA, 723 bp, Streptococcus pyogenes
ttgacagaccttgcccaacagtttaatgcgctcttagatcaaattgatagcttgatggttgccgttgcggataaggaaaaggcgattgggcagtataggttacaagccttggctagtcagattaacccgcattttctctataacaccttggacactattatttggatggcagaatttaatgacagcaagcgcgtggtagaagtgaccaagtctctagctaagtattttcgtttggcccttaatcaggggaacgaatacattcgtttggcagatgaactggatcacgttagccaatacctctttattcaaaaacagcgctatggagacaagctaagttatgaagtgcaaggcttagatgtctacgcagactttgttattcctaagcttatcttacagcccttagtagaaaatgctatctaccatggcatcaaagaagtcgatcgcaagggcatgatcaaggttacggtatctgatacagctcagcatctgatgttgactgtttgggataatggtaaaggcattgaagactcttcactgaccaatagtcagagcttgttggctaggggaggtgtgggccttaaaaatgttgaccagcggttaaaacttcactatggtgaaggctaccacatgaccattcatagccagtcagaccagttcactgaaatacaattaagccttcctaaaatgcatgaattaatggcagacgacacacaggaaaacgag

SEQ ID NO: 456 - protein, 241 aa, Streptococcus pyogenes
LTDLAQQFNALLDQIDSLMVAVADKEKAIGQYRLQALASQINPHFLYNTLDTIIWMAEFNDSKRVVEVTKSLAKYFRLALNQGNEYIRLADELDHVSQYLFIQKQRYGDKLSYEVQGLDVYADFVIPKLILQPLVENAIYHGIKEVDRKGMIKVTVSDTAQHLMLTVWDNGKGIEDSSLTNSQSLLARGGVGLKNVDQRLKLHYGEGYHMTIHSQSDQFTEIQLSLPKMHELMADDTQENE

SEQ ID NO: 457 - DNA, 744 bp, Streptococcus agalactiae
atgagcatgaaaattttaattcttgatgatgaaatgtttgccagacaagaattatcgtttttagttgaacatagccaggaggttgacaaccctgagatttttcaggctgaggatatcagtgaagccgaaaaaatcttatttagacagcaaattgatttaatttttttagatatttcgcttagtgaagaaaatggctttactttggctaatcagttgagccaacttgcacatcccccacttgttgtttttgcgacagcttatgataactacgctgtgaaagcttttgaaagtaacgctgttgattatatcatgaaaccgtttgaacaacagcgcgttgatatggctctatcaaaagtgaagaaattgagccaactcaccactgcttcagatgtagagcaagcaatacctaaaaaagccagtgttgaattgttaaccttgacattatcagatcgcagtgttgttgttaaaatgcaagatattgttgcagctagtgttgaagatggcgaattaactgttagtacagttcagaaaacttacactattcggaagacactcaattggtttaagtcacgcgctgtagcaccatattttctccagattcatcgaaacacagtgattaatctagagatgattgaggaaattcaaccttggtttaatcatactttgttactaattatgtctaatggagagaaatttccagtaggtcgatcgtatttaaaagacctaaatgagcatttaaccatg

SEQ ID NO: 458 - protein, 248 aa, Streptococcus agalactiae
MSMKILILDDEMFARQELSFLVEHSQEVDNPEIFQAEDISEAEKILFRQQIDLIFLDISLSEENGFTLANQLSQLAHPPLVVFATAYDNYAVKAFESNAVDYIMKPFEQQRVDMALSKVKKLSQLTTASDVEQAIPKKASVELLTLTLSDRSVVVKMQDIVAASVEDGELTVSTVQKTYTIRKTLNWFKSRAVAPYFLQIHRNTVINLEMIEEIQPWFNHTLLLIMSNGEKFPVGRSYLKDLNEHLTM

SEQ ID NO: 459 - DNA, 738 bp, Streptococcus pyogenes
gtgtactcattgttaattgtagaagacgaataccttgtgcgccagggtattcgttctttggttgattttagccagttcaagattgatcgggtcaacgaagcagaaaatggccagttggcttgggacttgtttcagaaagagccttatgatattgttttgacggatatcaatatgcccaaattaaatgggattcaactagcagaactcattaaacaggaatccccccaaactcatctggtatttttgacgggctacgatgattttaactatgccttatctgctttgaaattaggggcagatgattacttgctcaaacccttttccaaggcagatgtagaagacatgttaggaaagctccggaaaaaattagaactttccaagaaaacagaaaccattcaggaattggttgagcagcctcaaaaagaagtatcagcaatagcaatggctattcatgagcggttggcagattctgatttgaccctaaaaagcttggctcagcagcttggttttagccctaattaccttagcgtcttgattaaaaaagagttagggatgccctttcaagattatctggtacaagaacggttgaaaaaagccaagcttctcttgttaaccagtaatcttaaaatctatgaaattgcagagcaggtcggttttgaggacatgaattatttttctcagcgctttaagcaactggtaggcgttaccccaagtcagtataaaaaaggaggccaggca

SEQ ID NO: 460 - protein, 246 aa, Streptococcus pyogenes
VYSLLIVEDEYLVRQGIRSLVDFSQFKIDRVNEAENGQLAWDLFQKEPYDIVLTDINMPKLNGIQLAELIKQESPQTHLVFLTGYDDFNYALSALKLGADDYLLKPFSKADVEDMLGKLRKKLELSKKTETIQELVEQPQKEVSAIAMAIHERLADSDLTLKSLAQQLGFSPNYLSVLIKKELGMPFQDYLVQERLKKAKLLLLTSNLKIYEIAEQVGFEDMNYFSQRFKQLVGVTPSQYKKGGQA

SEQ ID NO: 461 - DNA, 345 bp, Streptococcus agalactiae
gtgacactgagttctctgatagcaagtattaatcgtgcaacatatgctaccactaccaacataacaacagttgagattgtaataacagcaactagttgcaagccttcagcttttaggatatcaagattcgctgctactgatattcctgaggggacaaacataaaaccaatcatgcttatcatcaaagccccaaaagagtcaacccactctaccttgataattttagcagttagcaatacatacattagcaccaaaccaataaccgtcgttgggattggtagtgatttcggtaataacattgaaatcatttgtgaaactaatagaatagctgcatatattgacatt

SEQ ID NO: 462 - protein, 115 aa, Streptococcus agalactiae
MTLSSLIASINRATYATTTNITTVEIVITATSCKPSAFRISRFAATDIPEGTNIKPIMLIIKAPKESTHSTLIILAVSNTYISTKPITVVGIGSDFGNNIEIICETNRIAAYIDI

SEQ ID NO: 463 - DNA, 459 bp, Streptococcus agalactiae
gtgactatgaaacacaccagtaaagaaaccaaaacaaaagaagctccaatgtttattcaaatgtcaatatatgcagctattctattagtttcacaaatgatttcaatgttattaccgaaatcactaccaatcccaacgacggttattggtttggtgctaatgtatgtattgctaactgctaaaattatcaaggtagagtgggttgactcttttggggctttgatgataagcatgattggttttatgtttgtcccctcaggaatatcagtagcagcgaatcttgatatcctaaaagctgaaggcttgcaactagttgctgttattacaatctcaactgttgttatgttggtagtggtagcatatgttgcacgattaatacttgctatcagagaactcagtgtcacagatttatttaaaaagatattacctaaccactatagtaagaaagtagaggaaaaa

SEQ ID NO: 464 - protein, 153 aa, Streptococcus agalactiae
MTMKHTSKETKTKEAPMFIQMSIYAAILLVSQMISMLLPKSLPIPTTVIGLVLMYVLLTAKIIKVEWVDSFGALMISMIGFMFVPSGISVAANLDILKAEGLQLVAVITISTVVMLVVVAYVARLILAIRELSVTDLFKKILPNHYSKKVEEK

SEQ ID NO: 465 - DNA, 726 bp, Streptococcus agalactiae
atggaactcttaaaaacacccatctttggtatttgcttttctttaatactctatacgataggagaacatttatttaagaagagtaaaggtttcttccttttgcagcctcttttctttgcaatggttagtggtattgtcattctttggcttatgtcaaaaggtttaggaaccgatgttaagacattttatacacaagcttataaaccaggtggtgatttaatattttggtttttaaatccagcgacaattgcttttgcagttcctctctataagaaaaatgacgttgttaaaaaatattgggtagaaattctcagcagtttagtaatcggtatgattgtttcccttatacttatcgtcgctatttctaaaatggttgggcttagtcaagtcggaattgcttcaatgttgccacaagcagcaacaacagcaattgctcttccaataacagcagcaattggagggaacacagctgtgacagcaatggcgtgtatcttaaatgcagttattatttatgcattaggtaaaaaattagtgtcatttttccatttgaatgatagtaagattggtgcaggattaggtctagggacctctggtcatacagtcggagcagcctttgcattggaattgggagaactgcaaggtgcgatggcagctatagctgtggtggttatcggtttggtagttgatttggttattcctatctttagtcatttgattggtttgcta

SEQ ID NO: 466 - protein, 242 aa, Streptococcus agalactiae
MELLKTPIFGICFSLILYTIGEHLFKKSKGFFLLQPLFFAMVSGIVILWLMSKGLGTDVKTFYTQAYKPGGDLIFWFLNPATIAFAVPLYKKNDVVKKYWVEILSSLVIGMIVSLILIVAISKMVGLSQVGIASMLPQAATTAIALPITAAIGGNTAVTAMACILNAVIIYALGKKLVSFFHLNDSKIGAGLGLGTSGHTVGAAFALELGELQGAMAAIAVVVIGLVVDLVIPIFSHLIGLL

SEQ ID NO: 467 - DNA, 1626 bp, Streptococcus agalactiae
gtgactaaatatttgaagtacatctcttttgttgctttgtttctggcgagtatctttttagtagcttgtcaaaatcaaaattcacaaaccaaggagcgaacgcgaaaacaacgacccaaagatgaattggttgtttctatgggggcaaagcttcctcatgaattcgatccaaaggaccgttatggaatccataatgaaggtaatattactcatagcaccctattgaaacgttctcctgaactagatataaaaggagagcttgctaaaaaatataaaatctctaaggatggcttaacgtggtcgttcgacttaaatgatgattttaaattctccaatggtgagcctgttactgctgacgatgttaagtttacttatgatatgttgaaagcagatggaaaagcttgggatttgacctttattaagaatgttgaagtagttgggaaaaaccaggtaaatattcatttgactgaggcgcattcgacatttacagcacagttgacagaaatcccaatcgtccctaaaaaacattacaatgataagtataagagcaatcctatcggttcaggaccttacatggtgaaagaatataaggctggagaacaagcaatcttcgttcgaaatccctattggcacggtaaaaagccttattttaaaaagtggacttgggtattacttgatgaaaatacagcactagctgctttagaatctggtgatgttgacatgatttacgcaacgccagagcttgctagcaagaaagtcaaaggaacacgtcttctagatattgcttcaaacgacgttcgcggactgtcattgccttatgtgaagaaaggtgttgtgaaaaattcaccagacggttatccagtaggaaatgatgtcactagtgatccagcaatcagaaaagccttgactattggtttaaatagacaaaaagttctggatactgttttaaatggttatggtaaaccagcttattcaattattgatagaacaccattctggaatccaaaaacagcaattaaagataataaagtagctaaagctaagcaacttttgacaaaagctggatggaaagaacaagcagacggtagccgtaaaaaaggaaatcttaaatcggaatttgacctttactaccctactaatgatcaattacgagcaaacttagccgttgaagtagcggagcaagctaaagccttaggtattactattaaactcaaggctagtaactgggatgaaatggcaactaagtcacatgattcagccttactttatgcgggaggacgtcatcatgcgcagcaattttatgaatcacattacccaagtttagctggtaaaggttggaccaatattactttttataacaatcctactgtgactaagtaccttgacaaagcaatgacatctcctgaccttgataaagctaacaaatattggaagttagctcagtgggatggcaaaacaggtgcttccactcttggagatttaccaaatgtatggttggtgagtcttaaccatacttatattggtgataaacgtatcaatgtaggtaaacaaggtgtccatagtcatggtcatgattggtcattattgactaacattgctgaatggacttgggatgaatctgctaag

SEQ ID NO: 468 - protein, 542 aa, Streptococcus agalactiae
MTKYLKYISFVALFLASIFLVACQNQNSQTKERTRKQRPKDELVVSMGAKLPHEFDPKDRYGIHNEGNITHSTLLKRSPELDIKGELAKKYKISKDGLTWSFDLNDDFKFSNGEPVTADDVKFTYDMLKADGKAWDLTFIKNVEVVGKNQVNIHLTEAHSTFTAQLTEIPIVPKKHYNDKYKSNPIGSGPYMVKEYKAGEQAIFVRNPYWHGKKPYFKKWTWVLLDENTALAALESGDVDMIYATPELASKKVKGTRLLDIASNDVRGLSLPYVKKGVVKNSPDGYPVGNDVTSDPAIRKALTIGLNRQKVLDTVLNGYGKPAYSIIDRTPFWNPKTAIKDNKVAKAKQLLTKAGWKEQADGSRKKGNLKSEFDLYYPTNDQLRANLAVEVAEQAKALGITIKLKASNWDEMATKSHDSALLYAGGRHHAQQFYESHYPSLAGKGWTNITFYNNPTVTKYLDKAMTSPDLDKANKYWKLAQWDGKTGASTLGDLPNVWLVSLNHTYIGDKRINVGKQGVHSHGHDWSLLTNIAEWTWDESAK

SEQ ID NO: 469 - DNA, 129 bp, Streptococcus agalactiae
atgactggatcaaccggtgattgttttagtaaaataaaggtcaaaattgatactccaaaaacgagtgacaaacacctaagtatcttccagataactacagtggtaatatgtttcacagataaatctcct

SEQ ID NO: 470 - protein, 43 aa, Streptococcus agalactiae
MTGSTGDCFSKIKVKIDTPKTSDKHLSIFQITTVVICFTDKSP

SEQ ID NO: 471 - DNA, 861 bp, Streptococcus agalactiae
atggcaagtgtcaattatgacacgtcactaacccctgttcagtacaaagcgattgctcaccactatggtttggataagccagctccggtccagtattttatttggttaaaaaattttatacagggacatttagggacttcactagtttatcggcaacctgttattgatattattagatcacgggcaggtgcctctttcatacttatgggactctcctgggtcttatcgggtcttattggatttatcttaggaactttatcagctttccatcaagggaaattgcttgatcgaattgtaaggtggttttcttaccttcagatatcagtaccaactttttggattgggctcatttttttattaatcttttctgtccagctggggtggttcccgattggtatttcttccccgataggtactttgagtcaagatattacgttagctgatcgtattaagcaccttattttacctgttttcacgctaagtattctaggcattgccaatgtaactcttcatactagaactaaaatgatgtcggtactttctagtgaatatgtcttatttgccagagcgcgtggggaaacggaatggcaaatttttaaaaatcattgtcttagaaatgctatcgtaccagctattacactgcatttttcctattttggagaattgtttggaggatccgttcttgctgagcaagttttctcatatccaggactagggtctaccctaactgaagcaggacttaaaagtgatacaccgctacttctagctattgtgatgatagggacattatttgtttttgcgggcaatcttattgcggatattttaaacagcataatcaatccacagttaaggagaaaagta

SEQ ID NO: 472 - protein, 287 aa, Streptococcus agalactiae
MASVNYDTSLTPVQYKAIAHHYGLDKPAPVQYFIWLKNFIQGHLGTSLVYRQPVIDIIRSRAGASFILMGLSWVLSGLIGFILGTLSAFHQGKLLDRIVRWFSYLQISVPTFWIGLIFLLIFSVQLGWFPIGISSPIGTLSQDITLADRIKHLILPVFTLSILGIANVTLHTRTKMMSVLSSEYVLFARARGETEWQIFKNHCLRNAIVPAITLHFSYFGELFGGSVLAEQVFSYPGLGSTLTEAGLKSDTPLLLAIVMIGTLFVFAGNLIADILNSIINPQLRRKV

SEQ ID NO: 473 - DNA, 819 bp, Streptococcus agalactiae
atgatattgagacgtcgaactattgttttatggcaactgggtatcgccatttctctcattcttagtattctagccttaaatctttatttccatagtactcccttgcaaaccaatgcagctttacggaaccttgctccttcattaaaccatctttttgggacagatggtttaggtagggatatgtttgtcagaacgattaaaggactttatttctctctacaagtctgcttattaggtgcccttatgggggtcattctggcgacagtttttggagtgcttgcaggtttaggaaatagcattattgataaaataatagcatggttagttgatttgtttattggtatgcctcatttgatttttatgattctcatttcttttgttgttgggaaaggtgctcaaggggtcatcattgcaacggctgttacacattggccttctttagcaaggcttatccgcaatgaagtctatcatctaaagaataaagaatttgtccaactttctaaaagtatgggaaaaacgccttattatattgtgaggcatcatatcctgcctttgattgcttctcaaattttcattggttttatcctcttatttccacatgtcatcctacatgaagcatcaatgactttcttaggatttgggctctctgccgaacaaccttcggttggtatcattctgtcagaggcagctaagcatatctctcttggaaattggtggttggttatctttccaggactttatcttattttggttgtcaatgcatttgatactatcggagaatctttaaagaaactcttttaccctcaaactgatcatttt

SEQ ID NO: 474 - protein, 273 aa, Streptococcus agalactiae
MILRRRTIVLWQLGIAISLILSILALNLYFHSTPLQTNAALRNLAPSLNHLFGTDGLGRDMFVRTIKGLYFSLQVCLLGALMGVILATVFGVLAGLGNSIIDKIIAWLVDLFIGMPHLIFMILISFVVGKGAQGVIIATAVTHWPSLARLIRNEVYHLKNKEFVQLSKSMGKTPYYIVRHHILPLIASQIFIGFILLFPHVILHEASMTFLGFGLSAEQPSVGIILSEAAKHISLGNWWLVIFPGLYLILVVNAFDTIGESLKKLFYPQTDHF

SEQ ID NO: 475 - DNA, 801 bp, Streptococcus agalactiae
atgacagaaacattattaagcattaaagacctctccatcaccttcactcaatacggaagatttttaaaaccatttcaatcaacaccgatacaagcgctgaatttagaaattaaaaaaggtgagttattagctattataggtgctagtggttcagggaagagtttattagcacatgctattatggatattcttcctaaaaatgcatctgtaacaggagatatgatttatcgtggtcaatcactaaattctaaacgcattaaacagttgcgaggaaaagatattacgttgattccacaatcagttaattatttagatccatctacgaaagtcaaacatcaggtgcgcttaggtatctcagaaaattcaaaggctactcaagaaggattgtttcaacagtttggtttaaaagaaagtgatggtgacttgtatcctttccaactttctggcggaatgctccgacgtgttttgtttacaacgtgtattagtgataaggtttctttgattattgcggatgagcccacccctggattacatccagatgctctgcaaatggttttagaccaactacgctcctttgcagataaaggaataagcgttatatttatcactcatgatattgtagcagctagtcaaattgctgatcgtattactatttttaaagagggaaaagctattgaaacagctccagctagtttctttagcggaaatggagagcagttacaaacagaatttgctagaagtttatggcgctctctcccacagcaagaatttttgaaaggagttactcatgaccttagaggc

SEQ ID NO: 476 - protein, 267 aa, Streptococcus agalactiae
MTETLLSIKDLSITFTQYGRFLKPFQSTPIQALNLEIKKGELLAIIGASGSGKSLLAHAIMDILPKNASVTGDMIYRGQSLNSKRIKQLRGKDITLIPQSVNYLDPSTKVKHQVRLGISENSKATQEGLFQQFGLKESDGDLYPFQLSGGMLRRVLFTTCISDKVSLIIADEPTPGLHPDALQMVLDQLRSFADKGISVIFITHDIVAASQIADRITIFKEGKAIETAPASFFSGNGEQLQTEFARSLWRSLPQQEFLKGVTHDLRG

SEQ ID NO: 477 - DNA, 801 bp, Streptococcus pyogenes
atgacagaaacattattaagcattaaagacctctccatcaccttcactcaatacggaagatttttaaaaccatttcaatccacaccgatccaagcgctgaatttagaagttaaaaaaggtgagttattagctattataggtgctagtggttcaggcaagagtttattagcacatgctattatggatattcttcctaaaaatgcagctgtaacaggagatatgatttatcgtggtcaatcactaacttctaaacgcatcaaacagttgcgaggaaaagaaatgacgttgattccacaatccgttaattatttagatccatctatgaaagtcaagcatcaggtgcgcttgggtatctcagaaaatgctaaggctactcaagaaggattgtttcaacagtttggattaaaagaaagtgatggtgacttgtatcctttccaactttctggcggaatgctccgacgtgttttgtttacaacgtgtattagtgatacggtttctttgattattgcggatgagcccacccctggattacatccagatgctctgcaaatggttttagatcaactacgctcctttgcagataaaggaataagcgtcatatttatcacccatgatattgtagcagctagtcaaattgcggatcgtattactatttttaaagagggaaaagctattgaaacagccccagctagcttttttagcggaggtggggagcaattacaaacagaatttgcgagacgtttatggcgcacactccctcagcaagactttttgaaaggagttactcatgaccttagaggc

SEQ ID NO: 478 - protein, 267 aa, Streptococcus pyogenes
MTETLLSIKDLSITFTQYGRFLKPFQSTPIQALNLEVKKGELLAIIGASGSGKSLLAHAIMDILPKNAAVTGDMIYRGQSLTSKRIKQLRGKEMTLIPQSVNYLDPSMKVKHQVRLGISENAKATQEGLFQQFGLKESDGDLYPFQLSGGMLRRVLFTTCISDTVSLIIADEPTPGLHPDALQMVLDQLRSFADKGISVIFITHDIVAASQIADRITIFKEGKAIETAPASFFSGGGEQLQTEFARRLWRTLPQQDFLKGVTHDLRG

SEQ ID NO: 479 - DNA, 624 bp, Streptococcus agalactiae
atgaccttagaggctaaaaagcttggcttttatcataaaaaagatcaatggctttttaaggagattaatttagaggtagcacctggtcaagttttaggtatatttggacaaagtggttgtggaaaaactagtttatccagggtgcttgcaggttttttacatcctaaatctggtgaagtattagttgatggcagtaatttgcctagcaaagcatttagacctgtacaacttattcaacaacatcctgaaaaaacgatgaatcctttatggcctatgaaaaaaagtttggaagaagcctattacccaagtcgagatttactagatgcttttggaattcaagaaaaatggctaaatcgtcgacctagtgaactctcgggaggagaattacaacgcttttcgattgtgcgttcattacatccagagactaaataccttattgcagatgaaatgactactatgttggatagcattacacaagctagtgtatggaaaagcctgttggagattgtaaaggatagaaatttaggtctcatcgttattagtcatgatttcgctatgttagagaaactttgtaaccaatgctatatgattgaagagaatcgtatcgtatctttcaatggagat

SEQ ID NO: 480 - protein, 208 aa, Streptococcus agalactiae
MTLEAKKLGFYHKKDQWLFKEINLEVAPGQVLGIFGQSGCGKTSLSRVLAGFLHPKSGEVLVDGSNLPSKAFRPVQLIQQHPEKTMNPLWPMKKSLEEAYYPSRDLLDAFGIQEKWLNRRPSELSGGELQRFSIVRSLHPETKYLIADEMTTMLDSITQASVWKSLLEIVKDRNLGLIVISHDFAMLEKLCNQCYMIEENRIVSFNGD

SEQ ID NO: 481 - DNA, 624 bp, Streptococcus pyogenes
atgaccttagaggctaaaaagcttggcttttatcataaaaaagatcaatggctttttaaggagattgatttagaggtagcacctggtcaaatcttagggatatttggacaaagtgggtgtggaaaaacgagtttatccagagtgcttgctggttttttgcagcctaaatctggtgaagtattagttgatggcagtcatttgcctaacaaagcatttagacctgtacaacttatccaacaacatcctgaacaaaccatgaatcctttatggcctatgaaaaaaagtttggaagaagcctactatccaagtcaagatttgcgagatgcttttggcattcaagaaaaatggctaaagcgtcgtcctagtgaactctcgggaggggaattgcaacgcttttcgattgtgcgttcattacatccagagacgaaataccttattgcagatgaaatgactactatgttggatagcattacacaagctagtgtatggaaaagcctgttggagattgtaaaggatagaaatttaggtctcatcattattagtcatgagtttgatatgttagaaaaactttgtgacgcgtgctatatgattgaagagaatcgtactcaactgttcaagcatacc

SEQ ID NO: 482 - protein, 208 aa, Streptococcus pyogenes
MTLEAKKLGFYHKKDQWLFKEIDLEVAPGQILGIFGQSGCGKTSLSRVLAGFLQPKSGEVLVDGSHLPNKAFRPVQLIQQHPEQTMNPLWPMKKSLEEAYYPSQDLRDAFGIQEKWLKRRPSELSGGELQRFSIVRSLHPETKYLIADEMTTMLDSITQASVWKSLLEIVKDRNLGLIIISHEFDMLEKLCDACYMIEENRTQLFKHT

SEQ ID NO: 483 - DNA, 2028 bp, Streptococcus agalactiae
atggaacaatttaaacatgatgccaaagccttgttagaggcaattgggggtaaagaaaatattagtgcagtgacacattgtgctacacgcatgcgatttgttttgaatgacagtagtaaagctaaggtaaaggtaattgaggagttaccatcagtcaagggtacctttaccaatgctgggcaatttcaagtcattattggtaatgatgtccctattttttataatgcttttgtagccgtttctggtattgagggtgtgtctaaagaggcggcaaaatcggctgcccaaaaaaatcaaaaccctttacagcgtgtgttgacaatgctggctgaaatatttacaccgattattccagccattattgttggtggtctgatccttggttttcgtaatattttagatgccgttccatttgaatttttaggtcaaaaagttgttgatggtgtcaggcaagtagactcttctgggcatccaatttggaatactctagtagatgtttcaacgttttggagcggagtagactcttttttatggttaccaggtgaagctatatttcatttcttaccagttggtattgtatggtctgtgactcgtaagatggggactactcaaatcctcggtattgttctaggtatctgtctagtgtcgccacaattacttaatgcttattctgtagctagtacttcagcagcagacattgctaaaaattggtcttggaattttggttactttacagtacaaaaaattggttatcaagctcaagttattccagctctgttagctggtttgagcctgtcttacttagaaatcttctggagaaaacatattcctgaagttgtttcaatgatttttgtgccatttctatccttagttccagctattatcttggctcatactgtccttggacctattggttggacactaggtaaatggatttctgctatcgttcttattggattgactggtcctgtaaaatggctctttggtgctatttttggtgccctgtatgccccatttgttattactggtttgcaccacatgacaaatgctatcgatactcaactcatagcagatacaaaaacacatacaactggcctttggccgatgattgctctttcaaatattgctcagggttcagctgtactagcttattattttatgcatcgtcatgatgaaaaagaggctcaaatatcacttccagctgctatctcagcctaccttggtgttacagagccggcgctttttggtgtaaacgttaaatacatttatccatttgttgctggtatgattggttcaagtgtggcaggtcttttggcgacaacttttaatgtccaagctaactctattggtgtaggcggtcttccaggcttcctgtcaattaacgttaaatatatgggatatttctttatctgtatggcagtggctatctttattcctttatttttgacactattctttaaaaaatcaggtattttgacaaaaactgaagaggaaaaattagtacctgatgctgtcattgcttcaacaacagaaacaaaatcagcaaaagaaaaagctgtcgtatcaggtacaaagcttagtgtagtaagccctttatcaggtttagctaaaccactggatcaagctagtgatcctgtcttttcacaaggaattatggggaagggagtggttatcgatccaagtgatggagaactagtttcaccggtcgatgcgacagtttcagttcttttccctacgaaacatgctattggattgttaacatcagagggggttgagtttcttattcatattggtatggatactgttaatttagaaggaaaagggtttacctctcatgttgctcaaggtgacactgtaaaagtaggagataaactcattactttcgatattccaatgataaaagaagaaggatacattgtggaaactcctattctgattactaatcaacaagaattccgaccagaagaattgatagatttacccaaacagataaaacgtggacaagcattaatggttgccaagaaaatt

SEQ ID NO: 484 - protein, 676 aa, Streptococcus agalactiae
MEQFKHDAKALLEAIGGKENISAVTHCATRMRFVLNDSSKAKVKVIEELPSVKGTFTNAGQFQVIIGNDVPIFYNAFVAVSGIEGVSKEAAKSAAQKNQNPLQRVLTMLAEIFTPIIPAIIVGGLILGFRNILDAVPFEFLGQKVVDGVRQVDSSGHPIWNTLVDVSTFWSGVDSFLWLPGEAIFHFLPVGIVWSVTRKMGTTQILGIVLGICLVSPQLLNAYSVASTSAADIAKNWSWNFGYFTVQKIGYQAQVIPALLAGLSLSYLEIFWRKHIPEVVSMIFVPFLSLVPAIILAHTVLGPIGWTLGKWISAIVLIGLTGPVKWLFGAIFGALYAPFVITGLHHMTNAIDTQLIADTKTHTTGLWPMIALSNIAQGSAVLAYYFMHRHDEKEAQISLPAAISAYLGVTEPALFGVNVKYIYPFVAGMIGSSVAGLLATTFNVQANSIGVGGLPGFLSINVKYMGYFFICMAVAIFIPLFLTLFFKKSGILTKTEEEKLVPDAVIASTTETKSAKEKAVVSGTKLSVVSPLSGLAKPLDQASDPVFSQGIMGKGVVIDPSDGELVSPVDATVSVLFPTKHAIGLLTSEGVEFLIHIGMDTVNLEGKGFTSHVAQGDTVKVGDKLITFDIPMIKEEGYIVETPILITNQQEFRPEELIDLPKQIKRGQALMVAKKI

SEQ ID NO: 485 - DNA, 2022 bp, Streptococcus pyogenes
atgggaaaatttgaacaggatgctaagagtcttctaactgctattggtggtaaagaaaacatcaaggttgtcacacactgtgcaacgcgtatgcgttttgttttgaatgataataataaggcaaatgtcaaagagattgaaaaaatctctgtagttaaagggacatttaccaatgctgggcagtttcaggtaatcattggtaatgatgttccagttttttataatgactttacagctgtttctagtattgaaggggtgtctaaagaagctgccaaatcagcagctaaaagtaatcaaaatgccttacaacgggtgatgaccatgttggctgagattttcacacctattattccggcgattattgttggggggcttattttaggtttccgtaatattttggagagtgtgccttttgaatttcttgggcagcaggtcgaaaaagggaaattagtttttgatgcagctggggatcctgtttggaatacgattgtgagggtatctcctttctggtcaggggttaaccatttcttgtggttaccaggggaagctattttccacttcttaccagttgggattacttggtctgtgacgcgtaagatgggaaccactcaaattttagggattgtccttggtatctgtttggtgtcaccacaattattgaatgcctatgcggtggcaggaacgcctgctgctgagattgccaaaaactgggtttgggattttggtttctttaccattaatcgtattgggtatcaggcacaggttattccagcccttttagctggtctgtcccttgcttatcttgaaattttctggcgtaaacggattccagaagtggtttcaatgatttttgtgccattcctttctttgattccagctttgattttagcgcatacggtattggggccaatcggttggactattggtaaagggatttcctttgttgtgttagctggattgactggtcctgttaaatggctattcggtgctatctttggtgccttgtatgctccgctagttattactggtttacatcacatgacaaatgccattgatacccaattaattgctgatactgcaactcgtacaactggtttgtggccaatgattgctctttcaaatatcgctcaagggtcagccgtttttgcttactatttaatgaatcgtcatgaagaacgtgaggctgaaatatcgcttcctgcagcaatttctgcttaccttggggtaactgagcctgccttatttggggttaatgttaaatacgtttatccctttgtagccggaatgattggctcaggtattgcgggtctcttatcaacaacctttaatgttcaggcaaattctattggtgttggtggtttaccaggtttcatggctatcaatgtgaagtacatgattccattcttcatctgtatggcagtagccattgtggtgccgatgtttttaaccttctttttccgtaaatcacatatcatgactaagacagaagatgaagctaaactacctgagacacccgtttcggatgctcctgtagcaactgctccacataagactatgcaaggaacagttatcactttaacaagccctttaacgggtgaagttaaagcgttgtctgaagctgttgatcctgtctttgcacagggagttatgggccaaggtgctcttcttcaaccgacagaaggggtgttagtagcgccttgtgatgctgaagtatcggtcttgttcccaactaaacacgctatttgtttggtgacgactgaaggtttggaattattgatgcatattggcatggatacggttaacttagatggtcaaggatttgaagctttggtgaagcaaggtgatcaggttaaggctggacaaacattgattcaatttgatatagcagcaatttctgaagctggatacgccactgaaacgcctcttgtggtgactaatcaagatgtttttacggtaactgttgaaggtagtttaccgcgtcagattaaggttaatgataagttagcagtagcggtgaaaaag

SEQ ID NO: 486 - protein, 674 aa, Streptococcus pyogenes
MGKFEQDAKSLLTAIGGKENIKVVTHCATRMRFVLNDNNKANVKEIEKISVVKGTFTNAGQFQVIIGNDVPVFYNDFTAVSSIEGVSKEAAKSAAKSNQNALQRVMTMLAEIFTPIIPAIIVGGLILGFRNILESVPFEFLGQQVEKGKLVFDAAGDPVWNTIVRVSPFWSGVNHFLWLPGEAIFHFLPVGITWSVTRKMGTTQILGIVLGICLVSPQLLNAYAVAGTPAAEIAKNWVWDFGFFTINRIGYQAQVIPALLAGLSLAYLEIFWRKRIPEVVSMIFVPFLSLIPALILAHTVLGPIGWTIGKGISFVVLAGLTGPVKWLFGAIFGALYAPLVITGLHHMTNAIDTQLIADTATRTTGLWPMIALSNIAQGSAVFAYYLMNRHEEREAEISLPAAISAYLGVTEPALFGVNVKYVYPFVAGMIGSGIAGLLSTTFNVQANSIGVGGLPGFMAINVKYMIPFFICMAVAIVVPMFLTFFFRKSHIMTKTEDEAKLPETPVSDAPVATAPHKTMQGTVITLTSPLTGEVKALSEAVDPVFAQGVMGQGALLQPTEGVLVAPCDAEVSVLFPTKHAICLVTTEGLELLMHIGMDTVNLDGQGFEALVKQGDQVKAGQTLIQFDIAAISEAGYATETPLVVTNQDVFTVTVEGSLPRQIKVNDKLAVAVKK

SEQ ID NO: 487 - DNA, 1623 bp, Streptococcus agalactiae
atgacgattgataaacgtaaagttgtctatcaaatttatccaaaatcatacaaagacacaactggtaatggggttggtgatcttcgtggtattatcgaaaaattaccctatttagcagaacttggtattgatatggtttggctcaacccattttatccaagtccacaacgagataatggatatgatatctctgattatacagctattaaccctgattttggaacgatggacgattttgaagaaatgattgaggtgggacgtcaataccgtatagattttatgcttgatatggtgcttaatcattgttcaatagaacatgagtggtttaaaaaagcacttgcaggagatcgctactatcaagatttctttatcttacgtgataatccaacagattgggtatctaaatttggtggaaatgcttgggcaccatttggtgatacagggaagtattatcttcatctttttgatatcactcaagctgaccttaattggcgcaatgccgatgttcgcaaggaactttttaaagttgtcaatttttggcgtgataaaggggttaaaggttttcgatttgatgtgattaatttaattgggaaagatgagatacttgagaactgcccaattaatgatggaaaaccagcttatactgatcgtccaataacacatgattatctcaagatgttgaataatgctagttttggacaagatgattccttcatgacagttggtgaaatgtcttcaacgacaattgcaaattgcattctttacactgcaccagaacgtgaagagttatccatggcttttaattttcaccacctcaaagtagattataaagatgggcaaaagtggaccattatggcttttgattttcctgcattacgtgaccttttccatagttggggcgaagggatgagcgaaggaaatggttggaatgctttattctataataatcatgaccaaccgcgagcattaaatcgttttgtagacgtgaaacgttttcgaaatgaaggagcaaccatgttagcagcatctatccacttatcgcgtggtactccttatatatatatgggtgaagaaatcggaatgcttgatcccgattacagttctatggatgattatgtggatattgagagtttgaatgcctaccaaataatgcttgatgaaggcaagtcacaagaagaggcatttagcattattcgagcgaaatctcgagacaattctcgagtaccaatgcaatgggatgatagtacgaatgcaggtttttctgaaggcgctccatggttgaaagtaggaaaatcatataaagaaatcaatgtcgcaaaggagaaaacagggctgatatttactttctatcaagagttgataaggctacgtaaacaactgccaataatagctgacgggaattataaagcagctttcaaagataatgaaaaagtatatgcttttgaacgccatcttgataaggaaaaacttcttgttttaaataatttctttgctgagaaagttaagataaaattaccggagaattatctccaaggacaagttcttctatcaaattataaggatgttactcttgatgaaacggttactttgcaaccttatcaaactttagctatcttagtgtca

SEQ ID NO: 488 - protein, 541 aa, Streptococcus agalactiae
MTIDKRKVVYQIYPKSYKDTTGNGVGDLRGIIEKLPYLAELGIDMVWLNPFYPSPQRDNGYDISDYTAINPDFGTMDDFEEMIEVGRQYRIDFMLDMVLNHCSIEHEWFKKALAGDRYYQDFFILRDNPTDWVSKFGGNAWAPFGDTGKYYLHLFDITQADLNWRNADVRKELFKVVNFWRDKGVKGFRFDVINLIGKDEILENCPINDGKPAYTDRPITHDYLKMLNNASFGQDDSFMTVGEMSSTTIANCILYTAPEREELSMAFNFHHLKVDYKDGQKWTIMAFDFPALRDLFHSWGEGMSEGNGWNALFYNNHDQPRALNRFVDVKRFRNEGATMLAASIHLSRGTPYIYMGEEIGMLDPDYSSMDDYVDIESLNAYQIMLDEGKSQEEAFSIIRAKSRDNSRVPMQWDDSTNAGFSEGAPWLKVGKSYKEINVAKEKTGLIFTFYQELIRLRKQLPIIADGNYKAAFKDNEKVYAFERHLDKEKLLVLNNFFAEKVKIKLPENYLQGQVLLSNYKDVTLDETVTLQPYQTLAILVS

SEQ ID NO: 489 - DNA, 1626 bp, Streptococcus pyogenes
atgacaattgataaaaagaaagtcgtctatcaaatttacccaaaatcctataaggacacgactggaaatggtgtgggagacttgctagggatcattgataaattgccttacttacaagaactaggaatagatatgatttggttgaaccctttctaccctagtccacaacgagacaatggctatgatgtttcagattatacggcggtcaaccctgattttggaacaatggctgattttgaaaatttggtaaaagctgctaaggagcatcagattgagttaatgttggacatggttttgaatcactgttccacagaccacgagtggttccaaaaagctttagcaggagacccttattatcaggatttctttatcttgagagatcagccgactgattgggtttccaaatttggtgggaatgcttgggcgccttttggagatacaggcaaatactacttacacttgtttgatgtgacacaggctgacttgaattggcggaacccacatgttcgtgaggaattggctaaagtggttaatttttggcgagataaaggagtgaaggggttccgttttgatgtgattaacctgattgggaaagatgaagagctggtggattgtccggtcaatgatggtaagccagcttatacggatcgtcctattactcacacttatcttcatgatctcaatcaagccagttttggtcaggatgattcgtttatgacagtaggggaaatgtctgcaacgactattgacaactgtcttttatacacggctcccgaacgtgaggagctatccatggcttttaatttccaccatctaaaagttgattatgagaacggtcagaaatggactattatggcttttgattttgcagcgctgcgagacttattccatgcttggggtgaaggcatgagtcagggcaatgggtggaatgccttgttctacaataaccatgatcaaccacgtgccctgaatcgttttgttgatgtaacacatttccgaaacgaaggtgcgacgatgttagcagcttccatccatttgtcacgaggaacgccttacatttatatgggtgaggagattggcatgcttgatccagactttgatagtatggatgattatgtggatgtggaaagtctcaatgcttactcaagcttattagtctcaggtaaaagtgcagaagaagcctttgccattatcaaggccaagtcaagggacaatgccagaacaccaatgcaatgggatgctagtgaacatgctggctttacgactggtaagccttggttagaggttggcaaatcttatcgagacatcaatgtcgaaacagaaaaagagggacgtatttttcctttctaccaacgcttgattgctttgcggaaggaactccctattattgctgaaggggactatcgggctgcttttaaagatagtcaggctgtctatgcctttgaacgccatttaggtgaccagtgtttgcttgttctcaatcatttctatgctgatgaggtcgaactggaattacctccacgttatcaacatggacaggtcttaatcagcaactatgagaaagtttctatttgtgaaaaagtgatactgaaaccttatcagacacttgctatcttagctgataac

SEQ ID NO: 490 - protein, 542 aa, Streptococcus pyogenes
MTIDKKKVVYQIYPKSYKDTTGNGVGDLLGIIDKLPYLQELGIDMIWLNPFYPSPQRDNGYDVSDYTAVNPDFGTMADFENLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELVDCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMSQGNGWNALFYNNHDQPRALNRFVDVTHFRNEGATMLAASIHLSRGTPYIYMGEEIGMLDPDFDSMDDYVDVESLNAYSSLLVSGKSAEEAFAIIKAKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPPRYQHGQVLISNYEKVSICEKVILKPYQTLAILADN

SEQ ID NO: 491 - DNA, 144 bp, Streptococcus agalactiae
gtgctgcttgtggaaaggaatcttgctctagattttgcaatttctttcttttttctttactctataacaatagcccaaattcattcaattgatagtagtgccagattgggctcaaatgacctagaaaaatgtaaacggttacta

SEQ ID NO: 492 - protein, 48 aa, Streptococcus agalactiae
MLLVERNLALDFAISFFFLYSITIAQIHSIDSSARLGSNDLEKCKRLL

SEQ ID NO: 493 - DNA, 1917 bp, Streptococcus agalactiae
atggttgataataagactgttgtgataatgttggtatttttagctcggaaaaatctttccttgtatgagttaacagtgcaaacaaagttttcaataaaagttatcatagagcaaattaactatctcaatagttttttagcaaaaaatcacctaccagctattgctcactctgctggacgttatcagttattaggagatgaaaaagagcatgataaaattgtctccttattagaagctgagcaattttacctaacccaggaagaaagggtatgtctgatttacctttatagcttttgccgaagagagtttgtctccaatgtgcattatcaagattttttgaaagtaagtaagaatactactttatcagatatcaagatgctacgttctaaattagcaaaaagaggtatctcactcacttatacaagagcaaagggatatagtctagtaggagatgagatggataagcatcaagttgcttttcagatgataactcaactactagaatctcccattggtttttggtctttgaattatatcttgtcttcttggaaattcgctctctcatatgagaagttagaaaagacggtagaatatttctatgaatcttttcaactttctccaatacaagataggcttgagaaatctttatattttatcattttaatactgtgtcgttatcaaaggtcagtagatcgtgttttgcagggttctcctattgtttctgaacaattaaaagagttaacgactattattgtgactaatttaagtcaggatatttccttatctaaaccattagatcagaaagaaaaagattatattaccttgatcttatctggctgttttgaaggtgagggaactaaagatgatgatttctttgaagcattggcaaaagcaatcgttgatgagatggaaactgtttcacttcttaatttttccaataaagaagagttattacaaggtctgaagcgtcatattattccagcttatttccgattgaaatatggtttaactggcgatagtggttatacacaaaatattaaagagcattacagtgatttatttctattggttaaaaaggcactacgtcctttggaagagcaagtaggattaatacccgatagtgaaatttcttacttcgtgattcactttggaggctatcttagacaatcaggtggtacacaatcaatgtcttataaagctttgatactctgtccaaacggcgttagttcatccttagtgattaaggaaaaattgcgtggattatttcctcaaattcattttcatcgtgtctctaaaattgagcagctgaaactgattgacaatcaaacttacgatatggtcttttctactatatttgtagaaacaaaaaaacctaattatctagtttcgctgatgatgacagcagagcaagtacaacagctcaaagaactggttatttcagattttcccaaggcttgccttgacgatttccaacttgatcaattaatagcaactataaaaaaatacgctcatgttcattgtgaagaggaattaaaattggctttgaggacaatggtaaaacaagatatacttagaaaggatgtgaggcccttgttgcaccaacttataacagaggaaacttatcagacaagttctgaacaaatgaattggaaagaggcaattcgtttagcggcaaaacccttgttagcttctggaaaaattacggaaagttacccagaagctatgattgaaaaagtcgaagagtttggtccttttatcaatcttggtaaaggtattgctattccacatgccagaccagaagatggggtaaactctgtcggtatgtcaatgcttgttttggaacagccacgccgtacgcatgaaaactttctcttcatccttttgtgcccggacatcaattttgaaaagattcctttt

SEQ ID NO: 494 - protein, 639 aa, Streptococcus agalactiae
MVDNKTVVIMLVFLARKNLSLYELTVQTKFSIKVIIEQINYLNSFLAKNHLPAIAHSAGRYQLLGDEKEHDKIVSLLEAEQFYLTQEERVCLIYLYSFCRREFVSNVHYQDFLKVSKNTTLSDIKMLRSKLAKRGISLTYTRAKGYSLVGDEMDKHQVAFQMITQLLESPIGFWSLNYILSSWKFALSYEKLEKTVEYFYESFQLSPIQDRLEKSLYFIILILCRYQRSVDRVLQGSPIVSEQLKELTTIIVTNLSQDISLSKPLDQKEKDYITLILSGCFEGEGTKDDDFFEALAKAIVDEMETVSLLNFSNKEELLQGLKRHIIPAYFRLKYGLTGDSGYTQNIKEHYSDLFLLVKKALRPLEEQVGLIPDSEISYFVIHFGGYLRQSGGTQSMSYKALILCPNGVSSSLVIKEKLRGLFPQIHFHRVSKIEQLKLIDNQTYDMVFSTIFVETKKPNYLVSLMMTAEQVQQLKELVISDFPKACLDDFQLDQLIATIKKYAHVHCEEELKLALRTMVKQDILRKDVRPLLHQLITEETYQTSSEQMNWKEAIRLAAKPLLASGKITESYPEAMIEKVEEFGPFINLGKGIAIPHARPEDGVNSVGMSMLVLEQPRRTHENFLFILLCPDINFEKIPF

SEQ ID NO: 495 - DNA, 2160 bp, Streptococcus pyogenes
ttgagtccaattgcagtcaaaaatgacatgagacaattggactcaatttatcttgaaaatgaaaacgcttcattttatactgacattataggaggagatgacatgctatctcatgagctcatcagaaactatcaactcttttctaaatataaaggacattcactggaggcatttgaatccattttaaaggcaagcaaacgtcatatactggcagatattgctaaaatcaatgacacgttgtcactctatcagttaccccttattgctctggacaggcagctggtttatccgccagaccttactgaaaaggacttgttgaatcgcatgctacctaccttagacgactatctctttcaagatgagcgtctggatatgattatcatttacatcatgatggctaaagaatttatctccattaaccacttggaaagcttgttacggctcagcagaaattctgttattgctgatttaaacttggtgcgtgatcgggtacaagcttttcaggtaactttagcttacaatcgccaggatggttatttttttgaaggagaacccttagccttgcggcgtctcttagaatcagcggtcagttctcttttgcaagtcacatctggaccttgggtgttcagttacttattgcatgaacttggtttgcccgaccagaaaaaggtgatggcagcaacgttggaggaactgagcagggagaaccacttaacttttatttcggagaaattgagggatttgatttattttttctgccttctcgctcatcgaccattttcacggaacgtaagggctgaagcagtggatacttttcctttagcttcgccagctgttgaaacgatggtggaccagttattggtcaacttccccagtctaaccgaagaaaaatatttggttcaatctaggttacttggttgtatccaaggtgacttagagttagtctttcagcaacctatttatgacattatggaggaaatcatcaattcggtggcggttaacacgggattgtctatcaccgataccccagaacttcgtcagaacctatacagtcaccttttgccagcttattaccgactttactacgacattaacttgaccaatcctttgaaggaacaaatcaaacaagattatgaatctctcttttacttggtcaagcgcagcctttctcctctagaaaaacaattggggaaatcagttaatgaagatgaggttgcttattttaccattcattttgggagatggttgcaggcccctaagaagaggccaagcaatcagctggtagccttatctgtttgccctaatggcattagttcgtctctgatgttggaggcaaccttgaaggaactttttccacagctacagtttattaggattcaccagctggacaaaataaagttgttggatccagcatcctttgatttgattttttcaacagtagcttttgactgtgctaaacctgtttatgtgacgcaagctttgatgggacctgttgaaaaaatgatgttgaaaaagatggtctgtgatgactttcatcttcccttgtcagagcaattcgctttggatgatctgttgagtattattcataaacataccacgattactaataaagaaggacttgttagtgatttatcccgttacctgattggtaaccatttaacgattgaaaaaggaggtctaggactattggacttgttaacagcagattttattaggcaggctgatgctgtttcggattggcaggaagcgattcgtttggctgctcagcctttactagaacaccagatgattgaaacatcttatatcgatggcatgattgattcggtcaatgagcttggggcctatattgttttagcccctaaggtggctgttcctcatgcggcgcctgaaaaaggaacgcggcagttaggcatgtctctcttacaactaaaagaacctgtcagctttgatttgaagcaagaaggtgatccagacaagcaagtgcaattgatttttgttttgtctgctgtggattctagttcacatttgaaggctttgcaggaactgtcgttgattttagatgatgatgaacatattgagcaattaattgaggctaagaatactgaggaaataatgagtctgattagccatatgattgaaaaaggagacgaatcacatgat

SEQ ID NO: 496 - protein, 720 aa, Streptococcus pyogenes
LSPIAVKNDMRQLDSIYLENENASFYTDIIGGDDMLSHELIRNYQLFSKYKGHSLEAFESILKASKRHILADIAKINDTLSLYQLPLIALDRQLVYPPDLTEKDLLNRMLPTLDDYLFQDERLDMIIIYIMMAKEFISINHLESLLRLSRNSVIADLNLVRDRVQAFQVTLAYNRQDGYFFEGEPLALRRLLESAVSSLLQVTSGPWVFSYLLHELGLPDQKKVMAATLEELSRENHLTFISEKLRDLIYFFCLLAHRPFSRNVRAEAVDTFPLASPAVETMVDQLLVNFPSLTEEKYLVQSRLLGCIQGDLELVFQQPIYDIMEEIINSVAVNTGLSITDTPELRQNLYSHLLPAYYRLYYDINLTNPLKEQIKQDYESLFYLVKRSLSPLEKQLGKSVNEDEVAYFTIHFGRWLQAPKKRPSNQLVALSVCPNGISSSLMLEATLKELFPQLQFIRIHQLDKIKLLDPASFDLIFSTVAFDCAKPVYVTQALMGPVEKMMLKKMVCDDFHLPLSEQFALDDLLSIIHKHTTITNKEGLVSDLSRYLIGNHLTIEKGGLGLLDLLTADFIRQADAVSDWQEAIRLAAQPLLEHQMIETSYIDGMIDSVNELGAYIVLAPKVAVPHAAPEKGTRQLGMSLLQLKEPVSFDLKQEGDPDKQVQLIFVLSAVDSSSHLKALQELSLILDDDEHIEQLIEAKNTEEIMSLISHMIEKGDESHD

SEQ ID NO: 497 - DNA, 123 bp, Streptococcus agalactiae
ttggagaaagaggctaagcagatcattgatttaaaaaggaatcttttcaaaattgatgtccgggcacaaaaggatgaagagaaagttttcatgcgtacggcgtggctgttccaaaacaagcat

SEQ ID NO: 498 - protein, 41 aa, Streptococcus agalactiae
MEKEAKQIIDLKRNLFKIDVRAQKDEEKVFMRTAWLFQNKH

SEQ ID NO: 499 - DNA, 105 bp, Streptococcus pyogenes
ttggagaaagaggctaagcagatgattgatttaaaaaggaatcttttcaaaattgatgtccgggcacaaaaggatgaagagaaagttttcatgcgtacggcgtgg

SEQ ID NO: 500 - protein, 35 aa, Streptococcus pyogenes
LEKEAKQMIDLKRNLFKIDVRAQKDEEKVFMRTAW

SEQ ID NO: 501 - DNA, 1140 bp, Streptococcus agalactiae
gtgactacgatgattgattttattatttctattgatgattgcgcagttgaattggatagtcgtcaatcttggaaaattcgctaccccttatcaaccattctatttcttgtctttgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 502 - protein, 380 aa, Streptococcus agalactiae
MTTMIDFIISIDDCAVELDSRQSWKIRYPLSTILFLVFVCQLAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 503 - DNA, 1140 bp, Streptococcus pyogenes
gtgactacgatgattgattttattatttctattgatgattgcgcagttgaattggatagtcgtcaatcttggaaaattcgctaccccttatcaaccattctatttcttgtcttcgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 504 - protein, 380 aa, Streptococcus pyogenes
VTTMIDFIISIDDCAVELDSRQSWKIRYPLSTILFLVFVCQLAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 505 - DNA, 198 bp, Streptococcus agalactiae
gtggaacagcctatttatttattggatgaccccaaacaggaaatttatctcttattatgcatagcagctattgataatgaaacgcatttgaaagctctatcgcatttgacaacaatacttcgtgataataataatgttaaagctttgttagcttcacgtaggtatcaagatattgaaatgattataaaacaggaggat

SEQ ID NO: 506 - protein, 66 aa, Streptococcus agalactiae
MEQPIYLLDDPKQEIYLLLCIAAIDNETHLKALSHLTTILRDNNNVKALLASRRYQDIEMIIKQED

SEQ ID NO: 507 - DNA, 282 bp, Streptococcus agalactiae
atgttaagaattggaacagcatgtggatcaggtttaggttcaagttttatggtacaaatgaatattgagtctattttgaaggatttgggggtttctgatgttgaagttgaacattatgatttaggtggagcagatccaagtgcagcagatgtttggattgttggtcgtgatttggaggattcagctggtcacctgggggatgttcgtattttaaacagtatcattgatatggatgaattgagagaattagtgacaggtatttgccaagaaaaaggcttaatc

SEQ ID NO: 508 - protein, 94 aa, Streptococcus agalactiae
MLRIGTACGSGLGSSFMVQMNIESILKDLGVSDVEVEHYDLGGADPSAADVWIVGRDLEDSAGHLGDVRILNSIIDMDELRELVTGICQEKGLI

SEQ ID NO: 509 - DNA, 303 bp, Streptococcus pyogenes
ttgaaaaaggagacgaatcacatgattaaaattgtaacggtttgtggaaacggtattggtagtagcttgttacttcgcatgaaagtagaagctatcgcctctagtttgggtattgatgtggatgcagaatcctgtgattccaatgcggctgttggaaagggtgcagatttgtttgttaccgttaaagaatttaaagatatttttccagaggatgccaaggtttgtatcgttaaaagctataccaatcgtaaaaaaattgaagaagatttggttccggttctcaaggaaatgagtggcaaggaa

SEQ ID NO: 510 - protein, 101 aa, Streptococcus pyogenes
LKKETNHMIKIVTVCGNGIGSSLLLRMKVEAIASSLGIDVDAESCDSNAAVGKGADLFVTVKEFKDIFPEDAKVCIVKSYTNRKKIEEDLVPVLKEMSGKE

SEQ ID NO: 511 - DNA, 93 bp, Streptococcus agalactiae
atgacagtagtgccagtcacaatcatgactatcatactaaccaatccaccaacaaaacttgagataaaaccaatcaatactgcattaggtgca

SEQ ID NO: 512 - protein, 31 aa, Streptococcus agalactiae
MTVVPVTIMTIILTNPPTKLEIKPINTALGA

SEQ ID NO: 513 - DNA, 1353 bp, Streptococcus agalactiae
atgaaaggtctattggattttttagttaatattgccagcacgccagctattttagtcgccttgatagccattatcggtttagtactgcagaaaaaaggcgttcctgatattgtaaaaggtggaataaaaacatttgttggcttcttagtggtttctggaggtacagggatagtccaaaattccttgaatccatttggaaaaatgtttgaacatgcttttcatttggtgggggtagttcctaataatgaagccattgtagcagtagctcttacgaagtatggctcagcaactgctttgattatgttagcgggaatgatttttaatattttaattgctcgttttacaaaatttaaatatatttttctgacaggacatcatacattgtatatggcttgtatgattgctgttatttttgccgtagcaggctttacttcgttctcgctcatcctttttggaggtctagcgttagggattattatgagcgtatctcctgcatttgtgcaaaaatacatgattcaactgacaggtaatgataaggtggcacttgggcactttggttctttaggctattggttgagtggatttattggtggaattgttggagataaatcaaaatcaacagaagatattaaatttccaaagagtttatcatttttacgtgacagtaccgtaagtattactatctcaatggcaattatttaccttatcgttgcagtgtttgctggtgaggcttatattgcaaaagaaataagtaacggtgtcaatggtcttgtttatgccctccaactagctgggcaatttgcggcaggtgtattcgttattttagcaggtgtacgccttatcctaggtgaaattgtaccagcctttaagggaatctcagaaaaattggttccaaattcaaaaccagccttggattgtccaattgtttacccttatgcacctaatgcagtattgattggttttatctcaagttttgttggtggattggttagtatgatagtcatgattgtgactggcactactgtcattttaccaggggtcgttcctcatttcttctgtggggcaacggcaggtgttatcggtaatgcttctggtggtgtgagaggagcgactattggtgcatttgttcaaggtatcctcatcagtttcttgccgattttcttgatgcctgtactaggtggacttggtttcaaagggtcaacattctcagatgctgattttggtttgaccggtatcattcttggcgctcttaatcatgtcggcggtgcgatagctattgttattggtattgtagttatcttaattggactttttggcatttcatttgttggaaaatcaacccataaggaaggt

SEQ ID NO: 514 - protein, 451 aa, Streptococcus agalactiae
MKGLLDFLVNIASTPAILVALIAIIGLVLQKKGVPDIVKGGIKTFVGFLVVSGGTGIVQNSLNPFGKMFEHAFHLVGVVPNNEAIVAVALTKYGSATALIMLAGMIFNILIARFTKFKYIFLTGHHTLYMACMIAVIFAVAGFTSFSLILFGGLALGIIMSVSPAFVQKYMIQLTGNDKVALGHFGSLGYWLSGFIGGIVGDKSKSTEDIKFPKSLSFLRDSTVSITISMAIIYLIVAVFAGEAYIAKEISNGVNGLVYALQLAGQFAAGVFVILAGVRLILGEIVPAFKGISEKLVPNSKPALDCPIVYPYAPNAVLIGFISSFVGGLVSMIVMIVTGTTVILPGVVPHFFCGATAGVIGNASGGVRGATIGAFVQGILISFLPIFLMPVLGGLGFKGSTFSDADFGLTGIILGALNHVGGAIAIVIGIVVILIGLFGISFVGKSTHKEG

SEQ ID NO: 515 - DNA, 1233 bp, Streptococcus pyogenes
atggaagcattattatcatttattcgagatattttaaaagaacctgcatttttaatgggcttgattgcctttgcagggttggtggctttgaaaacacctgctcataaggtgttgacaggaaccttggggccgattttgggataccttatgcttgttgcaggggcgggtgttattgtgaccaatttggaccctcttgccaaactcattgagcacggttttagcatcactggcgtagtgccaaataacgaagccgtcacttctgtcgctcaaaagattctgggtgtggaaactatgtccatcttggtggttgggttattgctcaatttggcttttgctcgttttacccgcttcaaatacattttcttaacaggacatcacagcttctttatggcttgtctcttgtccgccgtgcttggagctgttggtttcaaaggaagtcttttgattatcttagatgggttcctcttgggagcttggtcagctatttcgccagccattggtcaacagtatactctgaaagtgactgacggagatgaaatcgctatgggacactttggtagtttgggctattacctttctgcctgggttggtagcaaggttggcaaagacagtaaagataccgaagaccttcagatttctgaaaaatggagtttcttgcgcaacaccaccatttcaacaggacttatcatggtgattttctacttggtggcaacagtggcttctgttttgaggaatgcttcagtagcagaagaattagcagcaggtcaaaacccatttatttttgccattaagagtggtcttacctttgcggttggtgtggcaattgtctacgccggtgttcgcatgattttggctgacttgattccagccttccaaggtattgctaacaaattaattccaaatgctattccagccgtggattgtgcggtattcttcccttatgcgccaaccgctgttatcatcggttttgcgtcaagtttcgttggtggcttacttgggatgttgattttaggagttgcaggtggtgtcctgattatcccaggtatggtgcctcatttcttctgcggtgcaacagcagagatttttggaaattcaacaggtggtcgtcgcggtgcgatgattggtgcttcgctaatggcttattactcgccttcttgccagccatgcttctacctgtacttggtaaacttggtttttcaaacacgacctttggagatgtggatttcggtgttt

SEQ ID NO: 516 - protein, 411 aa, Streptococcus pyogenes
MEALLSFIRDILKEPAFLMGLIAFAGLVALKTPAHKVLTGTLGPILGYLMLVAGAGVIVTNLDPLAKLIEHGFSITGVVPNNEAVTSVAQKILGVETMSILVVGLLLNLAFARFTRFKYIFLTGHHSFFMACLLSAVLGAVGFKGSLLIILDGFLLGAWSAISPAIGQQYTLKVTDGDEIAMGHFGSLGYYLSAWVGSKVGKDSKDTEDLQISEKWSFLRNTTISTGLIMVIFYLVATVASVLRNASVAEELAAGQNPFIFAIKSGLTFAVGVAIVYAGVRMILADLIPAFQGIANKLIPNAIPAVDCAVFFPYAPTAVIIGFASSFVGGLLGMLILGVAGGVLIIPGMVPHFFCGATAEIFGNSTGGRRGAMIGASLMAYYSPSCQPCFYLYLVNLVFQTRPLEMWISVF

SEQ ID NO: 517 - DNA, 855 bp, Streptococcus agalactiae
atgacatcaccagaagaaagatattcatctctaagacgatttgcaacggagattcgtttaaatactctagaaacgctaaaccatttaggattcggtcactatgggggtagtttatcaattgttgaggctttggctgttctgtatggtgatattatggatataaatcctgaaaaattcaaagaaagtgatcgggattatatggtcttatcaaaaggacatgctggtccagccttgtatagtacactctatttaaaaggtttttttgataaaacattccttcattcgctcaatacaaacggtaccaaactaccttcgcatcctgaccgcaatttaactcctggtatagatgtaacgacaggctcgttaggtcaaggcattagtattgcaacgggaattgcttatgctcaaaagattgagaattcaagctattatacttatactattgtaggtgatggtgaattaaatgaaggacaatgttgggaggctatacaatttgctgcgcatcatcaactgcaccatttaattgtttttgtagatgataataaaaaacaattagatggtttgacagctgatatttgtaatcctggagactttgttgctaaatttgaagcttttggatttgatgcagtacgtgtaaaaggagatgacattgaggcaattgacaaagctattaaaacttttcaagattcaaatagtgtcagaccaaaatgtattgttttagatagcatcaagggacaaggtgtgaaagagttggaggagttagcttctaatcatcatttacgaccagatttacaacaaaaaacaatgttagagcgagcgttgataagcttgagagaaagtttggaggtggtagaa

SEQ ID NO: 518 - protein, 285 aa, Streptococcus agalactiae
MTSPEERYSSLRRFATEIRLNTLETLNHLGFGHYGGSLSIVEALAVLYGDIMDINPEKFKESDRDYMVLSKGHAGPALYSTLYLKGFFDKTFLHSLNTNGTKLPSHPDRNLTPGIDVTTGSLGQGISIATGIAYAQKIENSSYYTYTIVGDGELNEGQCWEAIQFAAHHQLHHLIVFVDDNKKQLDGLTADICNPGDFVAKFEAFGFDAVRVKGDDIEAIDKAIKTFQDSNSVRPKCIVLDSIKGQGVKELEELASNHHLRPDLQQKTMLERALISLRESLEVVE

SEQ ID NO: 519 - DNA, 2187 bp, Streptococcus pyogenes
gtggccactgtgtcaacaggctctcttatattcatcgtcaaaaagaatccaccaatgatgtccaaactagtttttttctggcaaaatagagaaaaagaatttagggactttggaggattttctgaaaaaagcgtctatttttgtgatacaatagacaatagaaaacgtttaattttagttgtaataaacagagaggttttacttatgacatttgatgcaattgaccagttggcagtaaacactgtccgcaccctatcaatggatgccattcaagcggcaaattctggacacccaggacttccaatgggggcagcacctatggcctatgttctttggaatcacttcatgaacatcaatcccaaaacaagccgtaattggtcaaacagagaccgttttatcctatcagcaggtcatggaagtgccatgctttatagcttgttacacttagctggttatgatttatctgtagaagatttaaagaacttccgtcaatggggttctaaaacaccaggtcacccagaagtgaaccacacagacggtgtcgaagcaaccacaggacctcttggtcaagggatcgcaaatgccgttgggatggccatggcagaagctcatctagcagctaaatttaacaaaccaggctttgacatcgttgatcactacacatttgctttgaatggtgacggtgaccttatggaaggggtcagccaagaagcagcaagtatggcaggacatttaaaacttgggaaattggtcttgctatatgattcaaacgacatctctcttgatggtccaacctctatggctttcacagaagatgtgaaaggacgtttcgaagcttatggttggcaacatatccttgtgaaagatggaaatgatttagaagaaattgcagctgctattgaagcagctaaagctgaaactgagaaaccaaccatcatcgaagtcaaaaccattattggttttggtgccgaaaaacaaggaacttcagctgttcacggcgctcctcttggagcagaaggcattgcttttgccaaaaaagcttaccaatggactcatcaagattttgaagtgcctgctgaagtaacagagcgctttgctcaaggtcttcaagcgcgtggtgaaaaagcagaacaagcctggaatgacttgtttgcagcttatgaagcagaatatccagaattagcagcagaataccaaaaagcctttactaacgaagctgctcaagtagaacttgaagcgcacgaacttggtagttcaatggcgagtcgtgtatccagtcaacaagccatccaacaaatttcagaacaagtagcctctttctggggtgggtcagcagacctttcagcttcaaacaatactatggttaaggctgaaacagatttccaaccaggtcactacgaaggccgtaacatctggtttggcgttcgtgaatttgccatggctgcagccatgaacggtattgcccttcacggcgggacacgcgtttacggcggaaccttctttgtcttctcaaactatcttcttccagctgttcgtatggcagcgctccaaaacttgccaacagtttatgtcatgacacatgattctatcgctgtcggtgaagatgggccaacgcacgaaccaattgaacaattggcaagtgttcgctcaatgcctaacttgaacgttattcgtccagcagacggtaacgaaacaaatgctgcttggaaacgtgccattgctgaaacagatcgcccaaccatgcttgtattgacgcgtcaaaaccttccagtgcttgagggcacaaaagaattggcagaagatggtcttagcaaaggagcttatatcttgtcagaagccaaaggcgaccttgatggtatcttgattgcaacaggttcagaagtgaaactggcaatggatactcaagaagctcttgaagcagaaggcattcatgtgcgtgtcgtatctatgccatcacaaaatatctttgacgaacagtcagcagagtataaagaaagcatcctaccagcagctgtgactaaacgtctcgctatcgaagcaggttcaagctttggctgggcaaaatatgtcggcctatcaggaaaaacattgaccattgacacttggggtgcttcagctccaggaaatcgtatcttcgaagaatatggtttcactgtggcaaatgcaactgagttatacaaatcactc

SEQ ID NO: 520 - protein, 729 aa, Streptococcus pyogenes
VATVSTGSLIFIVKKNPPMMSKLVFFWQNREKEFRDFGGFSEKSVYFCDTIDNRKRLILVVINREVLLMTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYEAEYPELAAEYQKAFTNEAAQVELEAHELGSSMASRVSSQQAIQQISEQVASFWGGSADLSASNNTMVKAETDFQPGHYEGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLSKGAYILSEAKGDLDGILIATGSEVKLAMDTQEALEAEGIHVRVVSMPSQNIFDEQSAEYKESILPAAVTKRLAIEAGSSFGWAKYVGLSGKTLTIDTWGASAPGNRIFEEYGFTVANATELYKSL

SEQ ID NO: 521 - DNA, 927 bp, Streptococcus agalactiae
atgagatgttcaaccaaagaaatgaggcttgtctatcgtgatttcctccttcaagctaatcaagaaaataaacaaattaccgttttagaagccgatttgtcgagttcaatgtcaacaaatgcactggcatcagaatttggaaaacgttatattaatctaggtattatggaggctgagatggtaggccttgcagcagggctcgccattaaaggttacaagccataccttcatacttttggtcctttcgcgtcaaggcgtgtctttgatcaagtattcttatcgttaggttactcacaattatcagctacgattattggctcagatgcaggaattagcgcagaaatgaatggcggaactcatatgccttttgaagagttaggtctactaaggttaattcccaaagcgactatttttgaggttagtgatgatattcagtttgaagcaattttaaaacaaacattaagtattgatggcctaaaatacattagaactattcgtaaggcccccactgcagtttatgagggacgcgaagatttttcaaagggttttatacaattacgccagggaaaagatattactcttgtagcaagtggtattatggtttctagagcgatagaagcagccgactacctcaaagaactagggattgaggcctcagttatcgacctttttaaaattaagccccttccagaagaactgaaaccattactgatagatcaatccattgtaactattgagaatcataaccgtattggcggtatcggaagtgcattatgcgaatggcttagtatggagaaagacactactgttagtcgtatgggtattgatgagcgatttggtcaggtaggtcagatggaatatttattagaggagtatggactcgctgttaaagatatagtacagcattgcaaatcaatttataaatca

SEQ ID NO: 522 - protein, 309 aa, Streptococcus agalactiae
MRCSTKEMRLVYRDFLLQANQENKQITVLEADLSSSMSTNALASEFGKRYINLGIMEAEMVGLAAGLAIKGYKPYLHTFGPFASRRVFDQVFLSLGYSQLSATIIGSDAGISAEMNGGTHMPFEELGLLRLIPKATIFEVSDDIQFEAILKQTLSIDGLKYIRTIRKAPTAVYEGREDFSKGFIQLRQGKDITLVASGIMVSRAIEAADYLKELGIEASVIDLFKIKPLPEELKPLLIDQSIVTIENHNRIGGIGSALCEWLSMEKDTTVSRMGIDERFGQVGQMEYLLEEYGLAVKDIVQHCKSIYKS

SEQ ID NO: 523 - DNA, 159 bp, Streptococcus agalactiae
atgctagataaaattaaaacaatacctttccaagctcgcataacgaccacccctttatttttagtaaggataaaataccacaagatacttatacaaaacttaaaaatttcagaaaataacaaaaaggcaactccaatgttgcctttttgttatgattta

SEQ ID NO: 524 - protein, 53 aa, Streptococcus agalactiae
MLDKIKTIPFQARITTTPLFLVRIKYHKILIQNLKISENNKKATPMLPFCYDL

SEQ ID NO: 525 - DNA, 1152 bp, Streptococcus agalactiae
ttgacaagtttatcgctaacattcctcttatcaaccaaatttaggatacttgaaagttactttcaaggtattgaaaatatgtatttttaccacaaggtaatggctgtattttcaatgattttgcttctattgcacaaaattggtcttggacaaggcggacatggaagtgagtttgcaaagactattggcagtgcgggattatatctttttctaagtattgtttttgtagcttatttcggaaattttttaaagtatgaaatttggcgttttattcatcgctttgtttatttagcttatattttgggattggtacatacttttatgattttaggagataggatactaggaaatactttactcagtttaatcgtattaggttatgctgtcattggggttatatctggattttatattattttcctatattctagaatgcgttttcgtcgtgtagggtacgttcaaaaggttactcatcttaaccatgatacaactgagattgaaatagcaatgaagcgtccttatcgatatgactatggacaatttactttttttaaaatttatcaagctggctttgaatcagcagctcatcctttctcgatatcaggtggtcatgatagagtgatatttttaactgttaaagcttcaggagattatacgaaatccatttacaaacagctaaaagttgggacaaaaatagccttagatagagcttatggtcatatgttatttgataaagacaagaaagaacaggtttggattgcaggaggtatcggcatcactcccttcatttcatttattagagaaaatagtattttgactaagagagttgacttcttttataccttttcaaatcaagacaatttgatttatcaagatatgttagaatcctatgctaaagccaatcctaattttaaacttcacttaaataatagtagcctcaaaggaagacttgattttagtcagtctgtttttgaaggacaaccaacaatatttatgtgtgggccaactagtatgacatctacttatgctaaggtctttcggcaaaaagatgcaaagtctcgtttagtctatgaaggattttcctttagagacagttggttatccatatttctattaaaaacttttgacaaagtttattctaatttgataaaa

SEQ ID NO: 526 - protein, 384 aa, Streptococcus agalactiae
MTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFFKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPTSMTSTYAKVFRQKDAKSRLVYEGFSFRDSWLSIFLLKTFDKVYSNLIK

SEQ ID NO: 527 - DNA, 267 bp, Streptococcus agalactiae
atggcaatctcaaaagagaaaaaaaatgaaatcattgctcaatatgcacgacacgaaggtgatacaggatcagttgaagttcaagtagcagttcttacttgggaaatcaaccaccttaacgaccacatcaaacaacacaaaaaagaccacgctacttaccgtggattgatgaaaaaaattggtcaccgtcgtaacttattagcatacctacgtcgtacagatgttaaccgttaccgtgaattgattcaatcacttggacttcgtcgt

SEQ ID NO: 528 - protein, 89 aa, Streptococcus agalactiae
MAISKEKKNEIIAQYARHEGDTGSVEVQVAVLTWEINHLNDHIKQHKKDHATYRGLMKKIGHRRNLLAYLRRTDVNRYRELIQSLGLRR

SEQ ID NO: 529 - DNA, 267 bp, Streptococcus pyogenes
atggcaatctcaaaagagaaaaaaaatgaaatcattgctcaatatgcacgtcatgaaggcgatacaggttcagttgaagttcaagtagcagttcttacttgggaaatcaaccacttgaacagccacatcaaacaacacaaaaaagaccacgctacttaccgtggattgatgaaaaaaattggtcaccgtcgtaacttgttggcatacctacgtcgtacagatgttaaccgttaccgtgagttgatccaatctcttggacttcgtcgt

SEQ ID NO: 530 - protein, 89 aa, Streptococcus pyogenes
MAISKEKKNEIIAQYARHEGDTGSVEVQVAVLTWEINHLNSHIKQHKKDHATYRGLMKKIGHRRNLLAYLRRTDVNRYRELIQSLGLRR

SEQ ID NO: 531 - DNA, 2139 bp, Streptococcus agalactiae
atggagaataatatgtcaaaacaagtctttgaaatgatttttgctggaaaaaaattagttgttgaaactggccaagtggctaaacaagcaaatggatcagttgtcgttcgttatggagattctactgtactcacagcagcagttatgtctaagaaaatgtcaacaggtgattttttcccacttcaagtcaattacgaagaaaaaatgtatgctgctgggaaatttccgggtggctttaacaaacgtgaagggcgtccaagtacggatgctaccttaacagcacgtcttattgatagaccaatccgtccgatgtttgctgagggatttcgtaacgaagtacaggtcatcaatactgttctttcatttgatgaaaatgctagcgcaccaatggctgctatgtttggttcatcattagcattatcgatttccgatattcctttcaatgggccaattgctggagttcaagttgcttatgttgatggtaattttattattaatccgacagcacaagaacaagaggcttctgcgttagaattaacggttgcaggtactaaagaagcgattaacatggttgaatctggagcgaaagaactttcagaagaaatcatgctagaggctcttcttaaaggacatgaggctgtctgtgaattaatcgcctttcaagaagagattgttactgctattggtaaagaaaaagccgaggtagaacttcttcaagttgatccagaacttcaagcagaaattattgctactcataacatagctttacaggctgcagtacaagttgaagagaaaaaggctagagaagcagctacagaagcagttaaagaagtagttataggtgaatatgaggcacgttacgctgaacatgaagaatatgatcgcattatgcgtgatgttgctgaaattttagaacaaatggaacatgcagaagttcgtcgcctcattacagaagataagattcgtcctgatggacgtcgtgtggatgagattcgtccattagacgcagagattgattttttaccacaagttcatggatcaggtctctttacacgaggacaaacccaagcattatcagtattaacgttagcacctatgggtgaagcacaaatcattgatgggctaacaccagagtataagaaacgctttatgcaccactataacttcccacaatattcagttggtgagacgggacgttatggagctgcagggcgtcgtgaaattggtcacggtgctttaggagagcgtgcattagaacaagtccttccaagattggaggagtttccgtatgctatccgactagttgcagaagttttagaatcaaacggttcatcatctcaggcttctatatgtgctggaacgcttgctcttatggcaggtggtgtgcctataaaagctccagttgctggtattgccatggggctcatatcagatggaacaaactatacagtcctcactgatattcaaggattagaagaccattttggcgatatggactttaaagttgcgggtacacgtgaagggattacagcacttcaaatggatattaaaattgaaggtattacccctcaaattttggaagaagctcttgcgcaagctaaaaaagcacgctttgaaattcttgatgtccttcatggagctatcgcagagccacgtccacaattagcaccaacggcacctaagattgatatgataaaaatcgatgttgataagattaaagttgtcatcggtaaaggtggcgaaactatcgataaaatcatcgctgaaacaggtgttaagattgatattgatgaagaaggaaatgtatctatcttctctagtgatcaggctgctattgatcgtacgaaagacattattgcaagtttagtacgtgaagcaaaagtgggagaagtttaccatgctaaagtagttcgtatcgagaaattcggtgcctttgtcaacctctttgataaaacagatgcattggtacatatttcagaaattgcatggacacgtacagcaaatgtagctgatgttcttgaaattggtgaagaagttgatgtgaaagtcatcaaaattgatgataaagggcgagttgatgcttctatgaaagcattgttaccacgtcctccaaaagctgacaatcctaaaaaggaatct

SEQ ID NO: 532 - protein, 713 aa, Streptococcus agalactiae
MENNMSKQVFEMIFAGKKLVVETGQVAKQANGSVVVRYGDSTVLTAAVMSKKMSTGDFFPLQVNYEEKMYAAGKFPGGFNKREGRPSTDATLTARLIDRPIRPMFAEGFRNEVQVINTVLSFDENASAPMAAMFGSSLALSISDIPFNGPIAGVQVAYVDGNFIINPTAQEQEASALELTVAGTKEAINMVESGAKELSEEIMLEALLKGHEAVCELIAFQEEIVTAIGKEKAEVELLQVDPELQAEIIATHNIALQAAVQVEEKKAREAATEAVKEVVIGEYEARYAEHEEYDRIMRDVAEILEQMEHAEVRRLITEDKIRPDGRRVDEIRPLDAEIDFLPQVHGSGLFTRGQTQALSVLTLAPMGEAQIIDGLTPEYKKRFMHHYNFPQYSVGETGRYGAAGRREIGHGALGERALEQVLPRLEEFPYAIRLVAEVLESNGSSSQASICAGTLALMAGGVPIKAPVAGIAMGLISDGTNYTVLTDIQGLEDHFGDMDFKVAGTREGITALQMDIKIEGITPQILEEALAQAKKARFEILDVLHGAIAEPRPQLAPTAPKIDMIKIDVDKIKVVIGKGGETIDKIIAETGVKIDIDEEGNVSIFSSDQAAIDRTKDIIASLVREAKVGEVYHAKVVRIEKFGAFVNLFDKTDALVHISEIAWTRTANVADVLEIGEEVDVKVIKIDDKGRVDASMKALLPRPPKADNPKKES

SEQ ID NO: 533 - DNA, 2130 bp, Streptococcus pyogenes
atgtcaaaacaaacctttacaacaacatttgcagggaaaccccttgttgttgaagttggtcaagtcgctaagcaagccaatggggcaaccgttgttcgttatggcgactcaactgtcctgaccgcagctgttatgtctaagaaaatggcaacgggtgatttcttcccccttcaagttaattacgaagaaaaaatgtatgccgctggtaaattcccaggaggtttcatgaaacgtgagggacgcccttcaacagatgcgaccttgacagctcgcttgattgaccgcccgattcgtcccatgtttgccgaaggttttcgtaacgaagtacaagtgattaacactgtcctttcttatgatgaaaatgctagcgctccaatggcagcgatgtttggctcatctctggccttgtcaatctcagatattccatttaatggaccgattgcaggtgttcaagttggctatattgatggcgagttcatcattaacccagataaagaacagatggaagcatcactcttagaattaactgttgctggtagcaaagaagccatcaatatggttgagtctggtgccaaagaattatcagaagacatcatgcttgaggctcttttaaaaggtcaccaagctattcaagaattaattgccttccaagaacaaatcgtagcagttgttggtaaagaaaaagctgaggttgaactgttacaggttgatgtagacttacaagctgatattgtggctaagtacaatgctcaactgcaaaaagctgttcaagttgaagagaaaaaagcgcgtgaagcagccacagaagccgttaaagaaatggttaaggctgaatacgaagagcgttacgcagaagacgaaaacctagcaaccattatgcgtgacgtggcagaaatccttgaacaaatggagcatgctgaggtgcgccgcctcattacagaagacaagattcgtcctgatggtcgtaagattgacgaaattcgtccgcttgatgctgtggttgacttcttgccaaaagtacatggatcaggtctttttacgcgcggtcaaacgcaggccttgtcagttttgactttggcaccaatgggagaaactcaaatcattgatggtctggccccagagtacaaaaaacgctttttgcatcactacaatttcccgcaatattcagttggtgaaacgggtcgttacggagctgctggtcgtcgtgaaattggacacggtgccttaggtgaacgcgctcttgaacaagtcttgccaagcttagaagagtttccttatgctattcgtttagttgccgaagttctagaatctaacggttcgtcttctcaggcttctatctgtgctgggacccttgccctaatggctggtggtgtgccgattaaagcgcctgtggcagggattgccatgggtctcatttccgatgggacgaattatacagtcttgaccgatatccaaggtcttgaagaccactttggagatatggactttaaagtggcaggaactcgtgaagggattacagcccttcaaatggatattaagattgcaggaattacccctcaaatcctagaagaagctcttgcacaagctaaaaaagctcgctttgaaatccttgatgtgattgaagcaactatcgctgaaccacgtcctgagttagccccaactgcaccgaaaattgacaccatcaagattgacgtagacaaaatcaaagtggttatcggtaaaggtggcgaaactattgacaagattattgccgaaacgggtgtcaaaattgatattgatgacgaaggaaatgtctctatctactcaagtgaccaagctgccattgaccgcactaaagaaattattgcaggtcttgttcgtgaagctaaggtaggcgaagtttaccatgctaaggttgtccgtattgagaaatttggtgcctttgtcaacctctttgacaagacagatgctcttgttcacatttctgaaattgcctggacgagaacgaccaacgtgtcagatgtccttgaagtgggtgaagacgttgatgttaaggtcattaagattgatgagaagggtcgtgtggatgcctcaatgaaagctttgattccacgcccaccaaaaccagagaaaaaagaagaaaaacatgac

SEQ ID NO: 534 - protein, 710 aa, Streptococcus pyogenes
MSKQTFTTTFAGKPLVVEVGQVAKQANGATVVRYGDSTVLTAAVMSKKMATGDFFPLQVNYEEKMYAAGKFPGGFMKREGRPSTDATLTARLIDRPIRPMFAEGFRNEVQVINTVLSYDENASAPMAAMFGSSLALSISDIPFNGPIAGVQVGYIDGEFIINPDKEQMEASLLELTVAGSKEAINMVESGAKELSEDIMLEALLKGHQAIQELIAFQEQIVAVVGKEKAEVELLQVDVDLQADIVAKYNAQLQKAVQVEEKKAREAATEAVKEMVKAEYEERYAEDENLATIMRDVAEILEQMEHAEVRRLITEDKIRPDGRKIDEIRPLDAVVDFLPKVHGSGLFTRGQTQALSVLTLAPMGETQIIDGLAPEYKKRFLHHYNFPQYSVGETGRYGAAGRREIGHGALGERALEQVLPSLEEFPYAIRLVAEVLESNGSSSQASICAGTLALMAGGVPIKAPVAGIAMGLISDGTNYTVLTDIQGLEDHFGDMDFKVAGTREGITALQMDIKIAGITPQILEEALAQAKKARFEILDVIEATIAEPRPELAPTAPKIDTIKIDVDKIKVVIGKGGETIDKIIAETGVKIDIDDEGNVSIYSSDQAAIDRTKEIIAGLVREAKVGEVYHAKVVRIEKFGAFVNLFDKTDALVHISEIAWTRTTNVSDVLEVGEDVDVKVIKIDEKGRVDASMKALIPRPPKPEKKEEKHD

SEQ ID NO: 535 - DNA, 750 bp, Streptococcus agalactiae
atgacaagtacaaacgagttagacattagattgcgtgcttttatcaatgcaccggataattttttagatagtataggtcttgtgaatgccttgcaccactctacggtttgggcaagcaaggaaccctatgctattcaagtagatggtcaagaagttgttcctgtttttacggatattactgaccttaatcatttcaaagaggagcaagaaagtgctcgagatatgttttgggagagtcgtcgtagtttagacgttcttgatgaagctatttcacatggcttagcaggattggtctataatttaaaaaaagaaggcgattttgggaactcgactattttctactgtgaagatatggtgcaatttatgaataattacaccacaatcttaaatcagttgttaaatgaagataacattgttgccgatatcatggataaaacctacttggtacctgcctttgtccatccacgtgaagaaggtagttttgaccgtcttttccctacaatgtctacccccgaaggaaaaagttatgttccagtattctcaaaccttttaagttttgaaaaatggtataaccataatgattttggtggtgcttttaggaaagcacaaggagtaattttagcctggacgattgacgatatttataaaccgcgtaatggagaaaatgagattgatgatacctttggagtagccatcaatccatttgatgaacaacaagttttagttgattggtctgatgtagaaaacgat

SEQ ID NO: 536 - protein, 250 aa, Streptococcus agalactiae
MTSTNELDIRLRAFINAPDNFLDSIGLVNALHHSTVWASKEPYAIQVDGQEVVPVFTDITDLNHFKEEQESARDMFWESRRSLDVLDEAISHGLAGLVYNLKKEGDFGNSTIFYCEDMVQFMNNYTTILNQLLNEDNIVADIMDKTYLVPAFVHPREEGSFDRLFPTMSTPEGKSYVPVFSNLLSFEKWYNHNDFGGAFRKAQGVILAWTIDDIYKPRNGENEIDDTFGVAINPFDEQQVLVDWSDVEND

SEQ ID NO: 537 - DNA, 750 bp, Streptococcus pyogenes
atgactaaatcaaatgaattagatattcgcttaagagcttttatcaatgcgcctgataactttttggatagccttgcgcttgtcaacgctttccataattttcctgtctgggctgctaaagaaccctacgtgatagaagtcgaaggtgtcaaggttacccctgtttttaccgataaggaagatatggctcgctttaaagaagaacaaaagagtgctcaaagtcagtattggctggagcgttcagctcttgcagtgctagaagaagtcattacatctggtgcagcaggtcttatctttaaccttaagaaaaagggagattttgggaattctaccattttcaaaagcagtgatatgattcaatttatgaaccattacaccactgtgttaaatacgcttatgagtgatgacaatgtggcggcagatacgatggaaaaggtttaccttgttcctgcctttgtttatcctaaagataataaccattacgaccgcctttttcctaccatgtcaacgcctgaaggaaaaagctatgttcccgccttttcaaatcttcaaagctttgcgaaatggtacaaccaagacgattttggaggccttttcaggaaagctgaaggagtgattctgacttggacgattgatgatatttatcaaccaagaaatggtgaaaacgagcttgatgaaacgttcggtgtcgccatcaatccttttgatgaccaacaaattcttgttgattggtcagaattagataagtcg

SEQ ID NO: 538 - protein, 250 aa, Streptococcus pyogenes
MTKSNELDIRLRAFINAPDNFLDSLALVNAFHNFPVWAAKEPYVIEVEGVKVTPVFTDKEDMARFKEEQKSAQSQYWLERSALAVLEEVITSGAAGLIFNLKKKGDFGNSTIFKSSDMIQFMNHYTTVLNTLMSDDNVAADTMEKVYLVPAFVYPKDNNHYDRLFPTMSTPEGKSYVPAFSNLQSFAKWYNQDDFGGLFRKAEGVILTWTIDDIYQPRNGENELDETFGVAINPFDDQQILVDWSELDKS

SEQ ID NO: 539 - DNA, 594 bp, Streptococcus agalactiae
ttgaggataactatggggtggtggaaagaaagtatagctattgtcaaagaacaagatccagctgctcgtagttctctagaagttattttaacttatccaggaataaaagctcttgcagctcataggctatctcattttttatggaatcataattttaaattgttagcacgtatgcacagtcaattttggcgtttctggacacaaattgaaattcatcccggagcgacgatttcggaaggggtttttattgaccacggttcaggattggtcattggagaaactgccattgtagagaaaggtgctatgctataccatggggttacattgggtggcacaggtaaagacaaaggcaaacgacacccaaccatacgtaaaggagcgctaatttcagcacattctcaaatcattggtccaattgaggttggagaaaatgctaaagtcggtgctgcagcagttgtccttgcagatgtgccagcagacgtaacagtagttggtgttccagctaaagttgtccgtgtccatggtcaaaaggatgatcttcaaatccgaagtattgaacatgatcgagaagaaagttattattcgtccaaactt

SEQ ID NO: 540 - protein, 198 aa, Streptococcus agalactiae
MRITMGWWKESIAIVKEQDPAARSSLEVILTYPGIKALAAHRLSHFLWNHNFKLLARMHSQFWRFWTQIEIHPGATISEGVFIDHGSGLVIGETAIVEKGAMLYHGVTLGGTGKDKGKRHPTIRKGALISAHSQIIGPIEVGENAKVGAAAVVLADVPADVTVVGVPAKVVRVHGQKDDLQIRSIEHDREESYYSSKL

SEQ ID NO: 541 - DNA, 579 bp, Streptococcus pyogenes
atgggttggtggaaagaaagtatagctattgttaaagctctagacccagctgctcgtaatagtcttgaggttatcctaacttatccaggcatcaaagccctagctgctcatcgtttgtctcattttctttggcgacatcattttaaattactagccagaatgcatagccaattttggcgattttggacacaaattgaaatccatcctggagcacaaatcgctcctggagtcttcattgaccatggtgctggtcttgttattggagagacagcaattgttgaaaaaggtgtgatgctttatcatggggtgaccctaggtggaaccggaaaagattgtggcaagcgtcatccaacggttcgacaaggtgccttaatttcggcacatgcccaagtgattggacctattgacatcggagcaaatgctaaagtaggggcagcagctgttgtgttatcagatgttcctgaagacgtgacagttgtaggtgtgccagctaagatagtacgagtgcatgggcaaaaagataatcgtcaaattcaaagtttacaaaaacaacgagaggtctcttatcagttgtcaaaa

SEQ ID NO: 542 - protein, 193 aa, Streptococcus pyogenes
MGWWKESIAIVKALDPAARNSLEVILTYPGIKALAAHRLSHFLWRHHFKLLARMHSQFWRFWTQIEIHPGAQIAPGVFIDHGAGLVIGETAIVEKGVMLYHGVTLGGTGKDCGKRHPTVRQGALISAHAQVIGPIDIGANAKVGAAAVVLSDVPEDVTVVGVPAKIVRVHGQKDNRQIQSLQKQREVSYQLSK

SEQ ID NO: 543 - DNA, 180 bp, Streptococcus agalactiae
gtgaaggattatgtaacaactcaaatattatcaatcttaggtatactagcagcagcttgtttaagctatttaaagtttgcacaaggtaaccctctcttaggaattatttgggctgcttttgttttaatgtatgttgttcgtttgtataaagcttatcaaaaacagaaaaaggaaaaacca

SEQ ID NO: 544 - protein, 60 aa, Streptococcus agalactiae
MKDYVTTQILSILGILAAACLSYLKFAQGNPLLGIIWAAFVLMYVVRLYKAYQKQKKEKP

SEQ ID NO: 545 - DNA, 1341 bp, Streptococcus agalactiae
atgataaaaatttacgacactatgactcgcagtttacaagattttatacctctcaatgaaggtaaagtcaacatgtacgtctgtgggccaacagtttataactatatacacatcgggaatgcccgcagtgtagtagcttttgatactattcgtcgttattttgagtattgtggttaccaagtcaattatatttctaactttactgatgttgatgataaaattataaaaggtgcagctgaagcaggtatggatacaaaatccttttcagataagtttatttcagcatttatggaagatgttgctgcattaggtgtcaaacctgctacaaaaaatcctcgagttattgactatatggatgagattattgattttgttaaagttttagttgataaggaatttgcctatgaagctaatggagatgtttattttagagtaagtaaatcacatcattatgcaaaattagccaataaaactttggaagatttagagattggtgcaagtggtcgtgttgatggtgaaggagagattaaagagaatcctttagattttgcactttggaaatcagctaaatctggggaagtctcatgggaaagtccttgggggaaagggcgcccagggtggcatattgaatgttctgttatggcaactgagatccttggtgatactattgatatccatggtggaggagctgatttagaatttccacatcacacgaatgagattgcacaatctgaagctaaaacaggtaagacctttgcaaattactggatgcataatggttttgttaacgttgataacgagaaaatgtctaaatctcttggtaactttattactgttcacgatatgttgaagagcgttgacggacaagtaatacgttttttcttagcgacacaacagtatcgtaaacccgtgaatttcactgaaaaggccgttcatgatgcggaagttaaccttaaatatttaaaaaatactttcaacttaccaatccaagagaatgctaatgatgaagaattagagcaatttgtgaaagcatttcaaggagcgatggatgatgattttaatacagcaaacggtattactgttatctttgaaatggcaaaatggattaattcaggacactatacttcaagagttaaggaaacctttgctgaattattagaaatttttggtattgtattccaagaggaagttcttgatgctgatattgaatctttaatagaacaacgtcaagaagcacgagctaatcgtgattttgcaactgctgatcgtattagagatgaattagcaaaacaaggaattaaattgttagatactaaggatggcgtgaggtggactcgtgat

SEQ ID NO: 546 - protein, 447 aa, Streptococcus agalactiae
MIKIYDTMTRSLQDFIPLNEGKVNMYVCGPTVYNYIHIGNARSVVAFDTIRRYFEYCGYQVNYISNFTDVDDKIIKGAAEAGMDTKSFSDKFISAFMEDVAALGVKPATKNPRVIDYMDEIIDFVKVLVDKEFAYEANGDVYFRVSKSHHYAKLANKTLEDLEIGASGRVDGEGEIKENPLDFALWKSAKSGEVSWESPWGKGRPGWHIECSVMATEILGDTIDIHGGGADLEFPHHTNEIAQSEAKTGKTFANYWMHNGFVNVDNEKMSKSLGNFITVHDMLKSVDGQVIRFFLATQQYRKPVNFTEKAVHDAEVNLKYLKNTFNLPIQENANDEELEQFVKAFQGAMDDDFNTANGITVIFEMAKWINSGHYTSRVKETFAELLEIFGIVFQEEVLDADIESLIEQRQEARANRDFATADRIRDELAKQGIKLLDTKDGVRWTRD

SEQ ID NO: 547 - DNA, 1341 bp, Streptococcus pyogenes
atgattaaaatttatgataccatgacccgttcgctccgcaagtttgtacctttgactgaaaatacagtcaatatatacgtttgtggaccgacggtctataattatattcatattggaaatgctagatcagcggtcgcttttgacaccattcgacgttattttgagtatactggctatcaggtcaattacatttccaattttaccgatgtcgatgataaaattatcaaggctgctactcaagcaggtgtttctcctaaagaattgtcagatcgctttattgcagcttttatagaagataccaaggcacttggtgttaagccagccacacaaaatcctcgtgttatggattatatagcagaaatcatttcatttgttgaaagtctcattgaaaaagattttgcttacgaagcagatggagatgtgtatttccgcgtggaaaagtcagagcattatgccaagctagctaataaaaccctgtcagaacttgaagttggagccagtggtcgaacagatgctgagacagctttaaaagaaaatccactggactttgctctttggaaatcagctaaggcaggtgaggtttcttgggatagcccctgggggtttggtcgtccaggctggcacattgaatgttctgtgatggctactgaaattcttggtgataccattgatattcatggtggcggagctgatttggaatttcctcatcataccaatgaaattgcccaatctgaggccaaaacaggcaagacttttgctaactattggatgcacaatgggtttgtcactgttgataacgaaaaaatgtccaagtcactaggtaattttgtgaccgttcatgacatgttacaaaccgttgatggtcaggttttgcgattctttcttgcgacacaacagtaccgaaaaccaattaacttcactgaaaagactattcatgatgcggaaatcaatctgaagtatcttaaaaacaccttgcaacaaccgctgacagaaactgcagatgagcaagagctaaaacagtttgtaatagctttccaagacgctatggacgatgatttcaatacagcaaatgggattaccgtcgtatttgacatggccaagtggattaattctggctcctatacagaacctgttaaaagcgcttttgagaaaatgttagctgtttttggcattatctttgaagaagaggtgcttgaggttgacattgaagccttgattgccaagcgacaagaagcacgcgcgaatcgtgattttgccacagctgatgccattcgagatcagttagcagttcaaggcatcaagctgctagataccaaagatggtgtgaggtggctgcgtgac

SEQ ID NO: 548 - protein, 447 aa, Streptococcus pyogenes
MIKIYDTMTRSLRKFVPLTENTVNIYVCGPTVYNYIHIGNARSAVAFDTIRRYFEYTGYQVNYISNFTDVDDKIIKAATQAGVSPKELSDRFIAAFIEDTKALGVKPATQNPRVMDYIAEIISFVESLIEKDFAYEADGDVYFRVEKSEHYAKLANKTLSELEVGASGRTDAETALKENPLDFALWKSAKAGEVSWDSPWGFGRPGWHIECSVMATEILGDTIDIHGGGADLEFPHHTNEIAQSEAKTGKTFANYWMHNGFVTVDNEKMSKSLGNFVTVHDMLQTVDGQVLRFFLATQQYRKPINFTEKTIHDAEINLKYLKNTLQQPLTETADEQELKQFVIAFQDAMDDDFNTANGITVVFDMAKWINSGSYTEPVKSAFEKMLAVFGIIFEEEVLEVDIEALIAKRQEARANRDFATADAIRDQLAVQGIKLLDTKDGVRWLRD

SEQ ID NO: 549 - DNA, 384 bp, Streptococcus agalactiae
gtgattgatgttcgtttgattaatggtattgctttagcttttgaaggagatgcagtttattctttgtatatccgacgccatttaattatgcagggttttaccaaacctaatcagttacatcggaaagcaacccaatatgtttctgctaatgcccaagcattgttaattaatgccatgttagaagaaaatattttaactgatgaagagcagttaatttataaacgaggacgtaatgcgaatagtcatacaaaagctaaaaatgctgatattattacctatcgtatgtctacaggttttgaggctcttatggggtacttggatatgactggtcagataaagcgcttggaaactctaatacagtggtgtattgaaaccattgaaaaa

SEQ ID NO: 550 - protein, 128 aa, Streptococcus agalactiae
MIDVRLINGIALAFEGDAVYSLYIRRHLIMQGFTKPNQLHRKATQYVSANAQALLINAMLEENILTDEEQLIYKRGRNANSHTKAKNADIITYRMSTGFEALMGYLDMTGQIKRLETLIQWCIETIEK

SEQ ID NO: 551 - DNA, 411 bp, Streptococcus pyogenes
gtgactaatccagttgatgtgaatttgattaatggcattgccctagcctttgaaggggatgcggtttattcctactatgttcgtcgtcatctcatttttcaaggtaaaacgaaacctagccagctacaccgtttagcaacgagatatgtttctgctaaggcacaagccaacttgattcaggctatgttagaagcgcagctattgaccgaaaaagaagaagacatctataagcgtggtcgcaataccaatagccatactaaagctaagaatgccgatattattacctatcgtatgtcgacaggttttgaagccattatgggttatcttgatatgatgggccaaaaagagcggttagaagaattgatcagatggtgtattgagtatgtagaaaagcaacaattgatatcctca

SEQ ID NO: 552 - protein, 137 aa, Streptococcus pyogenes
VTNPVDVNLINGIALAFEGDAVYSYYVRRHLIFQGKTKPSQLHRLATRYVSAKAQANLIQAMLEAQLLTEKEEDIYKRGRNTNSHTKAKNADIITYRMSTGFEAIMGYLDMMGQKERLEELIRWCIEYVEKQQLISS

SEQ ID NO: 553 - DNA, 753 bp, Streptococcus agalactiae
atgactatgaaagataaacaatttaaagaagaatcaagtgaccttgtctatggcttacatgctgtgacagagagtttaagagctaatactggtaataaattatacttgcaagatgacttaagaggaaagaacgttgataaagtcaaagcactagcgactgaaaaaaaagtatccatttcctggactcctaaaaaaaccttatcagacatgacaaatggtggagttcaccaaggattcgttctaaaagtttcggaatttgcctatgcggatttatcagagataatgacaaaggcagagaatgaagaaaatcctctcattttaatccttgatggtctgaccgaccctcacaacctaggttctattctacgcacagctgatgcaaccaatgtaacaggtattatcatccccaaacatcgttctgttggagtgaccccagtggtttcaaagacatctacaggagctgttgaacatgttcctattgcaagggtaactaatctcagtcaaactttggatactttaaaagataaggagttctggatatttggcactgatatgaatgggacaccatcgcataagtggaataccaaaggtaaattagccctagttattggtaatgaaggaaaaggtatttctcataatatcaaaaagcaagtagatgaaatgattacaattcccatgaatggtcatgttcagagtttaaatgccagtgtcgcagccgctattttgatgtatgaagtatttagaaaccgccta

SEQ ID NO: 554 - protein, 251 aa, Streptococcus agalactiae
MTMKDKQFKEESSDLVYGLHAVTESLRANTGNKLYLQDDLRGKNVDKVKALATEKKVSISWTPKKTLSDMTNGGVHQGFVLKVSEFAYADLSEIMTKAENEENPLILILDGLTDPHNLGSILRTADATNVTGIIIPKHRSVGVTPVVSKTSTGAVEHVPIARVTNLSQTLDTLKDKEFWIFGTDMNGTPSHKWNTKGKLALVIGNEGKGISHNIKKQVDEMITIPMNGHVQSLNASVAAAILMYEVFRNRL

SEQ ID NO: 555 - DNA, 771 bp, Streptococcus pyogenes
ttgaagcattcatggtataataaactcatggaagataaagatactattgaaacaaacgatatcgtctatggtgttcatgccgttacagaaagccttcaagcaaatacaggaaataagctttatatccaagaggatttaagaggaaagaaagtggataacatcaaaagcttagcgacacaaaaaaaggtcgctatttcatggacgcctaaaaaaaccttgtcacaaatgactgatggagctgtgcatcaaggttttgttctgagagtatcagcttttgcctatactgatgttgatgagatcctcgaaatagcagagcaagaagcaaatcctttgattcttattttagatggtctgacagatcctcataatttaggatcgattttacggacagctgatgctacaaatgtatgtggagtgattattcctaaacatcgttctgttggtgtgactccagtggtttcaaagacgtctacaggtgctgttgaacatattccgatagcgagagtaactaaccttagtcaaactctagataaattgaaagcaagaggattctggatttttggcacagacatgaatggaacaccgtctgattgctggaacactaatggtaaacttgctttagtcattggtaacgaaggtaaaggcatctctaccaatatcaaaaagcaagttgatgaaatgattacgattcctatgaatggtcacgtacagagcttaaatgctagcgtagcggcagctattctcatgtatgaagttttccgaaataggcgc

SEQ ID NO: 556 - protein, 257 aa, Streptococcus pyogenes
LKHSWYNKLMEDKDTIETNDIVYGVHAVTESLQANTGNKLYIQEDLRGKKVDNIKSLATQKKVAISWTPKKTLSQMTDGAVHQGFVLRVSAFAYTDVDEILEIAEQEANPLILILDGLTDPHNLGSILRTADATNVCGVIIPKHRSVGVTPVVSKTSTGAVEHIPIARVTNLSQTLDKLKARGFWIFGTDMNGTPSDCWNTNGKLALVIGNEGKGISTNIKKQVDEMITIPMNGHVQSLNASVAAAILMYEVFRNRR

SEQ ID NO: 557 - DNA, 516 bp, Streptococcus agalactiae
atgaaaaaacattctatcttactcgttgatggctacaatatgattgctttttggaaagatactcgacagctttttaaaagcaatcgtttagaagaggcaagggaagtattacttagaaagctaaatcattacgcacatttcgaacacattgatattatttgtgtatttgatgcacagtatgttcctggtgtacgtcaacgttatgaccaatacaaaatatccgttatctttactgaggaggacgaaactgcggatagctatattgaacgagcagcggcagaacttaatcaatctgtgttaaatttagtctccgttgctaccagtgatttaaatgaacaatggactatattttctcagggtgctttacgtgtctcggctagagaattggaacagcgtgtagcgacagtaaaatcagatttggataagatgtccagtcaaatcgatttgagtacgccaaagttaaggccgtggaatgatgaacaactaggaaaactcaaggattttttagatggtatg

SEQ ID NO: 558 - protein, 172 aa, Streptococcus agalactiae
MKKHSILLVDGYNMIAFWKDTRQLFKSNRLEEAREVLLRKLNHYAHFEHIDIICVFDAQYVPGVRQRYDQYKISVIFTEEDETADSYIERAAAELNQSVLNLVSVATSDLNEQWTIFSQGALRVSARELEQRVATVKSDLDKMSSQIDLSTPKLRPWNDEQLGKLKDFLDGM

SEQ ID NO: 559 - DNA, 516 bp, Streptococcus pyogenes
atgaaaaaacggatattattagtagatgggtataatatgattgccttttggcaatcaacccgtcagttgtttaagacaaatcagcttgatcaggcacgtaacacacttttaacaaaacttaatcattatgcccattttgagaatattaatattatttgtgtttttgatgcccaatatgtaccggggttaaggcaacgatatgaccagtattatatctcagtggtatttacagaggaagacgaaacagcagatagctacattgagcgcatggcagcagagttaaatacggctatacatatggtagaagtagctacgagtgatttaaatgaacaatggacgattttttctcaaggagctcttcgtgtcactgcaagagaattagagcaaagagttcatactgtcaaagctgatttagataaaatgtctagagatattgatctcaaaacgcctaaactgcggccttttgaccaaggacagcttattcaattgaaggattttatgtctcagttagatcga

SEQ ID NO: 560 - protein, 172 aa, Streptococcus pyogenes
MKKRILLVDGYNMIAFWQSTRQLFKTNQLDQARNTLLTKLNHYAHFENINIICVFDAQYVPGLRQRYDQYYISVVFTEEDETADSYIERMAAELNTAIHMVEVATSDLNEQWTIFSQGALRVTARELEQRVHTVKADLDKMSRDIDLKTPKLRPFDQGQLIQLKDFMSQLDR

SEQ ID NO: 561 - DNA, 858 bp, Streptococcus agalactiae
atgacttttaaaatactaacggattcgacatcggatttagatgaaaagtgggctcaagagcacaatgtcgatattataggtttaaccattgaacttgatggaaagacttatgagacagtcggagacgaaaaaattactagtgacttcttgttggagcgtatgcaagagggagcaaagcctacaacaagccaaattaacgttggtcagtttgaagaagttttttcaacctatgcagaaaatgaccatgccttgttatatttagcgctatcttcacatttatcaggcacttaccagagtgcaactattgcgcgtgagatggtcttagacaaatatcctgatgctcaaattgagattgtggatacgatggcagcttcatgtggtgagggtgtcttagcgatgttagcaactaaagagcgacaagaaggtaaatctttagaagaagtgaaacaaaaaattgaatcacttctccctaaattaaacacatactttttagttgacgatctcaaccatttaatgcgtagtggtcgcttatcaaaaggtgcagctatcattggaagtgttgctaagattaaaccattacttaagttagatagtgagggtaaattagtaccatttgccaagacaaggggccgtaaaaaaggtattaaagagattgtgactcaggcaacaaaaacactatcttatagcactttaattattgcttatagtggagagaaagattcagctcaagttatgaaagaacagttattagcagatgagcgtattgaagaagttattattcgtccattagggccagttatttcagctcatgtgggctcaggtgctttagctctattctctttaggggaagaaaaccga

SEQ ID NO: 562 - protein, 286 aa, Streptococcus agalactiae
MTFKILTDSTSDLDEKWAQEHNVDIIGLTIELDGKTYETVGDEKITSDFLLERMQEGAKPTTSQINVGQFEEVFSTYAENDHALLYLALSSHLSGTYQSATIAREMVLDKYPDAQIEIVDTMAASCGEGVLAMLATKERQEGKSLEEVKQKIESLLPKLNTYFLVDDLNHLMRSGRLSKGAAIIGSVAKIKPLLKLDSEGKLVPFAKTRGRKKGIKEIVTQATKTLSYSTLIIAYSGEKDSAQVMKEQLLADERIEEVIIRPLGPVISAHVGSGALALFSLGEENR

SEQ ID NO: 563 - DNA, 858 bp, Streptococcus pyogenes
atgacctttacaataatgacagattcaaccgctgatttgaatcaaacctgggcagaagatcatgatattgtccttataggattaacgattttgtgcgatggagaggtttatgaaacggtcggtcctaaccgtattagtagtgattaccttttgaaaaagatgaaagctggcagtcatcctcaaaccagtcagattaatgtgggagagtttgagaaggtttttcgtgaacatgctaggaacaacaaagcactgctttatcttgctttttcttcggttttatcgggtacctatcaaagcgctctaatggcacgcgatcttgttcgagaagattatcccgatgcggtgattgaaattgttgataccttggctgctgcaggaggagaaggctatctaaccattttagcagcagaagccagagatagtggcaaaaatttactggagactaaagatattgttgaagcagtgatccctcgactgcgcacctatttcttagtagatgatctttttcatttgatgcgtggtgggcgtctgtcaaaaggttcagcttttctaggcagtttagccagtatcaaacctcttttgtggattgatgaggaagggaaattggtgcccattgcaaaaattcggggacgccaaaaagccatcaaagaaatggtggctcaagtggaaaaagatattgcggattcgacggttattgtctcttatacaagcgatcagggtagtgccgaaaagttacgagaagagctgctggcgcatgaaaatattagcgatgttcttatgatgccactaggaccagttatctcagctcacgttggtcctaacaccctggcagtttttgtgattgggcaaaattcccgt

SEQ ID NO: 564 - protein, 286 aa, Streptococcus pyogenes
MTFTIMTDSTADLNQTWAEDHDIVLIGLTILCDGEVYETVGPNRISSDYLLKKMKAGSHPQTSQINVGEFEKVFREHARNNKALLYLAFSSVLSGTYQSALMARDLVREDYPDAVIEIVDTLAAAGGEGYLTILAAEARDSGKNLLETKDIVEAVIPRLRTYFLVDDLFHLMRGGRLSKGSAFLGSLASIKPLLWIDEEGKLVPIAKIRGRQKAIKEMVAQVEKDIADSTVIVSYTSDQGSAEKLREELLAHENISDVLMMPLGPVISAHVGPNTLAVFVIGQNSR

SEQ ID NO: 565 - DNA, 201 bp, Streptococcus agalactiae
ttgttgatgaaagtttttggaaaatgtttttgttgctggcgcatttgccctcataggaataactattttattgatgcttttactaggaaggttgatattgctacttatttttcaaggggagatgatgcaattttagcagttataggaatatcattgatagctatgggaatttcagtgtactaccataagtataaggacaga

SEQ ID NO: 566 - protein, 67 aa, Streptococcus agalactiae
MLMKVFGKCFCCWRICPHRNNYFIDAFTRKVDIATYFSRGDDAILAVIGISLIAMGISVYYHKYKDR

SEQ ID NO: 567 - DNA, 543 bp, Streptococcus agalactiae
ttgtttaccccatttgtaaggccccggaacctttcaaatactctcgtggaccggaacatccacacctgtaaacaaaaacgaattcgtataggagaaatcatgaacaaaacaactttcatggctaaaccaggccaagttgaacgcaaatggtacgttgttgacgcagcagatgtacctcttggacgtctttctgcagtagttgctagcgtacttcgcggaaaaaacaaaccaactttcacaccacacactgatacaggtgactttgtgattgttatcaatgctgaaaaagttaaattaactggtaaaaaagcgtcagataaaatctactacactcactcaatgtatccaggtggtttgaaacaaatctcagcaggtgaacttcgttctaaaaatgctgttcgtttgattgaaaaatcagttaaaggcatgcttccacataacactcttggacgtgcacaaggtatgaaattgaaagtatttgttggcggtgagcatacacatgctgcacaacaaccagaagtacttgatatctcaggacttatc

SEQ ID NO: 568 - protein, 181 aa, Streptococcus agalactiae
MFTPFVRPRNLSNTLVDRNIHTCKQKRIRIGEIMNKTTFMAKPGQVERKWYVVDAADVPLGRLSAVVASVLRGKNKPTFTPHTDTGDFVIVINAEKVKLTGKKASDKIYYTHSMYPGGLKQISAGELRSKNAVRLIEKSVKGMLPHNTLGRAQGMKLKVFVGGEHTHAAQQPEVLDISGLI

SEQ ID NO: 569 - DNA, 549 bp, Streptococcus pyogenes
ttgtttaccccatttgaaaggccccggaaccttccaaataccttcgatgggacggaacacccatcaccttgtaaacaaatattacgaattcgtataggagaaatcatgaacaaaacaactttcatggctaaaccaggccaagttgaacgcaaatggtacgttgttgacgcagctgatgtgccacttggacgtctttctgcagtagttgctagcgtacttcgcggaaaaaacaaaccaactttcacaccacatactgatacaggtgattttgttatcgttatcaacgctgaaaaagttaaattaactggtaaaaaagcaactgataaagtttactacactcactcaatgtacccaggtggtttgaaatcaatcactgctggtgaacttcgctctaaaaacgcagttcgcttgattgaaaaatcagttaaaggcatgcttccacataacactcttggacgtgcacaaggtatgaaattgaaagtcttcgttggcggtgagcatactcacgcagcacaacaaccagaagtacttgacatctcaggacttatc

SEQ ID NO: 570 - protein, 183 aa, Streptococcus pyogenes
LFTPFERPRNLPNTFDGTEHPSPCKQILRIRIGEIMNKTTFMAKPGQVERKWYVVDAADVPLGRLSAVVASVLRGKNKPTFTPHTDTGDFVIVINAEKVKLTGKKATDKVYYTHSMYPGGLKSITAGELRSKNAVRLIEKSVKGMLPHNTLGRAQGMKLKVFVGGEHTHAAQQPEVLDISGLI

SEQ ID NO: 571 - DNA, 390 bp, Streptococcus agalactiae
atggcacaagcacaatatgcaggtactggtcgccgtaaaaacgctgttgcacgcgttcgtttggtcccaggtactggtaaaattacaatcaataaaaaagatgtagaagagtacatcccacacgcagaccttcgtcttgttatcaaccaacctttcgcagttacttcaactcaaggttcatacgatgtttttgttaacgttgtaggtggtggatatgcaggtcaatcaggtgcgatccgtcatggtatctcacgtgcacttttagaagttgacccagatttccgcgattcattgaaacgtgctggacttcttacacgtgacgcacgtatggttgaacgtaaaaaaccaggtcttaagaaagctcgtaaagctagtcagttctcaaagcgt

SEQ ID NO: 572 - protein, 130 aa, Streptococcus agalactiae
MAQAQYAGTGRRKNAVARVRLVPGTGKITINKKDVEEYIPHADLRLVINQPFAVTSTQGSYDVFVNVVGGGYAGQSGAIRHGISRALLEVDPDFRDSLKRAGLLTRDARMVERKKPGLKKARKASQFSKR

SEQ ID NO: 573 - DNA, 390 bp, Streptococcus pyogenes
atggcacaagcacaatatgcaggtactggccgtcgtaaaaacgctgttgcacgcgttcgtttggttccaggtactggtaaaatcactgttaacaaaaaagatgtagaagaatacatcccacatgctgacttacgtttgatcatcaaccaaccttttgcagttacatcaactgaaggttcatacgacgttttcgttaacgttgttggtggtggttacggtggacaatcaggtgcgatccgtcatggtatcgctcgtgcgcttcttcaagtagacccagacttccgcgattcattgaaacgcgctggccttcttacacgtgacgcacgtatggttgaacgtaaaaaaccaggtcttaagaaagctcgtaaagcttcacaattctcaaaacgt

SEQ ID NO: 574 - protein, 130 aa, Streptococcus pyogenes
MAQAQYAGTGRRKNAVARVRLVPGTGKITVNKKDVEEYIPHADLRLIINQPFAVTSTEGSYDVFVNVVGGGYGGQSGAIRHGIARALLQVDPDFRDSLKRAGLLTRDARMVERKKPGLKKARKASQFSKR

SEQ ID NO: 575 - DNA, 1152 bp, Streptococcus agalactiae
atgtccattcacaaatacccaagcaaaaaagccaaaaatggctatttgtattttgtcaaaatctatatggtcaaagacagtcaacgtgcagaccatatcaaacgtggctttcgtactcgaaaggaagccaaagactacgaagccagactcatttatcttaaggcttcaggaaagttggaagagttcatcaaaccaactcataaaacttataacgagatattcgagaaatggtatcaagcctatcaagatatggtagagccaacaactgcttcacgtactcttgatatgtttcgacttcacattctgccagttatgggagacttacccatcagcaaaatctcccctttagactgccagaacttcatcacagataaagcaaagacctttaagaatatcaagcaaatcaagtcctatactgggaaggtctttgattttgctatcaagatgaaactgcttaagcataaccctatggcagaaatcattatgccaaaacggaaaaagacacggatagaaaactattggacggttcaagaacttcaggagttcctagccattgtccttcaggaagagccttacaaacactatgcactatttagattactagcttacagtggcttaaggaaaggcgagctatacgctcttaagtgggcagatatagactttcaaactgagacactaagtgtcgataagagcttaggacgattagacggacaggcaatcgaaaaaggcactaaaaatgatttctcagtaagaaagattaagctagatagcgaaactatttctattctgcaagaatggaaatccatcagccaaaaagaaaaggcacaactagcagttgcacctctttctatcgagcaagattttctcttcacttattgtacacggtcaggctctattgagccactacatgcagactatatcaacaacgtcctatcacggattatcagaaaacacgggttaaagaaaatcagtcctcatggttttagacatactcatgctaccttgatgattgagattggagttgacccagtcaacacagcaaaaagactggggcatgcaagtagtcaaatgaccttagatacttacagtcattcgacaactactggagaagataggtcagtcaaacaatttgcggactatctaaaagcaaaa

SEQ ID NO: 576 - protein, 384 aa, Streptococcus agalactiae
MSIHKYPSKKAKNGYLYFVKIYMVKDSQRADHIKRGFRTRKEAKDYEARLIYLKASGKLEEFIKPTHKTYNEIFEKWYQAYQDMVEPTTASRTLDMFRLHILPVMGDLPISKISPLDCQNFITDKAKTFKNIKQIKSYTGKVFDFAIKMKLLKHNPMAEIIMPKRKKTRIENYWTVQELQEFLAIVLQEEPYKHYALFRLLAYSGLRKGELYALKWADIDFQTETLSVDKSLGRLDGQAIEKGTKNDFSVRKIKLDSETISILQEWKSISQKEKAQLAVAPLSIEQDFLFTYCTRSGSIEPLHADYINNVLSRIIRKHGLKKISPHGFRHTHATLMIEIGVDPVNTAKRLGHASSQMTLDTYSHSTTTGEDRSVKQFADYLKAK

SEQ ID NO: 577 - DNA, 1161 bp, Streptococcus pyogenes
atggaaaggtttatgatcatgaaaataacagaacataagaagaaaaacggtacaatcgtttatcgtgctagtatttatctaggcattgaccaaatgacaggtaagagagtaaaaacaagcatcacaggaagaacaagaaaagaagttaatcaaaaagccaagcacgcgcagtttgacttcctatctaatggatctacaattaaaagaaaagttgtgattaaaacatttaaagaacttagtcatttatggcttgaaacctataagttaacagtaaagcctcaaacttatgatgctactgttactagacttaatcgacatattatgccaactctgggcaatatgaaggttgataagataaccgctagtgatattcaaatgctgattaatagattatctaaatattacgtcaattatactgcggtacgttcagtcatccgaaaagttctccaacaaggagtattgctagggctaatagattataactcagcaagagatattatccttccaaggaagcagccaaacgctaagaaaaaagttaagtttattgatccgtctgatttgaaatcttttttagaacatttagaaactagtcaacacaaacgctataacctttactttgatgcagttctctaccaacttttattatccactggcttgaggataggcgaagcctgtgcattagagtggggagatattgacctagaaaatggtacaatagccattaataagacttacaataaaaatttgaagtttttgagtacagctaaaacccagtcaggcaatagagtgattagtgttgataaaaagacccttagaagcctaaagctctatcaaatgagacagcgacaattatttaatgaggttggtgcgcgtgtgtcggaggtagtgtttgccacaccaacacgaaagtattttaatgcttcggttagacaaagcgctttagatactaggtgtaaggaagcagggattgaacgctttacctttcacgcttttagacacactcacgctagtttattgctgaacgctggtattagttataaggaacttcagtaccgtctaggacatgcgaatatcagcatgactttggatacctatggccatctttctaagggcaaagaaaaagaagctgttttatattatgaaaaggctatgaataattta

SEQ ID NO: 578 - protein, 387 aa, Streptococcus pyogenes
MERFMIMKITEHKKKNGTIVYRASIYLGIDQMTGKRVKTSITGRTRKEVNQKAKHAQFDFLSNGSTIKRKVVIKTFKELSHLWLETYKLTVKPQTYDATVTRLNRHIMPTLGNMKVDKITASDIQMLINRLSKYYVNYTAVRSVIRKVLQQGVLLGLIDYNSARDIILPRKQPNAKKKVKFIDPSDLKSFLEHLETSQHKRYNLYFDAVLYQLLLSTGLRIGEACALEWGDIDLENGTIAINKTYNKNLKFLSTAKTQSGNRVISVDKKTLRSLKLYQMRQRQLFNEVGARVSEVVFATPTRKYFNASVRQSALDTRCKEAGIERFTFHAFRHTHASLLLNAGISYKELQYRLGHANISMTLDTYGHLSKGKEKEAVLYYEKAMNNL

SEQ ID NO: 579 - DNA, 474 bp, Streptococcus agalactiae
atgtacaatagactaaaagaactacgaaaagacaaagggttaactcaggctgatctagctaaagtcatcaatactaatcaatctcaatatggaaaatatgaaaacggaaaaactagtcttagcatagaaaattctaaaatattagctgattttttcggtgtatctatcccttacttactagggcttgataacaattcaaaaatagcaaattcaacaatcaaagatacaaatttattaagtttttttgaacaagtcaaaaaggatatgggtcaagattatttttctactcttgaaacccttgaaaaagttagcaaaaaaactcttttcaactctcccatacgtgacagacttgaggaaattaagcaagaaaaaatcaagcttaaccagaaaattgatgaacttgaagcagaggctaaaaatcttcgaaaaactcttgataaagaagtaaaagagagattagaacttttaaaaaaa

SEQ ID NO: 580 - protein, 158 aa, Streptococcus agalactiae
MYNRLKELRKDKGLTQADLAKVINTNQSQYGKYENGKTSLSIENSKILADFFGVSIPYLLGLDNNSKIANSTIKDTNLLSFFEQVKKDMGQDYFSTLETLEKVSKKTLFNSPIRDRLEEIKQEKIKLNQKIDELEAEAKNLRKTLDKEVKERLELLKK

SEQ ID NO: 581 - DNA, 216 bp, Streptococcus pyogenes
atgtatccgcgtattaggaatttgagagaagataacgatttcactcaaaagtttgttgcaaatttactttccttctctcatgcaaattatgcaaaaattgagagaggagaggttgccttaatggcagatgttcttgtgcagttttataaactctataacgtcagtattgattatttattagggcaaacagattatccgtatcgttttcataataaa

SEQ ID NO: 582 - protein, 72 aa, Streptococcus pyogenes
MYPRIRNLREDNDFTQKFVANLLSFSHANYAKIERGEVALMADVLVQFYKLYNVSIDYLLGQTDYPYRFHNK

SEQ ID NO: 583 - DNA, 303 bp, Streptococcus agalactiae
atggcttacacactagaagaacgagaaacgattgtccgttatgatgaaatggataactgttggtattttgagagtaatgttaggaaacacattactaaaatcatgaaaactattgatagttgtcagattttaggtcaagagaaagaagacgaccgcattatatggattcatgctaaattgacaaatcttgatgattatatggtttctccatttgttcgaaaacgagttaaacgtgaaatgactgaagaacaacgagaggaagcaagaaaaagaatggcaagattacattctaagtctgaaata

SEQ ID NO: 584 - protein, 101 aa, Streptococcus agalactiae
MAYTLEERETIVRYDEMDNCWYFESNVRKHITKIMKTIDSCQILGQEKEDDRIIWIHAKLTNLDDYMVSPFVRKRVKREMTEEQREEARKRMARLHSKSEI

SEQ ID NO: 585 - DNA, 276 bp, Streptococcus agalactiae
atgacagaaggatttaccattcagctccccaaagtaactgaaaagaagttactggctcgctatgacactatggttcaaaaagcaatagaaaaagcccttgaggacaaagagctatataagcctatggttcgtatggctggcttgtgccgttttttagatgtctcaacgacaactattgtcaaatggcaaaaggcaggcatgccacatatggttattgacggagtgactctgtacgataagcgcaaggtcgctcaatggctacaacaatttgaaaga

SEQ ID NO: 586 - protein, 92 aa, Streptococcus agalactiae
MTEGFTIQLPKVTEKKLLARYDTMVQKAIEKALEDKELYKPMVRMAGLCRFLDVSTTTIVKWQKAGMPHMVIDGVTLYDKRKVAQWLQQFER

SEQ ID NO: 587 - DNA, 249 bp, Streptococcus agalactiae
ttgaaagataggaaatttggcatggataaaaataatttagaagacttgacaggaaaaaagatacttagaaatggttttggtggtcttcgtttggaatatgggacaatctttcttgatgttggattgttcacttatattgtgctgatactatcaatatttttctttttagttgaacgttggtttttgggagctttaacttttgtgttgcatgttcccttgcttctacttgggatatggtgtggagagaga

SEQ ID NO: 588 - protein, 83 aa, Streptococcus agalactiae
MKDRKFGMDKNNLEDLTGKKILRNGFGGLRLEYGTIFLDVGLFTYIVLILSIFFFLVERWFLGALTFVLHVPLLLLGIWCGER

SEQ ID NO: 589 - DNA, 627 bp, Streptococcus agalactiae
atgataaagatttattttggaaaagatataacacttaaccaagctattcagtcgcgattggatagctatcagattgactatcaagcattctcaagcaaagatatagatgctaaaacactgatggaatggctattcaggtcgaccgatatatttgaattactaagcactaagatgttgaaatacaagctgaatacacaaattaccctcagtcaatttgttcgaaagattttaaaagatgtcaatagcaccttgaagcttcccattgttgtgacagatgaggttatttattcgaacatgtcccctgactatgtgacagtactcttgccaaaagaatatcggaaaattaaaagaattcagctgatgaggaagatggagcagttagatgagggacgtctattctggaaaaactttgagtcactacgtaagcaatctgagctacgttggtttgaactgaatgagttactgtttgctgatatgtccgacgatttaggagaaatcaaaaaagctaaagaccgtttctttagctacaagaaaaataaacaggttccgcctgatgacattatcgaaaaaatcctcaagatatttttggttgaccgagaagactttttcaaaaaatctgtgttggat

SEQ ID NO: 590 - protein, 209 aa, Streptococcus agalactiae
MIKIYFGKDITLNQAIQSRLDSYQIDYQAFSSKDIDAKTLMEWLFRSTDIFELLSTKMLKYKLNTQITLSQFVRKILKDVNSTLKLPIVVTDEVIYSNMSPDYVTVLLPKEYRKIKRIQLMRKMEQLDEGRLFWKNFESLRKQSELRWFELNELLFADMSDDLGEIKKAKDRFFSYKKNKQVPPDDIIEKILKIFLVDREDFFKKSVLD

SEQ ID NO: 591 - DNA, 1062 bp, Streptococcus agalactiae
atgtgcacatctgaagtgcatttactacacccgttttttggcaagtttggctggagcaaaatgaaaatggtccgactccgaaggggtcggcttggggctactcccccaagaatgtcattttacgtaggcctttgcgcagacaaaaaaatcggcgccgttaggcgaccgccaaaaagaaaggaggtttgtttgaaattaaaagtcagcttagacaatatcactatgacagcctatatcaaatctaaaaagtatttagctatgaaacaactcatagaaacccatttagctattactgttcaaactgcgatgactgacatgtttcgagccaccactggggatggaatccacgttgtgctccatatgaattatgacaaacaaaaaggacaagaccgcaaggctcgtccatttcgcttggagtttaatcccaataaactccgtttagttgacagtgaaattatagatactattataccatttcttgaagatatttcaatatcacgtgctgatttagcttttgatctatttgaggttgattgtagtgagtttgtgctcgaaaaaaagggcagaccaaccgcaaccaaggaatttcgttctagtactggaacgttagaaacaaaatatctaggtgctccacgttctgaaaaacaagttaggctatataacaagaaaaaggaacaactccaaaatggtactgataaagataaagactttgcaagtcaatttaagcactggtggcgcttggaatttcaattaagaagccgttcaattgatgagatattcgaggttattgatactattatttttaaaccattcaatcttaaaggcttatctattgagacccaaatctatctaactgctcttattcacgataaaaatatctggaaaaaactccatagaaatacaagagcaagatacaaaaaaattttagaaactcatcaaacatcagatactgattatttaggtttgctgaaagacttgttgaagcatgaaagaccaagactagaaaatcagctcgcttattatgggggtaggatagacaaaaatagctttcaacccttttgt

SEQ ID NO: 592 - protein, 354 aa, Streptococcus agalactiae
MCTSEVHLLHPFFGKFGWSKMKMVRLRRGRLGATPPRMSFYVGLCADKKIGAVRRPPKRKEVCLKLKVSLDNITMTAYIKSKKYLAMKQLIETHLAITVQTAMTDMFRATTGDGIHVVLHMNYDKQKGQDRKARPFRLEFNPNKLRLVDSEIIDTIIPFLEDISISRADLAFDLFEVDCSEFVLEKKGRPTATKEFRSSTGTLETKYLGAPRSEKQVRLYNKKKEQLQNGTDKDKDFASQFKHWWRLEFQLRSRSIDEIFEVIDTIIFKPFNLKGLSIETQIYLTALIHDKNIWKKLHRNTRARYKKILETHQTSDTDYLGLLKDLLKHERPRLENQLAYYGGRIDKNSFQPFC

SEQ ID NO: 593 - DNA, 474 bp, Streptococcus agalactiae
ttgttgaaaattcagtattatcaaggagttacgaggtcaaaaatgagaataaaagattatgctgatagtctaggagttagtagccaatctatctataaacgcatacgctctccaaaatataaagaaaggttgaaaggtcatttataccgagacaaccaaaaggttgaaaatcttgatttgataggcattaaaatacttgaagattatcattttgagaatgatgtcattgaactggaaaaaacgctgggtgatattcaagaagaattcgagcaagaaaagaagggaatgcaatatcggatagatagactagctgataagttaactcctttacttgaggataaccaaaacttggtacaaaaaaattatgagttactcaactatgttcggagcttggaacgacagaagctattgctgattattgctttagctgtcatggtaatcactttattagtggcaatatggcttgccatcttt

SEQ ID NO: 594 - protein, 158 aa, Streptococcus agalactiae
MLKIQYYQGVTRSKMRIKDYADSLGVSSQSIYKRIRSPKYKERLKGHLYRDNQKVENLDLIGIKILEDYHFENDVIELEKTLGDIQEEFEQEKKGMQYRIDRLADKLTPLLEDNQNLVQKNYELLNYVRSLERQKLLLIIALAVMVITLLVAIWLAIF

SEQ ID NO: 595 - DNA, 1254 bp, Streptococcus agalactiae
atgagttatgttgttgctagaatggctaagtacaagtcaggtcagttgacggctatttataatcataatgaacggatttttaaaaatcactcaaataaagaaattgacgttgagaaatctcaccttaattatgaactgacaaatcgagaccaggcacaaaattatcacaaacaaataaaggagcacatcaatgaaaatcgcttatctactcgtggagtccgtaaagatgctatactctgtaacgaatggattattacttcagataaaacgttttttgactcgttagatgagaaacagacacgagagttttttgagacagctaaagattattttgctgaaaaatatggtgatgctaatattgcttacgctagagttcaccttgatgaaagtactccgcatatgcatttaggtatcgtgccaatgaaaaatggtaagttaagttcaaaagcactgtttggaaataaagagaaacttgtagcaatccaagatgaacttcccaagtaccttaatgagcatggctttaacctacaacgtggcgaaataggcagtaagaaaaaacatttggaaactgctgaatttaaagaaaaacaacgattactggataacgctgatagaaaactagctgataaacatgaagaattgaaagcacttgatgataagatttcaaatgttaacgatacaatagctgataaagaaagtaggcttaaagaattggaagcgaaagaatgggatgctgttggcgatttgaagcagtatgaattagagaaacagtcactagctgaaagcattgaagacataaaagacattgaactattacaacttgatagaattcaaaaagaagatttggtaaaacaaagctttgatggcaaattgaagatggataaagaaacctataatagactatttcaaactgcttcgaaacatgcatctagtaatgctgagttaaaaagagacttggttaaagcccagtcgcagaacaatcacctttctagagaattactcaatcaccgtaagacagctgaaaaaaatatcaaattaagtcaagaaaacagaaaattaaaggacaaagtaaaaatgcttgatgaacaagtgaaaattctgaataaaagcctctctgtttggaaagaaaaagctaaagaatttatgcctaaacaggtttatagagaaacattatcaatcataaacactctaaatcctattggtttagctaaaacagcaatcagacaagttaagaagatggttgatagtaatagt

SEQ ID NO: 596 - protein, 418 aa, Streptococcus agalactiae
MSYVVARMAKYKSGQLTAIYNHNERIFKNHSNKEIDVEKSHLNYELTNRDQAQNYHKQIKEHINENRLSTRGVRKDAILCNEWIITSDKTFFDSLDEKQTREFFETAKDYFAEKYGDANIAYARVHLDESTPHMHLGIVPMKNGKLSSKALFGNKEKLVAIQDELPKYLNEHGFNLQRGEIGSKKKHLETAEFKEKQRLLDNADRKLADKHEELKALDDKISNVNDTIADKESRLKELEAKEWDAVGDLKQYELEKQSLAESIEDIKDIELLQLDRIQKEDLVKQSFDGKLKMDKETYNRLFQTASKHASSNAELKRDLVKAQSQNNHLSRELLNHRKTAEKNIKLSQENRKLKDKVKMLDEQVKILNKSLSVWKEKAKEFMPKQVYRETLSIINTLNPIGLAKTAIRQVKKMVDSNS

SEQ ID NO: 597 - DNA, 6177 bp, Streptococcus pyogenes
atgtttttaaaacaccaagatgtgaaacaaaaaaattggagaatgcgtaaggtcaaaaaagtctttgttagttcatgtatgcttttaacagtgggcctcggagttgccgtacctactggattcagccaatctaatggcgtgatggttgtaaaggctgcggaagtgccggcgacagatttatcacgtcaggcgtctgattcggagagggtagatgaatcgtctttattgcagaaagaaaacttatcagtagattcatttaaattagaaaatttaaatggatgggaagctgaaaatgatacagcaggtaatttggggaaatttaaagatccagatagttcgggctatcaaaatattttgacatcatctggaaagaatatcagtgtagctgttgctcccaaaggttcaggtaaaatgaacattaaagtaactaaaagatcaaattttcagggtggatattatgtaggtggtcttagaactcaaactccggtattgaagttaaatgatgtttatcgatattcttttacaactaaaaaattatcaggaaattcttcagagttcaaaacgagagttaagcccgttgaatctaataataaactagggaaagagcttgttattagggtggataataaaaatgtatctactaagcatgattggcttccagacatctctgatggaactcatactgtggacttcactggtcttgataaaaaattatctgttgctttcagattttctccaagacaaacttcgaatgttgtttacgaattttctaacataaatataaaaaacattagtcctgcatcagtgccggctattccttcgaaagttttagagggaaccagcgtcttgtcgggtactgcaatatcttctggagatacattagaaaaaagaaaatcgtttgatggcgatatcctaagagtttataaagatagcaaaatcattgctagaacagtaataaaaggcaataagtgggatgttaaactttcaaagcctcttattgcaggtgaaaaattagattttgagattttgcatccgagatctcaaaacgttagtaaaaaaatttcaaaacaagtcgaagctaaaccatttgatccagcttcctataaagaaaaagttatagccaaattaaagccggtttatgaagctactagtgaaaaaatcacaaatgatgcttggttggatgaaaatgcgaaggatttgcaaaaacaaaaattagaagaacaatatatttctggaaaagtagcgatatcagaggctggaactaaacaagaagctatagatgcagcatataataaatattcaagtcaaacagatccagactctcttcctagtcagtataaacaaggtaataaagaaaatgaacaagaaaaagggcgtcaagatttaatccagactcgtgatctgacgttgaaagccattcaagaagacaaatggctaacagagcaggagaaaacaattcaaaaagaagaagcattaaaagcttttgaaactggtatagaaagtgttaatcaaacagtatcattagaacagttgaagcaacggttaatagtgtataaagcttctgaaaaagattcagagaaaaaagaatatcctgagtcaattcctaatcagcatattccagggaaagaaaaagaagttaaagctgctaaacaagaagaacttaaaaaattacatgacacaactcttgaaaaaatcaatcaagataaatggttgacgccagaccaacaagctgaacagttaaaacaagcggaagttacttttaaaaaaggccaagaagcaattaaaagtgctcagactttaactcagcttgagacagacttagctgattatgtttctgagaatgaaggtaagggaaattctattcccgataaatacaaatctggcaataaagatgatttggtaaataaggctgaagttaaacttaaggaagctcacgaagctactaaacaagcaattgaaaaagatccatggttgagtccggaacagaaaaaagctcaaaaagaaaaagccaaagcaagactagatgagggcttgaaagctcttaaagctgcagatagtttagagattcttaaagtgacagaagaagctttcgttgataaagaaaaaaatccagattcaattccaaatcaacataaagctggaactgctgatcaagctagaaaacaagctttagatagtttagataaggaggttcaaaaagagttagagtcaattgataacgataatactctaacaactgatgagaaagcagctgctaagaaaaaagtcaatgacgcttatgatgtagctaagcaaacagctatggaagccaattcttatgaagatttgactactattaaagatgagttcttatctaatttacctcataaacaaggaacgccgcttaaagatcaacaatctgatgctattgcagaattagagaagaagcagcaagaaattgaaaaagctattgagggtgataaaacattaccaagagacgaaaaagagaaacaaattgctgactctaaggaacgcttaaaatctgacacgcaaaaagttaaagatgctaaaaatgctgatgctattaaaaaagcatttgaagaagggaaagtgaatattcctcaagcacatatcccaggtgatttgaacaaggataaagaaaaacttcttgcagaattgaagcaaaaagcagatgatactgaaaaagctattgatgttgataaaactctgacagaagatgagaaaaaagagcaaaaagtcaaaacaaaagctgaacttgaaaaagctaaaactgatgttaaaaatactcagacacgtgaagaactagataaaaaagttccagaacttaagaaagctattgaagacactcacgttaaaggtaatcttgaaggtgttaagaataaggctattgaagatcttaaaaaagctcatactgaaacagttgctaaaataaatggtgatgatacccttgacaaagctactaaagaagctcaagtgaaagaagctgacaaagctttggcagcaggtaaagatgcgatcactaaagcagatgatgctgataaagtaagtacagctgttacagagcacacaccaaaaattaaagcagcacataaaactggtgaccttaaaaaagctcaagtagatgctaacacagctcttgacaaagcagctgaaaaagaacgtggagaaatcaataaagatgctacactaacgacagaagataaagcaaaacaactgaaagaagttgagacagctcttactaaagctaaagataacgtgaaagctgctaagacagcagacgctatcaatgacgcacgtgataaaggcgtagcaacaattgatgccgtccataaagcaggtcaagacttaggtgctcgtaagtcaggtcaagtcgctaaacttgaagaagcagctaaagcaacgaaagacaagatttcagctgatccaactttgacaagcaaagaaaaagaagagcaatctaaagctgttgacgctgaacttaagaaagcgatagaagctgttaacgcagctgacacagctgacaaggttgacgatgctcttggtgaaggtgttacagacatcaagaaccaacacaagtcaggtgactctatcgacgctcgtcgtgaggctcatggtaaggaacttgatagagtcgctcaagaaactaaaggtgcgattgaaaaagaccctactttgacgactgaagaaaaagctaaacaagttaaagacgtagatgccgctaaagaaagaggcatggctaagcttaatgaagctaaagatgctgatgctttagacaaagcttacggtgaaggtgttacagacatcaagaaccaacacaagtcaggtgaccctgtcgacgctcgtcgtggattacacaacaagtcaatcgacgaagtggcgcaagcaactaaggacgctatcacagcagatacgactttgactgaagctgaaaaagaaacacaacgtggcaatgttgataaagaagcaactaaagctaaagaagaacttgctaaggctaaagatgctgatgctttagacaaagcgtacggtgacggtgtaaccagcatcaagaaccaacacaagtcaggtaaaggtcttgacgttcgtaaagatgagcacaagaaagctcttgaagctgttgctaaacgtgtcactgctgaaattgaggctgatccaaccttaacaccagaagtgagagaacaacaaaaagcagaggttcaaaaagagcttgaacttgcgactgataagattgctgaagctaaagatgcagatgaagcagacaaagcttacggtgacggtgtcacagcgatcgaaaatgcccacgttattggtaaaggtatcgaagctcgtaaagaccttgctaagaaagaccttgctgaagctgctgctaagacaaaagctctcattattgaagacaaaacgcttactgatgatcaacgtaaagaacagttattaggtgttgatacagagtatgctaaaggtatcgagaatattgatgcagctaaggatgctgcaggtgttgataaagcatatagtgacggtgttcgtgacatcctggcacagtacaaagaaggtcaaaaccttaatgatcgtcgtaatgctgccaaagaatttcttcttaaagaagcagacaaagtgacgaaactaatcaatgatgatccaaccttgactcatgaccaaaaagttgatcaaatcaacaaagttgaacaagctaagttagacgcaatcaagtctgttgatgatgctcaaacagctgatgctatcaatgatgctcttggtaagggtattgaaaacatcaacaaccaataccaacatggcgatggcgttgatgttcgtaaagcgactgccaaaggcgatcttgaaaaagaagctgctaaagtgaaagctcttattgctaaggatccgaccttaactcaagctgataaagacaaacaaacagcagcggttgacgcagctaagaatacagcaattgcagcggttgataaagcgacaacaactgaaggcattaaccaagaacttggtaaaggcatcacagctatcaataaagcttaccgtccaggtgaaggtgttaaagcacgtaaagaagccgctaaagctgatcttgaaaaagaagctgctaaagtgaaagctcttattactaacgacccaaccttaacaaaagctgataaagctaaacaaacagaagctgttgctaaagcccttaaagctgctatcgcagcggttgataaagcgacaacagctgaaggcattaaccaagaacttggtaaaggcatcacagctatcaataaagcttaccgtccaggtgaaggtgttaaagcacgtaaagaagccgctaaggctgatcttgaaagagaagctgctaaggttcgtgaagctatcgctaacgacccaaccttaacaaaagctgataaagctaaacaaacagaagctgttgctaaagctcttaaagctgctatcgcagcggttgataaagcgacaacagctgaaggcattaaccaagaacttggtaaaggcatcacagctatcaacaaagcttaccgtccaggtgaaggtgttgaagcacataaagaagctgctaaagctaatcttgaaaaagtagctaaagaaactaaagctcttatttcaggagaccgttacttgagcgaaactgaaaaagcagtccaaaaacaagctgttgagcaagctcttgcgaaagcacttggtcaagttgaggctgctaagacagttgaagctgttaagttggcagaaaaccttggtactgtagctatccgttcagcatatgttgctggtttagctaaagatactgatcaagcaacagctgctcttaacgaagcgaaacaagctgctattgaagctcttaaacaagctgcggcagaaacacttgctaagattacaactgatgctaaattgactgaagctcaaaaagctgaacaatcagaaaatgtatcattagcgcttaagacggctattgcgactgttcgttcagcacaatctattgcgtctgtgaaagaagcaaaagataaaggtattactgctatccgtgcagcctatgtgcctaataaggcagtcgcaaaatcatcgtcagcgaaccatcttccaaaatcaggtgatgcaaactcaattgttcttgttggcttaggagttatgtctcttcttttaggtatggtgctttatagcaagaaaaaagaaagtaaagac

SEQ ID NO: 598 - protein, 2059 aa, Streptococcus pyogenes
MFLKHQDVKQKNWRMRKVKKVFVSSCMLLTVGLGVAVPTGFSQSNGVMVVKAAEVPATDLSRQASDSERVDESSLLQKENLSVDSFKLENLNGWEAENDTAGNLGKFKDPDSSGYQNILTSSGKNISVAVAPKGSGKMNIKVTKRSNFQGGYYVGGLRTQTPVLKLNDVYRYSFTTKKLSGNSSEFKTRVKPVESNNKLGKELVIRVDNKNVSTKHDWLPDISDGTHTVDFTGLDKKLSVAFRFSPRQTSNVVYEFSNINIKNISPASVPAIPSKVLEGTSVLSGTAISSGDTLEKRKSFDGDILRVYKDSKIIARTVIKGNKWDVKLSKPLIAGEKLDFEILHPRSQNVSKKISKQVEAKPFDPASYKEKVIAKLKPVYEATSEKITNDAWLDENAKDLQKQKLEEQYISGKVAISEAGTKQEAIDAAYNKYSSQTDPDSLPSQYKQGNKENEQEKGRQDLIQTRDLTLKAIQEDKWLTEQEKTIQKEEALKAFETGIESVNQTVSLEQLKQRLIVYKASEKDSEKKEYPESIPNQHIPGKEKEVKAAKQEELKKLHDTTLEKINQDKWLTPDQQAEQLKQAEVTFKKGQEAIKSAQTLTQLETDLADYVSENEGKGNSIPDKYKSGNKDDLVNKAEVKLKEAHEATKQAIEKDPWLSPEQKKAQKEKAKARLDEGLKALKAADSLEILKVTEEAFVDKEKNPDSIPNQHKAGTADQARKQALDSLDKEVQKELESIDNDNTLTTDEKAAAKKKVNDAYDVAKQTAMEANSYEDLTTIKDEFLSNLPHKQGTPLKDQQSDAIAELEKKQQEIEKAIEGDKTLPRDEKEKQIADSKERLKSDTQKVKDAKNADAIKKAFEEGKVNIPQAHIPGDLNKDKEKLLAELKQKADDTEKAIDVDKTLTEDEKKEQKVKTKAELEKAKTDVKNTQTREELDKKVPELKKAIEDTHVKGNLEGVKNKAIEDLKKAHTETVAKINGDDTLDKATKEAQVKEADKALAAGKDAITKADDADKVSTAVTEHTPKIKAAHKTGDLKKAQVDANTALDKAAEKERGEINKDATLTTEDKAKQLKEVETALTKAKDNVKAAKTADAINDARDKGVATIDAVHKAGQDLGARKSGQVAKLEEAAKATKDKISADPTLTSKEKEEQSKAVDAELKKAIEAVNAADTADKVDDALGEGVTDIKNQHKSGDSIDARREAHGKELDRVAQETKGAIEKDPTLTTEEKAKQVKDVDAAKERGMAKLNEAKDADALDKAYGEGVTDIKNQHKSGDPVDARRGLHNKSIDEVAQATKDAITADTTLTEAEKETQRGNVDKEATKAKEELAKAKDADALDKAYGDGVTSIKNQHKSGKGLDVRKDEHKKALEAVAKRVTAEIEADPTLTPEVREQQKAEVQKELELATDKIAEAKDADEADKAYGDGVTAIENAHVIGKGIEARKDLAKKDLAEAAAKTKALIIEDKTLTDDQRKEQLLGVDTEYAKGIENIDAAKDAAGVDKAYSDGVRDILAQYKEGQNLNDRRNAAKEFLLKEADKVTKLINDDPTLTHDQKVDQINKVEQAKLDAIKSVDDAQTADAINDALGKGIENINNQYQHGDGVDVRKATAKGDLEKEAAKVKALIAKDPTLTQADKDKQTAAVDAAKNTAIAAVDKATTTEGINQELGKGITAINKAYRPGEGVKARKEAAKADLEKEAAKVKALITNDPTLTKADKAKQTEAVAKALKAAIAAVDKATTAEGINQELGKGITAINKAYRPGEGVKARKEAAKADLEREAAKVREAIANDPTLTKADKAKQTEAVAKALKAAIAAVDKATTAEGINQELGKGITAINKAYRPGEGVEAHKEAAKANLEKVAKETKALISGDRYLSETEKAVQKQAVEQALAKALGQVEAAKTVEAVKLAENLGTVAIRSAYVAGLAKDTDQATAALNEAKQAAIEALKQAAAETLAKITTDAKLTEAQKAEQSENVSLALKTAIATVRSAQSIASVKEAKDKGITAIRAAYVPNKAVAKSSSANHLPKSGDANSIVLVGLGVMSLLLGMVLYSKKKESKD

SEQ ID NO: 599 - DNA, 468 bp, Streptococcus agalactiae
atgacagataaaaaaattgtttattactttgaccatgacttatcaaaaaaagatatgggaggagtaggacctacctacaccggtaaaaatcttttattcctactttggtggacatattcttatgtggcagaagacaatttagacattgatacgtcattgtttgaagtcccagaattcaatgatttttacaataatggtctagagctttatcgtataaaaaatgaactagctaattacaatatcagatttggatatgaggttaatccaaaagatagtacaaagatgctgataggtattttgccaactgatgaagaagattatgttaagggatatagaaattttattgctgatatttccaatcctgacacacgttacgcaatctatcatcgactaattaaaaccatggacacaatgctaccgattgaacaaattaatgtttataaaagccttgcaaaaggtaataaaaag

SEQ ID NO: 600 - protein, 156 aa, Streptococcus agalactiae
MTDKKIVYYFDHDLSKKDMGGVGPTYTGKNLLFLLWWTYSYVAEDNLDIDTSLFEVPEFNDFYNNGLELYRIKNELANYNIRFGYEVNPKDSTKMLIGILPTDEEDYVKGYRNFIADISNPDTRYAIYHRLIKTMDTMLPIEQINVYKSLAKGNKK

SEQ ID NO: 601 - DNA, 333 bp, Streptococcus agalactiae
ttggactataagaaatatcagattatctatgctcctgatgttttagagaagttaaaggaaattcgtgattatatttctcaaaactattcctcgacatcaggtcagcacaaaatggagcaaatcattagtgacatagaaaaactcgaggttttccctgaagttggttttgatgccgatgaaaaatatggttcaaaaatcagtaagtaccacagcactagaggttataccttaagtaaagattatattgtcctataccatatcgaggaggaagagaatagggtcgttattgattacttgcttcctactcgaagcgactatatgaaattgtttaaa

SEQ ID NO: 602 - protein, 111 aa, Streptococcus agalactiae
MDYKKYQIIYAPDVLEKLKEIRDYISQNYSSTSGQHKMEQIISDIEKLEVFPEVGFDADEKYGSKISKYHSTRGYTLSKDYIVLYHIEEEENRVVIDYLLPTRSDYMKLFK

SEQ ID NO: 603 - DNA, 333 bp, Streptococcus pyogenes
ttggactataagaaatatcagattatctatgctcctgatgttttagagaagctaaaagaaattcgtgattatatttctcaaaactattcctcaacatcaggtcagcgtaaaatggagcaaatcattagcgacatagaaaaactcgaggttttcccagaagttggttttgatgccgatgaaaaatatggttcaaaaatcatccattatcacagcactaaaggttataccttaagtaaagattatattgtcctataccatatcgagggggaagaaaataggatcgttattgattacttgcttcctactcaaagcgactatataaagttattcaaa

SEQ ID NO: 604 - protein, 111 aa, Streptococcus pyogenes
LDYKKYQIIYAPDVLEKLKEIRDYISQNYSSTSGQRKMEQIISDIEKLEVFPEVGFDADEKYGSKIIHYHSTKGYTLSKDYIVLYHIEGEENRIVIDYLLPTQSDYIKLFK

SEQ ID NO: 605 - DNA, 285 bp, Streptococcus agalactiae
atggttacagcagaaaaaaatagagctgtcacattccaagctaacaaagaattggtaagcgaagcaatgacagtattaaacaagaaaaatttaaccttatcatctgctttaagattattccttcaaaatgtcgttgtcacaaatgaggttgacttattgacggaagaggagctagagaaagaaaaacttttcaagcaatttcaagctgaaatcaacaaaaatattgaagatgttcgtcaagggaaattttatacctctgaagaagtgaggtctgaacttggacta

SEQ ID NO: 606 - protein, 95 aa, Streptococcus agalactiae
MVTAEKNRAVTFQANKELVSEAMTVLNKKNLTLSSALRLFLQNVVVTNEVDLLTEEELEKEKLFKQFQAEINKNIEDVRQGKFYTSEEVRSELGL

SEQ ID NO: 607 - DNA, 285 bp, Streptococcus pyogenes
atgactacagtaaaaaaaaacagagcggttacctttcaagctaataaagaattggtaagcgaagcaatgacagtattaaacaaaaaaaatttaaccttatcatctgctttaagattattcctacaaaatgtcgttgtcacaaacgaggttgacttattgacggaagaggagttagagaaagaaaaacttttcaagcaatttcaagctgaaatcaacaaaaatattgaggatgttcgtcaagggaagttttatacctctgaggaagtgagggctgaacttggacta

SEQ ID NO: 608 - protein, 95 aa, Streptococcus pyogenes
MTTVKKNRAVTFQANKELVSEAMTVLNKKNLTLSSALRLFLQNVVVTNEVDLLTEEELEKEKLFKQFQAEINKNIEDVRQGKFYTSEEVRAELGL

SEQ ID NO: 609 - DNA, 291 bp, Streptococcus agalactiae
atgatgtcacaaattaaactaacacctgaagaactccgtatttcagcacaaaaatatacaacaggatcacaatcaattacagatgtgttaacagttttgactcaagaacaagctgttattgatgaaaattgggatggtacagcatttgatagctttgaagcccaattcaatgaattatctccaaaaatcacacaatttgcacaattattagaagatataaatcaacaattattgaaagttgcggatgttgtcgaacaaacagactcagatattgcctcacaaattaataaa

SEQ ID NO: 610 - protein, 97 aa, Streptococcus agalactiae
MMSQIKLTPEELRISAQKYTTGSQSITDVLTVLTQEQAVIDENWDGTAFDSFEAQFNELSPKITQFAQLLEDINQQLLKVADVVEQTDSDIASQINK

SEQ ID NO: 611 - DNA, 558 bp, Streptococcus agalactiae
atggtatttacatataccgagaaagaacttcgtgaattcaatattggagataatgtatattcagttaaccccgattatgcagaaaaaaatcattcaactgtcataacggatttaccccagaaagataacgaaacaaatattattacaacagaagatagaaaaaaatttaaggtattaaaaacttctcctgacgatatgtctggctatcagggtatggcagttgcaccaattatcaagggtaaagtagattataacagtgttgcagttatatccgccgcaacggattcaagtaattataaagatttaattggcgcagtttcatctgctcaaccacatcaaagttcgactcagttaaaatcagctgataaatttttaaaagacgtacagtcacatgacaaatggactgtgactcagctttcaggctattctcaatctgcatatatgttaaaattaggtgctcaatatcatatcccgactacagtatttaatggatggtttaggtatagcactttaaatgaagatgaaaaaaattcatggctaagcatcctgaatattttg

SEQ ID NO: 612 - protein, 186 aa, Streptococcus agalactiae
MVFTYTEKELREFNIGDNVYSVNPDYAEKNHSTVITDLPQKDNETNIITTEDRKKFKVLKTSPDDMSGYQGMAVAPIIKGKVDYNSVAVISAATDSSNYKDLIGAVSSAQPHQSSTQLKSADKFLKDVQSHDKWTVTQLSGYSQSAYMLKLGAQYHIPTTVFNGWFRYSTLNEDEKNSWLSILNIL

SEQ ID NO: 613 - DNA, 678 bp, Streptococcus agalactiae
atggctaagcatcctgaatattttgtgaattttcgacataaagaggataatgtaacttggtggaacgattttaataaactagatgataaagattatggtaccgtgaaatgggtaaatggtaaaagtcataaaatagagagttggaaatttactgatgatggtaagttaaaagatgaaaaaggtaacatcgtaaatcctaagtcaccagctgttcagtctgttctttatgaagaagttcattttcaaaaagctaaagctaaattaaaaaaatctggaggcaaacttagtcatagtgaaaaagtatatttagattctgaacaggctatatttattgctaacggtttaaccacggcatctcaaacagcttctgatgatatcaagaagaatgctgaattagttaaagaaaaagcatcagaactatttgcaaaaactaaagtgatgcctcctggtataacagatttaagtccggaagaattagctgatacatatagtgagggcggagttagagaggacaccatagtaacaccaattgaaactttctttgatgaaaaagttactaatgcacaagagattacaacttcatatattaatcttcaaaaacaaattgaatctggtgtccaaaaattgctagaagaggactccaaattagcaggagaatttaaggaatggtcacagtac

SEQ ID NO: 614 - protein, 226 aa, Streptococcus agalactiae
MAKHPEYFVNFRHKEDNVTWWNDFNKLDDKDYGTVKWVNGKSHKIESWKFTDDGKLKDEKGNIVNPKSPAVQSVLYEEVHFQKAKAKLKKSGGKLSHSEKVYLDSEQAIFIANGLTTASQTASDDIKKNAELVKEKASELFAKTKVMPPGITDLSPEELADTYSEGGVREDTIVTPIETFFDEKVTNAQEITTSYINLQKQIESGVQKLLEEDSKLAGEFKEWSQY

SEQ ID NO: 615 - DNA, 384 bp, Streptococcus agalactiae
atggtcacagtactagatcaaaatgaaaacaaaattaatagtctaaaaataaacctagggaaattggaagataattatcatcgcgaaaatatggagatagaagataaattatatagccttgaggataaaaagaacgagttagagacttatttacaagaagtctatgaagagacaagtcaccttttgagacaaaatgattcagatggttcgacttttatgagtttaaatcgaataattgaaagttatcaaatggaattaattgatgaatatgaaaactataaacagactatcattgtccaagaggaaaatagtcggacacagtttctaaaagaccgagtaaaattagaaaatgacatttctagtttagaaggaagaaaatactac

SEQ ID NO: 616 - protein, 128 aa, Streptococcus agalactiae
MVTVLDQNENKINSLKINLGKLEDNYHRENMEIEDKLYSLEDKKNELETYLQEVYEETSHLLRQNDSDGSTFMSLNRIIESYQMELIDEYENYKQTIIVQEENSRTQFLKDRVKLENDISSLEGRKYY

SEQ ID NO: 617 - DNA, 279 bp, Streptococcus agalactiae
atgagtttaataggcgctgtattgaaaggaaccaaagaagacaaagaattcaaaaagcaaattcaaagagctttagtaaggattgtctatgcccctgaaatagtagaagaagctgattctattaagatgacttatagtgacaagattgataatgtttctgagacggccaaatcatcaattaaaacgatagcaaatcaaatagattcaggacttgtaggacaatttggggaaaaagtaaaggcacaggtagatttaaataaaggtagttatgatgattta

SEQ ID NO: 618 - protein, 93 aa, Streptococcus agalactiae
MSLIGAVLKGTKEDKEFKKQIQRALVRIVYAPEIVEEADSIKMTYSDKIDNVSETAKSSIKTIANQIDSGLVGQFGEKVKAQVDLNKGSYDDL

SEQ ID NO: 619 - DNA, 96 bp, Streptococcus agalactiae
atgaaggataacaaagtttattatttacattttggtaaagcaatagataaaaatgaagctaaaaatgataagtatctcaatcaaattataaataat

SEQ ID NO: 620 - protein, 32 aa, Streptococcus agalactiae
MKDNKVYYLHFGKAIDKNEAKNDKYLNQIINN

SEQ ID NO: 621 - DNA, 105 bp, Streptococcus agalactiae
atgatggaggaattttgtatggtaagtactcaatatatgaaagtaaccttacgagaaaaattcccagataaattaacatatgttgatttagaagaacttgtgata

SEQ ID NO: 622 - protein, 35 aa, Streptococcus agalactiae
MMEEFCMVSTQYMKVTLREKFPDKLTYVDLEELVI

SEQ ID NO: 623 - DNA, 99 bp, Streptococcus agalactiae
gtgaatgtgactcctcaagaaaaatgtcggaagaagacctttgctttttgtcggattacctctttcaaaaggatagttgggaaattagtgactatattt

SEQ ID NO: 624 - protein, 33 aa, Streptococcus agalactiae
MNVTPQEKCRKKTFAFCRITSFKRIVGKLVTIF

SEQ ID NO: 625 - DNA, 858 bp, Streptococcus agalactiae
atgtttaaatatgtccctatttttagggaatttcgacttaatcgacagttttctcttaaacaggttgcttcaaatgaactttctgtttctcagttatcacgatttgagaggggtgaatcagatttatcattaacaaaatttttaggggctttagaggcaattgatttatcaattagcgaatttatggatagagtaaataaatatcaaaaatctgatcagatatctttaatgtctcagatggctcaatatcattatcaaagagacgtagctgggttagaaaagatgatttctgtggaagaaggtaaactaaaaaaggatagttcagatatacgttgtcgtttaaacatagttctttttagaggaatgatatgtgaatgtgactcctcaagaaaaatgtcggaagaagacctttgctttttgtcggattacctctttcaaaaggatagttgggaaattagtgactatattttgattggaaatctttaccggtattacaacacaaggcatatttgccaacttgttaaagaggttatcaatcaaaaggaatattatcgagatatttatacaaaccgcaatgttgtcgaagcaaccctcctaaatgtggtagagacactaatagaacggcgcgctctagaagaagcaacgttttttctagagaaagttgaagcacttttaaataatgagcggaatgcttatcaccgtattattttactctatgaaaaaggatttcttgcctatgctaaaggggatagtcgaggaatacaaagcatgaagcaagctattttttgcttccaagcaattggttctaaacatcatgttgaaaattttcaggaacactttaatagggtaacaagatta

SEQ ID NO: 626 - protein, 286 aa, Streptococcus agalactiae
MFKYVPIFREFRLNRQFSLKQVASNELSVSQLSRFERGESDLSLTKFLGALEAIDLSISEFMDRVNKYQKSDQISLMSQMAQYHYQRDVAGLEKMISVEEGKLKKDSSDIRCRLNIVLFRGMICECDSSRKMSEEDLCFLSDYLFQKDSWEISDYILIGNLYRYYNTRHICQLVKEVINQKEYYRDIYTNRNVVEATLLNVVETLIERRALEEATFFLEKVEALLNNERNAYHRIILLYEKGFLAYAKGDSRGIQSMKQAIFCFQAIGSKHHVENFQEHFNRVTRL

SEQ ID NO: 627 - DNA, 879 bp, Streptococcus pyogenes
gtgaaagtgggaaaaatggaaaaagaactcggaaaaaccttaaggcgattacgtaagggtaagcaggttagcatttcttttttagcagatgaatacctgtccaagtcacaaatttcaagatttgaacgaggggaatcagaaatcacctgcagtcgcttgcttaatcttttggataaactgaatattacgattgacgaatttgtttcggctcattccaagacgcatacgcattttttcacgctcttaagtcaggcgagaaaatgttatgctgagaaaaacgtggttaaattgaccaaactgttgaaggattatgcccataaagattatgaacgaacgatgattaaagctattcttttttctattgactcctcaattgcacctagtcaagaagaattgactcgcctcacagattatttatttaaagtggaacagtggggatattatgaaatcattcttctggggaattgctcgcgcttcatgaattacaataccctatttttattgactaaggaaatggtagcatcttttgcttattcggaacaaaataaaaccaataaaatgttagtgactcagttatccattaattgtctcattatcagtattgaccattcttgctttgaacatagtcgctatttgattaacaaaattgatcttttgctgcgagacgagctcaatttttatgaaaagactgttttcttatatgtgcatgggtattataaattaaagcaggaagaaatgtctggagaagaggacatgcggcaggccttgcagatttttaagtatcttggagaggactcattgtattatagttataaggaacattaccgtcaaatagtgctgggaggtaagggggatgaggactggtctgaggcagattta

SEQ ID NO: 628 - protein, 293 aa, Streptococcus pyogenes
VKVGKMEKELGKTLRRLRKGKQVSISFLADEYLSKSQISRFERGESEITCSRLLNLLDKLNITIDEFVSAHSKTHTHFFTLLSQARKCYAEKNVVKLTKLLKDYAHKDYERTMIKAILFSIDSSIAPSQEELTRLTDYLFKVEQWGYYEIILLGNCSRFMNYNTLFLLTKEMVASFAYSEQNKTNKMLVTQLSINCLIISIDHSCFEHSRYLINKIDLLLRDELNFYEKTVFLYVHGYYKLKQEEMSGEEDMRQALQIFKYLGEDSLYYSYKEHYRQIVLGGKGDEDWSEADL

SEQ ID NO: 629 - DNA, 1179 bp, Streptococcus agalactiae
atgaatattaatggtataaaattactatctagtcgagcagtcagtaaacttggtgatgtgttttatgattatggaaatagtacttggattgcttcgatgggtggtctaggacaaaagattttaggtatttatcagatagtagagttgttggtttctattgtcctcaacccttttggaggcgccttagctgatcgctttcaacgaagaaaaattttactaataacagatgctatctgtgctatcatgtgtttcttactttcttttattggagatgataaagtaatggtgtatggtctaatagttgctaatgctatcttagcggtttccaatgctttttcttctccggcttataaatcttatattcctgaaatagtagataaagctgatatcattacctataatgctaatctggaaaccattgtgcaaattattagtgtaagttcccctgttttaggtttccttatttttaataattttggtattaggattactttaattgttgatgcgattacttttttgatctctttcctgtttctttatgctattaaagtggaaagggtacagctttcaaaacaagaaaaggtagcgataaaaaatattttagctgatattgcagatggatttacttacatcaaaaaagaaaaagaaattatgttttttctaattattgctgctttattaaacactttcctagcaatgttcaattatcttttaccttttactaactccctattaaaaacttcaggtgcttatgcaacaatacttagtatatcagctatcggatcaattattggagcgcttattgctagaaaaattaaatctagtattaattctatgctatctatgctagtattcagtagtttgggagtcatagttatgggattcccatctctatttgaattaccgatatggataccttacagtggtagttttctttttaatagtcttctgacaatgtttaatattcattttttcagtcaggtacaaatcagggtcgatgaagcgtatatggggcgtgtgatgtcgactatatttactattgctattatgtttatgcctataggaacactatttatgactatcttttcatttgccttatcaaatgttagctttattgttataggatgtgccattgctatattgggaggattaggatttagctatagtaaaaaacaattt

SEQ ID NO: 630 - protein, 393 aa, Streptococcus agalactiae
MNINGIKLLSSRAVSKLGDVFYDYGNSTWIASMGGLGQKILGIYQIVELLVSIVLNPFGGALADRFQRRKILLITDAICAIMCFLLSFIGDDKVMVYGLIVANAILAVSNAFSSPAYKSYIPEIVDKADIITYNANLETIVQIISVSSPVLGFLIFNNFGIRITLIVDAITFLISFLFLYAIKVERVQLSKQEKVAIKNILADIADGFTYIKKEKEIMFFLIIAALLNTFLAMFNYLLPFTNSLLKTSGAYATILSISAIGSIIGALIARKIKSSINSMLSMLVFSSLGVIVMGFPSLFELPIWIPYSGSFLFNSLLTMFNIHFFSQVQIRVDEAYMGRVMSTIFTIAIMFMPIGTLFMTIFSFALSNVSFIVIGCAIAILGGLGFSYSKKQF

SEQ ID NO: 631 - DNA, 1206 bp, Streptococcus pyogenes
atgaacaataggaaaaaaaatattcaatatttagtgtatagtaaagttatatatcgaattggcgatgttatgtttgattttgctaacaatacttttcttgctgggcttaatccagcgtctctatcattagttgcagtatatcagtctctagaaagtgtcataggtgttctatttaatttatttggtggagtcattgcagacagtttcaagcggaaaaaaattattattactacaaatatcttatgtggcacagcttgcttagtactctcgttcctaacaaaagagcaatggttggtttatgccattgtactaactaatgttatcttggcatttatgagtgctttttctagtccatcctataaagcatttacaaaagaaattgttaaaaaagatagtatatcacaacttaattcattgctagagacaacaagtactgtaatcaaagtaacagttcctatggtagcaattttcttatataagctacttggtatacacggtgtattactattggatggactatcatttctaatagctgctttactaatttcctttattttacctgttaatgacgaagtggtgataaaggagaaggtgacaatcagagaaatatttaacgatttaaaaataggatttaaatacgtttacagccataagtccatctttattattaccgttctttctgcacttgttaatttttttctagccgcttataatttattgttgccctatagtaatcaaatgtttggagaaatttcaactggactttatggcacttttttaacagcagaagcaattggtggatttattggggcaatattaagtggttttgtgaataaagaattatcaagtatgagattgatattgtttctatctttatcaggactgatgttaatgttagctcccccattttatattatgtttcataatgcaattattttagctttgtcaccagctttattcagtttatttctttccatctttaatattcaatttttttctcttgtccagaaagatgttgataacgattttttagggagagtgtttggtattatctttacaataactattctttttatgcctattgggactggctttttctcggtggcattaaatcctaacaatagctttaatctttttattattggttcgtgcattactacattgtcattagtatttagaatattatttaaaaagtataatattcgt

SEQ ID NO: 632 - protein, 402 aa, Streptococcus pyogenes
MNNRKKNIQYLVYSKVIYRIGDVMFDFANNTFLAGLNPASLSLVAVYQSLESVIGVLFNLFGGVIADSFKRKKIIITTNILCGTACLVLSFLTKEQWLVYAIVLTNVILAFMSAFSSPSYKAFTKEIVKKDSISQLNSLLETTSTVIKVTVPMVAIFLYKLLGIHGVLLLDGLSFLIAALLISFILPVNDEVVIKEKVTIREIFNDLKIGFKYVYSHKSIFIITVLSALVNFFLAAYNLLLPYSNQMFGEISTGLYGTFLTAEAIGGFIGAILSGFVNKELSSMRLILFLSLSGLMLMLAPPFYIMFHNAIILALSPALFSLFLSIFNIQFFSLVQKDVDNDFLGRVFGIIFTITILFMPIGTGFFSVALNPNNSFNLFIIGSCITTLSLVFRILFKKYNIR

SEQ ID NO: 633 - DNA, 468 bp, Streptococcus agalactiae
atgggaatcgcaaatgtcatccaaaccattccttctttagctatgatctctatcattatgttaggtctagggctaggtattaaaacagtagttgcaactgtctttctttattctcttctgccaatcatcacaaatacttacactggtattagaaatgttgactccgacttactagatgctgctaaaggaatgggcatgactaagcgtcaacgtttatttatggttgagttaccactatctatttccgttatcatggctggacttagaaatgcccttgttgtagcaattggtattacagccattggtgctttcgtcgggggaggcggacttggagatatcatcataagaggaactaatgcaacaaatggtggtgctattatcttagcaggatctcttccaacagcccttatggcaattttctctgatttaatcctaggcggtatccaacgcatgcttgaaccaagaaaa

SEQ ID NO: 634 - protein, 156 aa, Streptococcus agalactiae
MGIANVIQTIPSLAMISIIMLGLGLGIKTVVATVFLYSLLPIITNTYTGIRNVDSDLLDAAKGMGMTKRQRLFMVELPLSISVIMAGLRNALVVAIGITAIGAFVGGGGLGDIIIRGTNATNGGAIILAGSLPTALMAIFSDLILGGIQRMLEPRK

SEQ ID NO: 635 - DNA, 1560 bp, Streptococcus pyogenes
atgcttttgtggtcaatttatttggaggtgatgagcatgcctagtttgtttgtaactttccaaaaccgttttaatgaatggctggcggctctgggggaacacctgcaaatttcccttttatctcttatgatcgccttgctaataggtgtgcctttagcagcccttctcagtcgcagcaaacgttggtcagacattatgttacaggtaacaggtgtttttcaaaccattccctcactggctttgcttggtcttttcatccctttaatgggaattggaacgttgcctgcagtgacagctttagttatctatgcgatttttccgattttacaaaacaccatcacaggattaaatggtattgacccaagtctcgtggaagcaggaatagcttttgggatgaccaaatgggagcgattgaaaacatttgagattccaattgccatgcctgttattatgtcaggtgtgcggacgtcagcagtcatgattatcggcacagctactttagcttccttgataggagccggtggacttggctctttcatcttattagggattgatcgtaataatgctaacctgattctgataggggctatttcttcagctctgctagctattattttcaatagtttgttacagtaccttgagaaagcttccttgcgacggattatgattagttttggaattaccttacttgcactgctagcatcgtatactcctatggcgcttagtcagttttcaaaaggaaaagatacagtggttattgccggtaaattgggagcagagcccgatattctgattaatctctataaggaattaattgaagaccaatcagatataagtgttgagttgaaatctaattttgggaaaactagcttcttatatgaagcccttaaatctggagatattgatatgtatcctgaatttacaggaaccataacatcaagtcttttacgcgacaaaccacctttgtctaatgaccctaagcaggtctatgaggatgctaaaaaaggcattgctaagcaagataaactgacccttctcaagccatttgcttaccaaaatacgtatgctgttgctatgccagaaaaattggctaaggaatatcagattgaaaccatttctgatttaaaagcgcatgctgatactttaaaggccggttttactttggaatttaaggacagagcagatggctataagggaatgcaatctcaatatggattacagctatctgtggcgacgatggagccagctcttcgttatcaagcaattcaatcaggagatatccaagtaacagatgcttactctacggatgctgaaattacgaaataccatttgaaagttttaaaggatgataaacagttgtttccaccttatcagggagctcctttgatgaaaacttccttattaacaaaacatccagaattaaaaggcattcttaatcaattagcgggaaaaattactgaaaaagagatgcaggacatgaactacgaggtatctgttaaaggagcagatgctaataaggtcgctcgagattatctgttgaaaacaggcttaatccagaaa

SEQ ID NO: 636 - protein, 520 aa, Streptococcus pyogenes
MLLWSIYLEVMSMPSLFVTFQNRFNEWLAALGEHLQISLLSLMIALLIGVPLAALLSRSKRWSDIMLQVTGVFQTIPSLALLGLFIPLMGIGTLPAVTALVIYAIFPILQNTITGLNGIDPSLVEAGIAFGMTKWERLKTFEIPIAMPVIMSGVRTSAVMIIGTATLASLIGAGGLGSFILLGIDRNNANLILIGAISSALLAIIFNSLLQYLEKASLRRIMISFGITLLALLASYTPMALSQFSKGKDTVVIAGKLGAEPDILINLYKELIEDQSDISVELKSNFGKTSFLYEALKSGDIDMYPEFTGTITSSLLRDKPPLSNDPKQVYEDAKKGIAKQDKLTLLKPFAYQNTYAVAMPEKLAKEYQIETISDLKAHADTLKAGFTLEFKDRADGYKGMQSQYGLQLSVATMEPALRYQAIQSGDIQVTDAYSTDAEITKYHLKVLKDDKQLFPPYQGAPLMKTSLLTKHPELKGILNQLAGKITEKEMQDMNYEVSVKGADANKVARDYLLKTGLIQK

SEQ ID NO: 637 - DNA, 984 bp, Streptococcus agalactiae
atgcttaaaaaatcgcactttttacagatatttacactttgcttagccctcttaacgatttctggttgtcaattaaccgatactaaaaagtctggtcataccacaattaaggttgctgcccaaagttctacagagtctagtattatggcaaatattatcaccgaattaattcatcacgaattaggatacaacacaactttaataagcaatcttggttcctctacggttactcaccaagctttgctccgtggtgatgctgacattgctgccacacgttatacaggaacagacatcacagggactcttggtttaaaagctgttaaagaccctaaagaagcttctaagattgtaaaaactgaattccaaaaacgctacaatcaaacttggtatcctacttatggtttttctgatacttatgcattcatggttactaaagagtttgccagacagaataaaatcactaagatctctgatcttaaaaaattatcaacaactatgaaggcaggggttgatagttcatggatgaatcgcgagggagatggatacactgatttcgctaaaacatacggttttgaattttcacatatttaccctatgcaaattggcttagtctatgatgcggttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagrrgarrwwaawwaawkraammaawkaawwmyttccmammatttwtyywmywmytycmammwwawkgkwrk

SEQ ID NO: 638 - protein, 328 aa, Streptococcus agalactiae
  misc_feature (1)..(328): Xaa = Any Amino Acid
MLKKSHFLQIFTLCLALLTISGCQLTDTKKSGHTTIKVAAQSSTESSIMANIITELIHHELGYNTTLISNLGSSTVTHQALLRGDADIAATRYTGTDITGTLGLKAVKDPKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRXXXXXXXXXXFXXFXXXXXXXXX

SEQ ID NO: 639 - DNA, 633 bp, Streptococcus agalactiae
atggtcaatttcttatcacagtatggcatgcaaatattagtaaaaacatgggaacaagtctatatctcattctttgctatagcacttgggattgcaattgctgttccattgggtgtggtcttaacacgttttcccaaagtagccaaaattatcattgctatagctagcatgttacaaactataccaagtttagccttattagctttaatgattccattgtttggaattggaaaaatcccagctatcgttgctttatttatttattccttgcttcctatactaaggaatacttatataggtatgaataatgtcaatccaacacttaaagattgtgctaaagggatgggaatgaaacctattcaatctatatttcaagttgagttacctttagctactccaattattatggctggtattcgcttgtctactatttatgttattgcttgggctacattggcttcttatataggtgcaggtggacttggtgatctcatttttagcgggttaaatctttttcagtccaaattaattctagggggcacaattcctgttattatcctgtcacttattatagattatcttttaggattactggaaacagctctaacgcccagaacaacaagaagggaggct

SEQ ID NO: 640 - protein, 211 aa, Streptococcus agalactiae
MVNFLSQYGMQILVKTWEQVYISFFAIALGIAIAVPLGVVLTRFPKVAKIIIAIASMLQTIPSLALLALMIPLFGIGKIPAIVALFIYSLLPILRNTYIGMNNVNPTLKDCAKGMGMKPIQSIFQVELPLATPIIMAGIRLSTIYVIAWATLASYIGAGGLGDLIFSGLNLFQSKLILGGTIPVIILSLIIDYLLGLLETALTPRTTRREA

SEQ ID NO: 641 - DNA, 1143 bp, Streptococcus agalactiae
atgggccaagaacctatcatcgaatatcaaaatatcaataaagtgtatggggaaaatgttgcggttgaagacattaaccttaaaatttaccctggtgattttgtttgtttcatcggtacgagtggatcaggtaaaacaacattaatgcgtatggttaaccatatgttaaaaccaacaaatggtactctattatttaagggaaaagatatttctactattaaccccattgaattaagacgcagaattggatatgttatccaaaacattggtttaatgcctcatatgaccatttacgaaaatatagttcttgtaccaaaattattgaaatggtcagaagaagctaaaagagctaaagcaagggaacttattaaattagttgaattacccgaagaatatttggatcgctaccctagtgagttgtctggcggtcagcaacaacgtatcggtgtcattcgcgctcttgcagcagaccaagatattattttaatggatgagccttttggagctctggatcctattactagagaaggtattcaagacttagtcaagtctcttcaggaagaaatggggaaaactatcatcttagttactcatgatatggatgaagccctcaagttagcaacaaaaattattgttatggacaatggtaaaatggtccaagaagggacacccaatgatctcttacatcatcctgctactagtttcgttgaacaaatgattggagaagagcgtctccttcatgcgcaggctgatattactcctgttaaacagataatgttaaataatcctgtttcaataactgctgaaaaaacactaactgaagctattacactaatgcgccaaaaacgcgttgactcacttctagtaaccgataacggtaaattaattggttttattgacttagaatctctaagcagtaaatataagaaagatcgacttgtttctgatatcttaaaacatactgatttttatgttatggaagacgacttacttagaaatactgctgagcgtattttaaaacttggtttaaaatacgctccagttgttgaccatgagaataacttaaagggcattgttactcgtgcatccctagttgatatgttatacgatattatttggggcgatactgaaacggaggatcaa

SEQ ID NO: 642 - protein, 381 aa, Streptococcus agalactiae
MGQEPIIEYQNINKVYGENVAVEDINLKIYPGDFVCFIGTSGSGKTTLMRMVNHMLKPTNGTLLFKGKDISTINPIELRRRIGYVIQNIGLMPHMTIYENIVLVPKLLKWSEEAKRAKARELIKLVELPEEYLDRYPSELSGGQQQRIGVIRALAADQDIILMDEPFGALDPITREGIQDLVKSLQEEMGKTIILVTHDMDEALKLATKIIVMDNGKMVQEGTPNDLLHHPATSFVEQMIGEERLLHAQADITPVKQIMLNNPVSITAEKTLTEAITLMRQKRVDSLLVTDNGKLIGFIDLESLSSKYKKDRLVSDILKHTDFYVMEDDLLRNTAERILKLGLKYAPVVDHENNLKGIVTRASLVDMLYDIIWGDTETEDQ

SEQ ID NO: 643 - DNA, 726 bp, Streptococcus pyogenes
atgatacgttttaataatgtttctaaaacttttggtcagacaaaggttttgcaagagcagacctttcaaattaatgatcgtgaattttttgtgctggttggccccagcggatcgggcaagaccacacttttaaaaatgattaattgccttattgaaccaagctctggagatattttactaaataacgtcccacagacagagttagatttacgtgagatgaggctatctattggatacgtattgcagcaaattgctctgttccccaatctcacagtagctgaaaatattgcgattatccctgagatgaagcaatggtcagctgaagaaattagacaaaaaactgaagaattattggataaggtgggcctacctgctaaagattatcttgatcgttacccaagtgatttatcgggaggtgaacagcaacgtattggtattgtacgtgctatcatttctcatcctaaaattctattgatggatgaaccattttcagccttagatcctatttcacgtaaacaattgcaagagttaatgttgagtcttcacaaggaatttgacatgacgattgtatttgtgacacatgatattgatgaggccattaaattaggagaccgcgtagctattttaaatgagggagaaattgtgcaactggatcgcccagaaatgattaagacccaccctgctaatgcttttgtggtcaatttatttggaggtgatgagcatgcc

SEQ ID NO: 644 - protein, 242 aa, Streptococcus pyogenes
MIRFNNVSKTFGQTKVLQEQTFQINDREFFVLVGPSGSGKTTLLKMINCLIEPSSGDILLNNVPQTELDLREMRLSIGYVLQQIALFPNLTVAENIAIIPEMKQWSAEEIRQKTEELLDKVGLPAKDYLDRYPSDLSGGEQQRIGIVRAIISHPKILLMDEPFSALDPISRKQLQELMLSLHKEFDMTIVFVTHDIDEAIKLGDRVAILNEGEIVQLDRPEMIKTHPANAFVVNLFGGDEHA

SEQ ID NO: 645 - DNA, 111 bp, Streptococcus agalactiae
ttgatgggcacgagtggactcgaaccaccgacctcacgcttatcaggcgtgcgctctaaccacctgagctacgcgcccaagctattgcttggtttttactttcttataaag

SEQ ID NO: 646 - protein, 37 aa, Streptococcus agalactiae
MMGTSGLEPPTSRLSGVRSNHLSYAPKLLLGFYFLIK

SEQ ID NO: 647 - DNA, 495 bp, Streptococcus agalactiae
ttgatatataaaatttatattctaagaaaagagaacatgatgagaaaatatataaaatggttaattcccatatcaatttttgggatgatacttggaggctgtcaaatgaatagtgaacataaaattcagtcaaacgaagtaaaaaatagcaagcaatcagaagtgaagaaagataaaaaaatgacaaaaaaagaacaattagcctatctcaaagagcatgagcaagaaatcatagattatgtaaaattacataacaaccaaattgagtccgttcaattcgattggtcaagtgtaaaagtagaacaaagcgggaatggaactccacaagggggtgattataatctttcactgagaggaaagtttaatcatctacaaaattcaaaattaatagttgatttttatttagctcataaaaatgatatcccaaatatcaaatcaatgggaatgctaaataagccgtatatacataaaaatggtatttggcacatttatgaa

SEQ ID NO: 648 - protein, 165 aa, Streptococcus agalactiae
MIYKIYILRKENMMRKYIKWLIPISIFGMILGGCQMNSEHKIQSNEVKNSKQSEVKKDKKMTKKEQLAYLKEHEQEIIDYVKLHNNQIESVQFDWSSVKVEQSGNGTPQGGDYNLSLRGKFNHLQNSKLIVDFYLAHKNDIPNIKSMGMLNKPYIHKNGIWHIYE

SEQ ID NO: 649 - DNA, 804 bp, Streptococcus agalactiae
ttgagtaattggaacttagataattttgataacttacatagctctttagcagaaagtgcatataatagtcgacctaattcatttcctgaattatttgagactgactcagtaacagaagtaaaattttctcaaccctcagaagataacaaaggtcaaatcacacagggtggcactaacctccccaatgatggtattgtctacctgcaaccagataagtccttaaaatctattgatgaaaatgtaaaggtcctcattccagatgtcaatggaggctatcacactgagcattatgttactcattcttatcaaaaaggtgtgcttactgacgataaggcaggttttaatgcttactacctgtcagatactgaaaaaatagatagcactacaaagcacacttatctagccattcgtggtagtgatgggattggtctagatacactaaacgattgggttagtaacaatgcaatgtttgctgtctctaacaagtatattccacaagcgaaattggctaataaggctatgaaagaaaaaattgccgagctaaaaggaaaagcgcctggagctattatagatgttactggtcactcactcggtacgattgtatcttctcaagcagttgttaatcttagctatgcagaattggagaatgttggtcaagtagtccttttcgatggccctgatgtatcaagaagcttggaaaaaatggaaggcatttctgctaaaaaaatccaagaagctgggaagcatgttacctactatgtcaatccctttgatatagttagtatgcttaatcgtgaaaagcca

SEQ ID NO: 650 - protein, 268 aa, Streptococcus agalactiae
MSNWNLDNFDNLHSSLAESAYNSRPNSFPELFETDSVTEVKFSQPSEDNKGQITQGGTNLPNDGIVYLQPDKSLKSIDENVKVLIPDVNGGYHTEHYVTHSYQKGVLTDDKAGFNAYYLSDTEKIDSTTKHTYLAIRGSDGIGLDTLNDWVSNNAMFAVSNKYIPQAKLANKAMKEKIAELKGKAPGAIIDVTGHSLGTIVSSQAVVNLSYAELENVGQVVLFDGPDVSRSLEKMEGISAKKIQEAGKHVTYYVNPFDIVSMLNREKP

SEQ ID NO: 651 - DNA, 348 bp, Streptococcus agalactiae
atgctctatatggcaacgcaattagcagaatcagatgtttcagaaaaagtctctgcaacaaaaaaacatattagtgaagctaaggatacgattgtagaaatatcgacatccactatttcatcagctgaaataatggctatgcaccttgaccaatcagaagttgatgctctggtttcagatataaaaatgtcaacagtttggaatgatggcgtagagacttctgattatgaagcacttgatcactataaaacaaaaatgaccacatttacgaccaatttggtaacagttgcacaaaatttaacagctcaagatgagcaactagctggtgatattgtcacgaacttatcc

SEQ ID NO: 652 - protein, 116 aa, Streptococcus agalactiae
MLYMATQLAESDVSEKVSATKKHISEAKDTIVEISTSTISSAEIMAMHLDQSEVDALVSDIKMSTVWNDGVETSDYEALDHYKTKMTTFTTNLVTVAQNLTAQDEQLAGDIVTNLS

SEQ ID NO: 653 - DNA, 270 bp, Streptococcus agalactiae
atgtccaaagaattgaaattgcccttgaatgaaatgttgaaagaacaagaaagaatagctattaaggcaatagttgctacagcaaaaagcactattacggatactggaacaaatttaaaagcaactttagagtcagatgcccaagacctaaaaaactatgcatccacctataacgccaatatcacggatggtcttgaaggccagtcagctcaagcagcatctgatttcttgacacaacttccaaaaccagagttagataatccagtcaat

SEQ ID NO: 654 - protein, 90 aa, Streptococcus agalactiae
MSKELKLPLNEMLKEQERIAIKAIVATAKSTITDTGTNLKATLESDAQDLKNYASTYNANITDGLEGQSAQAASDFLTQLPKPELDNPVN

SEQ ID NO: 655 - DNA, 348 bp, Streptococcus agalactiae
atgatagatacaaaaaaactgcaagaactcgatcaagaatatgatcaaaatctcagaaacatttatcgtaacagagagcaactagaagatgactttcacttgtttatggcaagaacagacagcctaaaagagtctgtctatcaagcaactttaggacaaggttgggaattaccccaagaagctcatgcacacctatataatatggatgataataaggatacattcatatcagaattcaatgaatatatggaaaagcttgaagaaaaggaaatagatcttcgaagagtttataatgatagagtagatgaattgtatcagaaggctaagcaaaacgaagcaaaaaaagga

SEQ ID NO: 656 - protein, 116 aa, Streptococcus agalactiae
MIDTKKLQELDQEYDQNLRNIYRNREQLEDDFHLFMARTDSLKESVYQATLGQGWELPQEAHAHLYNMDDNKDTFISEFNEYMEKLEEKEIDLRRVYNDRVDELYQKAKQNEAKKG

SEQ ID NO: 657 - DNA, 96 bp, Streptococcus agalactiae
atgaaaattatgaaagaattagacaatataggaattaaccgtaagaatctttttcgggatcatgataatatagcaaaatatctaattgaaaaagta

SEQ ID NO: 658 - protein, 32 aa, Streptococcus agalactiae
MKIMKELDNIGINRKNLFRDHDNIAKYLIEKV

SEQ ID NO: 659 - DNA, 591 bp, Streptococcus agalactiae
ttgggagattttatgaacaataaaaacaaatggactataattttacttatttttactatcatcgtaattgatgttagcttactatttggcgggaatcgtttaagtttaccaatcaaattattaattttattagtaaccagtatagcagaattttgttcgatttttataatgataaaagttccgactcctcaaaaatataagaaagaaccatttggattaaaagcaaaattttattctattgtactctttctctcgactattctttatacaattgggatatggaatgtgacgccagcttccccatacaatgttaaagaatcaattcttggagttggcattttaatacaagtagttttcttcatttattttctattaaaaaaaattaacgaaagtcccgatgaacgcttttatagtaatttagcattgtcagcttctttgatgtttttgatatcaataatgttattaattcttatagctatttaccttaatatatatggaacgttagagttaaaatcaggctacctttatattatggtaggtttattattactaatgtttgctgttacatattactttcttgagggacggaga

SEQ ID NO: 660 - protein, 197 aa, Streptococcus agalactiae
MGDFMNNKNKWTIILLIFTIIVIDVSLLFGGNRLSLPIKLLILLVTSIAEFCSIFIMIKVPTPQKYKKEPFGLKAKFYSIVLFLSTILYTIGIWNVTPASPYNVKESILGVGILIQVVFFIYFLLKKINESPDERFYSNLALSASLMFLISIMLLILIAIYLNIYGTLELKSGYLYIMVGLLLLMFAVTYYFLEGRR

SEQ ID NO: 661 - DNA, 216 bp, Streptococcus agalactiae
atggggaaagaaacaaaaattatcagttctttaaaacaggttagagaagatatcggaatgactcaacaagagttagctattcggataggtgttaggagagaaacaattggtcatttagaaaataacaggtataatccttctctagagatggcacttaaaattgttaagattttcgacatgaagatagaagatatttttcaattaaggaaagaggat

SEQ ID NO: 662 - protein, 72 aa, Streptococcus agalactiae
MGKETKIISSLKQVREDIGMTQQELAIRIGVRRETIGHLENNRYNPSLEMALKIVKIFDMKIEDIFQLRKED

SEQ ID NO: 663 - DNA, 558 bp, Streptococcus agalactiae
ttgaataaattttttttagaatcagagagacttattataaggccactagaagaaagtgattatgatagttggtatactagttttatgaatcgtggaccatctttaactccatttgatgatgggatacttgatatgtctatgtgtgacattaattggtttaaaaatttagtaaatttacaaaggaaagaatgggaaagtgacatagtatatatatttggtgtttttctaaaaagcggtgagcacgtaggaatgttaaatattgttacccttgcaagagcagatatgcaatggggagaattgggatatgtttttcataatcaattttggagtaatggctatgcatttgagtcaatcttggcattacttaatagtacttatgaaaaattgggttttcatcatattgaagcacagattactcctgggaatgaacgatcggaaaagttggttagaagattgggattaacctatgagacaactcgaaaagatttttcatttgagaatggaaaatggacagataaactgatttatagtataaatttacataataataatttagaa

SEQ ID NO: 664 - protein, 186 aa, Streptococcus agalactiae
MNKFFLESERLIIRPLEESDYDSWYTSFMNRGPSLTPFDDGILDMSMCDINWFKNLVNLQRKEWESDIVYIFGVFLKSGEHVGMLNIVTLARADMQWGELGYVFHNQFWSNGYAFESILALLNSTYEKLGFHHIEAQITPGNERSEKLVRRLGLTYETTRKDFSFENGKWTDKLIYSINLHNNNLE

SEQ ID NO: 665 - DNA, 576 bp, Streptococcus agalactiae
atgaataatttggatacactatattgtaaattagcaatgtgcaacacagtactaacggaaagattacgactccagcctgttgaattaactaatgtaaatgattttttagaattttcatctgattctgaaacagtattctatatgcaacgttataaagctaataccgtagaagaagcacaagtcgttttagcaaatgtttgtatgaaatcaccattaggaatttatgcaatgattgaaaaagaatcacagaagatgataggtattattgaattagaaatcagagatgaattttctgcagaatttggttatattttaaataaaaattataatggaaaaggttatatgacagaagcttgttcaaaattgatgtcaattggatttgaacatctagacttggaaagaatttatgctagatttgacattaataataaaaaatctggaaatgttatggaacggataggtatgaaaaaagaaggcgagcttcgtcatcttgcaaaaaatccaaaaggtgagtggaaaacaagagcgtattattctattttaaaagaagaatattttaataaagttaatactaaa

SEQ ID NO: 666 - protein, 192 aa, Streptococcus agalactiae
MNNLDTLYCKLAMCNTVLTERLRLQPVELTNVNDFLEFSSDSETVFYMQRYKANTVEEAQVVLANVCMKSPLGIYAMIEKESQKMIGIIELEIRDEFSAEFGYILNKNYNGKGYMTEACSKLMSIGFEHLDLERIYARFDINNKKSGNVMERIGMKKEGELRHLAKNPKGEWKTRAYYSILKEEYFNKVNTK

SEQ ID NO: 667 - DNA, 540 bp, Streptococcus pyogenes
atggatatttggacaaagcttgcagtgtttgctttttttgagactccgaaagtaatattacggccttttcgctatgaagatcattgggatttttacagcatggttaacgacactaaaaacctttattatgtttttccagaacaaaaaactaaggcagcaagtgactatcttttagtacatagttttataaagtttcctttaggtcagtgggcaatagaagataaagcaacccaccaagtaataggttctattagaattgagcattatgatgctaaaacgcgttgtgctgatattggctattttttaaactatgccttttggggacaaggaattatgacagaagtcgtaataaaacttgtttatttatcttttcacgaatttggtctcaaaacgttgcgtattataactcatttagaaaataaggccagccagaaagtagctaaaaaagcaggttttcaactaaaaacctgttttaaaggaagtgatcgtaatactcataaaatctgcatttataaaatgtaccaactaactaatgatagg

SEQ ID NO: 668 - protein, 180 aa, Streptococcus pyogenes
MDIWTKLAVFAFFETPKVILRPFRYEDHWDFYSMVNDTKNLYYVFPEQKTKAASDYLLVHSFIKFPLGQWAIEDKATHQVIGSIRIEHYDAKTRCADIGYFLNYAFWGQGIMTEVVIKLVYLSFHEFGLKTLRIITHLENKASQKVAKKAGFQLKTCFKGSDRNTHKICIYKMYQLTNDR

SEQ ID NO: 669 - DNA, 678 bp, Streptococcus agalactiae
gtgggtgatgtcgttgaaaattttacggaaggtaaaaatccgaagattgatacacttaatgggaaaacagttagaatagaaaaaataaatccagatcattttgaagacttatttcaagtttatggagaattgtctactgaagatagtttaacttatatatcttttagcaaatttaatagtaagaatgaatttgatgtctttttccaaactctattaaaatcagaagatccttattatttagctattgttgataataatactggtaaagtattagggactttttcattaatgcgtattgatacaaaaaatagagttgttgaaatgggatgggtggtttattcatcaaaactaaaacaaacaaggatagcaacagaagctcaatatttggttatgaaatatgtttttgaagaactctgttaccgccgttatgagtggaaatgtgatagtttgaatgcaccatctaataattctgcaaaacgacttggttttacttttgaaggaacttttagacaagctgtcgtatataagggtcgtaacagagatacaaattggtattctattttagataaagagtggccagagaaaaaaacacggtttgaaaaatggctagatgattcaaactttgctgtaaatgggtatcaaatcagatcactatcaagcattgagcagaagacaaaa

SEQ ID NO: 670 - protein, 226 aa, Streptococcus agalactiae
MGDVVENFTEGKNPKIDTLNGKTVRIEKINPDHFEDLFQVYGELSTEDSLTYISFSKFNSKNEFDVFFQTLLKSEDPYYLAIVDNNTGKVLGTFSLMRIDTKNRVVEMGWVVYSSKLKQTRIATEAQYLVMKYVFEELCYRRYEWKCDSLNAPSNNSAKRLGFTFEGTFRQAVVYKGRNRDTNWYSILDKEWPEKKTRFEKWLDDSNFAVNGYQIRSLSSIEQKTK

SEQ ID NO: 671 - DNA, 945 bp, Streptococcus agalactiae
atgataaaaacaaagtttagtgatccactggaacaattagccaaaaaaaggaaaaggaaaacattattcaagaccgtagtattggcattaataactgtactattagtagttggaatagcttttaaagggtttacatatttaacttcaaaaaatggtcaaaaaacatatcataactttgaactactttctgaaatagcatatccaaatatttcctatgatagtctctattaccagccaagcggtcagtttactggtaaagtacatgctgatagatttaaagatatcgatggggttcaaattccatattctagttttgaagaaaattatagtatctcaggtacttttggcacaaatgctgatgaaaaatcagaaaagaatggcttgtatgatcgaggtactagacaaaaagttccacaatttttcaataaaaatgttaagtataaaaaaggagaagccaaaacaactccaacaaatgatttaaaatatgtaaataaattgaataatgatcttattgaaattgcaataacttttgataagtcctatagttacaaagaaataaaaacaatgataccaaataatataaaacaaaattggttatggataggtacaagcacagaattagatacatcatattggccaacaaagtatcaattcggtacagatcctgaaactttgaatacaccacaaatattcatagataaaataaaagaaaacttaaaaggtaactcaaaagtatactttaataatataaatatctactcagatttagaaaagtatgccaaaaaatacgacaaggtaaataatagcgacaaattaaaattttcgggaataatattaacaggtaaagccgaaaactttaaacaacttaaagaaaaagaatgggtacatgcttcaagtataggggcaaacatagaatataagccctattataaattagataaagaa

SEQ ID NO: 672 - protein, 315 aa, Streptococcus agalactiae
MIKTKFSDPLEQLAKKRKRKTLFKTVVLALITVLLVVGIAFKGFTYLTSKNGQKTYHNFELLSEIAYPNISYDSLYYQPSGQFTGKVHADRFKDIDGVQIPYSSFEENYSISGTFGTNADEKSEKNGLYDRGTRQKVPQFFNKNVKYKKGEAKTTPTNDLKYVNKLNNDLIEIAITFDKSYSYKEIKTMIPNNIKQNWLWIGTSTELDTSYWPTKYQFGTDPETLNTPQIFIDKIKENLKGNSKVYFNNINIYSDLEKYAKKYDKVNNSDKLKFSGIILTGKAENFKQLKEKEWVHASSIGANIEYKPYYKLDKE

SEQ ID NO: 673 - DNA, 162 bp, Streptococcus agalactiae
atgatgaaaaaatatataaaatggttaattcccatatctattattgggatgttactagtaggctgtcaaatgaataggggacctaaaagtcagtcaaacgaagtaaaaaatagcaagcaatcagaagtgaagaaaggtaaaaatatgataaaaaagaacagt

SEQ ID NO: 674 - protein, 54 aa, Streptococcus agalactiae
MMKKYIKWLIPISIIGMLLVGCQMNRGPKSQSNEVKNSKQSEVKKGKNMIKKNS

SEQ ID NO: 675 - DNA, 606 bp, Streptococcus agalactiae
atgaaaaataatattattttttctattgaacagtatattaatgaccaagagatgccaaaaggaaaacaaaaagttattttatccgctatagagctctttgcctcacaaggcttccatggaacttccactgctcaactagctaaaaatgcagaagttagccaagcaactatatataaatattttgaaactaaagacaagcttttggtctttattctcgagttaatcgtacaaactattggacgccccttctttacagaattatctacattttctactaaagaggaactaattcatttctttgtacaggaccgttttaaatttattgaaaaaaataatgatctcattaaaatattgatgcaagaattattaatcaatagtgaaacatcaactatttttactaagctaataaattcaactgatccaaacattactaaaattttcaactgtttaagtgaaggaaattcgttgaataaaatggaaatacttcgagcagtaatcggacagttcattactttctttattcaattatatatccttaatataaagcctgaaaatctagaggaagaactaaaacaaatagaaaaacaaatattaaaattactgagc

SEQ ID NO: 676 - protein, 202 aa, Streptococcus agalactiae
MKNNIIFSIEQYINDQEMPKGKQKVILSAIELFASQGFHGTSTAQLAKNAEVSQATIYKYFETKDKLLVFILELIVQTIGRPFFTELSTFSTKEELIHFFVQDRFKFIEKNNDLIKILMQELLINSETSTIFTKLINSTDPNITKIFNCLSEGNSLNKMEILRAVIGQFITFFIQLYILNIKPENLEEELKQIEKQILKLLS

SEQ ID NO: 677 - DNA, 192 bp, Streptococcus agalactiae
atgccgtatgataacatatatccaaatacaatatcactacgtttaacaggagttgcaaggagtcgatcaagtgtaccagaagtacgctcttttaataaagccattccagaaattaaaaaaacaaagaagaagaccataaatcccattagtattggtatcatttttgcaaaaaagcctgtatttttatttccg

SEQ ID NO: 678 - protein, 64 aa, Streptococcus agalactiae
MPYDNIYPNTISLRLTGVARSRSSVPEVRSFNKAIPEIKKTKKKTINPISIGIIFAKKPVFLFP

SEQ ID NO: 679 - DNA, 1095 bp, Streptococcus agalactiae
atgagaattattgcaataactgaaaaggttataaaagaactgtttcgtgataaaagaacacttgctatgatgtttttagcacctattttaattatgtttttgatgaatgttatgttttctgcgaatagtaatacaaaagttaagattggaactattaacgttaacacgaaggtcgtttcaaatttagataatattaagcatattcaagtgagatcatttaaatttaactcatctgctaaaaaagcactcaaatcaaataaaattgatgctcttatttcggaggacaataaatcttatactgtcttctatgcgaatacagattcttcaaagacgactttaacaagacaagcttttaaaaccgctgttaatacaatgaacagtaaggaactgatttcgcaagttaaaattttagctaataagaatccgaaactagcacaatccttacaaactcgctccaaatatatcaaagaaaaatataattacggaaataaaaatacaggcttttttgcaaaaatgataccaatactaatgggatttatggtcttcttctttgtttttttaatttctggaatggctttattaaaagagcgtacttctggtacacttgatcgactccttgcaactcctgttaaacgtagtgatattgtatttggatatatgttatcatacggcattctagcaattattcaaacgatagttatcgttttatcaactatttggctactagatattcaagttgtaggtagtatttttagtgtcatcattgtcaattttattttggctctggttgccttatcattaggaatcttaatgtctactctagcaaaatcagaatttcaaatgatgcaatttattcccttaattataatgcctcaattattcttttcaggaataatccctctagaaaatatggcaagttgggctcagacagtcggtaaaattctaccgctctcctactctggtgatgcacttacaaaaataattatgtacggtcaaggattacctaacgtttcttcaaatcttctggtacttcttctatttttaattattttaaccatcgcaaatatctttggactaaaacgataccgtaaagta

SEQ ID NO: 680 - protein, 365 aa, Streptococcus agalactiae
MRIIAITEKVIKELFRDKRTLAMMFLAPILIMFLMNVMFSANSNTKVKIGTINVNTKVVSNLDNIKHIQVRSFKFNSSAKKALKSNKIDALISEDNKSYTVFYANTDSSKTTLTRQAFKTAVNTMNSKELISQVKILANKNPKLAQSLQTRSKYIKEKYNYGNKNTGFFAKMIPILMGFMVFFFVFLISGMALLKERTSGTLDRLLATPVKRSDIVFGYMLSYGILAIIQTIVIVLSTIWLLDIQVVGSIFSVIIVNFILALVALSLGILMSTLAKSEFQMMQFIPLIIMPQLFFSGIIPLENMASWAQTVGKILPLSYSGDALTKIIMYGQGLPNVSSNLLVLLLFLIILTIANIFGLKRYRKV

SEQ ID NO: 681 - DNA, 1116 bp, Streptococcus pyogenes
atgatttgttttataaaaactctatttgttaagataaagcgcaaaaaaacaagttatgtgacattctttttaatgcctattttaacgacacttttggctttatctttgagtttttcaaataataatcaagctaaaattgggatattagataaagataatagtcagatatctaaacaatttattgctcaactaaagcaaaacaaaaagtacgacatttttaccaaaatcaaaaaagagcatattgatcactaccttcaagataaatctctagaagcggtattgactattgacaaagggttctcagataaagtgttgcaaggaaaatctcaaaaactcaatatacgttcgattgctaatagcgaaattacagagtgggtaaaggcacagaccaattatctattggaaaattataatattataggggatgtggctctaggtaacgaagatacttttaatagaattctccaaaaaaaccaacagttaaattatgatgttaagcaagtaactttgacagaccgatcacgtagcaaagcagtatcttccacaacgacaggatttttgcttattctaatgttaggtagtacgagcgtgatttacagtggtattttggcagataaatctagtcagttataccatcgattaatgttatcgaacttatctcgttttcgctatatgttgagttacgtctgtgtaggatttgttgcttttacgattcaaattgtcattatgctgagtttgttaaaagtatttaatattagtttttttgttccgacatcacttcttttgattatttttttcctttttagtttattagcgataggctttggcctgctgattggagctatcacacaaaattcccaacaaagtagccagttagctaatcttattgtaatgccgacttcaatgttggctggctgtttatggccattgtctattacgccttcttatatgcaagcaattggtaagttattaccacaaaattgggttttatcagccatagctatttttcaaagtggagggaccttatctcaggcttggccatacttgttagctctaatgggaacagcactagctttgattagtttttcaagtttattattaaaacctaccaaacta

SEQ ID NO: 682 - protein, 372 aa, Streptococcus pyogenes
MICFIKTLFVKIKRKKTSYVTFFLMPILTTLLALSLSFSNNNQAKIGILDKDNSQISKQFIAQLKQNKKYDIFTKIKKEHIDHYLQDKSLEAVLTIDKGFSDKVLQGKSQKLNIRSIANSEITEWVKAQTNYLLENYNIIGDVALGNEDTFNRILQKNQQLNYDVKQVTLTDRSRSKAVSSTTTGFLLILMLGSTSVIYSGILADKSSQLYHRLMLSNLSRFRYMLSYVCVGFVAFTIQIVIMLSLLKVFNISFFVPTSLLLIIFFLFSLLAIGFGLLIGAITQNSQQSSQLANLIVMPTSMLAGCLWPLSITPSYMQAIGKLLPQNWVLSAIAIFQSGGTLSQAWPYLLALMGTALALISFSSLLLKPTKL

SEQ ID NO: 683 - DNA, 642 bp, Streptococcus agalactiae
ttggaggtgtttaaaggcgaaataattggattaataggaccctctggagcagggaaatctaccttgattaaaactatgcttggcatggaaaaagcagataagggaacagctcttgttcttgatactcaaatgccagatcgtaatattttaaatcaaattggctatatggctcaatctgatgccttatacgagtctttaactggcttagaaaatttattattctttggaaaaatgaaaggtattcaaaaaactgaattaaaacagcagataactcatatttctaaagtagtagatctagaaaaccaacttgataaatttgtctcaggttactcaggaggtatgaaaagacggctttctctagccatcgccctacttggaaaccccacagttttaatcctagatgaacctaccgttggaattgatccatccttgaggagaaaaatctggcaagagctaattaatattaaggatgaaggacattctatctttattacaacccacgttatggatgaagcagaattaacaagtaaggttgcactactattacgtggaaacattattgcctttgatactccattacatttaaaaaaacaatttaatgtgagtactattgaggaagttttcttaaaagctgaaggagaa

SEQ ID NO: 684 - protein, 214 aa, Streptococcus agalactiae
MEVFKGEIIGLIGPSGAGKSTLIKTMLGMEKADKGTALVLDTQMPDRNILNQIGYMAQSDALYESLTGLENLLFFGKMKGIQKTELKQQITHISKVVDLENQLDKFVSGYSGGMKRRLSLAIALLGNPTVLILDEPTVGIDPSLRRKIWQELINIKDEGHSIFITTHVMDEAELTSKVALLLRGNIIAFDTPLHLKKQFNVSTIEEVFLKAEGE

SEQ ID NO: 685 - DNA, 921 bp, Streptococcus pyogenes
atgagttttgtacaattaacaaatgttgtcaagtcctacaaaaacggcaagaaagctgtcaatgatgtttccttgtctattgaagcaggtaatatttatggtttgttaggaccaaatggtgctggtaagtctaccttgattaatcttatcttaggcttgatccctttgagttccggtaaaattactgttttagggcaatcccaaaagactattcgaaaaataagttcgcagataggttatgttcctcaagacattgctgtttatccagacctaactgcttatgaaaatgtagaactatttgggtcactttatggcttaaagggagctcagcttaaaaaacaagttctaaaaagtttagaatttgtggggctacactcccaagctaagcagtttccaagtcaattctcaggaggaatgaagagacggttaaatatcgcttgtgcgctagttcattcacctaaattaatcatttttgacgaaccgactgtagggattgatcctcaatcacgtaatcatattttagagtcgattcgtttgctaaacaaagaaggtgctacagttatttatacgacccattatatggaagaagtagaggctctttgtgattatatttttattatggatcatggtcaagttattgaagaaggacctaaatttgaactggaaaaacgttacgttgcaaatctagcaaaccagattattgtaactctaacagattcacgtcatttggaactggcagataagcctgattggtctttgatagaagatggagaaaaactcatgttgaagattgataatagtgatatgacatcagttgttcatcagctcacacaggccaatattacttttagcgagattagacataaccatttgaatttagaagaaattttcttacacttaacaggtaagaagttacgagat

SEQ ID NO: 686 - protein, 307 aa, Streptococcus pyogenes
MSFVQLTNVVKSYKNGKKAVNDVSLSIEAGNIYGLLGPNGAGKSTLINLILGLIPLSSGKITVLGQSQKTIRKISSQIGYVPQDIAVYPDLTAYENVELFGSLYGLKGAQLKKQVLKSLEFVGLHSQAKQFPSQFSGGMKRRLNIACALVHSPKLIIFDEPTVGIDPQSRNHILESIRLLNKEGATVIYTTHYMEEVEALCDYIFIMDHGQVIEEGPKFELEKRYVANLANQIIVTLTDSRHLELADKPDWSLIEDGEKLMLKIDNSDMTSVVHQLTQANITFSEIRHNHLNLEEIFLHLTGKKLRD

SEQ ID NO: 687 - DNA, 105 bp, Streptococcus agalactiae
gtgagtaaacactcactcactgagagaggagcaaaaagttatcatgaaaaaagtcatcgatttaaaaaaactacaaaaagcatatgcctcagaaaccgttttaaa

SEQ ID NO: 688 - protein, 35 aa, Streptococcus agalactiae
MSKHSLTERGAKSYHEKSHRFKKTTKSICLRNRFK

SEQ ID NO: 689 - DNA, 387 bp, Streptococcus agalactiae
atgaaggctcaggcgattgtcacaagccaagggagaattgtttctttggatattgcagtgaactattgccacgatatgaagttgttcaaaatgagtcgcagaaacatcggacaagctgctaaaatcttggcagacagtggttatcaagggatcatgaagatgtattcacaagcgcaaactccgaggaaatcaagcaaacttaagccactaactcttgaagataaaacctataaccatacgctatccaaagagagaatcaaggttgagaatatttttgccaaagtaaaaacgtttaaaatattttcaacaacctatcgaaatcgacgcaaacggtttggattacgaatgaatttgattgctggaatgatcaaccgtgaactaggattt

SEQ ID NO: 690 - protein, 129 aa, Streptococcus agalactiae
MKAQAIVTSQGRIVSLDIAVNYCHDMKLFKMSRRNIGQAAKILADSGYQGIMKMYSQAQTPRKSSKLKPLTLEDKTYNHTLSKERIKVENIFAKVKTFKIFSTTYRNRRKRFGLRMNLIAGMINRELGF

SEQ ID NO: 691 - DNA, 381 bp, Streptococcus agalactiae
atgaattatgaagcaagcaaacaattaactgatgtacgatttaagcgccttgttggtgttcagcgcactacttttgaagagatgttagctgtgttaaaaacagcttatcaacgtaaacacgcaaaaggtggccgaacccctaagttaagcttagaagatctcctcatggctactcttcaatacatgcgagaataccgcacttatgaacaaattgcggctgattttggcattcacgaaagcaacttaatccgtcgaagtcaatgggttgaatcaactcttattcaaagtggttttacgatttcaaaaactcatcttagtgctgaggatacggtgattgtggatgcaacagaggtaaaaatcaatcgtcctaaaaaaatcaac

SEQ ID NO: 692 - protein, 127 aa, Streptococcus agalactiae
MNYEASKQLTDVRFKRLVGVQRTTFEEMLAVLKTAYQRKHAKGGRTPKLSLEDLLMATLQYMREYRTYEQIAADFGIHESNLIRRSQWVESTLIQSGFTISKTHLSAEDTVIVDATEVKINRPKKIN

SEQ ID NO: 693 - DNA, 669 bp, Streptococcus agalactiae
atggataaactgaaaaaattacaaaaagaaaatacgctattagaaggaagaattgataactctaataaccaaacctatacagatatgattgtctatttgcgaggtgctagcattagcccctaccatcaggagctcattcgaaatgatattgtcaatatgttattagaagcacaagagcgacaagcaagtttagttagtgtatttggagaagataggcatgactttataaaccaagttattaaatctacacctaaaatctctaagaaagaagaaacattacaacgttgggatttagccattttactactaactatccaaatgattatctttttaggaggatatctcattactgaagcacttcaacagtcagtaccagatctaatccctattactctattagatgttctttttgcaatctttatcagtattattgctgtcaagatagctgataccataatatatgctacatataacttcgataaatcgaaagaaaagaaatatttctttcgatatatatttctaattctttcgcttatcatagcttatatccttataggaaaatattatcatcttcctttcattaatatccccctttggatttatttaattatactgggacttagcttctctcttcatatcattgttaaaaaatacctgaataaacattat

SEQ ID NO: 694 - protein, 223 aa, Streptococcus agalactiae
MDKLKKLQKENTLLEGRIDNSNNQTYTDMIVYLRGASISPYHQELIRNDIVNMLLEAQERQASLVSVFGEDRHDFINQVIKSTPKISKKEETLQRWDLAILLLTIQMIIFLGGYLITEALQQSVPDLIPITLLDVLFAIFISIIAVKIADTIIYATYNFDKSKEKKYFFRYIFLILSLIIAYILIGKYYHLPFINIPLWIYLIILGLSFSLHIIVKKYLNKHY

SEQ ID NO: 695 - DNA, 711 bp, Streptococcus agalactiae
gtgagtatgaaaatagataaaaaagaacttttagcacttattgctagtattattttattaatttttgcttctgttacgtttttcttatttaaagatcatggcactactcaaatggatactgtagaaagcagtgttaaccatgtcagtgattctcaattaactgaggcacaagatatgttagataaatttgagaagaaaccttcagaaaaattattgaaggatgtcgaacttgctttaaataaattgtccaattcttctaaaaaagaagctttgcaaaaacgttttaagaaagcaaaagataagtatcttaaagacgaagcagataagaaagctaccaaagatgctacagatttagtagaaattctagaacaagccccttcagaagaaaatgtgttaaaagctgaagcagcagtcaataagttaactgtcaaagaatctaaagaagctttacaaaaacgtattgatactgttaagacacaatatggtttgattgggaatcaaactccctctagttcagtagctgaaactacagaacaagggacagctaatcctgctagtcaggatacttctagttacgttaatcagaatgtagcaccaacttatgagcaaccgcaagcgaataatacaccagttactccaggggttaacaatactgttccgactccaggaactggtactgtacctgctactaatgggacaggtgttgctcag

SEQ ID NO: 696 - protein, 237 aa, Streptococcus agalactiae
MSMKIDKKELLALIASIILLIFASVTFFLFKDHGTTQMDTVESSVNHVSDSQLTEAQDMLDKFEKKPSEKLLKDVELALNKLSNSSKKEALQKRFKKAKDKYLKDEADKKATKDATDLVEILEQAPSEENVLKAEAAVNKLTVKESKEALQKRIDTVKTQYGLIGNQTPSSSVAETTEQGTANPASQDTSSYVNQNVAPTYEQPQANNTPVTPGVNNTVPTPGTGTVPATNGTGVAQ

SEQ ID NO: 697 - DNA, 720 bp, Streptococcus pyogenes
atggctacgatgaaacaatatcataaaggagattccatgactaaatcacaaaaagaggcgctttattggatgttgagtgttctaactatcactctaataggtggctcctgccttatttttggatcccaccctcaaacgcaagataaggtagctaaacattctaaaagtgctgctagtttactaaaaaaagcagttaaagcagttaatgacgctgatcgtttagccactgcagctgctatccaagaagcccagaaagctgttgataaattagcagaatcttctaagaaaaaaacgctacaagaacagctaaacgttgccaaagcaaagcaagagcaagaagatgcagctactcaagcagttaaagctgctgaggagactctcaatcaaaatcttaaagatatcgcccaaaaagcagttaacgacttaagtaacaaaggtaaaaaagccgctttacaatctcggttagacgctattttaccagcgaaacccattattgatgaatttccaagacaaagtggagaaataacagataactcttactggacacctttcccaggagacgtctcagatacttatgataattcccagtcacctactttagacccaagctcagaatcttcagcttcagatgttacaccacaacctagtcatcctgatccaattccacctcagacctcttcagaaccttccgactcaggagacaagcaatcatcaaaagag

SEQ ID NO: 698 - protein, 240 aa, Streptococcus pyogenes
MATMKQYHKGDSMTKSQKEALYWMLSVLTITLIGGSCLIFGSHPQTQDKVAKHSKSAASLLKKAVKAVNDADRLATAAAIQEAQKAVDKLAESSKKKTLQEQLNVAKAKQEQEDAATQAVKAAEETLNQNLKDIAQKAVNDLSNKGKKAALQSRLDAILPAKPIIDEFPRQSGEITDNSYWTPFPGDVSDTYDNSQSPTLDPSSESSASDVTPQPSHPDPIPPQTSSEPSDSGDKQSSKE

SEQ ID NO: 699 - DNA, 165 bp, Streptococcus agalactiae
ttgcccgctactgccgcaactgatttagacgcctcttctagtcgctttgtatctgaagttagggttgtcggcaagaaagatgtgactccagtagatagtaagccagcactcattcgcaaaattccttctgaatcacaatccataacatcagcgccagcaaaacca

SEQ ID NO: 700 - protein, 55 aa, Streptococcus agalactiae
MPATAATDLDASSSRFVSEVRVVGKKDVTPVDSKPALIRKIPSESQSITSAPAKP

SEQ ID NO: 701 - DNA, 939 bp, Streptococcus agalactiae
  misc_feature (1)..(939): n = a, c, g, or t
atgagagtgaatggggggaagaagatgacgaagtacatcaaggctgaccgattcttttatgctgatcatgtaaaggaaaacggttatttagaaataaaagataatcactttggtaaatggatagaaaatatttctggacaagaggagattttagattattcaggttatcaaatagcacctggtttagttgatacacatattcatggttttgctggcgctgatgttatggattgtgattcagaaggaattttgcgaatgagtgctggcttactatctactggagtcacatctttcttgccgacaaccctaacttcagatacaaagcgactagaagaggcgtctaaatcagttgcggcagtagcgggcaaagaacaaggagcaaaaattcaaggcatctattttgagggaccatattttactgaggaatataaaggagctcaaaatccgatttatatgagaaatccaaacttggaagagtttgctcaatggcagaaggctgcaaaaggcttgattacaaaaattgctttggcaccagaacgtgagggagttgaggaatttgtctcagcaatcacaaagcaaggtgttacggtagctttaggtcattctaatgggacatataaagaagctaaaaaggcagtgaaggcgggtgcctcagtttgggtacatgcgtataatggtatgcgtggtttgacacaccgagaaccaggtatggttggtgcggtttataatttacctaatacctatgccgaactcatttgcgatggtcatcacgttgatcctgttgcttgtgacattttaatgacacaaaaaggccataatcatgtggcattaataacagattgtatggcagctggaggtgcccctgatggagattatatgttaggggaattgcccgtggttgtgtctaatggaactgcgcgtttgannnnnttaattaat

SEQ ID NO: 702 - protein, 313 aa, Streptococcus agalactiae
  misc_feature (1)..(313): Xaa = Any Amino Acid
MRVNGGKKMTKYIKADRFFYADHVKENGYLEIKDNHFGKWIENISGQEEILDYSGYQIAPGLVDTHIHGFAGADVMDCDSEGILRMSAGLLSTGVTSFLPTTLTSDTKRLEEASKSVAAVAGKEQGAKIQGIYFEGPYFTEEYKGAQNPIYMRNPNLEEFAQWQKAAKGLITKIALAPEREGVEEFVSAITKQGVTVALGHSNGTYKEAKKAVKAGASVWVHAYNGMRGLTHREPGMVGAVYNLPNTYAELICDGHHVDPVACDILMTQKGHNHVALITDCMAAGGAPDGDYMLGELPVVVSNGTARLXXLIN

SEQ ID NO: 703 - DNA, 1146 bp, Streptococcus pyogenes
atgacatgctatcttaaagcagattgtttttattacccaacagaggtgagaccggctggctacctaagtcttcatgatggtgtttttggggagtggacagaaattgttccggcagatgcgcaaatcattgactacaccggttatcaaattgcaccaggtcttgtggatacgcatatccatggctatgcgggagctgatgtcatggataattctgcccaagggattcatcaaatgagtgaaggactattagcaacaggagtaacgtcttttttaccgacgaccttaacttctacctttgagcagttagaaaaagtatcagggactattgcttcagttgctgatcaggtaaaaggtgctaaaatacaaggtatctactttgaaggtccttattttaccgaagaatataagggtgctcaaaacccaagttatatgaaaaccccacgcttggaggaatttgatgcttggcaaaaagctgctaaagggctcatcaaaaaaattgcccttgctcctgaacgtgatggtgtcaaagaatttgtgtctgcagtgacaaaacaaggcgtaacagtggccttagggcattcaaacggtacttatcaagaggctaaagaagctgttcaagctggtgctagtgtttgggttcatgcttataatggcatgcgaggattgacccaccgtgaaccaggaatggtgggagcggtttataatcttccaaatacttacgcagagttgatttgtgatggccaccatgtctcaccaattgcttgtgatattttgatgcagcaaaaagggcatgatcatgtagccatgattacggactgtatgcgagcaggtggttcaccagatggtgattacctcttgggggaattctctgtggttgtggcaaatggcactgctcgtcttaaagagagtggaaacttggcaggatctattttgaaattaaaagatggccttagaaatgtagtggcctggggaatcgcaactccggcagaagccattcatatggcaacttatgtgccagctgtttctgtcggtattgacgacgtatgtggtcaaatcaaagctgggcatgcggctgactttattgttcttgataaggatttaacacttgttgcaacctatttaaatgggcaaaaagcttttgatgcc

SEQ ID NO: 704 - protein, 382 aa, Streptococcus pyogenes
MTCYLKADCFYYPTEVRPAGYLSLHDGVFGEWTEIVPADAQIIDYTGYQIAPGLVDTHIHGYAGADVMDNSAQGIHQMSEGLLATGVTSFLPTTLTSTFEQLEKVSGTIASVADQVKGAKIQGIYFEGPYFTEEYKGAQNPSYMKTPRLEEFDAWQKAAKGLIKKIALAPERDGVKEFVSAVTKQGVTVALGHSNGTYQEAKEAVQAGASVWVHAYNGMRGLTHREPGMVGAVYNLPNTYAELICDGHHVSPIACDILMQQKGHDHVAMITDCMRAGGSPDGDYLLGEFSVVVANGTARLKESGNLAGSILKLKDGLRNVVAWGIATPAEAIHMATYVPAVSVGIDDVCGQIKAGHAADFIVLDKDLTLVATYLNGQKAFDA

SEQ ID NO: 705 - DNA, 771 bp, Streptococcus agalactiae
  misc_feature (1)..(771): n = a, c, g, or t
gtgaatagagaggttactatgtcaatagaatcagattttttccggaaaaaacgttttattttttcatcgcttgaggagtttggatttatcaaatctgaccaagagtatatctattgtcaaacatttatggataatgactttaaagctattatcacgatttcattggatggaaagatagctggtaaggttattgattcggcacttgaagaagaatatttaccgcttcgagcagcaaattataatggttcgtttgttggcgaagtacgatcggcttatatggctatattaggtgatatttcagattcttgttgtaaggacttattatttaccaaagatcaaagtaatcgtttagcggagaagatagctaaaacttttgaagattcagttgattatccatttgcgaagcacccacaatatgcttcctatcgtgtgtcaggtaaatggtatgctctgctttttccattgaagatggggaaactagaaaatgttccagctcaactgtcagaagatgaggttgaagttttgaatattaaagtcaatcctcaagatatggaaatacttttacaaaaagaaggtatttatccttcttatcatatgtctaaaaagacttgggtatctatcgttttagacaatactttgtctgatatagaaatttttaaattggtatcagatagtcgtaagcttgtttctcacaataaaaaatcaaattctgagccagagttttggattattcctgctaatcctaaattttacgatcnnnnnttaattaat

SEQ ID NO: 706 - protein, 257 aa, Streptococcus agalactiae
  misc_feature (1)..(257): Xaa = Any Amino Acid
MNREVTMSIESDFFRKKRFIFSSLEEFGFIKSDQEYIYCQTFMDNDFKAIITISLDGKIAGKVIDSALEEEYLPLRAANYNGSFVGEVRSAYMAILGDISDSCCKDLLFTKDQSNRLAEKIAKTFEDSVDYPFAKHPQYASYRVSGKWYALLFPLKMGKLENVPAQLSEDEVEVLNIKVNPQDMEILLQKEGIYPSYHMSKKTWVSIVLDNTLSDIEIFKLVSDSRKLVSHNKKSNSEPEFWIIPANPKFYDXXLIN

SEQ ID NO: 707 - DNA, 1077 bp, Streptococcus pyogenes
atgagtttagcaactgactattttagccgacagacccccatagttgaaaagctaatggcttacggttttgagaagcgagacaacggttatttctataacgaacggtttatggaaggggaatttgaggcgcagcttaggattgatgaggctggcaatatctgggatcgggttattgattgtgacttggaggaggattatttgcctttacaacaagcagcctggcaaggaacctatactgggcaggttagagcggcctatttggaacttttggagcgcttatcagtagcctgttttgaagccactccttttcagtcaatgcaagctaatagacttgctaagcatatcaccaaagaatggtctgacccaatggactatccttttgaaaagcacccagaccttgcaacctatcgggtagggggcaaatggtatgctatgattttttctctcttggctgataaattagaccagataccagagagattagtaggacagacatgtgaagtgatgactgtcaaagttaatcccaaggctttccctcagttactgcagcaagaaggcatttacccagcgtatcacatgtcaaagaaaaactggattagtattattttggatgataaggtaacagatgataagctttggacgttagtgactcaaagtcgtcaactagtcaacccaaacggtctttctaatcctaatggtcctgattattgggttattccagctaatttgaaatactatgacattgatgcagaatttgcagccaatgatgtgattttatggacccaaaaagctggtattgccgtgggagactacgtgctgatttatataacagccccagtcaaatccattcgctatgtctgccaagttctagaaactgatatacctaacgagggttatcgtaaaaatcctaacattgacaaactcatgcgtctccgaaaatgccaacagtacaaggatggtctcttgtcttttgaccttatgaaaaaacatggcgtagctgcagtgagagggccaagacgattaagccctcaattaattgcatttttaaaggaaaaagagtattttaaagagaacaac

SEQ ID NO: 708 - protein, 359 aa, Streptococcus pyogenes
MSLATDYFSRQTPIVEKLMAYGFEKRDNGYFYNERFMEGEFEAQLRIDEAGNIWDRVIDCDLEEDYLPLQQAAWQGTYTGQVRAAYLELLERLSVACFEATPFQSMQANRLAKHITKEWSDPMDYPFEKHPDLATYRVGGKWYAMIFSLLADKLDQIPERLVGQTCEVMTVKVNPKAFPQLLQQEGIYPAYHMSKKNWISIILDDKVTDDKLWTLVTQSRQLVNPNGLSNPNGPDYWVIPANLKYYDIDAEFAANDVILWTQKAGIAVGDYVLIYITAPVKSIRYVCQVLETDIPNEGYRKNPNIDKLMRLRKCQQYKDGLLSFDLMKKHGVAAVRGPRRLSPQLIAFLKEKEYFKENN

SEQ ID NO: 709 - DNA, 1206 bp, Streptococcus agalactiae
ttgcgagacttcactagaaagagatttattcccatgacccagtttaccacagaattacttaacttcctagctcaaaaacaagatattgatgaatttttccgttcgtctcttgaaactgccatgaatgaccttctccaagtggagctatccgccttccttggctatgaaccatacgataaggcaggttacaacaccggtaatagtcgtaatggtgcttatacacgtcgatttgagaccaagtatggtgttgttaatttgttgatccctagagatcgaaacggggagttcagtccagccttaatcccaagttacggtcgtcgagacaatcatttagaagaaatggttatcaagctttatcgaactggagtcacaacacgtgaaatcagcgacatcattgagcgtatgtatggtcatcattacagtccagcaacagtatctaatatctcgaaagcgacacaggaaaacgtggctagctttcatgaacgttccttagaagctaactataccgtattatatcttgatgggacttaccttcctctgagacgtggtacagttagtaaggaatgcatccacattgcactaggcgtcacatcatatgggcataaggctatccttggatatgacatcgcacccaatgaaaacaatgcttcgtggtcagaccttctagaaagatttaagggtcaaggtgtacaacaagtctctcttgttgtgagtgatggttttaatggacttgatcagcttatccagcaagccttcccaatggccaaacaacagcgttgccttgtccatattggccgaaatattgcaagtaaggtgaaacgagcagatcgtgctctaattttggagcagtttaaaacaatttatcgcgcgatcaatgtagaggaagcaaagcaagccttagatagctttatcaatgagtggaaaccacactacaagaaggtaatagagaccttagaatcaatcgaaaatctattgatcttttatgaatttcctcatcagatctggggaagtatctactcgaccaaccttattgaatcacttaacaaagaaatcaaacgtcaaaccaaaaagaaagtcgtctttcccaatgaagaatccctagaacgctatctcgtcacactatttagtgattacaacttcaagcaaggacaacgaatccacaaaggttttggccaatgtacggacacacttgaaagcctatttgat

SEQ ID NO: 710 - protein, 402 aa, Streptococcus agalactiae
MRDFTRKRFIPMTQFTTELLNFLAQKQDIDEFFRSSLETAMNDLLQVELSAFLGYEPYDKAGYNTGNSRNGAYTRRFETKYGVVNLLIPRDRNGEFSPALIPSYGRRDNHLEEMVIKLYRTGVTTREISDIIERMYGHHYSPATVSNISKATQENVASFHERSLEANYTVLYLDGTYLPLRRGTVSKECIHIALGVTSYGHKAILGYDIAPNENNASWSDLLERFKGQGVQQVSLVVSDGFNGLDQLIQQAFPMAKQQRCLVHIGRNIASKVKRADRALILEQFKTIYRAINVEEAKQALDSFINEWKPHYKKVIETLESIENLLIFYEFPHQIWGSIYSTNLIESLNKEIKRQTKKKVVFPNEESLERYLVTLFSDYNFKQGQRIHKGFGQCTDTLESLFD

SEQ ID NO: 711 - DNA, 420 bp, Streptococcus pyogenes
atgactcagtttaccacagaattacttaacttcctagcacaaaaacaagatattgatgaattctttcgctcctctttagaaatagctatgaatgacctcttgcaagttgaactatcagcttttcttggttatgaaccttatgaaaaagaaggttacaacacaggtaatagccgtaatgggacttattctcgtcagtttgaaacaaagtatggcttagtcaatttaatcatcccaagagatcgaaacggcgagttttcaccagttttattaccatcttatgctagacgagaggaccacttggaagagatagtgatcaaactctatcagactggcgttacgacacgcgaaatcagtgacattattaagcgcatgtatggtgaccacttgtttctgagtggaagcctcgttacaaaaaggtta

SEQ ID NO: 712 - protein, 140 aa, Streptococcus pyogenes
MTQFTTELLNFLAQKQDIDEFFRSSLEIAMNDLLQVELSAFLGYEPYEKEGYNTGNSRNGTYSRQFETKYGLVNLIIPRDRNGEFSPVLLPSYARREDHLEEIVIKLYQTGVTTREISDIIKRMYGDHLFLSGSLVTKRL

SEQ ID NO: 713 - DNA, 861 bp, Streptococcus agalactiae
atgttttcgagcgattttggatttgagataattaatgttgacgacctatccttgcaagaggagagatttttaccttcagaattgctggcttatgcacgtgatgaaaatgagtcttctttcgtacgtgatattgaggggcatttggcacttgtttaccagcttttggatacgcaaggtcacgttgatgatgttcgtcatgtgccgagagtgataccagtgactctatttttgaaagaagatggcttgtttgtattagctaatcataaaaatattaaccttgtaaaaaaagcacttaatcgtgttgaaaaggtagattctccgaaacacctcttattatcattagtgactgctttctcaaagcaatattttgatgttttagatactatttctgaagaaagagataaactaatcaatgatttgcgtaaaagaccaaacaaatcgaacttggcaaggctggcaaatttacaaagtggaacagtacacttaatgatgggaactaagcaaaattttgaaatgctgaccgatttacaaaacattgagcaagataaagagaacactagaaatgaaaagatgcaacttcaagatgctattattgaagcaagacaattatctaacatgtgttccttaaattcacaggttttccaagaactttcttcttataataatgtcctcagcaataaccttaacgacaatgtaactactttaacaattatttccattggtatttccattattgctatggttaccagtttttatggaatgaatgttaagttgccttttgatagtgtggatgctgtctgggtattgattattttaattacgactatcattactattatgctctctattgttatgtacatt

SEQ ID NO: 714 - protein, 287 aa, Streptococcus agalactiae
MFSSDFGFEIINVDDLSLQEERFLPSELLAYARDENESSFVRDIEGHLALVYQLLDTQGHVDDVRHVPRVIPVTLFLKEDGLFVLANHKNINLVKKALNRVEKVDSPKHLLLSLVTAFSKQYFDVLDTISEERDKLINDLRKRPNKSNLARLANLQSGTVHLMMGTKQNFEMLTDLQNIEQDKENTRNEKMQLQDAIIEARQLSNMCSLNSQVFQELSSYNNVLSNNLNDNVTTLTIISIGISIIAMVTSFYGMNVKLPFDSVDAVWVLIILITTIITIMLSIVMYI

SEQ ID NO: 715 - DNA, 942 bp, Streptococcus pyogenes
atgaaacaaatgtttctttcatcggcaattgaattcaaagaaatagaaacattcgagccaggagcttggattaaactggttaacccttcccaagaagagtctatgaagatcgccgatcaatttaacattgatatttctgacttgcgcgcccctttggacgtggaagaaacctcacgtattgccgtagaagatgattataccctaattatcgtagacgtcccgatatacgaagaacgtaacaataaaagttactatattactatgcctttaggcattattgtaacggaaaatgctgttatcacaacttgtctgcatgacatgacccttttcgatcattttcacaaccgccgggtcaaaaatttctataccttcatgaagacacgttttgtttttcagattctatatcgcaacgccgagctctttctgactgccttgaggaccattgatcgccaaagcgaacgtttggaagctcagcttgaagcagctactcgaaatgaagaacttatcgacatgatggaacttgaaaaatccattgtctacttaaaggcttccttgaaattcaacgaacgcatcgtcaagaaattatccagctcaacaagctctctcaagaaatacattgaggacgaggatttgctagaagataccttgattgaaacccaacaggcgattgagatggctggcatttatgaaaatgtcttgaatgccatgaccgaaaccactgcttctattatcaacaataaccagaacaccattatgaaaacactggccttgatgaccatggctttagatataccaactgtgattttctccgcctatggtatgaatttccaaaacaactggttaccactaaatggcctagaacatgctttttggtatatcaccttgattgctatgctccttagttcctttgttgtgatttactttattagaaaaaaatggttc

SEQ ID NO: 716 - protein, 314 aa, Streptococcus pyogenes
MKQMFLSSAIEFKEIETFEPGAWIKLVNPSQEESMKIADQFNIDISDLRAPLDVEETSRIAVEDDYTLIIVDVPIYEERNNKSYYITMPLGIIVTENAVITTCLHDMTLFDHFHNRRVKNFYTFMKTRFVFQILYRNAELFLTALRTIDRQSERLEAQLEAATRNEELIDMMELEKSIVYLKASLKFNERIVKKLSSSTSSLKKYIEDEDLLEDTLIETQQAIEMAGIYENVLNAMTETTASIINNNQNTIMKTLALMTMALDIPTVIFSAYGMNFQNNWLPLNGLEHAFWYITLIAMLLSSFVVIYFIRKKWF

SEQ ID NO: 717 - DNA, 957 bp, Streptococcus agalactiae
atgtcaaaggtaaggtatggtgttgtgtcaacggcaaaggtggcgcctcgttttattgaaggagtccgcttagcaggaaatggtgaagttgtggctgtatcgagtcgaactcttgagtctgcgcaagcttttgccaacaaatatcatctcccaaaggcttacgataagttagaggatatgttagcagatgagtcaattgatgtgatttatgtggcaacaattaatcaagaccattataaagttgctaaagcagctctgttagcgggaaaacatgtgttggtagaaaagcctttcacattgacttacgaccaagcgaatgaattattcgctttggcagaaagttgtaatctgtttttgatggaggcacaaaaatcggtatttattccgatgacacaagtgattaaaaaattacttgcctctggtgaaataggagaagtgatctccatctcatctacaacagcctacccaaacattgaccatgtaacatggtttagagaacttgagttaggtggaggaacagtgcattttatggcgccctacgccctgtcttatttacaatatctatttgatgcgactataactcatgctagtgggactgcgacttttccaaaaggtcaaagcgatagtcaatccaaactactcttgcaattatcaaatggggtcctcgtagatatcttcttgacaacacgtctaaatttaccgcatgaaatgattatttatggaactgaaggtcgtctaatcattccacatttttggaaaaccactcatgcaaaattggtgagaaatgatactagtgcgcgaacgattcaagttgacatggttagtgattttgagaaagaagcttatcatgttagtcaaatgattttagaagggcaaagggtaagtcatatcatgacgcctcagttgacgctgtcaggtgttaagattatagaagacttataccgttcatgggggaaa

SEQ ID NO: 718 - protein, 319 aa, Streptococcus agalactiae
MSKVRYGVVSTAKVAPRFIEGVRLAGNGEVVAVSSRTLESAQAFANKYHLPKAYDKLEDMLADESIDVIYVATINQDHYKVAKAALLAGKHVLVEKPFTLTYDQANELFALAESCNLFLMEAQKSVFIPMTQVIKKLLASGEIGEVISISSTTAYPNIDHVTWFRELELGGGTVHFMAPYALSYLQYLFDATITHASGTATFPKGQSDSQSKLLLQLSNGVLVDIFLTTRLNLPHEMIIYGTEGRLIIPHFWKTTHAKLVRNDTSARTIQVDMVSDFEKEAYHVSQMILEGQRVSHIMTPQLTLSGVKIIEDLYRSWGK

SEQ ID NO: 719 - DNA, 957 bp, Streptococcus pyogenes
atgaaattagcggttttggggacaggtatgattgttaaggaagttttgcctgtcttgcagaaaattgatggtattgatttagttgctatcttatcaacagttagaagtttaacgacagctaaagacctcgctaaggcacatcacatgcctctagctacgagtaaatatgaggctatcttaggcaatgaggagattgacacggtttatattggactgccgaatcacctgcattttgcctatgctaaggaggcccttctagctggcaaacatgtcatttgtgaaaagccctttaccatgacagcaggagaattagatgaactggtggtaatcgctagaaaacgaaaactcattttgttagaagcgattacgaatcagtacctgagtaacatgacctttatcaaagagcatcttgaccaacttggcgatatcaaaattgtagaatgcaattattcacaatattcttcacgctacgatgccttcaaacgaggtgatatcgcgccagcttttaatcctaaaatgggtggtggagctttacgtgatttaaacatctacaacattcattttgtggtagggttatttggtcgccctaaaacggttcaatatttagccaatgtcgaaaaaggcattgacacctcaggcatgcttgtcatggactatgagcagtttaaagtggtgtgtatcggggccaaagactgcactgcagaaatcaaatcaaccatccaaggtaacaaagggtcactggcagtgcttggagcaacaaataccctccctcaggttcagttaagtctacacggtcacgaaccacaagtgattaaccacaacaagcatgaccaccggatgtatgaagagtttgtcgcttttagggacatgattgaccaaagagactttgagaaagtgaatcaggctttggaacatagccgagctgtcatggctgtgttggagcgcgctgttcattcg

SEQ ID NO: 720 - protein, 319 aa, Streptococcus pyogenes
MKLAVLGTGMIVKEVLPVLQKIDGIDLVAILSTVRSLTTAKDLAKAHHMPLATSKYEAILGNEEIDTVYIGLPNHLHFAYAKEALLAGKHVICEKPFTMTAGELDELVVIARKRKLILLEAITNQYLSNMTFIKEHLDQLGDIKIVECNYSQYSSRYDAFKRGDIAPAFNPKMGGGALRDLNIYNIHFVVGLFGRPKTVQYLANVEKGIDTSGMLVMDYEQFKVVCIGAKDCTAEIKSTIQGNKGSLAVLGATNTLPQVQLSLHGHEPQVINHNKHDHRMYEEFVAFRDMIDQRDFEKVNQALEHSRAVMAVLERAVHS

SEQ ID NO: 721 - DNA, 2649 bp, Streptococcus agalactiae
atgtcaaaagaactatcaccaaaatacaatcctgccgaggttgaggaaggccgttatcaaacttggcttgaccaagatgttttcaagccatcaggggatactgaggctaagccttattctatcgtaattccaccaccaaacgttacgggtaaattgcacttgggtcacgcttgggatacaactctacaagatatcattattcgtcaaaagcgtatgcagggctttgatacactctggcttccaggtatggaccacgctggtatagccactcaagctaaggttgaggagcgccttcgtgagcaaggcatttcacgttatgatcttggtcgtgaaaaattcctagataaagtttgggaatggaaagacgagtatgcagcaactattaaatctcagtggggaaaaatgggtctttcggttgattatagccgtgagcgttttacccttgatgagggactttcaaaagcggtaagaaaagtctttgttgatttgtacaataaaggttggatctatcgtggggagttcatcattaactgggatccagcagctcgcacagccctttcagatattgaagttattcacaaggatgttgagggtgctttctatcatatgaattatatgctggaagatggctcacgcgccctagaagtagcaacaactcgtcctgagactatgtttggagatgtggctgtagcggtaaatccagaagatgcacgttacaaggatttgattggtcaaaatgttatccttcctatcatcaataaacctattccaatcgtcgctgatgaacacgctgatccagaatttggaacaggtgtggttaagattacgccggctcacgaccctaatgactttgctgtaggtcaacgccacaacttaccacaagttaacgttatgaacgatgatggtactatgaatgaacttgcggatgaatttaatggtatggatcgtttcgaagctcgtaaggcagtagtcgctaaattagaatcgttaggaaacttagtaaaaattaaaaaaacgactcattctgttggtcattcagaacgaacaggcgttgtggttgaaccacgtttatctactcaatggttcgtcaagatggatcaattggctaagaatgccattgccaaccaagatacagaagacaaggtagagttttatccaccacgatttaacgatacttttatgagctggatggaaaatgtccatgactgggttatctctcgtcaattatggtggggacaccaaattcctgcatggtacaacgtcaatggtgagatgtatgttggagaagatgccccagagggtgacggatggacacaggatgaagacgttctagacacatggtttagttctgctttatggccgttttcaacaatgggatggccagacaccgaagcagctgacttcaaacgctacttcccaacgtcaaccttggtaactggatacgatatcatcttcttctgggtatcgcgcatgattttccaatcccttgaatttacaggacgccaaccattctcaaatgttcttattcatggactcatccgtgatgaagaaggacgtaaaatgtctaaatcactcggcaacgggattgatccgatggatgtcattgagaaatatggtgcggatgcccttcgttggttcctctcaaatggttcagcccctggtcaagatgtgcgtttttcatacgaaaaaatggatgcttcgtggaatttcattaataagatttggaacatttcacgctatatccttatgaataacgaaggtttaacgttggatcaagccagagaaaatgtggaaaaagttgttaatagtcaagttggaaatgtaacagaccgttggattctccacaatttaaatgagactgtgggtaaagttactgaaaactttgacaagtttgaatttggtgttgctggtcacatcctttacaactttatctgggaagaatttgctaattggtacgttgagttaacaaaagaggttctttatagtgacaatgaagacgagaaagtcatcactcgctctgttcttctttataccttagatcaaatcttgcgtcttcttcatccaatcatgccatttgtgacagaagaaatttttggacaatatgcagaaggatcaattgtccttgcaagttatccacaagttaacgcgacatttgaaaatcaaacagctcacaaaggcgttgaaagcttgaaagatttgattcgttcagtgcgaaatagcagagcagaggtcaatgttgctccatctaaaccaatcactatcttggttaagacaagtgacagcgaactcgaaagcttcttcaaagacaatagcaactacatcaaacgcttcacaaacccagagacgcttgaaatcagctcagcaattgccacaccagaacttgccatgtcatcagtcatcacaggtgcagaaattttcctcccacttgctgacctccttaacgttgaagaagagttggcacgacttgaaaaagaacttgctaaatggcaaaaagaactagatatggttggcaaaaaactcagcaacgagcgctttgtagctaacgctaaaccagaagtcgtccaaaaagaaaaagataaacagaccgactaccaaactaaatacgacgcaaccatagcacgtattgaagaaatgaagaagttggtgagg

SEQ ID NO: 722 - protein, 883 aa, Streptococcus agalactiae
MSKELSPKYNPAEVEEGRYQTWLDQDVFKPSGDTEAKPYSIVIPPPNVTGKLHLGHAWDTTLQDIIIRQKRMQGFDTLWLPGMDHAGIATQAKVEERLREQGISRYDLGREKFLDKVWEWKDEYAATIKSQWGKMGLSVDYSRERFTLDEGLSKAVRKVFVDLYNKGWIYRGEFIINWDPAARTALSDIEVIHKDVEGAFYHMNYMLEDGSRALEVATTRPETMFGDVAVAVNPEDARYKDLIGQNVILPIINKPIPIVADEHADPEFGTGVVKITPAHDPNDFAVGQRHNLPQVNVMNDDGTMNELADEFNGMDRFEARKAVVAKLESLGNLVKIKKTTHSVGHSERTGVVVEPRLSTQWFVKMDQLAKNAIANQDTEDKVEFYPPRFNDTFMSWMENVHDWVISRQLWWGHQIPAWYNVNGEMYVGEDAPEGDGWTQDEDVLDTWFSSALWPFSTMGWPDTEAADFKRYFPTSTLVTGYDIIFFWVSRMIFQSLEFTGRQPFSNVLIHGLIRDEEGRKMSKSLGNGIDPMDVIEKYGADALRWFLSNGSAPGQDVRFSYEKMDASWNFINKIWNISRYILMNNEGLTLDQARENVEKVVNSQVGNVTDRWILHNLNETVGKVTENFDKFEFGVAGHILYNFIWEEFANWYVELTKEVLYSDNEDEKVITRSVLLYTLDQILRLLHPIMPFVTEEIFGQYAEGSIVLASYPQVNATFENQTAHKGVESLKDLIRSVRNSRAEVNVAPSKPITILVKTSDSELESFFKDNSNYIKRFTNPETLEISSAIATPELAMSSVITGAEIFLPLADLLNVEEELARLEKELAKWQKELDMVGKKLSNERFVANAKPEVVQKEKDKQTDYQTKYDATIARIEEMKKLVR

SEQ ID NO: 723 - DNA, 2646 bp, Streptococcus pyogenes
atgacagaactatcacctaaatacaatcctgccgaggttgaggcaggtcgctatcaaaaatggcttgatgcagatgttttcaagccatcaggagaccaaaaagcaaaaccgtattctatcgtgattccaccgccaaatgtgactggtaagttgcacttgggacatgcttgggacacaacacttcaagatattatcattcgtcaaaaacgcatgcagggctttgatacgctttggcttccagggatggaccatgcaggaattgcgacacaggctaaggtagaggagcgtctgcgcgagcaggggatttctcgttacgaccttggtcgtgacaaattcctagacaaggtctgggagtggaaagacgaatatgccactacgattaaagagcagtggggcaaaatggggctttctgtggactacagccgtgagcgcttcacccttgatgagggcttgtcaaaagcagttcgcaaggtttttgttgacctctacaaaaaaggctggatttaccgtggtgaattcatcatcaactgggatcctgctgccagaactgccctttctgacatcgaggttatccacaaggatgttgagggagctttctatcacatgaactatatgttggaagatggctcacgcgcccttcaagtggcaacaacgcgaccagaaaccatgtttggagacgttgccgttgccgtaaacccagaagatcctcgttacaaagatttgattggcaaaaatgttattttaccaatcgtgaataaattgattccaatcgtgggtgacgagcatgctgaccctgaatttgggactggagttgtgaaaatcacgcctgcccatgatcctaacgatttcgaggttggtcaacgccataatctaccacaagtgaatgtcatgaacgatgacggtaccatgaatgagttagctggcgactttgcaggcatggaccgttttgaagctcgtcaagctaccgttgctaaacttgaagaacttggcgccctagtaaacatcgaaaaacgtgttcactcagtaggtcactcagaacgttcaggtgcagtcgttgagcctcgtctatccactcaatggtttgtaaaaatggatgagcttgctaaacaagctatggacaaccaagaaacagatgaccgagtagatttctacccaccacgtttcaacgataccttcctccaatggatggaaaatgtccatgactgggtaatctctcgccaattatggtggggtcaccaaattcctgcttggtacaatgcagaaggtgagatttacgttggcgaagaagcaccagaaggtgatgactggactcaagatgaagatgttcttgacacttggttctcatctgctttatggccgttctcaactatggggtggcctgacacagatgtagaagatttcaaacgttatttcccaacctcaaccttagtaacaggttatgacatcattttcttctgggtgtcacgtatgattttccaatcgcttgaatttaccgggcgtcagccattccaaaatgtcctgattcacggtcttattcgtgacgaagaaggacgcaaaatgtctaaatcattggggaacgggattgatccgatggatgtcattgagaaatatggtgccgatagcttacgttggttcctctcaaacggctctgccccaggacaagacgtgcgtttctcatacgaaaaaatggacgcctcttggaatttcattaataaaatttggaatatttctcgctatatcctcatgaataatgaagggttgacattggaagatgctgaaagtaatgtggctaaggtagctgcctcagaagctggaaatgtgactgaccagtggattctccacaatctcaatgaaaccatcgctaaagtgacagaaaactttgacaagtttgagtttggtgtggcaggacacattctttacaactttatttgggaagaatttgccaactggtatgtggaattgaccaaggaagtgctgtatagcgacaacgaagctgaaaaagttatcacgcgctctgtccttctttatactttggacaagattttacgtctccttcacccaatcatgccatttgtaacagaagaaatttacgctcaatatgcccaaggttctattgtgacggtggactatcctgtggttcgcccagcttttgaaaatgaagctgcgcataaaggtgtggaaagtttgaaagacctgattcgtgcagttcgtaatgcgcgcgctgaagttaacgtggcaccatcaaaaccaatcaccattttggtgaagacagcagatagtgaattagaagactttttcaacagcaatatcaactacatcaaatgcttcactaaccctgaaaaattagaaatcagctcagccattgctgcgccagaactggctatgaccagcatcatcacaggtgctgaaatctacttgccactagcagatttgcttaacgtggaagaagaacttgctcgcctagataaagaactggctaaatggcaaaaagaactggacatggtcggcaaaaaactcggcaacgaacgctttgttgccaacgccaaaccagaagttgtccaaaaagaaaaagacaaacaagctgactaccaagctaagtacgacgcaacccaagaacggattgcagagatgaagaaaattaaatca

SEQ ID NO: 724 - protein, 882 aa, Streptococcus pyogenes
MTELSPKYNPAEVEAGRYQKWLDADVFKPSGDQKAKPYSIVIPPPNVTGKLHLGHAWDTTLQDIIIRQKRMQGFDTLWLPGMDHAGIATQAKVEERLREQGISRYDLGRDKFLDKVWEWKDEYATTIKEQWGKMGLSVDYSRERFTLDEGLSKAVRKVFVDLYKKGWIYRGEFIINWDPAARTALSDIEVIHKDVEGAFYHMNYMLEDGSRALQVATTRPETMFGDVAVAVNPEDPRYKDLIGKNVILPIVNKLIPIVGDEHADPEFGTGVVKITPAHDPNDFEVGQRHNLPQVNVMNDDGTMNELAGDFAGMDRFEARQATVAKLEELGALVNIEKRVHSVGHSERSGAVVEPRLSTQWFVKMDELAKQAMDNQETDDRVDFYPPRFNDTFLQWMENVHDWVISRQLWWGHQIPAWYNAEGEIYVGEEAPEGDDWTQDEDVLDTWFSSALWPFSTMGWPDTDVEDFKRYFPTSTLVTGYDIIFFWVSRMIFQSLEFTGRQPFQNVLIHGLIRDEEGRKMSKSLGNGIDPMDVIEKYGADSLRWFLSNGSAPGQDVRFSYEKMDASWNFINKIWNISRYILMNNEGLTLEDAESNVAKVAASEAGNVTDQWILHNLNETIAKVTENFDKFEFGVAGHILYNFIWEEFANWYVELTKEVLYSDNEAEKVITRSVLLYTLDKILRLLHPIMPFVTEEIYAQYAQGSIVTVDYPVVRPAFENEAAHKGVESLKDLIRAVRNARAEVNVAPSKPITILVKTADSELEDFFNSNINYIKCFTNPEKLEISSAIAAPELAMTSIITGAEIYLPLADLLNVEEELARLDKELAKWQKELDMVGKKLGNERFVANAKPEVVQKEKDKQADYQAKYDATQERIAEMKKIKS

SEQ ID NO: 725 - DNA, 618 bp, Streptococcus agalactiae
ttgtggcgatatgcgctttggtttactgcgaagcgagtgggagaaaaaaagaagatgaatattattatcatcggagcacaagcttctgggaaaatgacaattggtcaggaaatcgcaaaacagacaggcatgaccttattccataaccatgattctatagattttgttttacgcttcatgccatggtctccagatagtattgctctaacggagtctattcgctttaaattttttgaaacgtttgctaagactggtcaagaaatgatttttactattgtaattgatttcaatgattcaagagatgtagtatttctagaaaagattcaaatagtttttcaatctcacaaccaagaggtattatttgtagaattagaaacagagctaagtgagcgtctcaaacgaaatcgcacagaaaatcgcctcaagcataagccttcaaaacgtgatatcaaatggtcagagagcgatatttgttcaaccatggattacgctatctttaatcctgaagtagccccagaagcgcttacatattatcataaaatcaataatacttgcttaactgctactgaaacagcatatcttattattcaaaaaataaaccaaatcaaggagaaaaac

SEQ ID NO: 726 - protein, 206 aa, Streptococcus agalactiae
MWRYALWFTAKRVGEKKKMNIIIIGAQASGKMTIGQEIAKQTGMTLFHNHDSIDFVLRFMPWSPDSIALTESIRFKFFETFAKTGQEMIFTIVIDFNDSRDVVFLEKIQIVFQSHNQEVLFVELETELSERLKRNRTENRLKHKPSKRDIKWSESDICSTMDYAIFNPEVAPEALTYYHKINNTCLTATETAYLIIQKINQIKEKN

SEQ ID NO: 727 - DNA, 582 bp, Streptococcus pyogenes
gtgggaggagcagaaacaaaaatgaaccttatcatcattggtgctcaagcgtcgggcaagatgaccattgggcaagaagttgccaggcagacaggcatgactttgtttcataatcacgattctattgactttgttttacggtttatgccttggtctcaagagagcactgccttgattgaacgtatccgttttgctttttttgaaacctttgctaagacaggtcaagacatgatttttactattgtaattgacttcaatgatccaaatgatgtagcaatgcttgaaaagattcaggctgtttttcagtcttatgaccaagaggttctctttgtcgaattaaaaacagatatagaggaacgtcttaaacgcaatcgcacagaaaatcgtctcaaacataaacctcttaaacgcaacatcgagtggtcagaacaagatattcaatccacgatggcatatgctgtttttaatccagaagaaccacccaaaacgctcacgcattaccaaaaaatcaataatacccagctcaccgctgctgaaacagcgcagcttattatccaaaaaatgactcatatcaaggagaac

SEQ ID NO: 728 - protein, 194 aa, Streptococcus pyogenes
VGGAETKMNLIIIGAQASGKMTIGQEVARQTGMTLFHNHDSIDFVLRFMPWSQESTALIERIRFAFFETFAKTGQDMIFTIVIDFNDPNDVAMLEKIQAVFQSYDQEVLFVELKTDIEERLKRNRTENRLKHKPLKRNIEWSEQDIQSTMAYAVFNPEEPPKTLTHYQKINNTQLTAAETAQLIIQKMTHIKEN

SEQ ID NO: 729 - DNA, 582 bp, Streptococcus agalactiae
atgattaagatacttggagaaatcgtagataaccagctacctgttgtggaaacgaatcgtctgttgttgcgtcaacgcaagttagaagatgctaaggagatatttgaatttgtcaaacttgatgaggtgagttatccagcaggttttccggctgttaaaagcttggaagaagagataacctatattcaagagatttatccaactaatcttgaaaaagaaaagttaccctctggttatgctattactctaaaaggcgatgataaggtaattggttcagtagattttaaccatcgccacgaagatgacatttttgaaattggctacctgctccaccctgattattggggacaaggcattgtgccagaagcagcttcagcccttgtggagataggtttcacactgctaggactacataagattgagctgggatgctatgactataataagcaaagtcaggcggttgcgcgcaaattaggttttactttagaggctaatattcgtgatcgaagagatgcccaggggaaacgttgtggcgatatgcgctttggtttactgcgaagcgagtgggagaaaaaaagaaga

SEQ ID NO: 730 - protein, 194 aa, Streptococcus agalactiae
MIKILGEIVDNQLPVVETNRLLLRQRKLEDAKEIFEFVKLDEVSYPAGFPAVKSLEEEITYIQEIYPTNLEKEKLPSGYAITLKGDDKVIGSVDFNHRHEDDIFEIGYLLHPDYWGQGIVPEAASALVEIGFTLLGLHKIELGCYDYNKQSQAVARKLGFTLEANIRDRRDAQGKRCGDMRFGLLRSEWEKKRR

SEQ ID NO: 731 - DNA, 177 bp, Streptococcus pyogenes
ttgcataaaattgagctgggttgctacgactacaacaagcaaagtcaggcagtggctcgcaaattaggctttaccttagaagccaatgcccgtgaccgtaaggacgttcaaggtcgccgctgtggcgacatgcgttttgggttactgagaagtgagtgggaggagcagaaacaaaaa

SEQ ID NO: 732 - protein, 59 aa, Streptococcus pyogenes
LHKIELGCYDYNKQSQAVARKLGFTLEANARDRKDVQGRRCGDMRFGLLRSEWEEQKQK

SEQ ID NO: 733 - DNA, 696 bp, Streptococcus agalactiae
ttgaaacaaaacgagttgcggatgttatcatccgaatttgggtggtaccgcggaaatcgtaacacgaaattcgtccctgtcagaattgacagggattttttgtatttaggagtgaggagattgaagtatatgcagattctagaagatttcgatggcaaagcattaccaaaactagaaacggatcggcttatcttgcgtcagcgaacggtgggggatgtcccagccatgtttgattacgtttgcttggaagaggttgcctatccagcaggactcagcccaatagcttctttagaagatgagtacgattattttgaaaatcgctactatcaaaatctggaaaaggcaaaattaccatctggttatggtattaccgttaaaggaagtgatcgtattatcggatcctgcgcctttaaccatcgccatgaagacgatgttttcgagatttgctatctgcttcatcctgactactggggtcatggctatatgacagaagctgtcgccgctttgattgaagtcggttttacccttctcaatctccacaaaatcgaaatccgctgctatgattacaataagcaaagccggcgcgtggcagaaaaactaggattcacccttgaagctaccattcgtgatcgtaaggataatcaagacaatcgctgtgtcaatttgatatatggtttgctgaggagtgagtgggag

SEQ ID NO: 734 - protein, 232 aa, Streptococcus agalactiae
MKQNELRMLSSEFGWYRGNRNTKFVPVRIDRDFLYLGVRRLKYMQILEDFDGKALPKLETDRLILRQRTVGDVPAMFDYVCLEEVAYPAGLSPIASLEDEYDYFENRYYQNLEKAKLPSGYGITVKGSDRIIGSCAFNHRHEDDVFEICYLLHPDYWGHGYMTEAVAALIEVGFTLLNLHKIEIRCYDYNKQSRRVAEKLGFTLEATIRDRKDNQDNRCVNLIYGLLRSEWE

SEQ ID NO: 735 - DNA, 300 bp, Streptococcus agalactiae
atgggatttcaaaacacctctaagttaatttattctagcaaaataaggctactttcgcaaggtaaatcaaattattttgcaaaaacaacaccattatcaactaactgtttaatagctgctggaccaataccttttagtgctaaaacatctgcttcacttactttcgcaaatgcttcaaggctgacaaggccagcttcttttaaaacatcttgtttattagcagttaaaccttctaaaagatcgactgcctttggcgcttcaggagccgtctttttcggtaatgcgacttcttgtaaagtt

SEQ ID NO: 736 - protein, 100 aa, Streptococcus agalactiae
MGFQNTSKLIYSSKIRLLSQGKSNYFAKTTPLSTNCLIAAGPIPFSAKTSASLTFANASRLTRPASFKTSCLLAVKPSKRSTAFGASGAVFFGNATSCKV

SEQ ID NO: 737 - DNA, 330 bp, Streptococcus agalactiae
atgaggagaaagcattatacaatggcaaagcgtattaaaccgaataaaaaaagagagcttttgaaagctaaagggatcaattggaaggatgttcgactatctcaaactttacaagaagtcgcattaccgaaaaagacggctcctgaagcgccaaaggcagtcgatcttttagaaggtttaactgctaataaacaagatgttttaaaagaagctggccttgtcagccttgaagcatttgcgaaagtaagtgaagcagatgttttagcactaaaaggtattggtccagcagctattaaacagttagttgataatggtgttgtttttgcaaaa

SEQ ID NO: 738 - protein, 110 aa, Streptococcus agalactiae
MRRKHYTMAKRIKPNKKRELLKAKGINWKDVRLSQTLQEVALPKKTAPEAPKAVDLLEGLTANKQDVLKEAGLVSLEAFAKVSEADVLALKGIGPAAIKQLVDNGVVFAK

SEQ ID NO: 739 - DNA, 393 bp, Streptococcus pyogenes
gtggcaaaacaaaaaaatcgtaaaaaagcattgaaattagaaatgaagcgtaatggcttgttaaaaaaagcaggtcaagtttttgataaggcagttgaaagtgttgaaacagctgtggataaaaccatttctgctggtaaaaatcttgtggaaaaaggcagccaaacagttgaaaacctgacagcaagcaaggaaagacttactcttgatgagtttgcagggcagccagttgtagctggtatccgctctgaccttgtcgaaaccctatatgcagaaggcatccattcagcgcaagcttttaaggagtggacagaaaaagacctccttgctcttaagggcattggtccagcaacggttaaaaaattggtcgaaaatggtgcaagctttaaaaaa

SEQ ID NO: 740 - protein, 131 aa, Streptococcus pyogenes
VAKQKNRKKALKLEMKRNGLLKKAGQVFDKAVESVETAVDKTISAGKNLVEKGSQTVENLTASKERLTLDEFAGQPVVAGIRSDLVETLYAEGIHSAQAFKEWTEKDLLALKGIGPATVKKLVENGASFKK

SEQ ID NO: 741 - DNA, 252 bp, Streptococcus agalactiae
atgtcatacgaacaagaatttttaaaagactttgaagagtggttacaatcgcaaataagtatcaaccaaatggcaatggacagtgcaaagaaagttttagaggaagataaggatgagcgagcagcagatgcgtatattcgttatgagagtaagttagacgcttatcgctttttgcaagggaaatttaataactatcataaccaaaaatctttccatgatttgcctgatggtctttttggacaacgtcattat

SEQ ID NO: 742 - protein, 84 aa, Streptococcus agalactiae
MSYEQEFLKDFEEWLQSQISINQMAMDSAKKVLEEDKDERAADAYIRYESKLDAYRFLQGKFNNYHNQKSFHDLPDGLFGQRHY

SEQ ID NO: 743 - DNA, 252 bp, Streptococcus pyogenes
atgtcttatgaaaaagaatttttaaaagattttgaagactgggttaaaactcagattcaagtcaatcagctagccatggcaaccagtcaagaagttgcccaagaagatggcgatgaaagggctaaagatgcctttattcgttatgaaagtaagttagacgcctacgaatttttactaggtaaatttgacaattataaaaatggtaaagcctttcacgatattccagatgagttatttggagcaaggcattat

SEQ ID NO: 744 - protein, 84 aa, Streptococcus pyogenes
MSYEKEFLKDFEDWVKTQIQVNQLAMATSQEVAQEDGDERAKDAFIRYESKLDAYEFLLGKFDNYKNGKAFHDIPDELFGARHY

SEQ ID NO: 745 - DNA, 246 bp, Streptococcus agalactiae
atgtccccgttaggaatgattaaagatgaaggtttattcaataccattaaaatcatcagccggggactgaaaaatgaacgatgccctcatccaaaattaataaatgttttggaaagaaaacttgaaattatccttggtgatcagaaacatatccttgaaaaagatagccttattagcctctctccacaagaaacacaccatttaagagctattgaaaatagtaaatttctccaaatagaattagac

SEQ ID NO: 746 - protein, 82 aa, Streptococcus agalactiae
MSPLGMIKDEGLFNTIKIISRGLKNERCPHPKLINVLERKLEIILGDQKHILEKDSLISLSPQETHHLRAIENSKFLQIELD

SEQ ID NO: 747 - DNA, 303 bp, Streptococcus pyogenes
atgattgaaaatctctctcaattggtgcaatatcatgatcatcaggtggctagccgatccttgagccgtctactgggattatctcaatctattgttttatatgccatggcccaaggagaaagcattagtcaagagactagtccaagagataaagtaatacttgttttagaaggtcagctcattttcgatttagaggatcaaaaacaggtcctaactcaagaaagtctcatagccatacctgcccaaaaagtccatcatttagaagctaaaaccgattgtaaactattacaagtgcttttagat

SEQ ID NO: 748 - protein, 101 aa, Streptococcus pyogenes
MIENLSQLVQYHDHQVASRSLSRLLGLSQSIVLYAMAQGESISQETSPRDKVILVLEGQLIFDLEDQKQVLTQESLIAIPAQKVHHLEAKTDCKLLQVLLD

SEQ ID NO: 749 - DNA, 297 bp, Streptococcus agalactiae
ttgcttgaactaaaatttcaacaagaaagaatgctgaaaggtttgcatataaaaaatacagatcaattgattttttatgactataggtttggtatgatatcaaatgatgctgttaacaaattcttggcaagctcattggaaaaattagaaatagaatctaagatgtcatcaacaggtgctagacatacttatggaagttatttgttggctaacggagtagatatttgggcggttgcaaaattaatggggcataaagatatcaaacaattaatagaaacatatggtcatttgcttctg

SEQ ID NO: 750 - protein, 99 aa, Streptococcus agalactiae
MLELKFQQERMLKGLHIKNTDQLIFYDYRFGMISNDAVNKFLASSLEKLEIESKMSSTGARHTYGSYLLANGVDIWAVAKLMGHKDIKQLIETYGHLLL

SEQ ID NO: 751 - DNA, 369 bp, Streptococcus agalactiae
atgaaaaagaaattattaggattgatgattttagctatatctacagtatttttagttgcttgttcgactaattcgttaaatgtaaagtattataaagtatatgatggtgaaaaaatgttagttttagaaattaatgatgaatcaggaatttatcataatgaaggaaactttgtagtaactaatattgatactaaaagtaaaagttttgtacttaaaggtgggtctgctaagtatactgttttatatgatgttaaaagtgatggtaaattgaatgttgatttagggaacttttattataatgcttctggtaaggagacatattataaagaaggtagcaaggctttagaaaaagcattaagagataaagaa

SEQ ID NO: 752 - protein, 123 aa, Streptococcus agalactiae
MKKKLLGLMILAISTVFLVACSTNSLNVKYYKVYDGEKMLVLEINDESGIYHNEGNFVVTNIDTKSKSFVLKGGSAKYTVLYDVKSDGKLNVDLGNFYYNASGKETYYKEGSKALEKALRDKE

SEQ ID NO: 753 - DNA, 291 bp, Streptococcus agalactiae
atgtcaacagtagcagtaagagttgatgatcaattaaaagatgatgctacagaactttttcaatccttagggttggatatgagcacagcagtaaaaatgtttttgattcaatctgttaaaactcaaagtattccttttgaaataaaaaataaatcatctgtttctgatgaagaatttcaaaatttggtagaaacaaaattaaagggaatacgagttaaggctagtgatccagaaagtgtaaatgcgttttttggagatgaagatttttcagaatatgaggaatattttaaa

SEQ ID NO: 754 - protein, 97 aa, Streptococcus agalactiae
MSTVAVRVDDQLKDDATELFQSLGLDMSTAVKMFLIQSVKTQSIPFEIKNKSSVSDEEFQNLVETKLKGIRVKASDPESVNAFFGDEDFSEYEEYFK

SEQ ID NO: 755 - DNA, 312 bp, Streptococcus pyogenes
atgtcgttacaaaaaaggaggataaccatggctaaaacgggaactttgaatttacgagttgatgattcagtaaaaagtgcggcagatgatattttgaaacgcttaggtattcctatgtcaactgcgattgatatgtttttgaatcagattattttgactgggggtatcccatttgatgtttctctacctgaagcgcctcaacgagttaatgttgattacatgagtcaggagaagttttatgataagcttatcaccagctttgaagatgcgaaaacttgcaaccctcaggatgtcgggaaattctatttccaa

SEQ ID NO: 756 - protein, 104 aa, Streptococcus pyogenes
MSLQKRRITMAKTGTLNLRVDDSVKSAADDILKRLGIPMSTAIDMFLNQIILTGGIPFDVSLPEAPQRVNVDYMSQEKFYDKLITSFEDAKTCNPQDVGKFYFQ

SEQ ID NO: 757 - DNA, 1176 bp, Streptococcus agalactiae
gtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatggtaaaggaaataaactaccagcaacaggtgagaatgcaactccattctttaatgttgtagctttgacaattatgtcatcagttggtttattatctgtttctaagaaaaaagaggat

SEQ ID NO: 758 - protein, 392 aa, Streptococcus agalactiae
MTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNGKGNKLPATGENATPFFNVVALTIMSSVGLLSVSKKKED

SEQ ID NO: 759 - DNA, 1137 bp, Streptococcus pyogenes
atgcgtagagcagaaaataacaaacacagccgctattccattcgcaaactgagcgttggggtaacgagtatagcaattgcgagtctctttttaggaaaggttgcctatgccgtagatggcatccctccaatctctcttactcaaaagactacagccactacatcagaaaattggcatcatattgataaggatggccttattcctttaggtataagcttagaagctgccaaagaggaatttaaaaaagaagtagaagaatcacgtttatctgaagcacaaaaagaaacgtataaacaaaaaattaaaactgcaccagacaaagataagctattattcacgtatcatagtgagtatatgacagccgttaaggatcttccagcgtctactgagtctactactcagccagttgaggcacccgtgcaggagacacaggcatcagcttcagattcgatggtgacaggtgattcaacatcagttacgactgattctcctgaggaaaccccatcttcggaaagtccagtggccccagctttatctgaggctccagctcaaccagctgagagtgaggaaccttcagtagcagcatcttctgaggaaaccccatctccatcaactccagcggccccagaaactcctgaagaaccagcagctccatctccatcacctgagagtgaggaaccttcagtagcagctccttctgaggaaaccccatctccagaaactcctgaagaaccagcagctccatctcaaccagctgagagtgaagaatcttcagtagcagctacgacaagcccgtctccatcaactccagctgaatcagagactcagacgccaccagctgttactaaagactctgataagccatcttcagcagctgaaaaaccagcagcctcttcacttgtttcagaacaaaccgttcaacaaccaacttcaaagagatcttctgataaaaaagaagagcaagaacagtcttactctccaaatcgctcattgtcaagacaggttagggcccatgagtcaggtaagtacttgccttcaacaggtgaaaaagcacagccactctttatagctactatgactttgatgtctctatttggcagtcttttagtcacaaaacgccaaaaagaaactaaaaaa

SEQ ID NO: 760 - protein, 379 aa, Streptococcus pyogenes
MRRAENNKHSRYSIRKLSVGVTSIAIASLFLGKVAYAVDGIPPISLTQKTTATTSENWHHIDKDGLIPLGISLEAAKEEFKKEVEESRLSEAQKETYKQKIKTAPDKDKLLFTYHSEYMTAVKDLPASTESTTQPVEAPVQETQASASDSMVTGDSTSVTTDSPEETPSSESPVAPALSEAPAQPAESEEPSVAASSEETPSPSTPAAPETPEEPAAPSPSPESEEPSVAAPSEETPSPETPEEPAAPSQPAESEESSVAATTSPSPSTPAESETQTPPAVTKDSDKPSSAAEKPAASSLVSEQTVQQPTSKRSSDKKEEQEQSYSPNRSLSRQVRAHESGKYLPSTGEKAQPLFIATMTLMSLFGSLLVTKRQKETKK

SEQ ID NO: 761 - DNA, 219 bp, Streptococcus agalactiae
  misc_feature (1)..(219): n = a, c, g, or t
gtgactgttaaggttgtcgatccacgtacagatgccgataagaatgatacagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgaaacttacccannnnnt

SEQ ID NO: 762 - protein, 73 aa, Streptococcus agalactiae
  misc_feature (1)..(73): Xaa = Any Amino Acid
MTVKVVDPRTDADKNDTAGKDQQVNVGETPKAEDSIGNLPDLPKGTTVAFETPVDTATPGDKPAKVVETYPXX

SEQ ID NO: 763 - DNA, 1401 bp, Streptococcus agalactiae
atgtatagagctatacagaataaagtaaaggagaatattatgtttagaaggtctaaaaataacagttatgatactttacagacgaaacaacggttttcaattaagaagtttaagtttggtgcagcttctgtactaattggtattagttttttaggaggttttactcaagggcaatttaatatttctacagatactgtgtttgcagctgaagtaatttcaggaagtgctgttacgttaaacacaaatatgactaaaaatgttcagaatggtagagcatatatagatttatatgatgtgaaaaatgggaaaatagatccattacaattaattacgttaaattcacctgatttaaaagctcagtatgtcattaggcaaggcggcaattatttcacacaaccttctgaattgactactgttggtgcagctagtattaattatacagtattgaagacagatggaagtcctcatacgaagcctgatggacaagtggatattgtaaacgtttcattgactatttacaattcttcagctttgagagataaaatagatgaagttaaaaagaaagcggaagaccctaaatgggacgagggaagtcgcgataaagttttgataagtttagatgatatcaaaacagatattgataataatcctaagacgcaatcagacattgccaataaaataactgaagttactaatttagaaaaaatactagtacctcgaatcccagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatctg

SEQ ID NO: 764 - protein, 467 aa, Streptococcus agalactiae
MYRAIQNKVKENIMFRRSKNNSYDTLQTKQRFSIKKFKFGAASVLIGISFLGGFTQGQFNISTDTVFAAEVISGSAVTLNTNMTKNVQNGRAYIDLYDVKNGKIDPLQLITLNSPDLKAQYVIRQGGNYFTQPSELTTVGAASINYTVLKTDGSPHTKPDGQVDIVNVSLTIYNSSALRDKIDEVKKKAEDPKWDEGSRDKVLISLDDIKTDIDNNPKTQSDIANKITEVTNLEKILVPRIPDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDL

SEQ ID NO: 765 - DNA, 1203 bp, Streptococcus agalactiae
gtggtaactcatatgattgattttctactgttgaaatcattacacagtcttctaggtctaactattactgtttgtgatcaaaatttttctgttatcagagagtataaatccgagaaaactatttcacttttttacaatcattaccttattttaagtaactttagtaaaactcaacatgattttttatttcattatggctctttaggagaactttttcttgtccaccatattcaacaatattatattatcatcggtccctggcgtagcaatgttattgaccctttacttcttaagaaaaagctgactgaaacacaaatcaatgctagtgaacaagactactttattgatagactatcccaattacctttcttctcacttagtcaaatccgagaattactaatagtaaccaattattgtctaactggggttgtgaaagataaattatcagagcccttacattactacacgaaagggtggagcaactcctttgatctagataaaattaagcaattttctaaacagaatatgagttcttacaaatatcagtatcattttgaaaataatattctaaaagctgttaaatcaggtagtgaatttcttttgaaagaaacagtggaacaatttagcaattctatcgtacctataatcagtggagatgaattgcgatctgaaaaaaactactccatcatgatttatgatcgtctctcacaggctaccatccaagcaggacttgatatcgaaacagcttatcgagcacgagatcgttttataaaagaaaacgagtcaactataagtctaaatgaagttttaaaattacgtgatactgctatcttattctatactcaacaagttcattctttaaaaaaacatctcgaaacccctcattctcaaactattgtcgcagtgattcgatatcttgaaaataatctaaatcgctttattaaaacagaagaaatagctaaagaatgtcacatgagtgaatcgaagttacgaaaactatttaagcaagaaaaacacatcactattcaacaatattttctaaacttaaaaatcgaagctgctaagcaattactagatgaaaataagaaagtagaagaagtttccaatttacttggattttccacttcttctaatttttcaaggacatttaaaaaaatagtgggaattagcccactagaatataagcaaaagcctaagacaata

SEQ ID NO: 766 - protein, 401 aa, Streptococcus agalactiae
MVTHMIDFLLLKSLHSLLGLTITVCDQNFSVIREYKSEKTISLFYNHYLILSNFSKTQHDFLFHYGSLGELFLVHHIQQYYIIIGPWRSNVIDPLLLKKKLTETQINASEQDYFIDRLSQLPFFSLSQIRELLIVTNYCLTGVVKDKLSEPLHYYTKGWSNSFDLDKIKQFSKQNMSSYKYQYHFENNILKAVKSGSEFLLKETVEQFSNSIVPIISGDELRSEKNYSIMIYDRLSQATIQAGLDIETAYRARDRFIKENESTISLNEVLKLRDTAILFYTQQVHSLKKHLETPHSQTIVAVIRYLENNLNRFIKTEEIAKECHMSESKLRKLFKQEKHITIQQYFLNLKIEAAKQLLDENKKVEEVSNLLGFSTSSNFSRTFKKIVGISPLEYKQKPKTI

SEQ ID NO: 767 - DNA, 531 bp, Streptococcus agalactiae
gtgtcctatatggtaaaagatagacaaattcagaaaacaaaagtagcgatttataatgcttttataagcttgctacaggaaaatgattattctaaaataacggttcaagatgtaatcggacttgcaaatgtaggaagatcaactttttactctcactatgaaagcaaagaagtgttactcaaggagctctgtgaagacctttttcaccacttatttaagcagggtagagatgttacgtttgaagagtatttagttcatatcttaaaacattttgaacaaaatcaagatagtatcgctacgttattattatctgacgatccctattttttattacgctttagaagtgaattagaacacgatgtttaccctagattgcgtgaggagtatattacaaaggtggacattcctgaagatttcttaaaacaatttcttttatccagttttatcgagaccttaaagtggtggcttcatcaaagacagaaaatgactgttgaagatttactaaaatattatttaactatggtagagagg

SEQ ID NO: 768 - protein, 177 aa, Streptococcus agalactiae
MSYMVKDRQIQKTKVAIYNAFISLLQENDYSKITVQDVIGLANVGRSTFYSHYESKEVLLKELCEDLFHHLFKQGRDVTFEEYLVHILKHFEQNQDSIATLLLSDDPYFLLRFRSELEHDVYPRLREEYITKVDIPEDFLKQFLLSSFIETLKWWLHQRQKMTVEDLLKYYLTMVER

SEQ ID NO: 769 - DNA, 528 bp, Streptococcus pyogenes
gtgtccgatatgacaaaagacagacaaatcaaaaaaacaaaaacagctatctatagtgcttttattgctttattacaaaaaaaagaatattcgaaaataactgttcgagatatgattacacttgctaatgtagggagatcaaccttttatgcacattatgaaagcaaagaaatgttactaaaagaactctgtgaagaactttttcatcatttgtttaggcaaaaaagaaatgtgacttttgaggactatttggtacatattttaaagcattttgaacaaaataaagacagcattgcgacgttgttactttctaatgatccctattttttattaagatttaaaaacgaactagaacatgatgtttaccctaacttgcgctgcaagtatatcgacaaaacgactattccagaagtattcctaaaacaatttgttctatctagttttatagaaaccttaaaatggtggctccatcaaaggcaaaggatgtctgcaaatgaactattaaagtattatttagagctcataaaa

SEQ ID NO: 770 - protein, 176 aa, Streptococcus pyogenes
VSDMTKDRQIKKTKTAIYSAFIALLQKKEYSKITVRDMITLANVGRSTFYAHYESKEMLLKELCEELFHHLFRQKRNVTFEDYLVHILKHFEQNKDSIATLLLSNDPYFLLRFKNELEHDVYPNLRCKYIDKTTIPEVFLKQFVLSSFIETLKWWLHQRQRMSANELLKYYLELIK

SEQ ID NO: 771 - DNA, 183 bp, Streptococcus agalactiae
atggaatctggaacaccatctaaaaaaagtttcagggttgatagtaatttaggaagtgctttagataagatgaaagtagatatggcaactgataataatggatcaaggatatacaacggtttccaatttaagataagagatataacaataatagctaaccaccctagaatatcttccaaaaaa

SEQ ID NO: 772 - protein, 61 aa, Streptococcus agalactiae
MESGTPSKKSFRVDSNLGSALDKMKVDMATDNNGSRIYNGFQFKIRDITIIANHPRISSKK

SEQ ID NO: 773 - DNA, 861 bp, Streptococcus agalactiae
atgacatcaaacaaaaaagtggctatcgcttttatattaaatatcagcttttccgtccttgaattcatctttggaagtctattcttctcaggagctatcttagccgatgctgttcatgattttggtgatgcaatagctattggcatctcagctactttagaaaaaaaatctaagaaagatgaagatacgatattttcattaggttataaacgttttagccttttaggagctcttatcacaagtctaattcttataagtggatctatcttagtcatgatagaaaatatcccaaaattgtggcatcctactcctgttaattatcacggcatgtttattctagctgtcatcgctattatcattaatggtctagctagttttattctccattctggtcaaagtaaacatgaggaaatattaagccttcattttttggaagatattctagggtggttagctattattgttatatctcttatcttaaattggaaaccgttgtatatccttgatccattattatcagttgccatatctactttcatcttatctaaagcacttcctaaattactatcaaccctgaaactttttttagatggtgttccagattccatagattacgctgcattacatgatgaacttaagggactttcgcaagtaagatctatcaatcaactcaatatctggtcaatggatggtattgataatcgagcaatcattcactgttgcttaaatcaattgatatctgaaaaagattgtaaaagagctattcgaacgatttgccaacattataagataaacgatgttactgttgaaatcgattattctttaagagaacatcaaaatcattgcaaaccattaaaaaac

SEQ ID NO: 774 - protein, 287 aa, Streptococcus agalactiae
MTSNKKVAIAFILNISFSVLEFIFGSLFFSGAILADAVHDFGDAIAIGISATLEKKSKKDEDTIFSLGYKRFSLLGALITSLILISGSILVMIENIPKLWHPTPVNYHGMFILAVIAIIINGLASFILHSGQSKHEEILSLHFLEDILGWLAIIVISLILNWKPLYILDPLLSVAISTFILSKALPKLLSTLKLFLDGVPDSIDYAALHDELKGLSQVRSINQLNIWSMDGIDNRAIIHCCLNQLISEKDCKRAIRTICQHYKINDVTVEIDYSLREHQNHCKPLKN

SEQ ID NO: 775 - DNA, 873 bp, Streptococcus pyogenes
atgccagcaagtaaaaaagtcaccattatttttatattaaatcttagtttttccctcattgaatttatttttgggacattattcttttcgggtgctattttagcagatgctgtccacgattttggagatgccattgctattggtatctcagctatcttagaaagaaaggctgttaaaaaagagagtccaaatttttcactaggctataagcgatttagccttttaggagcgctaacgacaaatctaatacttattagcgggtcattattagtaatgattgaaacgataccaaaattatggcatcctactattgttaattatgacggtatgttcgttttagctatttttgcaattataatcaatggatttgctagcttcatcattcactctaaccagacaaaaaatgaagaaatattaagccttcactttttagaagatatccttgggtggttagccattatcatactgtcactgatcttaaaatggaaaccttggtacattcttgatcctttattatcaattgccattgcttcttttatattatctaaagctcttccaaagttagtagcaactgctaacatttttttagatggtgttcctgattctatagactattgcactttgcaccatgaactcagccaacttcctcatatagtgtctgttaatcagcttaatgtttggtcgatggatggtattgatcatagagcaactatacattgctgcttgagagaatctaccactgaaaaacattgcaaaaaatctattagactgatttgtcaaaggtacaatataaactcagtcactgtggaaatcgatacttctttaaacgaacaccaacatcactgttcttctctttctagtattgaagtcaac

SEQ ID NO: 776 - protein, 291 aa, Streptococcus pyogenes
MPASKKVTIIFILNLSFSLIEFIFGTLFFSGAILADAVHDFGDAIAIGISAILERKAVKKESPNFSLGYKRFSLLGALTTNLILISGSLLVMIETIPKLWHPTIVNYDGMFVLAIFAIIINGFASFIIHSNQTKNEEILSLHFLEDILGWLAIIILSLILKWKPWYILDPLLSIAIASFILSKALPKLVATANIFLDGVPDSIDYCTLHHELSQLPHIVSVNQLNVWSMDGIDHRATIHCCLRESTTEKHCKKSIRLICQRYNINSVTVEIDTSLNEHQHHCSSLSSIEVN

SEQ ID NO: 777 - DNA, 852 bp, Streptococcus agalactiae
atgacagatacaatgatattaaatgacaatcataaaataccaactttaggtttaggtacgtggatgatagataatgatagggtagctcaagttgttaaagatgctatcgaattaggctaccgccatattgatactgcacaagcatacaacaatgaaaaaggtgtcggtgtagggattaaagagtctggtattacacgtgaatctttatttgttacgactaaaattgccgctgaacataaagattatgaaagtgctacaaaatcaattgatcaatcactagaagctttagggcttgattatattgatttaatgattattcatagtccacagccttggaaggaatggcgtgaaacagataaacattttgaccaaggaaatttagaagcttggagagctttagaggatgctcaaaaatctggtaagatgaaatccatcggtgtctcaaactttttagaaaaagacttagaaaatatcttaaaaaatggtcatgttaaacctgctgtcaatcaaatcttagctcacatcggaaatacacctttcgacttgattgattactgtcaaagtaaaggtattcaagttgaagcctattcaccaattgcacatggacaagcattgaaatctgatggtattcaaaaaatggctgaaaaatatggggttagtgttgctcaattatgtattcaatatttactacaattaaacctgatcgttttaccaaaggcttctagtaaagaacatttacagtctaatctagactttgactttgtaattagtgacgaagatatgtcgatattaaaatcacttatgtttgacgattatggggaattttctaacttccctgtttttagtggaaaa

SEQ ID NO: 778 - protein, 284 aa, Streptococcus agalactiae
MTDTMILNDNHKIPTLGLGTWMIDNDRVAQVVKDAIELGYRHIDTAQAYNNEKGVGVGIKESGITRESLFVTTKIAAEHKDYESATKSIDQSLEALGLDYIDLMIIHSPQPWKEWRETDKHFDQGNLEAWRALEDAQKSGKMKSIGVSNFLEKDLENILKNGHVKPAVNQILAHIGNTPFDLIDYCQSKGIQVEAYSPIAHGQALKSDGIQKMAEKYGVSVAQLCIQYLLQLNLIVLPKASSKEHLQSNLDFDFVISDEDMSILKSLMFDDYGEFSNFPVFSGK

SEQ ID NO: 779 - DNA, 840 bp, Streptococcus pyogenes
gtgatggtaacaacagtaaaaatgacaagtggctatgagattcccgttttaggatttggaacttaccaagcagccgatggtgaggaagcttaccaatctaccttagcagccatcaaggctggctatcgtcatattgatactgcagctatttataaaaatgaagaaagtgtgggtcgtgccatcaaggattctggggttctacgagaagacttatttattacaactaaactctggaatgacgcccatagttatgaaggggcaaaagacgctttagctgcttctcttgaccgtcttggtctggattatgtggatctctatcttatccattggccaaacccaaaagctctgcgtaacacttggaaagaggcaaatgcccaagcatggcaatatatggaagaggcggttgaagcagggcttattaaaagcattggcgtcagcaattttatggtgcatcatctagaagctcttcaagagacagctaaaataactccagcaattaatcagattcgattagccccaggttgctatcaaaaggaagtggttgattattgtaaggcaaatgagattttattggaagcttggagtcctctaggacaaggggagatttttgataatgagactatgcagcagttagctaataaatatgacaaaacagtggcacaagttgccttagcttggtcgctggcagaaggttttattcccttgccaaaatcggtgcatgatgagcgcatcaaggaaaatatggctatttttgatgtgagcttgacacaagaagataaaaaaacaattcgctatctctcaggaatgtcagcgattcctaaccctgatactacaagtttt

SEQ ID NO: 780 - protein, 280 aa, Streptococcus pyogenes
VMVTTVKMTSGYEIPVLGFGTYQAADGEEAYQSTLAAIKAGYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTQEDKKTIRYLSGMSAIPNPDTTSF

SEQ ID NO: 781 - DNA, 102 bp, Streptococcus agalactiae
gtgattttgttattgttccctttacacatggctgtggccaatgtccgtcttgtaaggctggatttgatggaaattgtacaaatcatcaagctgcaaaaaatg

SEQ ID NO: 782 - protein, 34 aa, Streptococcus agalactiae
MILLLFPLHMAVANVRLVRLDLMEIVQIIKLQKM

SEQ ID NO: 783 - DNA, 1035 bp, Streptococcus agalactiae
atgaaagtagctacatttattgaacctggcaaaatggttataactgatacaccaaaaccagtcattgaacaagagacagatgctgttatcaaaattgttagagcctgtgtttgtggttcagacttgtggtggtatcgtggtatttcaaaacgtgaaagtggttcttttgcaggtcatgaggctattggtatcgttgaggaagttggtactaaagtaactgacgtgtcaaaaggtgattttgttattgttccctttacacatggctgtggccaatgtccgtcttgtaaggctggatttgatggaaattgtacaaatcatcaagctgcaaaaaatgtaggataccaaggtcaatatctacgttatactaatgcaaactgggcattggttaagatcccaggacaaccttctgattatgataatgagactcttaactctctgctcaccttatcagatgtaatggcaactggttatcatgctgcagcaactgcagaagttaaagaaggtgacacggtagttgtcatgggagatggtgctgttggactctgtggtgttatcgctgctaaaatgttaggtgctaaccgtatcattgcaatgagtcgtcacaaagataggcaggaactagcattgacttttggtgcaacggatattgtcgaagaacggggtgacgaagccgttaaacgtgttttagatttaaccaatcaagcaggtgccgatgctgttttagaatgtgttggtacagagcagtctgttgatacagctacccaaattgctaggcctggtgctgtcataggacgtgttggtatcccacaaaatccagacatgaataccaataatttattctggaaaaatatcggccttagaggtggcattgcttctgtaacaacatttgataagtctgtccttttagatgctgttctaactcataaaattaacccaggcttagtttttacaaaatcctttgtattagatgatattcaaaaggcttatgaagcaatggataaacgtgacgctatcaaatccttagtgattgttgac

SEQ ID NO: 784 - protein, 345 aa, Streptococcus agalactiae
MKVATFIEPGKMVITDTPKPVIEQETDAVIKIVRACVCGSDLWWYRGISKRESGSFAGHEAIGIVEEVGTKVTDVSKGDFVIVPFTHGCGQCPSCKAGFDGNCTNHQAAKNVGYQGQYLRYTNANWALVKIPGQPSDYDNETLNSLLTLSDVMATGYHAAATAEVKEGDTVVVMGDGAVGLCGVIAAKMLGANRIIAMSRHKDRQELALTFGATDIVEERGDEAVKRVLDLTNQAGADAVLECVGTEQSVDTATQIARPGAVIGRVGIPQNPDMNTNNLFWKNIGLRGGIASVTTFDKSVLLDAVLTHKINPGLVFTKSFVLDDIQKAYEAMDKRDAIKSLVIVD

SEQ ID NO: 785 - DNA, 1089 bp, Streptococcus pyogenes
atgaattggttgattacctctcaaccttataagaagttaaatatgaaagcagcaacttacctttcaaccggaaatctacagctcatagacaaaccaaaaccagtcattataaagcctacagatgctatcgtccagttggtaaaaaccactatttgtggaactgatttgcatatcttaggtggggatgttcccgcatgtaaagaaggaacaatccttggtcatgaaggaattggaattgttaaggaggtcggtgatgcggttactaactttaaaatcggagataaagtgattatttcttgcgtcacatcatgtcatacctgttattattgtaaacgaggcctttcgtcacattgtcaagatggcggttggattcttggccatttaattaatggaacacaagcagaatatgtccatatcccacatgcagatggtagtctctatcatgctcctgatacgattgatgatgaggcacttgtcatgctttctgatattttaccaacttcatatgaaattggtgtcttgccatcacatgtcaagcctggagataatgtttgtattgttggtgccggtccagtaggactcgcagccctactaaccgttcaatttttctctccagccaatattattatggtcgacttatctcaaaatcgccttgaagcagctaaaacatttggagccacacacacgatttgttcaggaagtagtgaagaagtcaaggctatcattgacgatataaccaatggacgtggtgtcgatatttccatggagtgtgttggttatcccgcgacatttgatatttgtcaaaaaattatatcagtaggtgggcatattgctaacgttggggttcatgggaaaccagttgatttcaacctggatgaattatggattaaaaatatcaccttaaacactggacttgttaatgccaatacaactgaaatgctactaaatgtcttgaaaactggaaagattgacgcaacaagacttattacacatcattttaaactttcagaagttgaaaaagcttatgaaacctttaaacatgctggtgcaaataacgccttgaaagttattattgataatgatattagc

SEQ ID NO: 786 - protein, 363 aa, Streptococcus pyogenes
MNWLITSQPYKKLNMKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCQDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 787 - DNA, 393 bp, Streptococcus agalactiae
atgcaagaaacaactaagtctatctttcctaagggtgaaaaaaatccatatggtgaattctttattgggcaatcctatctcgcagcattagcaaaatctccagatgggaatgtttcagttggaaatgtaacctttgaagcaggctgtcgtaataattggcatgttcatttggacggttatcaaatccttctcgttacagaaggttcaggttggtaccaagaagaaggaaaagaagcagtgtcattaaaaccaggcgacgttatcgttacagataaaggtgttagacattggcatggtgctaaaaaagattctgaatttgcacatattgcgattacagctggtaagagtgagttttatgaagctgttagtgatgaagaatattcaagactaggt

SEQ ID NO: 788 - protein, 131 aa, Streptococcus agalactiae
MQETTKSIFPKGEKNPYGEFFIGQSYLAALAKSPDGNVSVGNVTFEAGCRNNWHVHLDGYQILLVTEGSGWYQEEGKEAVSLKPGDVIVTDKGVRHWHGAKKDSEFAHIAITAGKSEFYEAVSDEEYSRLG

SEQ ID NO: 789 - DNA, 315 bp, Streptococcus agalactiae
atgaaagaaaaacaaacagccggacgtcgtcaattagaagaatttgcacctgaatttgccagatataatgatgatattttatttggtgaggtttgggcaaaagaggatcatttaacagataaaacacgttctattattactatatctgccttaattagcggaggaaatcttgaacagttagagcatcatcttcaatttgccaaacaaaacggagttactaaagaagaaattgctgacattatcactcacctcgctttttatgttggatggccaaaagcttggtcagcctttaataaagctaaggaaatttggata

SEQ ID NO: 790 - protein, 105 aa, Streptococcus agalactiae
MKEKQTAGRRQLEEFAPEFARYNDDILFGEVWAKEDHLTDKTRSIITISALISGGNLEQLEHHLQFAKQNGVTKEEIADIITHLAFYVGWPKAWSAFNKAKEIWI

SEQ ID NO: 791 - DNA, 282 bp, Streptococcus agalactiae
atgcttactattcaagaaatgaaagatacaacctttgaattacaagaaaattttagaaggttaaattatcctattaaacaagttgctaaagacttgcaacttaatatcagtgaagttgaatctcttttaagtcttgatgttacttatcctggagatgtttgtatgctgagagattatctagaagatatgttgaaaaaagagggtaaagaagtttatccattttctagattagcatctcattcagcaaatcgttggtacccttatgagacaccatggcgttat

SEQ ID NO: 792 - protein, 94 aa, Streptococcus agalactiae
MLTIQEMKDTTFELQENFRRLNYPIKQVAKDLQLNISEVESLLSLDVTYPGDVCMLRDYLEDMLKKEGKEVYPFSRLASHSANRWYPYETPWRY

SEQ ID NO: 793 - DNA, 429 bp, Streptococcus agalactiae
atgctatcatttcaaattgttgaaaagccagcaatgatacttgctggagtaactttagaaaatgtaaagtcaaatcaagaaggtatccagcaagccattggcatttgtaaaacacaacctgattttcgtttcgattacagtgccacttatcaagtagagacaagtgtccaagccccaaaagggttagaaattattaggatcccaagcgctacctatgcagtcatttctgttaaaggtccaatgccatcgagtcttcaagaaacatggcgaaaaataatacaaggattttttcaagagaataatctaaaaccagctaactcgccaaacttagaaatttattcatctcaacatccacaagatactgattatcaaatggaaatttggcttgctatcgcagatattactaataactcgaaaacaaacttaatc

SEQ ID NO: 794 - protein, 143 aa, Streptococcus agalactiae
MLSFQIVEKPAMILAGVTLENVKSNQEGIQQAIGICKTQPDFRFDYSATYQVETSVQAPKGLEIIRIPSATYAVISVKGPMPSSLQETWRKIIQGFFQENNLKPANSPNLEIYSSQHPQDTDYQMEIWLAIADITNNSKTNLI

SEQ ID NO: 795 - DNA, 387 bp, Streptococcus agalactiae
atgattacacaagaaatgaaagagattattaatagtcagttagcaatggtcgcgacggttgatgctaaaggtcaacccaatattggcccaaaacgttctatgcgtctctgggatgataaaacgtttatttataatgaaaatacagatggtcaaactcgtattaacattgaagataatgggaaaattgaaattgcctttgttgatcgtgaacgtcttttaggttacaggtttgtgggaactgctgaaattcaaacagaaggtacttattacgaagcagcgaaaaaatgggcagaaggacgcatgggggttccgaaagcagttggtattattcatgtcgagcgtatttttaatttacaatctggtgctaatgcaggtaaagaaatcact

SEQ ID NO: 796 - protein, 129 aa, Streptococcus agalactiae
MITQEMKEIINSQLAMVATVDAKGQPNIGPKRSMRLWDDKTFIYNENTDGQTRINIEDNGKIEIAFVDRERLLGYRFVGTAEIQTEGTYYEAAKKWAEGRMGVPKAVGIIHVERIFNLQSGANAGKEIT

SEQ ID NO: 797 - DNA, 399 bp, Streptococcus pyogenes
atgataacacaagaaatgaaagatcttattaataaccaattagcaatggttgcgacggttgatgccaaaggtcaacccaatattggtccaaaacgttctatgcgtctctgggatgataaaacatttatttataatgaaaatacagatggtcaaactcgtattaacattgaagataatgggaaaattgaaattgcctttgttgatcgtgagcgccttttaggttacaggtttgtaggaactgctgaaattcaaacagaaggtgcttattacgaagcagcgaaaaaatgggcacaaggacgcatgggggtaccaaaagcagttggtattattcatgtcgagcgtatttttaatttacaatctggtgctaatgcaggtaaagaaataaacagtgaaagtaac

SEQ ID NO: 798 - protein, 133 aa, Streptococcus pyogenes
MITQEMKDLINNQLAMVATVDAKGQPNIGPKRSMRLWDDKTFIYNENTDGQTRINIEDNGKIEIAFVDRERLLGYRFVGTAEIQTEGAYYEAAKKWAQGRMGVPKAVGIIHVERIFNLQSGANAGKEINSESN

SEQ ID NO: 799 - DNA, 3165 bp, Streptococcus agalactiae
atgacaaaaaaacatcttaaaacgcttgccttggcacttactacagtatcagtagtgacatacagccaggaggtatatggattagaaagagaggaatcggtcaaacaagaacaaacccagtcagcttcagaagatgattggttcgaagaagataatgagaggaaaacaaatgtttctaaagagaattctactgttgatgaaacagttagtgatttattttctgatggaaatagtaataactctagttctaaaaccgagtcagtggtaagtgaccctaaacaagtccccaaagcaaaaccagaggttacacaagaagcaagcaattctagtaatgatgctagcaaagtagaagtaccaaaacaggatacagcttcaaaaaaggaaactctagaaacatcaacttgggaggcaaaagatttcgtaactagaggggatactttagtaggtttttcaaaatctggaattaataagttatctcaaacatcacacttggttttaccaagtcatgcagcagatggaactcaattgacacaagtagctagctttgcttttactccagataaaaagacggccattgcagaatatacaagtaggctaggagaaaatgggaaaccgagtcgtttagatattgatcagaaggaaattattgatgagggagaaatatttaatgcttaccagttgactaagcttactattccaaatggttataagtctattggtcaagatgcttttgtggacaataagaatattgctgaggttaaccttcctgagagtctcgagactatttcagactatgcttttgctcacatgtctttaaaacaagtaaagttaccagataacctaaaggtcattggagaattagctttttttgataatcagattggtggtaagctttacttgccacgtcacttgataaaattagcagaacgcgctttcaaatctaatcgtattcaaacagttgaatttttgggaagtaagcttaaggttataggagaagcaagttttcaagataataatctgaggaatgttatgcttccggatggacttgaaaaaatagaatcagaagcttttacaggaaatccaggagatgaacattacaacaatcaggttgtattgcgcacaaggacaggccaaaatccacatcaacttgcgactgagaatacttacgtcaatccggacaaatcattgtggcgtgcaacacctgatatggattataccaaatggttagaggaagattttacctatcaaaaaaatagtgttacaggtttttcaaataaaggcttacaaaaggtaagacgtaataaaaacttagaaattccaaaacaacacaatggtattactattactgaaattggtgataacgcttttcgcaatgttgattttcaaagtaaaactttacgtaaatatgatttggaagaaataaagctcccctcaactattcggaaaataggtgcttttgcttttcaatctaataacttgaaatcctttgaagcaagtgaagatttagaagagattaaagagggagcctttatgaataatcgtattggaactctagacttgaaagacaaacttatcaaaataggtgatgctgctttccatattaatcatatttatgccattgttcttccagaatctgtacaagaaataggacgttcagcttttcgacaaaatggtgcgcttcaccttatgtttatcggaaataaggttaaaacaattggtgaaatggcttttttatccaataaactggaaagtgtaaatctctctgagcaaaaacaattaaagacaattgaggtccaagctttttcggataatgcccttagtgaagtagtcttaccgccaaatttacagactattcgtgaagaggctttcaaaaggaatcatttgaaagaagtgaagggttcatctacattatctcagattacttttaatgcttttgatcaaaatgatggggacaaacgctttggtaagaaagtggttgttaggacacataataattctcatatgttagcagatggtgagcgttttatcattgatccagataagctatcttctacaatggtagaccttgaaaaggttttaaaaataatcgaaggtttagattactctacattacgtcagactactcaaactcagtttagagaaatgactactgcaggtaaagcgttgttatcaaaatctaacctccgacaaggagaaaaacaaaaattccttcaagaagcacaatttttccttggtcgcgttgatttggataaagccatagctaaagctgagaaggctttagtgaccaagaaggcaacaaagaatggtcatttgcttgagaggagtattaacaaagcggtattagcttataataatagtgctattaaaaaagctaatgttaagcgcttggaaaaagagttagacttgctgacggatttagtcgagggaaaaggaccattagcgcaagctacaatggtacaaggagtttatttattaaagacgcctttaccattgccagaatattatatcggattgaacgtttattttgacaagtctggaaaattgatttatgcacttgatatgagtgatactattggcgagggacaaaaagatgcatatggtaatcctatattaaatgttgacgaggataatgaaggttatcataccttggcagttgccactttagctgattatgaaggtctttatattaaagatattttaaatagttcccttgataagattaaagcaatacgccagattcctttggcaaaatatcatagattaggaattttccaagctattcgaaatgcagcggcagaagcagaccgattgcttcctaagacacctaaggggtacctaaatgaagtcccaaattatcgtaaaaaacaagtggagaaaaatttaaaaccagttgattataaaacgccgatttttaataaggctttacctaatgaaaaggtagacggtgatagagcggctaaaggtcataatataaatgcggagactaataattctgtagctgtaacaccaataaggtccgagcagcaattacataagtcacagtctgatgtaaatttacctcaaacaagttctaaaaataattttatatacgagattctaggatacgttagtttatgtttgcttttcctagtaactgctgggaaaaaaggaaaacgagcaagaaaa

SEQ ID NO: 800 - protein, 1055 aa, Streptococcus agalactiae
MTKKHLKTLALALTTVSVVTYSQEVYGLEREESVKQEQTQSASEDDWFEEDNERKTNVSKENSTVDETVSDLFSDGNSNNSSSKTESVVSDPKQVPKAKPEVTQEASNSSNDASKVEVPKQDTASKKETLETSTWEAKDFVTRGDTLVGFSKSGINKLSQTSHLVLPSHAADGTQLTQVASFAFTPDKKTAIAEYTSRLGENGKPSRLDIDQKEIIDEGEIFNAYQLTKLTIPNGYKSIGQDAFVDNKNIAEVNLPESLETISDYAFAHMSLKQVKLPDNLKVIGELAFFDNQIGGKLYLPRHLIKLAERAFKSNRIQTVEFLGSKLKVIGEASFQDNNLRNVMLPDGLEKIESEAFTGNPGDEHYNNQVVLRTRTGQNPHQLATENTYVNPDKSLWRATPDMDYTKWLEEDFTYQKNSVTGFSNKGLQKVRRNKNLEIPKQHNGITITEIGDNAFRNVDFQSKTLRKYDLEEIKLPSTIRKIGAFAFQSNNLKSFEASEDLEEIKEGAFMNNRIGTLDLKDKLIKIGDAAFHINHIYAIVLPESVQEIGRSAFRQNGALHLMFIGNKVKTIGEMAFLSNKLESVNLSEQKQLKTIEVQAFSDNALSEVVLPPNLQTIREEAFKRNHLKEVKGSSTLSQITFNAFDQNDGDKRFGKKVVVRTHNNSHMLADGERFIIDPDKLSSTMVDLEKVLKIIEGLDYSTLRQTTQTQFREMTTAGKALLSKSNLRQGEKQKFLQEAQFFLGRVDLDKAIAKAEKALVTKKATKNGHLLERSINKAVLAYNNSAIKKANVKRLEKELDLLTDLVEGKGPLAQATMVQGVYLLKTPLPLPEYYIGLNVYFDKSGKLIYALDMSDTIGEGQKDAYGNPILNVDEDNEGYHTLAVATLADYEGLYIKDILNSSLDKIKAIRQIPLAKYHRLGIFQAIRNAAAEADRLLPKTPKGYLNEVPNYRKKQVEKNLKPVDYKTPIFNKALPNEKVDGDRAAKGHNINAETNNSVAVTPIRSEQQLHKSQSDVNLPQTSSKNNFIYEILGYVSLCLLFLVTAGKKGKRARK

SEQ ID NO: 801 - DNA, 3024 bp, Streptococcus pyogenes
atgaagaaacatcttaaaacagttgccttgaccctcactacagtatcggtagtcacccacaatcaggaagtttttagtttagtcaaagagccaattcttaaacaaactcaagcttcttcatcgatttctggcgctgactacgcagaaagtagcggtaaaagcaagttaaagattaatgaaacttctggccctgttgatgatacagtcactgacttattttcggataaacgtactactcctgaaaaaataaaagataatcttgctaaaggtccgagagaacaagagttaaaggcagtaacagagaatacagaatcagaaaagcagatcacttctggatctcaactagaacaatcaaaagagtctctttctttaaataaaacagtgccatcaacgtctaattgggagatttgtgattttattactaaggggaatacccttgttggtctttcaaaatcaggtgttgaaaagttatctcaaactgatcatctcgtattgcctagtcaagcagcagatggaactcaattgatacaagtagctagttttgcttttactccagataaaaagacggcaattgcagaatataccagtagggctggagaaaatggggaaataagccaactagatgtggatggaaaagaaattattaacgaaggtgaggtttttaattcttatctactaaagaaggtaacaatcccaactggttataaacatattggtcaagatgcttttgtggacaataagaatattgctgaggttaatcttcctgaaagcctcgagactatttctgactatgcttttgctcacctagctttgaaacagatcgatttgccagataatttaaaagcgattggagaattagctttttttgataatcaaattacaggtaaactttctttgccacgtcagttaatgcgattagcagaacgtgcttttaaatcaaaccatatcaaaacaattgagtttagaggaaatagtctaaaagtgataggggaagctagttttcaagataatgatctgagtcaactaatgctacctgacggtcttgaaaaaatagaatcagaagcttttacaggaaatccaggagatgatcactacaataaccgtgttgttttgtggacaaaatctggaaaaaatccttctggtcttgctactgaaaatacctatgttaatcctgataagtcactatggcaggaaagtcctgagattgattatactaaatggttagaggaagattttacctatcaaaaaaatagtgttacaggtttttcaaataaaggcttacaaaaagtaaaacgtaataaaaacttagaaattccaaaacagcacaatggtgttactattactgaaattggtgataatgcttttcgcaatgttgattttcaaaataaaactttacgtaaatatgatttggaagaagtaaagcttccctcaactattcggaaaataggtgcttttgcttttcaatctaataacttgaaatcttttgaagcaagtgacgatttagaagagattaaagagggagcctttatgaataatcgtattgaaaccttggaattaaaagataaattagttactattggtgatgcggctttccatattaatcatatttatgccattgttcttccagaatctgtacaagaaatagggcgttcagcatttcggcaaaatggtgcaaataatcttatttttatgggaagtaaggttaagaccttaggtgagatggcatttttatcaaatagacttgaacatctggatctttctgagcaaaaacagttaacagagattcctgttcaagccttttcagacaatgccttgaaagaagtattattaccagcatcactgaaaacgattcgagaagaagccttcaaaaagaatcatttaaaacaactggaagtggcatctgccttgtcccatattgcttttaatgctttagatgataatgatggtgatgaacaatttgataataaagtggttgttaaaacgcatcataattcctacgcactagcagatggtgagcattttatcgttgatccagataagttatcttctacaatagtagaccttgaaaagattttaaaactaatcgaaggtttagattattctacattacgtcagactactcaaactcagtttagagacatgactactgcaggtaaagcgttgttgtcaaaatctaacctccgacaaggagaaaaacaaaaattccttcaagaagcacaatttttccttggccgcgttgatttggataaagccatagctaaagctgagaaggctttagtgaccaagaaggcaacaaagaatggtcagttgcttgaaagaagtattaacaaagcggtattagcttataataatagcgctattaaaaaagctaatgttaagcgcttggaaaaagagttagacttgctaacaggattagttgagggaaaaggaccattagcgcaagctacaatggtacaaggagtttatttattaaagacgcctttgccattgccagaatattatatcggattgaacgtttattttgacaagtctggaaaattgatttatgcacttgatatgagtgatactattggcgagggacaaaaagacgcttatggtaatcctatattaaatgttgacgaggataatgaaggttatcatgccttggcagttgccactttagctgattatgaggggctcgacatcaaaacaattttaaatagtaagcttagtcaattaacatctattcgtcaggtaccgactgcagcctatcatagagccggtattttccaagctatccaaaatgcagcggcagaagcagagcagttattgcctaaaccaggtacgcactctgagaagtcaagctcaagtgaatctgctaactctaaagatagaggattgcaatcaaacccaaaaacgaatagaggacgacactctgcaatattgcctaggacagggtcaaaaggcagctttgtctatggaatcttaggttacactagcgttgctttactgtcactaataactgctataaaaaagaaaaaatat

SEQ ID NO: 802 - protein, 1008 aa, Streptococcus pyogenes
MKKHLKTVALTLTTVSVVTHNQEVFSLVKEPILKQTQASSSISGADYAESSGKSKLKINETSGPVDDTVTDLFSDKRTTPEKIKDNLAKGPREQELKAVTENTESEKQITSGSQLEQSKESLSLNKTVPSTSNWEICDFITKGNTLVGLSKSGVEKLSQTDHLVLPSQAADGTQLIQVASFAFTPDKKTAIAEYTSRAGENGEISQLDVDGKEIINEGEVFNSYLLKKVTIPTGYKHIGQDAFVDNKNIAEVNLPESLETISDYAFAHLALKQIDLPDNLKAIGELAFFDNQITGKLSLPRQLMRLAERAFKSNHIKTIEFRGNSLKVIGEASFQDNDLSQLMLPDGLEKIESEAFTGNPGDDHYNNRVVLWTKSGKNPSGLATENTYVNPDKSLWQESPEIDYTKWLEEDFTYQKNSVTGFSNKGLQKVKRNKNLEIPKQHNGVTITEIGDNAFRNVDFQNKTLRKYDLEEVKLPSTIRKIGAFAFQSNNLKSFEASDDLEEIKEGAFMNNRIETLELKDKLVTIGDAAFHINHIYAIVLPESVQEIGRSAFRQNGANNLIFMGSKVKTLGEMAFLSNRLEHLDLSEQKQLTEIPVQAFSDNALKEVLLPASLKTIREEAFKKNHLKQLEVASALSHIAFNALDDNDGDEQFDNKVVVKTHHNSYALADGEHFIVDPDKLSSTIVDLEKILKLIEGLDYSTLRQTTQTQFRDMTTAGKALLSKSNLRQGEKQKFLQEAQFFLGRVDLDKAIAKAEKALVTKKATKNGQLLERSINKAVLAYNNSAIKKANVKRLEKELDLLTGLVEGKGPLAQATMVQGVYLLKTPLPLPEYYIGLNVYFDKSGKLIYALDMSDTIGEGQKDAYGNPILNVDEDNEGYHALAVATLADYEGLDIKTILNSKLSQLTSIRQVPTAAYHRAGIFQAIQNAAAEAEQLLPKPGTHSEKSSSSESANSKDRGLQSNPKTNRGRHSAILPRTGSKGSFVYGILGYTSVALLSLITAIKKKKY

SEQ ID NO: 803 - DNA, 2163 bp, Streptococcus agalactiae
atgacacaatcagatgcatatctctcgttgaacgcgaagacacgctttagagatcgcacaggtaattatcattttacttcggataaagaggctgttgaacaatatatgatagaacatgttgaacctaatacgatggtgttcacatcactaattgaaaagctagattatttggtttctaataactactatgaatcggaccttctaaaacaatataaccttgagtttatttgccaaatttttgagcatgcatacgctaagaaatttgcttttctaaattttatgggggctttaaaattttataatgcttatgctcttaaaacagaagacaatcgttattatttggaacactatgaagatcgtgttgtaatgaatgctctgtttttagctgctggtgatgaaaaagctgcctatgacctagtagatgacatgctagcaaatcgctttcaaccagcaacacctacctttttaaatgcagggaaaaaacgtcgtggtgaatatatctcttgctatttgttgcgcattgaagacaatatggaatctatttctcgtgctattagtacaagccttcagttatcaaaacgaggtggtggggtagcactttgcttaaccaacttacgggaatttggtgctccaataaaaggtattaaaaatcaagctactggtattgtacctgtcatgaaattactagaagattcgttttcttacgccaatcaattaggacaaagacaaggagctggtgcagtttacttacacgctcaccatcctgaagtattaacgtttttagatactaaacgtgagaatgccgatgagaaaattcgaattaaatctctttccctaggacttgttattcctgatattacttttgaattggctaaggcaaataaagatatggccttgttttcaccgtatgacattgagcgagtatatggtaaaccaatgtctgatatctctatcacagaagaatatgaaactttattagccaatgcggatattcgtaaaacctttattagtgcacgaaaactatttcaaacgatagcagagcttcattttgaatctggttatccttatatcttatttgaagatactgtaaatgctaaaaaccctcacaaaaaagagggacgaattgttatgtctaatttatgttctgagattgcacaagttaatacagctagtcaattttcagaagacctgactttcactaaggttggacatgatgtttgttgtaatttaggttctattaatattgcgcgtgctatggatcaagcggcggattttgaaaaattaattgctaatagcattagagcccttgatcgtgtatctcgaacttctgatttagatagtgctccatctattaaaaaaggtaatgcagctaatcatgctgttggtttaggtgctatgaatttgcatggatttttggcgactaaccatatttattacgattctcaagaggctattgattttacagattgcttcttttacgctatggcttattatgcctttaaagcttctaaccatttagcaaaagaaaaaggaacctttgagggcttctcggaatcaagttatgctgatggcagttatttctatcaatataccgaacaaaactttgagccaaaaacacagcgtgttaaaaatctactagctgagtatggtctgactctaccaagccaagaggattggagaaagcttgtgcaaagtattaaagagataggattagctaatgcgcatttattagctgttgctccgacagggtcaatcagttatctttcttcttgtactccgagccttcaaccggttgtatcacctgtcgaagtacgcaaggaaggagcactggggagggtttatgtacctgcttataagattgatgcagataattatgtctactacaaaaaaggagcttatgaagtgggatctgaggcgattatcaatattgcagctgccgctcaaaaacacattgatcaagctatttcgttaacgcttttcatgacagatcaagcaactacgcgagatttaaataaagcctatattcaagcatttaaacaaaaatgtgcctctatttattatgtacgagtgagacaggacatcctagaaggtagcgagagttatgatgatatgctggatgatttcacttcatcggacttagaagactgtcaatcctgcatgatt

SEQ ID NO: 804 - protein, 721 aa, Streptococcus agalactiae
MTQSDAYLSLNAKTRFRDRTGNYHFTSDKEAVEQYMIEHVEPNTMVFTSLIEKLDYLVSNNYYESDLLKQYNLEFICQIFEHAYAKKFAFLNFMGALKFYNAYALKTEDNRYYLEHYEDRVVMNALFLAAGDEKAAYDLVDDMLANRFQPATPTFLNAGKKRRGEYISCYLLRIEDNMESISRAISTSLQLSKRGGGVALCLTNLREFGAPIKGIKNQATGIVPVMKLLEDSFSYANQLGQRQGAGAVYLHAHHPEVLTFLDTKRENADEKIRIKSLSLGLVIPDITFELAKANKDMALFSPYDIERVYGKPMSDISITEEYETLLANADIRKTFISARKLFQTIAELHFESGYPYILFEDTVNAKNPHKKEGRIVMSNLCSEIAQVNTASQFSEDLTFTKVGHDVCCNLGSINIARAMDQAADFEKLIANSIRALDRVSRTSDLDSAPSIKKGNAANHAVGLGAMNLHGFLATNHIYYDSQEAIDFTDCFFYAMAYYAFKASNHLAKEKGTFEGFSESSYADGSYFYQYTEQNFEPKTQRVKNLLAEYGLTLPSQEDWRKLVQSIKEIGLANAHLLAVAPTGSISYLSSCTPSLQPVVSPVEVRKEGALGRVYVPAYKIDADNYVYYKKGAYEVGSEAIINIAAAAQKHIDQAISLTLFMTDQATTRDLNKAYIQAFKQKCASIYYVRVRQDILEGSESYDDMLDDFTSSDLEDCQSCMI

SEQ ID NO: 805 - DNA, 2178 bp, Streptococcus pyogenes
atgtcacaaaccaatgcgtcatacctctcattaaatgcactgacccgttttaaaaaaccagacggcagctaccattttgatagcgataaagaagctgttaggcgctacctggaagaacatgtctctcccaatcaaatggcttttaactcactagaagataagctagcttacctcatcaatgaagggtattatgagcaggccatttttgatgcctatcctaatgaccttatcaaggaggcctttcattatgcctatcaacaaggctatcgctttttaaatctcatgggcgctatgaaattttaccagtcctatgccttaaaaaccttggacggtaagcagtatctagaaacatttgaagaccgtgctgtgatgaatgcactctttttagctgatggagatcaaacctttgtctttgacgtgattgatgccatcttgcaccgacgctttcaaccagctaccccaacgtttttaaatgccggaaaaaaacgccgtggcgaatacatttcgtgctatcttcttcgtgtcgaagacaatatggaatctatctctcgcgccattagcaccagcttgcaactctcaaaaagaggaggcggagtcgccttgtgcctcaccaacctcagagaaatcggagcaccgataaaagggattgaaaatcaggcaacaggcatcgttcctgtcatgaaactactagaggactctttttcctatgccaatcaactaggtcagcgccaaggagcaggtgcggtttaccttcatgcccatcaccctgaggttttgacctttttagacaccaaacgtgaaaatgccgatgagaaaattcgcattaagtccctagcattgggacttgtgatcccagatattaccttccagttagccaaagaaaacaaagacatggcactcttttcaccctatgatatcaagcgtgcctatggcaaggacatgtcagacatctccatcacagaggaatacgataaactgctagccaatccagccatcaaaaagacctacatcagtgctagaaagttctttcagttaattgcagagctacattttgagtcaggctacccttacctcttgtttgatgacacggtcaataagcgcaaccctcatgccaaaaaaggcagaatcgtcatgtctaacctgtgttctgaaatcgctcaagttagcaccccaagcactttcaaagaagatttgagttttgaaaccattggagaggatatctgctgtaatttagggtctatcaatattgcccaggctatggcagatgcgccacactttgaacagctcatcacaacgagcatcagagcacttgatcgtgtctctagagtgtctgacctgaattgtgcgccttctgttgagacaggcaatgcagccaaccatgcagtaggattaggcgccatgaacctacatggttttttggcaaccaaccacatctactatgatacaaaagaagccgttgactttacagatctgtttttccatgccatggcctattatgcttttaaagcctcttgccaattagccaaagaaaaaggcgcttttgcaggattttcgttatcaacctattcagatggcacttattttgccaagtatttgcaagaagatgccaagccacaaacagccaaggttgccacattgttgcaagattacggcttcacgttgccaacggtggcggattggcaagccctagtagcagatatcaagcagtttggcctagccaatgcgcacttgctagcggttgctccgacaggctccatcagctacttatcatcctgcactccgagtctacaaccagtcgttgctcctgttgaggtccgaaaagaaggtagcctgggcaggatttacgtccctgcctatcagattgaccaggctaactatgcttactatgaacgtggtgcctatgaggtcggcccaaaagccatcatcgacgttgtagctgctgcccaaaaacacgttgaccaagccatctcattgaccctgtttatgaccgatcaagcgaccacacgtgacctgaaccgctcctatatccaagcttttaagcaaaattgtgcatcgatctattatgtgcgagtgaggcaagacgtcctagcaggcagcgaacagtatgacgaggatagtcttgtgacagctcctggagctagtgatgagaccaccacagagtgtcaaagctgtatgatc

SEQ ID NO: 806 - protein, 726 aa, Streptococcus pyogenes
MSQTNASYLSLNALTRFKKPDGSYHFDSDKEAVRRYLEEHVSPNQMAFNSLEDKLAYLINEGYYEQAIFDAYPNDLIKEAFHYAYQQGYRFLNLMGAMKFYQSYALKTLDGKQYLETFEDRAVMNALFLADGDQTFVFDVIDAILHRRFQPATPTFLNAGKKRRGEYISCYLLRVEDNMESISRAISTSLQLSKRGGGVALCLTNLREIGAPIKGIENQATGIVPVMKLLEDSFSYANQLGQRQGAGAVYLHAHHPEVLTFLDTKRENADEKIRIKSLALGLVIPDITFQLAKENKDMALFSPYDIKRAYGKDMSDISITEEYDKLLANPAIKKTYISARKFFQLIAELHFESGYPYLLFDDTVNKRNPHAKKGRIVMSNLCSEIAQVSTPSTFKEDLSFETIGEDICCNLGSINIAQAMADAPHFEQLITTSIRALDRVSRVSDLNCAPSVETGNAANHAVGLGAMNLHGFLATNHIYYDTKEAVDFTDLFFHAMAYYAFKASCQLAKEKGAFAGFSLSTYSDGTYFAKYLQEDAKPQTAKVATLLQDYGFTLPTVADWQALVADIKQFGLANAHLLAVAPTGSISYLSSCTPSLQPVVAPVEVRKEGSLGRIYVPAYQIDQANYAYYERGAYEVGPKAIIDVVAAAQKHVDQAISLTLFMTDQATTRDLNRSYIQAFKQNCASIYYVRVRQDVLAGSEQYDEDSLVTAPGASDETTTECQSCMI

SEQ ID NO: 807 - DNA, 411 bp, Streptococcus agalactiae
atggatagtacagtgaaggtggtctatttttcatcgaaatctaacaatacccatcgttttgttcaaaagttggcttgttctaaccagcgtattccatcagatggtagtagtatattggttactgaggattatattttgattgtgcctacttacgctggaggaggagatgataccaaaggcgcagttccaaaacaagttgtacagtttttaaatgttcgacaaaatcgggaacattgccaaggggttatttcttctggaaataccaattttggtgacacttatgccattgctggacctattattgctcgaaaattaaatgttcctttgcttcatcaatttgaattactgggaacacaagaagatgttacaagggtaaaggagttactttgccaattcactagaaaggataaa

SEQ ID NO: 808 - protein, 137 aa, Streptococcus agalactiae
MDSTVKVVYFSSKSNNTHRFVQKLACSNQRIPSDGSSILVTEDYILIVPTYAGGGDDTKGAVPKQVVQFLNVRQNREHCQGVISSGNTNFGDTYAIAGPIIARKLNVPLLHQFELLGTQEDVTRVKELLCQFTRKDK

SEQ ID NO: 809 - DNA, 486 bp, Streptococcus pyogenes
atggcagagctgattattgtgtatttttcatctaagtccaataacacccatcgcttcgtccaaaaattaggcctgcctgctcagcgcataccagtagataataggccacttgaagtttccacccattaccttttgattgtgcctacctatgcagctggtggctcagatgccaaaggagccgtttctaaacaagtgattcgttttttgaataatcctaacaatcgtaaacattgtaagggagtgatttcttctggaaataccaattttggcgatacctttgccttagcaggccctatcatttctcaaaaattgcaggtccccttattacaccaatttgaactattaggcactgctacagatgtcaaaaaggtacaggcgatttttgcccgcttaaagcatcacacacacgacaagcaaaaacaaaccaacaacctgattacagaaaggacacacccatgtcacaaaccaatgcgtcatacctctcat

SEQ ID NO: 810 - protein, 162 aa, Streptococcus pyogenes
MAELIIVYFSSKSNNTHRFVQKLGLPAQRIPVDNRPLEVSTHYLLIVPTYAAGGSDAKGAVSKQVIRFLNNPNNRKHCKGVISSGNTNFGDTFALAGPIISQKLQVPLLHQFELLGTATDVKKVQAIFARLKHHTHDKQKQTNNLITERTHPCHKPMRHTSH

SEQ ID NO: 811 - DNA, 1008 bp, Streptococcus agalactiae
atgcaatcatactatgatcgttctcaatcgccacttgactatgccttgtcagaaaaagcttttcctatgcgttctgttaattggaataagctaaacgatgacaaagacttagaggtatggaacagagtaactcaaaatttctggttacctgaaaagatcccagtttctaatgaccttaattcttggagaacattggatgctgattggcagcaattaattactcggacttttactggtctaaccttattagattctgtgcaggctactgttggtgatattgctcagattaagcattctcagacagatcatgaacaagttatttatgctaactttgcctttatggtagctattcatgcgcgatcttatggaacgattttttcaaccttatgcactagccaacaaattgaggaagcacatgaatgggtagtggatactgaaagtctacaagctcgatcacgtatacttattcctttttatactggtgacgatcctttgaaatctaaggttgctgcagccatgatgccaggatttttgttatatggtggcttttaccttcctttttacctttcagccagaggaaaattaccaaatacgtctgatattattcgtttaattttacgagataaggtaattcataactattacagtggctataagtatcaacagaaagttgctaaattatctgtagaaaagcaagccgaaatgaagacatttgtctttgacctcctctatcagttgattgatttagaaaaagcctatctttacgaactatatgatggttttgatttggctgaagatgcaatcagatttagcatttacaatgctggtaaatttttacaaaatttaggatatgattctccatttacagaagaagagactcgtatatctcctgaggtttttgcacaactttcggcgcgtgcagatgaaaatcatgatttcttctcaggaaacggctcttcatatattatggggattacagaagaaacattggatgaagattgggagttt

SEQ ID NO: 812 - protein, 336 aa, Streptococcus agalactiae
MQSYYDRSQSPLDYALSEKAFPMRSVNWNKLNDDKDLEVWNRVTQNFWLPEKIPVSNDLNSWRTLDADWQQLITRTFTGLTLLDSVQATVGDIAQIKHSQTDHEQVIYANFAFMVAIHARSYGTIFSTLCTSQQIEEAHEWVVDTESLQARSRILIPFYTGDDPLKSKVAAAMMPGFLLYGGFYLPFYLSARGKLPNTSDIIRLILRDKVIHNYYSGYKYQQKVAKLSVEKQAEMKTFVFDLLYQLIDLEKAYLYELYDGFDLAEDAIRFSIYNAGKFLQNLGYDSPFTEEETRISPEVFAQLSARADENHDFFSGNGSSYIMGITEETLDEDWEF

SEQ ID NO: 813 - DNA, 1011 bp, Streptococcus pyogenes
atgacccaacattattatgaacgttcgcaatccccaattgaatacgccctatctgaaacacaaaaacagttgcgctccatcaattggaattaccttaatgatgacaaagatttagaagtgtggaaccgtgtcactcaaaatttttggttgcctgaaaaggttcctgtttctaatgatttaaattcttggcgctccttgggtgaggattggcaacagctcatcacaaggacctacactgggttgaccttactagatacagtacaagcaacggttggtgatgtggcacaaattcagcattcacaaaccgaccacgaacaagtcatctatacgaactttgcctttatggtggggattcatgcccgctcttacgggacgattttttcgaccctttgcagcagcgagcaaatcgaagaagcacatgaatgggtggtctcaacacagagcttgcaagaccgtgcccgtgtcttgattccttactatacgggtgatgaccctttgaaatcaaaagtagcagcagctatgatgccaggatttttgctgtatggcggcttttaccttcctttttacctatcagcacgtggtaaaatgccaaacacatctgatatcatccgcctgattttacgcgacaaagttattcacaactattacagcggttacaaataccaacaaaaagtagcacgtcttagcccagaaaaacaggctgaaatgaaggcctttgtctttgacttgctctatgaactcatcgaccttgaaaaagcttacttgagagaactgtatgcaggctttgatttggcagaagatgctatccgttttagcctttataacgctggaaaattccttcaaaatttaggctatgagtcgcccttcacagatgaagaaacgcgcgtttcaccagaagtatttgctcagctatcagcgcgtgcagacgaaaaccatgactttttctcaggcaatggctcatcttatgtgatggggatcaccgaagaaaccacagatgacgattgggagttt

SEQ ID NO: 814 - protein, 337 aa, Streptococcus pyogenes
MTQHYYERSQSPIEYALSETQKQLRSINWNYLNDDKDLEVWNRVTQNFWLPEKVPVSNDLNSWRSLGEDWQQLITRTYTGLTLLDTVQATVGDVAQIQHSQTDHEQVIYTNFAFMVGIHARSYGTIFSTLCSSEQIEEAHEWVVSTQSLQDRARVLIPYYTGDDPLKSKVAAAMMPGFLLYGGFYLPFYLSARGKMPNTSDIIRLILRDKVIHNYYSGYKYQQKVARLSPEKQAEMKAFVFDLLYELIDLEKAYLRELYAGFDLAEDAIRFSLYNAGKFLQNLGYESPFTDEETRVSPEVFAQLSARADENHDFFSGNGSSYVMGITEETTDDDWEF

SEQ ID NO: 815 - DNA, 915 bp, Streptococcus agalactiae
ttgatagcaatgaaaacgataaaagattggcaaataaatatttgcttagcgacctataatggtcaaaaataccttcgccagcaattagatagcataatacaacaaggttatactgactggatttgtttaataagggacgatggatctactgatgatacagtagctattattaaagaatatgttaatagagattcacgttttatatttattaattctaacgatgacagaaagttaggaagtcaccgcagtttttacgagttggttaactataaaaaagcagatttttatgttttctcagaccaggatgatgtttggaaagaaaatcgtttagaacgttaccttgaagaagcagagaaatttaaccaagaactaccattgcttgtttattcgaactggacttctgtagatgaaaaattaacagtattgaaagaacataatccagcaacagttattcaagaacaaattgcctttaaccaaataaatggtatggttatcatgatgaatcatgagttagcaaagctttgggaatatcgtcaaattggcgcccatgattcttatgttggaactctagcttacgccgttggaaatgtggcttatatttctgacagtacagtcctttggcgtagacaagtaggggcagagtcgctaaacaattacgggagacaatatggggtggctacgttttggcagatgataaatacttcttttgatcgtgcttcgcttatttttgctcaagtatccgataaaatgtccctggagcgtaaactcttctttagtcgttttatagaattaaaaaatgccaatctaatgagaaggatttatcttttatcaaaattaaaactccgtcggaaatcattgaaagaaacagttgctatgactatcctacttttaacaggttacggtaaaccaaaagca

SEQ ID NO: 816 - protein, 305 aa, Streptococcus agalactiae
MIAMKTIKDWQINICLATYNGQKYLRQQLDSIIQQGYTDWICLIRDDGSTDDTVAIIKEYVNRDSRFIFINSNDDRKLGSHRSFYELVNYKKADFYVFSDQDDVWKENRLERYLEEAEKFNQELPLLVYSNWTSVDEKLTVLKEHNPATVIQEQIAFNQINGMVIMMNHELAKLWEYRQIGAHDSYVGTLAYAVGNVAYISDSTVLWRRQVGAESLNNYGRQYGVATFWQMINTSFDRASLIFAQVSDKMSLERKLFFSRFIELKNANLMRRIYLLSKLKLRRKSLKETVAMTILLLTGYGKPKA

SEQ ID NO: 817 - DNA, 930 bp, Streptococcus pyogenes
atgaacattaatattttactatccacctacaatggagaacgcttcttagcagaacaaattcaaagtatccaaaggcaaacagttaacgactggaccttattgattagagatgatggttcaactgatggcacccaggatattattcgcacatttgtcaaggaagacaaacgaattcagtggatcaatgaggggcagacagaaaatctgggagttattaagaatttttacaccctcttaaagcaccaaaaagcagatgtctattttttcagtgaccaagatgatatatggttagacaataaactggaagtgaccttattggaggctcaaaaacatgaaatgacagctcctttattggtttatacagacctcaaagtggtaacccaacatttagctgtttgccatgacagtatgattaagacccaatctggtcatgcaaacacaagcctacttcaagaattaaccgaaaataccgtaacaggcggcacaatgatgattactcatgctctggctgaggaatggaccacttgtgacggtttattgatgcatgactggtatttagctttactagcttctgctattgggaaattagtttaccttgatattccaacagaattataccgtcagcacgatgctaacgtgttgggagctagaacttggtctaaacgcatgaaaaattggttaaccccccatcatttagtcaacaaatattggtggttgattacttcaagccaaaaacaggctcaattactattagatttaccattaaaaccaaatgaccatgaattggtaacggcctatgtttctttattggatatgccttttaccaaacgcttagctaccttgaaaaggtacggttttagaaaaaatcgcatctttcacacctttatttttcgtagtttagttgttaccttatttggttacaggagaaag

SEQ ID NO: 818 - protein, 310 aa, Streptococcus pyogenes
MNINILLSTYNGERFLAEQIQSIQRQTVNDWTLLIRDDGSTDGTQDIIRTFVKEDKRIQWINEGQTENLGVIKNFYTLLKHQKADVYFFSDQDDIWLDNKLEVTLLEAQKHEMTAPLLVYTDLKVVTQHLAVCHDSMIKTQSGHANTSLLQELTENTVTGGTMMITHALAEEWTTCDGLLMHDWYLALLASAIGKLVYLDIPTELYRQHDANVLGARTWSKRMKNWLTPHHLVNKYWWLITSSQKQAQLLLDLPLKPNDHELVTAYVSLLDMPFTKRLATLKRYGFRKNRIFHTFIFRSLVVTLFGYRRK

SEQ ID NO: 819 - DNA, 3717 bp, Streptococcus agalactiae
ttggaggaaataggaaaagtggataaacatcactcaaaaaaggctattttaaagttaacacttataacaactagtattttattaatgcatagcaatcaagtgaatgcagaggagcaagaattaaaaaaccaagagcaatcacctgtaattgctaatgttgctcaacagccatcgccatcggtaactactaatactgttgaaaaaacatctgtaacagctgcttctgctagtaatacagcgaaagaaatgggtgatacatctgtaaaaaatgacaaaacagaagatgaattattagaagagttatctaaaaaccttgatacgtctaatttgggggctgatcttgaagaagaatatccctctaaaccagagacaaccaacaataaagaaagcaatgtagtaacaaatgcttcaactgcaatagcacagaaagttccctcagcatatgaagaggtgaagccagaaagcaagtcatcgcttgctgttcttgatacatctaaaataacaaaattacaagccataacccaaagaggaaagggaaatgtagtagctattattgatactggctttgatattaaccatgatatttttcgtttagatagcccaaaagatgataagcacagctttaaaactaagacagaatttgaggaattaaaagcaaaacataatatcacttatgggaaatgggttaacgataagattgtttttgcacataactacgccaacaatacagaaacggtggctgatattgcagcagctatgaaagatggttatggttcagaagcaaagaatatttcgcatggtacacacgttgctggtatttttgtaggtaatagtaaacgtccagcaatcaatggtcttcttttagaaggtgcagcgccaaatgctcaagtcttattaatgcgtattccagataaaattgattcggacaaatttggtgaagcatatgctaaagcaatcacagacgctgttaatctaggagcaaaaacgattaatatgagtattggaaaaacagctgattctttaattgctctcaatgataaagttaaattagcacttaaattagcttctgagaagggcgttgcagttgttgtggctgccggaaatgaaggcgcatttggtatggattatagcaaaccattatcaactaatcctgactacggtacggttaatagtccagctatttctgaagatactttgagtgttgctagctatgaatcacttaaaactatcagtgaggtcgttgaaacaactattgaaggtaagttagttaagttgccgattgtgacttctaaaccttttgacaaaggtaaggcctacgatgtggtttatgccaattatggtgcaaaaaaagactttgaaggtaaggactttaaaggtaagattgcattaattgagcgtggtggtggacttgattttatgactaaaatcactcatgctacaaatgcaggtgttgttggtatcgttatttttaacgatcaagaaaaacgtggaaattttctaattccttaccgtgaattacctgtggggattattagtaaagtagatggcgagcgtataaaaaatacttcaagtcagttaacatttaaccagagttttgaagtagttgatagccaaggtggtaatcgtatgctggaacaatcaagttggggcgtgacagctgaaggagcaatcaagcctgatgtaacagcttctggctttgaaatttattcttcaacctataataatcaataccaaacaatgtctggtacaagtatggcttcaccacatgttgcaggattaatgacaatgcttcaaagtcatttggctgagaaatataaagggatgaatttagattctaaaaaattgctagaattgtctaaaaacatcctcatgagctcagcaacagcattatatagtgaagaggataaggcgttttattcaccacgtcagcaaggtgcaggtgtagttgatgctgaaaaagctatccaagctcaatattatattactggaaacgatggcaaagctaaaattaatctcaaacgaatgggagataaatttgatatcacagttacaattcataaacttgtagaaggtgtcaaagaattgtattatcaagctaatgtagcaacagaacaagtaaataaaggtaaatttgcccttaaaccacaagccttgctagatactaattggcagaaagtaattcttcgtgataaagaaacacaagttcgatttactattgatgctagtcaatttagtcagaaattaaaagaacagatggcaaatggttatttcttagaaggttttgtacgttttaaagaagccaaggatagtaatcaggagttaatgagtattccttttgtaggatttaatggtgattttgcgaacttacaagcacttgaaacaccgatttataagacgctttctaaaggtagtttctactataaaccaaatgatacaactcataaagaccaattggagtacaatgaatcagctccttttgaaagcaacaactatactgccttgttaacacaatcagcgtcttggggctatgttgattatgtcaaaaatggtggggagttagaattagcaccggagagtccaaaaagaattattttaggaacttttgagaataaggttgaggataaaacaattcatcttttggaaagagatgcagcgaataatccatattttgccatttctccaaataaagatggaaatagggacgaaatcactccccaggcaactttcttaagaaatgttaaggatatttctgctcaagttctagatcaaaatggaaatgttatttggcaaagtaaggttttaccatcttatcgtaaaaatttccataataatccaaagcaaagtgatggtcattatcgtatggatgctcttcagtggagtggtttagataaggatggcaaagttgtagcagatggtttttatacttatcgcttacgttacacaccagtagcagaaggagcaaatagtcaggagtcagactttaaagtacaagtaagtactaagtcaccaaatcttccttcacgagctcagtttgatgaaactaatcgaacattaagcttagccatgcctaaggaaagtagttatgttcctacatatcgtttacaattagttttatctcatgttgtaaaagatgaagaatatggggatgagacttcttaccattatttccatatagatcaagaaggtaaagtgacacttcctaaaacggttaagataggagagagtgaggttgcggtagaccctaaggccttgacacttgttgtggaagataaagctggtaatttcgcaacggtaaaattgtctgatctcttgaataaggcagtagtatcagagaaagaaaacgctatagtaatttctaacagtttcaaatattttgataacttgaaaaaagaacctatgtttatttctaaaaaagaaaaagtagtaaacaagaatctagaagaaataatattagttaagccgcaaactacagttactactcaatcattgtctaaagaaataactaaatcaggaaatgagaaagtcctcacttctacaaacaataatagtagcagagtagctaagatcatatcacctaaacataacggggattctgttaaccataccttacctagtacatcagatagagcaacgaatggtctatttgttggtactttggcattgttatctagtttacttctttatttgaaacccaaaaagactaaaaataatagtaaa

SEQ ID NO: 820 - protein, 1239 aa, Streptococcus agalactiae
MEEIGKVDKHHSKKAILKLTLITTSILLMHSNQVNAEEQELKNQEQSPVIANVAQQPSPSVTTNTVEKTSVTAASASNTAKEMGDTSVKNDKTEDELLEELSKNLDTSNLGADLEEEYPSKPETTNNKESNVVTNASTAIAQKVPSAYEEVKPESKSSLAVLDTSKITKLQAITQRGKGNVVAIIDTGFDINHDIFRLDSPKDDKHSFKTKTEFEELKAKHNITYGKWVNDKIVFAHNYANNTETVADIAAAMKDGYGSEAKNISHGTHVAGIFVGNSKRPAINGLLLEGAAPNAQVLLMRIPDKIDSDKFGEAYAKAITDAVNLGAKTINMSIGKTADSLIALNDKVKLALKLASEKGVAVVVAAGNEGAFGMDYSKPLSTNPDYGTVNSPAISEDTLSVASYESLKTISEVVETTIEGKLVKLPIVTSKPFDKGKAYDVVYANYGAKKDFEGKDFKGKIALIERGGGLDFMTKITHATNAGVVGIVIFNDQEKRGNFLIPYRELPVGIISKVDGERIKNTSSQLTFNQSFEVVDSQGGNRMLEQSSWGVTAEGAIKPDVTASGFEIYSSTYNNQYQTMSGTSMASPHVAGLMTMLQSHLAEKYKGMNLDSKKLLELSKNILMSSATALYSEEDKAFYSPRQQGAGVVDAEKAIQAQYYITGNDGKAKINLKRMGDKFDITVTIHKLVEGVKELYYQANVATEQVNKGKFALKPQALLDTNWQKVILRDKETQVRFTIDASQFSQKLKEQMANGYFLEGFVRFKEAKDSNQELMSIPFVGFNGDFANLQALETPIYKTLSKGSFYYKPNDTTHKDQLEYNESAPFESNNYTALLTQSASWGYVDYVKNGGELELAPESPKRIILGTFENKVEDKTIHLLERDAANNPYFAISPNKDGNRDEITPQATFLRNVKDISAQVLDQNGNVIWQSKVLPSYRKNFHNNPKQSDGHYRMDALQWSGLDKDGKVVADGFYTYRLRYTPVAEGANSQESDFKVQVSTKSPNLPSRAQFDETNRTLSLAMPKESSYVPTYRLQLVLSHVVKDEEYGDETSYHYFHIDQEGKVTLPKTVKIGESEVAVDPKALTLVVEDKAGNFATVKLSDLLNKAVVSEKENAIVISNSFKYFDNLKKEPMFISKKEKVVNKNLEEIILVKPQTTVTTQSLSKEITKSGNEKVLTSTNNNSSRVAKIISPKHNGDSVNHTLPSTSDRATNGLFVGTLALLSSLLLYLKPKKTKNNSK

SEQ ID NO: 821 - DNA, 3543 bp, Streptococcus pyogenes
ttgcgtaaaaaacaaaaattaccatttgataaacttgccattgcgctcatgtctacgagcatcttgctcaatgcacaatcagacattaaagcaaatactgtgacagaagacactcctgctaccgaacaagctgtagaaaccccacaaccaacagcggtttctgaggaagcaccatcatcaaaggaaaccaaaaccccacaaactcctgatgacgcagaagaaacaatagcagatgacgctaatgatctagcccctcaagctcctgctaaaactgctgatacaccagcaacctcaaaagcgactattagggatttgaacgacccttctcaggtcaaaaccctgcaggaaaaagcaggcaaaggagctgggactgttgttgcagtgattgatgctggttttgataaaaatcatgaagcgtggcgcttaacagacaaaaccaaagcacgttaccaatcaaaagaagatcttgaaaaagctaaaaaagagcacggtattacctatggcgagtgggtcaatgataaggttgcttattaccacgactatagtaaagatggtaaaaccgctgtcgatcaagagcacggcacacacgtgtcagggatcttgtcaggaaatgctccatctgaaacgaaagaaccttaccgcctagaaggtgcgatgcctgaggctcaattgcttttgatgcgtgtcgaaattgtaaatggactagcagactatgctcgtaactacgctcaagctatcatagatgctgtcaacttgggagctaaggtgattaatatgagctttggtaatgctgcactagcctatgccaaccttccagacgaaaccaaaaaagcctttgactatgccaaatcaaaaggtgttagcattgtgacctcagctggtaatgatagtagctttgggggcaagacccgtctacctctagcagatcatcctgattatggggtggttgggacacctgcagcggcagactcaacattgacagttgcttcttacagcccagataaacagctcactgaaactgctacggtcaaaacagccgatcagcaagataaagaaatgcctgttctttcaacaaaccgttttgagccaaacaaggcttacgactatgcttatgctaatcgtgggatgaaagaggatgattttaaggatgtcaaaggtaagattgcccttattgaacgtggcgatattgatttcaaagataagattgcaaacgctaaaaaagctggtgctgtaggagtcttgatctatgacaatcaggacaagggcttcccgattgaattgccaaatgttgatcagatgcctgcggcctttatcagtcgaaaagatggtctcttattaaaagagaatccccaaaaaaccatcaccttcaatgcgacacctaaggtattgccaacagcaagtggcaccaaactaagccgcttctcaagctggggtctgacagctgacggcaatattaagccagatattgcagcacccggccaagatattttgtcatcagtggctaacaacaagtatgccaaactttctggaactagtatgtctgcgccattagtagcgggtatcatgggactgttgcaaaagcaatatgagacacagtatcctgatatgacaccatcagagcgtcttgatttagctaaaaaagtattgatgagctcagcaactgccttatatgatgaagatgaaaaagcttatttttctcctcgccaacaaggagcaggagcagtcgatgctaaaaaagcttcagcagcaacgatgtatgtgacagataaggataatacctcaagcaaggttcacctgaacaatgtttctgataaatttgaagtaacagtaacagttcacaacaaatctgataaacctcaagagttgtattaccaagcaactgttcaaacagataaagtagatggaaaactctttgccttggctcctaaagcattgtatgagacatcatggcaaaaaatcacaattccagccaatagcagcaaacaagtcaccattccaatcgatgttagtcaatttagcaaggacttgcttgccccaatgaaaaatggctatttcttagaaggttttgttcgtttcaaacaagatcctacaaaagaagagcttatgagtattccctatattggtttccgaggtgattttggcaatctgtcagccttagaaaaaccaatctatgatagcaaagacggtagcagctactatcatgaagcaaatagtgatgccaaagaccaattagatggtgatggattacagttttacgctctgaaaaataactttacagcacttactacagagtctaatccatggacgattattaaagctgtcaaagaaggggttgaaaacatagaggatatcgaatcttcagagatcacagaaaccatttttgcaggtacttttgcaaaacaagacgatgatagccactactatatccaccgtcacgctaatggcaagccatatgctgcgatctctccaaatggggacggtaacagagattatgtccaattccaaggtactttcttgcgtaatgctaaaaaccttgtggctgaagtcttggacaaagaaggaaatgttgtttggacaagtgaggtaaccgagcaagttgttaaaaactacaacaatgacttggcaagcacacttggttcaacccgttttgaaaaaacgcgttgggacggtaaagataaagacggcaaagttgttgctaacggaacatacacctatcgtgttcgctacactccgattagctcaggtgcaaaagaacaacacactgattttgatgtgattgtagacaatacgacacctgaagtcgcaacatcggcaacattctcaacagaagatcgtcgtttgacacttgcatctaaaccaaaaaccagccaaccggtttaccgtgagcgtattgcttacacttatatggatgaggatctgccaacaacagagtatatttctccaaatgaagatggtacctttactcttcctgaagaggctgaaacaatggaaggcgctactgttccattgaaaatgtcagactttacttatgttgttgaagatatggctggtaacatcacttatacaccagtgactaagctattggaaggccactctaataaaccagaacaagacggttcagatcaagcaccagacaaaaaaccagaaactaaaccagaacaagacggttcaggtcaagcaccagataaaaaaccagaaactaaaccagaacaagacggttcaggtcaaacaccagacaaaaaaccagaaactaaaccagaacaagacggttcaggtcaaacaccagataaaaaaccagaaactaaaccagaaaaagatagttcaggtcaaacaccaggtaaaactcctcaaaaaggtcaaccttctcgtactctagagaaacgatcttctaagcgtgctttagctacaaaagcatcaacaaaagatcagttaccaacgactaatgacaaggatacaaatcgtttacatctccttaagttagttatgaccactttcttcttgggattagtagctcatatctttaaaacaaaacgcactgaagat

SEQ ID NO: 822 - protein, 1181 aa, Streptococcus pyogenes
LRKKQKLPFDKLAIALMSTSILLNAQSDIKANTVTEDTPATEQAVETPQPTAVSEEAPSSKETKTPQTPDDAEETIADDANDLAPQAPAKTADTPATSKATIRDLNDPSQVKTLQEKAGKGAGTVVAVIDAGFDKNHEAWRLTDKTKARYQSKEDLEKAKKEHGITYGEWVNDKVAYYHDYSKDGKTAVDQEHGTHVSGILSGNAPSETKEPYRLEGAMPEAQLLLMRVEIVNGLADYARNYAQAIIDAVNLGAKVINMSFGNAALAYANLPDETKKAFDYAKSKGVSIVTSAGNDSSFGGKTRLPLADHPDYGVVGTPAAADSTLTVASYSPDKQLTETATVKTADQQDKEMPVLSTNRFEPNKAYDYAYANRGMKEDDFKDVKGKIALIERGDIDFKDKIANAKKAGAVGVLIYDNQDKGFPIELPNVDQMPAAFISRKDGLLLKENPQKTITFNATPKVLPTASGTKLSRFSSWGLTADGNIKPDIAAPGQDILSSVANNKYAKLSGTSMSAPLVAGIMGLLQKQYETQYPDMTPSERLDLAKKVLMSSATALYDEDEKAYFSPRQQGAGAVDAKKASAATMYVTDKDNTSSKVHLNNVSDKFEVTVTVHNKSDKPQELYYQATVQTDKVDGKLFALAPKALYETSWQKITIPANSSKQVTIPIDVSQFSKDLLAPMKNGYFLEGFVRFKQDPTKEELMSIPYIGFRGDFGNLSALEKPIYDSKDGSSYYHEANSDAKDQLDGDGLQFYALKNNFTALTTESNPWTIIKAVKEGVENIEDIESSEITETIFAGTFAKQDDDSHYYIHRHANGKPYAAISPNGDGNRDYVQFQGTFLRNAKNLVAEVLDKEGNVVWTSEVTEQVVKNYNNDLASTLGSTRFEKTRWDGKDKDGKVVANGTYTYRVRYTPISSGAKEQHTDFDVIVDNTTPEVATSATFSTEDRRLTLASKPKTSQPVYRERIAYTYMDEDLPTTEYISPNEDGTFTLPEEAETMEGATVPLKMSDFTYVVEDMAGNITYTPVTKLLEGHSNKPEQDGSDQAPDKKPETKPEQDGSGQAPDKKPETKPEQDGSGQTPDKKPETKPEQDGSGQTPDKKPETKPEKDSSGQTPGKTPQKGQPSRTLEKRSSKRALATKASTKDQLPTTNDKDTNRLHLLKLVMTTFFLGLVAHIFKTKRTED

SEQ ID NO: 823 - DNA, 426 bp, Streptococcus agalactiae
atgtggaatgtaaaaacttttgataatttaactacacatgagttgtttcaaatatataaattaagagtatctgtatttgtggttgaacaagattgtccttatcaagaggttgatgatgaagatttgatttgtttgcatgggatgaattgggtagatggtcaattggcagcttattatagattgataccagaagatgataaggtgcatttgggacgtgtgattgttaatccagactttagaaaaaagggattaggaaatcaattagtggaatatgcgattaaatttagtgaggcaaattaccctaataaacctatttatgctcaggcccaagcttatttacaagatttttatcaatctttcggatttcaacctgtctcagatatctatctagaagataatattcctcatcttgatatggttttatta

SEQ ID NO: 824 - protein, 142 aa, Streptococcus agalactiae
MWNVKTFDNLTTHELFQIYKLRVSVFVVEQDCPYQEVDDEDLICLHGMNWVDGQLAAYYRLIPEDDKVHLGRVIVNPDFRKKGLGNQLVEYAIKFSEANYPNKPIYAQAQAYLQDFYQSFGFQPVSDIYLEDNIPHLDMVLL

SEQ ID NO: 825 - DNA, 117 bp, Streptococcus agalactiae
atggatgtctcctcaattgacgaatcaaggacgccacatgttccaaaaacaattaaactttccattccaaatactataatatcttccaagattgctacgcaagctgaagcaccaaca

SEQ ID NO: 826 - protein, 39 aa, Streptococcus agalactiae
MDVSSIDESRTPHVPKTIKLSIPNTIISSKIATQAEAPT

SEQ ID NO: 827 - DNA, 1353 bp, Streptococcus agalactiae
atgaatgtggttttaaaacagcgaattcctttaaaaattaaacgaatgggaattaatggtgaaggaataggtttttataaaaaaacactaatctttgttccaggggccctcaagggagaagaggtgttttgtcagatttcttctgttagacgtaattttgcagaagctaaactgttaaagataaataaaaaatctaaaaatagggtagaacccccttgttctatttataaagaatgtgggggatgccaaataatgcaccttcaatatgataagcagctagagtttaaaacggatgttattcgacaggctctaatgaaatttaaaccagagggatatgagaattatgaaatccgtaaaacgataggtatgtcggaacctgaacactatcgtgctaaattacaatttcaagtgcgttcgtttggagggaatgtaaaggcaggtttatatgcacaagggacacatcgattgattgatatcaaagattgtttagtgcaagatagccttactcaggaaatgataaatcgagttgcagaacttttaggaaaatataaattgcctatttataatgaacgtaaaatagctggtgtccgtactgttatgattcgacgagcacaagcgagtggagaggttcaactgatctttatcacaagtaaaagacttgattttgatgatgttgttattgaattagttcgagagtttcctgagttaaagacagttgctgtaaatatcaacgctagtaaaacaagtgatatctatggtcaaataacagaagttatttggggtcaagaatccatcaatgaagaagtattagattatggtttttcgttatcaccacgtgctttttatcaacttaatcctaaacaaacacaaattttatatagtgaggcagttaaggccttagatgtgaaggaagatgatgatttaattgacgcttattgtggagtaggaacgattggacttgcttttgctggaaaagttaaaagtgttcgtggaatggatattatccctgaggctattcaggatgctaaagagaacgcactttatatgggttttactaatacacattacgaagctggaaaggcagaggatattatccctaggtggtatagtgagggatttcgcgctaatgcgttaatcgtggatcctcctcgcacaggtttagatgataaattgctaaatactatactaaaaatgcctccagaaaaaatggtttacgtttcttgtaatacatccacgcttgctagagacttagtaacattaacaaaagtataccatgtccactacatccaatccgttgacatgtttccacatacagcaaggaccgaggctgtagtgaaactacaacgtaaggaa

SEQ ID NO: 828 - protein, 451 aa, Streptococcus agalactiae
MNVVLKQRIPLKIKRMGINGEGIGFYKKTLIFVPGALKGEEVFCQISSVRRNFAEAKLLKINKKSKNRVEPPCSIYKECGGCQIMHLQYDKQLEFKTDVIRQALMKFKPEGYENYEIRKTIGMSEPEHYRAKLQFQVRSFGGNVKAGLYAQGTHRLIDIKDCLVQDSLTQEMINRVAELLGKYKLPIYNERKIAGVRTVMIRRAQASGEVQLIFITSKRLDFDDVVIELVREFPELKTVAVNINASKTSDIYGQITEVIWGQESINEEVLDYGFSLSPRAFYQLNPKQTQILYSEAVKALDVKEDDDLIDAYCGVGTIGLAFAGKVKSVRGMDIIPEAIQDAKENALYMGFTNTHYEAGKAEDIIPRWYSEGFRANALIVDPPRTGLDDKLLNTILKMPPEKMVYVSCNTSTLARDLVTLTKVYHVHYIQSVDMFPHTARTEAVVKLQRKE

SEQ ID NO: 829 - DNA, 1353 bp, Streptococcus pyogenes
atggtcgtaaaggttaaacagaaaattcctttaaaaattaagcgaatgggaattaacggtgaggggattggtttttatcagaaaactttggtatttgtccctggtgctttaaagggagaagatattttttgccaaatcacggcggttaaacggaattttgcagaggccaaactgttaacggtaaacaaggcttctaagaatcgtgtcaaaccagcttgttctgtttatgaaacttgtggtggttgccaaatcatgcatctagcctatcctaaacagctagatttcaaagatgatgtgattaggcaggcccttaaaaagttcaaaccaactggctatgaacaatttgagattagaccgactttaggaatgaaaaagccagatcactatcgggccaaattgcagtttcagctgcggtcatttggcgggacggtcaaggctggtttattttcccagggaagtcatcgcttggttcctattgacaattgcttggtacaggatcaactaacgcaagatattatcaataagattacgcagttagtggacaagtacaagttgcccatttacaatgagcgcaagattgctgggattcggacgataatggttcgtaaggcacaggctagtgatcaggtacagattattgttgtgagtagcaaagaagttaggttagcgaatttcattggcgaattgactaaggcatttcctcaggttaaaacggttgccttgaatagtaatcgttctaaatcgagtgagatttatggggacgaaacggaaattctatggggacaagaggcgattcatgaagaagttttagactatggatttgcgttatcaccgagagctttttaccaacttaatccacagcagacagaagttttgtatggtgaggtggtgaaggccttggatgtagggagcaaagatcatattattgatgcctattgtggggttggctcgattggctttgcttttgcagggaaggtcaagtctgtgcgggggatggatattatcccagaagcgattgaagatgcacaaaaaaatgccaaagccatgggctttgacaacgcttactatgaggcagggaaggcagaggatattatttctaaatggtataaacaaggttaccgcgcggatgccgtcattgtggacccaccaagaactggtttagatgataaattattaaaaacgattcttcattaccagcctaaacagatggtttatgtgtcttgtaatacctccactttggcccgcgacttggtgcagctaacaaaggtttacgatgttcactatatccaaagtgtagacatgttcccccatacagctaggaccgaggctgtcgtgaagttacaaaaacgtgta

SEQ ID NO: 830 - protein, 451 aa, Streptococcus pyogenes
MVVKVKQKIPLKIKRMGINGEGIGFYQKTLVFVPGALKGEDIFCQITAVKRNFAEAKLLTVNKASKNRVKPACSVYETCGGCQIMHLAYPKQLDFKDDVIRQALKKFKPTGYEQFEIRPTLGMKKPDHYRAKLQFQLRSFGGTVKAGLFSQGSHRLVPIDNCLVQDQLTQDIINKITQLVDKYKLPIYNERKIAGIRTIMVRKAQASDQVQIIVVSSKEVRLANFIGELTKAFPQVKTVALNSNRSKSSEIYGDETEILWGQEAIHEEVLDYGFALSPRAFYQLNPQQTEVLYGEVVKALDVGSKDHIIDAYCGVGSIGFAFAGKVKSVRGMDIIPEAIEDAQKNAKAMGFDNAYYEAGKAEDIISKWYKQGYRADAVIVDPPRTGLDDKLLKTILHYQPKQMVYVSCNTSTLARDLVQLTKVYDVHYIQSVDMFPHTARTEAVVKLQKRV

SEQ ID NO: 831 - DNA, 774 bp, Streptococcus agalactiae
atgaaaataaccaaaatcgaaaagaaaaaaagactttacactctagagctagacaataccgaaaatttatatataacagaagatactatcgttcattttatgttaagtaaagggatgataattaatgccgagaaacttgaaaatattaaaaaatttgcccaactatcatacggtaaaaatctaggtctttattatatttctttcaagcagagaaccgagaaagaagttattaaatatcttcaacaacatgatattgattctaaaattattccacaaattattgataatctaaaaagtgagaattggataaacgataaaaactacgtgcaatctttcatacagcaaaatctaaatactggcgataagggaccatacgtgataaaacaaaaattattgcaaaaaggtatcaaaagtaaaataattgaatctgaacttcaagctataaactttcaagacttagcatccaaaataagccaaaaactctataaaaaatatcaaaacaaacttccactaaaagcattaaaagataaattgatgcagagcttaactacaaaaggatttgattatcagatagtgcataccgtaattcaaaaccttgaaattgaaaaagatcaagaacttgaagaagacctcatttataaagaattagataaacaataccaaaaattatcaaaaaaacatgaccagtatgaattaaagcaacgtataatcaatgccttaatgcgtaaaggataccagtacgaagatatcaaaagtgctttaagagaatattta

SEQ ID NO: 832 - protein, 258 aa, Streptococcus agalactiae
MKITKIEKKKRLYTLELDNTENLYITEDTIVHFMLSKGMIINAEKLENIKKFAQLSYGKNLGLYYISFKQRTEKEVIKYLQQHDIDSKIIPQIIDNLKSENWINDKNYVQSFIQQNLNTGDKGPYVIKQKLLQKGIKSKIIESELQAINFQDLASKISQKLYKKYQNKLPLKALKDKLMQSLTTKGFDYQIVHTVIQNLEIEKDQELEEDLIYKELDKQYQKLSKKHDQYELKQRIINALMRKGYQYEDIKSALREYL

SEQ ID NO: 833 - DNA, 774 bp, Streptococcus pyogenes
atgaaaatcactaaaattgaaaagaaaaaacgcctctaccttatcgaattggataatgacgaatccctttatgtaacagaagatactattgttcggtttatgttgagtaaagataaagtccttgacaatgatcagcttgaagacatgaaacattttgcccaactgtcctacggcaaaaatttagccctttattttctttcctttcaacaacgcagcaacaagcaagttgctgattacctgcgcaagcatgagattgaagaacacattattgctgacatcatcactcaactccaagaagaacaatggatagacgacaccaaattggctgatacctacattcgccaaaatcagttaaatggtgataaaggtccccaagtcttaaaacaaaaattattacaaaaaggcattgcaagtcatgacattgatcctatcttatctcaaactgactttagccaactcgctcaaaaagtaagccaaaaactctttgacaaatatcaagaaaaattgccaccaaaagccttgaaagataaaatcacccaagcattactgaccaaaggcttttcatacgatctagctaaacatagcctcaatcaccttaattttgaccaagataatcaagaaatagaagatcttcttgacaaagaattagacaaacaatatcgtaaactcagtcgcaaatatgatggttataccttaaagcaaaagctctatcaggctctctaccgaaaaggctacaacagcgacgacattaattgcaagttaagaaattattta

SEQ ID NO: 834 - protein, 258 aa, Streptococcus pyogenes
MKITKIEKKKRLYLIELDNDESLYVTEDTIVRFMLSKDKVLDNDQLEDMKHFAQLSYGKNLALYFLSFQQRSNKQVADYLRKHEIEEHIIADIITQLQEEQWIDDTKLADTYIRQNQLNGDKGPQVLKQKLLQKGIASHDIDPILSQTDFSQLAQKVSQKLFDKYQEKLPPKALKDKITQALLTKGFSYDLAKHSLNHLNFDQDNQEIEDLLDKELDKQYRKLSRKYDGYTLKQKLYQALYRKGYNSDDINCKLRNYL

SEQ ID NO: 835 - DNA, 531 bp, Streptococcus agalactiae
atgagattacctaaagaaggcgactttattacaattcaaagttacaaacatgatggtagtttacaccgaacttggcgtgacaccatggtattaaaaacaaccgaaaatgccctcattggtgttaatgatcatactttagtaacagaaaatgatggtcgacgctgggtgacacgagagcctgcaatagtatactttcataaaaaatactggtttaacattatcgctatgatacgtgaaactggtgtctcctactattgtaatctagcaagtccgtatatcttggaccctgaagcactcaagtatattgactatgaccttgatgtcaaagtatttgcagatggtgaaaaaagactactagatgtggacgaatatgaacagcataaagctcagatgaactatcctaccgatattgattatatattaaaggaaaatgtaaaaatattggtagaatggataaatgagaataaaggccccttttcatcatcatatatcaatatctggtataaacggtaccttgaattgaaaaagcgc

SEQ ID NO: 836 - protein, 177 aa, Streptococcus agalactiae
MRLPKEGDFITIQSYKHDGSLHRTWRDTMVLKTTENALIGVNDHTLVTENDGRRWVTREPAIVYFHKKYWFNIIAMIRETGVSYYCNLASPYILDPEALKYIDYDLDVKVFADGEKRLLDVDEYEQHKAQMNYPTDIDYILKENVKILVEWINENKGPFSSSYINIWYKRYLELKKR

SEQ ID NO: 837 - DNA, 531 bp, Streptococcus pyogenes
atgaaattacctaaagaaggcgactttattacaattcaaagttataagcatgatggtagtttgcaccgtacttggcgcgatactatggtactaaaaacaactgaaaatgccctcattggagttaatgatcacactcttgtcacagaaagtgacggtagacgatgggtgacccgcgaacctgcaatcgtttactttcataaaaaatactggtttaacattatagccatgattcgagataatggcgtctcttattactgtaacttagctagtccatacatgatggacactgaggcccttaaatacattgattacgatttagatgtcaaagtctttgcggatggtgaaaagagattacttgatgttgatgaatacgagattcataaaaaagagatgcagtattcagccgatatggactttatcctaaaagaaaatgtcaaaatattggttgattggattaatcatgaaaaaggaccattttccaaggcctatatcactatttggtacaaacgttatcttgaactgaagaatcgt

SEQ ID NO: 838 - protein, 177 aa, Streptococcus pyogenes
MKLPKEGDFITIQSYKHDGSLHRTWRDTMVLKTTENALIGVNDHTLVTESDGRRWVTREPAIVYFHKKYWFNIIAMIRDNGVSYYCNLASPYMMDTEALKYIDYDLDVKVFADGEKRLLDVDEYEIHKKEMQYSADMDFILKENVKILVDWINHEKGPFSKAYITIWYKRYLELKNR

SEQ ID NO: 839 - DNA, 885 bp, Streptococcus agalactiae
atgaaaaagaacaaagagttaaacgtgctaagagaaaagcaagtaagaaaagaaagtaggaaaaccatggtattatttacaggagcgactgtagaagaagctattgaaaaaggactacaagagttaaacatttcacgattgagggcacatataaaagttgtatcacgtgagaaaaaaggttttttgggctttggtaaaaagccagcaaaagttgaaatagaaggtatcaccgacgaagtaactgatattaatgaatcggtagcgttaaaaaatattaagaatgtaccgtctagcgtagatgtggtggaagaatatatagaggaggttgatgaaacgcttgaaaaagaagacgtatcacaaccagaacttccaaaaattgatgataaaaacgttgtaactacaagtgaagctattgaaaaaattgacctacttcctaatattgaagtagcagctgctcaggtgactaaatacgttgaaaatatcatctatgagatggatttagatgcaacaatagaaactacgacaagtaagcgacaaataaatctccaaatagaaacgccagaagctgggcgcatcattggttatcatggaaaagtattaaaatcgttgcagttgttagcacaaaattatcttcatgaccgcttttctaagagtttttcagtatccattaatgtccatgactacgttgagcatcgtacagaaactttaattgatttttctaaaaaaatagctaggcgtgttttagagactaatgaaccttaccatatggatcctatgagtaacagtgagcgaaaaactgttcataaaacaattgcaactatagagggtgttgaaagttattctgaaggtaacgatcctaatagatttgtagtagttactaagaaa

SEQ ID NO: 840 - protein, 295 aa, Streptococcus agalactiae
MKKNKELNVLREKQVRKESRKTMVLFTGATVEEAIEKGLQELNISRLRAHIKVVSREKKGFLGFGKKPAKVEIEGITDEVTDINESVALKNIKNVPSSVDVVEEYIEEVDETLEKEDVSQPELPKIDDKNVVTTSEAIEKIDLLPNIEVAAAQVTKYVENIIYEMDLDATIETTTSKRQINLQIETPEAGRIIGYHGKVLKSLQLLAQNYLHDRFSKSFSVSINVHDYVEHRTETLIDFSKKIARRVLETNEPYHMDPMSNSERKTVHKTIATIEGVESYSEGNDPNRFVVVTKK

SEQ ID NO: 841 - DNA, 912 bp, Streptococcus pyogenes
atggtattatttacaggaaaaacagtcgaagaagctatcgaaacaggacttcaagagttagggttatcacgccttaaagcgcatatcaaagtcatttcaaaagagaaaaaaggtttcctcgggtttggtaaaaagccagcccaagttgatatcgaaggtatcagcgacaagacggtttataaggctgataaaaaagccactcgaggtgttccagaggatattaatcgtcaaaatactcccgcggtcaattctgctgatgtagaacctgaagaaataaaagccactcaaaggttagaagcagaagataccaaagtggttcctctcatgtctgaagatagtccagcgcaaaccccttctaatcttgctgagacagtcactgaaacaaaagcacaacaaccgtcaatcccagtcgaagaatcagaagtgccccaagatgctggtaatgatggtttcagcaaagatattgaaaaagctgctcaggaagtgtccgattatgtgactaaaattatctatgaaatggatatcgaagctaccgttgaaaccagcaacaatcgtcgccaaatcaatttgcagattgaaacgccagaggcgggacgtgtgattggttaccatggtaaggtcttgaaatccttgcagttgttagctcaaaatttcttgcacgaccgctattcaaaaaatttttcagtatccttgaatgtccatgattatgtggaacatcgaacagaaaccttgattgactttacgcaaaaagttgccaaacgcgttttggaatctggtcaagattacaccatggatcccatgagtaacagtgagcgtaaaatcgttcataaaaccgtttcatccattgaaggggttgatagttattctgaaggcaatgaccctaaccgctatgtggtagtcagtcttcaacgt

SEQ ID NO: 842 - protein, 304 aa, Streptococcus pyogenes
MVLFTGKTVEEAIETGLQELGLSRLKAHIKVISKEKKGFLGFGKKPAQVDIEGISDKTVYKADKKATRGVPEDINRQNTPAVNSADVEPEEIKATQRLEAEDTKVVPLMSEDSPAQTPSNLAETVTETKAQQPSIPVEESEVPQDAGNDGFSKDIEKAAQEVSDYVTKIIYEMDIEATVETSNNRRQINLQIETPEAGRVIGYHGKVLKSLQLLAQNFLHDRYSKNFSVSLNVHDYVEHRTETLIDFTQKVAKRVLESGQDYTMDPMSNSERKIVHKTVSSIEGVDSYSEGNDPNRYVVVSLQR

SEQ ID NO: 843 - DNA, 813 bp, Streptococcus agalactiae
ttgaagaaaaaacttaaaacatttagcttaatattgctgacaggctctttattggttgcttgcggacgaggagaagtatctagtcattcagccacattatgggagcaaatagtttatgcatttgctaaatcaatacaatggctctcctttaaccattcaattggtttgggaataatcttattcactctaataatcagagcgattatgatgccgctttataatatgcaaatgaaatccagccaaaagatgcaggaaattcagccaaggctcaaggaattacaaaaaaaatatccagggaaagatcctgataaccgtttaaagctaaatgatgaaatgcaatctatgtataaagctgagggagttaacccatatgcaagtgtattacctcttctaattcagttacctgtcctatgggctcttttccaagctttgactagggtttctttcttaaaagtaggaacatttttgagcctagaattatcacagccggacccatattatattttacctgtactggcggccttatttacctttttatcaacttggttaactaacaaagcagctgttgaaaaaaatattgctttaactcttatgacttatgttatgccgtttatcatattggtaacaagctttaactttgctagtggtgttgttttatactggacggtgtctaatgcttttcaagtatttcaaattctattattgaacaacccatacaagattataaaggttcgagaagaagcagtaagagtggcacatgaaaaagaacaaagagttaaacgtgctaagagaaaagcaagtaagaaaagaaag

SEQ ID NO: 844 - protein, 271 aa, Streptococcus agalactiae
MKKKLKTFSLILLTGSLLVACGRGEVSSHSATLWEQIVYAFAKSIQWLSFNHSIGLGIILFTLIIRAIMMPLYNMQMKSSQKMQEIQPRLKELQKKYPGKDPDNRLKLNDEMQSMYKAEGVNPYASVLPLLIQLPVLWALFQALTRVSFLKVGTFLSLELSQPDPYYILPVLAALFTFLSTWLTNKAAVEKNIALTLMTYVMPFIILVTSFNFASGVVLYWTVSNAFQVFQILLLNNPYKIIKVREEAVRVAHEKEQRVKRAKRKASKKRK

SEQ ID NO: 845 - DNA, 825 bp, Streptococcus pyogenes
ttgagaaaggttttgagagtgaagaaaaacattaaaattgcaagaatagtccccttagttctattattagtggcctgtggtcgtggtgaggtaacggcacaatcatctagtggttgggaccagttggtttacttatttgccagagcaattcaatggctttcctttgatggttcaattggtgttggcattattctttttacccttactatccgtctcatgctcatgcctttgtttaacatgcaaatcaaatcaagccagaagatgcaagacatccaacctgagcttagagaattgcaaaggaaatacgctggtaaagacacacaaacgcggatgaagttggctgaagaaagtcaagccctttacaaaaaatatggggttaacccttatgctagtctcttacccctcttaattcagatgccagttatgattgccttattccaagccttgacacgggtatctttcttaaaaacagggactttcttgtgggtggaattggcacaacatgatcatttgtaccttttaccagttttggcagctgtcttcactttcttgtccacttggttgaccaatctagcggctaaagaaaaaaatgtcatgatgactgttatgatttatgtgatgccgctaatgatctttttcatgggctttaacttggctagtggagtagtgctctattggacggtctccaatgcctttcaagtggtacaactactgttattaaacaatccttttaagattattgcggaaagacaacgtcttgccaatgaagaaaaagaacgccgtcttcgtgaacgtcgtgctcgtaaaaaagcaatgaagagaaaa

SEQ ID NO: 846 - protein, 275 aa, Streptococcus pyogenes
LRKVLRVKKNIKIARIVPLVLLLVACGRGEVTAQSSSGWDQLVYLFARAIQWLSFDGSIGVGIILFTLTIRLMLMPLFNMQIKSSQKMQDIQPELRELQRKYAGKDTQTRMKLAEESQALYKKYGVNPYASLLPLLIQMPVMIALFQALTRVSFLKTGTFLWVELAQHDHLYLLPVLAAVFTFLSTWLTNLAAKEKNVMMTVMIYVMPLMIFFMGFNLASGVVLYWTVSNAFQVVQLLLLNNPFKIIAERQRLANEEKERRLRERRARKKAMKRK

SEQ ID NO: 847 - DNA, 387 bp, Streptococcus agalactiae
ttgagtcttttaggttatttatggtataataaaaccaatttagataaatggagcactattttgaaaaaaacctatcgggtaaaaagtgataaggattttcaaatgattttcagcagaggtaaaaatgttgctaatcgaaaatttgttatctactatttagaaaaagaacaaaaacactttcgtgtgggaatctctgttagtaagaaattaggaaatgctgttgttcgtaacgctattaaaagaaaaattaggcatgttttactctctcagaaaacagcgctgcaagattatgattttgtcgtgattgcgcgtaaaggtgtagaggaattggactatcaagcattagaaaaaaatcttatacacgttttaaaaatagcaggactcatc

SEQ ID NO: 848 - protein, 129 aa, Streptococcus agalactiae
MSLLGYLWYNKTNLDKWSTILKKTYRVKSDKDFQMIFSRGKNVANRKFVIYYLEKEQKHFRVGISVSKKLGNAVVRNAIKRKIRHVLLSQKTALQDYDFVVIARKGVEELDYQALEKNLIHVLKIAGLI

SEQ ID NO: 849 - DNA, 357 bp, Streptococcus pyogenes
ttgaagaagacctatcgtgtcaagcgtgagaaagatttccaagccatatttaaggatggaaaaagtacagcaaatcgaaaatttgtcatttatcatttaaatagaggccaagaccacttccgtgtgggtatttctgtcggtaaaaaaataggaaatgcagtcaccagaaatgcagtcaaacgaaagatacgtcatgttatcatggcattagggcatcagctgaagtcagaggatttcgtggtgattgcccgtaagggtgtccactctttggagtatcaagagcttcaacaaaatttacatcatgttttaaagttagcacaattgcttgagaaaggttttgagagtgaagaaaaacat

SEQ ID NO: 850 - protein, 119 aa, Streptococcus pyogenes
LKKTYRVKREKDFQAIFKDGKSTANRKFVIYHLNRGQDHFRVGISVGKKIGNAVTRNAVKRKIRHVIMALGHQLKSEDFVVIARKGVHSLEYQELQQNLHHVLKLAQLLEKGFESEEKH

SEQ ID NO: 851 - DNA, 1056 bp, Streptococcus agalactiae
atgttagcgctatatgccttattattagaaagaaggaataagatgacaaaacaaaaaattgccgttcttggacctggttcatgggggactgctcttgcacaagtattaaatgacaatggacatgaggtacgcttatggggaaacgtggttgaacaaatagaagagattaatactaaccatactaatcaacgttacttcaaagatattaccttagattccaaaataaaagcctacactaatcttgaggaagcgattaataatgttgacagcattttattcgtcgtcccaactaaagttacaagacttgttgctaaacaagtggctaatcttttaaagcataaagttgttcttatgcatgcttctaagggactagaacctggtactcatgaacgactttctacaattttagaagaagaaatctctgaacaatatcgtagtgatatcgttgttgtttcaggtcccagtcatgctgaagaagccatcgttcgtgatattactttgattactgctgcttcaaaagatattgaagcagctaagtatgtccaaaaattgtttagtaatcattattttagactttatactaacactgatgtcgtaggagtagaaacagctggtgctctaaaaaatattattgctgttggtgctggagcactacacggtcttggttatggtgataatgctaaagcagctattattacgcgtggtttagctgagataacacgtcttggtgtacaattaggggccgaccctctcactttcagtggtttatccggagttggagatttaattgtgactggtacatctgttcattctcgcaactggagagcgggagatgctttaggacgtggtgagaaacttgaagatattgaaaaaaatatggggatggttattgaaggtatctcaacaactaaagttgcttacgaaatcgcccaaaacttaaatgtttacatgcccattacagaagctatttataaatcaatatatgaaggggctaatatcaaagatagcattttagatatgatgtccaatgaatttcgttcagagaatgaatggcac

SEQ ID NO: 852 - protein, 352 aa, Streptococcus agalactiae
MLALYALLLERRNKMTKQKIAVLGPGSWGTALAQVLNDNGHEVRLWGNVVEQIEEINTNHTNQRYFKDITLDSKIKAYTNLEEAINNVDSILFVVPTKVTRLVAKQVANLLKHKVVLMHASKGLEPGTHERLSTILEEEISEQYRSDIVVVSGPSHAEEAIVRDITLITAASKDIEAAKYVQKLFSNHYFRLYTNTDVVGVETAGALKNIIAVGAGALHGLGYGDNAKAAIITRGLAEITRLGVQLGADPLTFSGLSGVGDLIVTGTSVHSRNWRAGDALGRGEKLEDIEKNMGMVIEGISTTKVAYEIAQNLNVYMPITEAIYKSIYEGANIKDSILDMMSNEFRSENEWH

SEQ ID NO: 853 - DNA, 1014 bp, Streptococcus pyogenes
atgacaaaacaaaaagtagctattttaggacctggttcttggggaactgccctttctcaggttcttaatgacaatggccatgacgtccgtttatggggaaatattcctgatcaaattgaagagataaataccaagcataccaatagacactacttcaaagacattgtgttagacaaaaacattacggcaactcttgatttaggtcaagccctatcagatgttgatgcggtgctttttgttgtgccaactaaagtaacacgattagttgctagacaagttgccgccattttagatcataaagtagtggtcatgcatgcctcaaaaggtctagaaccagagacccacgaacgtttatcaactatcctagaagaagaaattccagctcattttcgtagtgaagtggtcgttgtatcaggtcctagtcatgctgaagaaactatcgttcgcgatattactctcatcacggcagcctcaaaagatattgaagctgcaaagtatgttcagtccctctttagtaaccactacttccgactttataccaataccgacgtcatcggagttgaaacagctggtgccctcaaaaacattattgctgttggagcaggagctctccatggacttgggtatggagataatgccaaagcagcggtaattactcgtgggttagctgaaatcacccgtctaggcgtcaagcttggtgctgacccgttaacctacagtgggttatctggtgttggtgatctaattgtaacaggtacttctgtccattcacgtaactggcgggctggagctgcccttggacgtggtgaaaaattagaagatattgaacgcaacatgggtatggttatcgaaggtatcgcaacaactaaggtagcctatgaaattgcccaagacctcggagtttacatgccaattacaacagctatttataagtccatctacgagggcgctgatatcaaagaaagcatcctcggcatgatgtcaaatgaatttcgttctgaaaatgaatggcat

SEQ ID NO: 854 - protein, 338 aa, Streptococcus pyogenes
MTKQKVAILGPGSWGTALSQVLNDNGHDVRLWGNIPDQIEEINTKHTNRHYFKDIVLDKNITATLDLGQALSDVDAVLFVVPTKVTRLVARQVAAILDHKVVVMHASKGLEPETHERLSTILEEEIPAHFRSEVVVVSGPSHAEETIVRDITLITAASKDIEAAKYVQSLFSNHYFRLYTNTDVIGVETAGALKNIIAVGAGALHGLGYGDNAKAAVITRGLAEITRLGVKLGADPLTYSGLSGVGDLIVTGTSVHSRNWRAGAALGRGEKLEDIERNMGMVIEGIATTKVAYEIAQDLGVYMPITTAIYKSIYEGADIKESILGMMSNEFRSENEWH

SEQ ID NO: 855 - DNA, 897 bp, Streptococcus agalactiae
atgaaagtcagaaaagcagttatccctgccgctggtttaggaacacgttttttacctgctactaaagctttagctaaagaaatgcttccaatcgttgataaaccaactattcaatttattgttgaagaagcactaaaatctggaattgaagatattttagttgtaactggtaaatcaaaacgttctatagaagaccactttgattcaaattttgaattagaatataacctaaaagagaaagggaaaaacgaacttctcaaacttgttgatgaaacaactggcattcgactccattttattcgacaaagtcatcctcgtgggcttggagatgctgtgctacaagcaaaagccttcgttggtaatgaaccttttgttgttatgctaggtgatgatctaatggatattaccaataataaagttattcctctcaccaaacaattaattaatgactttgaagctactcatgcatcaacaattgctgttatggaagttccacatgaagatgtttctgcttatggtgttattgctccacaaggagaaggagttaatggtctatatagcgttaacactttcgttgaaaaaccttctcccgaagaggctccaagtaatttggcaatcattggtcgctacttgttaactccagaaatttttaatattttagaaactcaaaaacctggtgcaggaaatgagattcaactaaccgatgctatcgatactttaaataaaacgcaacgtgtttttgctagaaaatttacaggagaccgttacgacgttggtgacaagtttggttttatgaaaacatctattgattatgctcttcaacacccacaagttaaagatgacttgaagaaatatatcattgatttaggaaaatctctagaaaaaacatctaagaag

SEQ ID NO: 856 - protein, 299 aa, Streptococcus agalactiae
MKVRKAVIPAAGLGTRFLPATKALAKEMLPIVDKPTIQFIVEEALKSGIEDILVVTGKSKRSIEDHFDSNFELEYNLKEKGKNELLKLVDETTGIRLHFIRQSHPRGLGDAVLQAKAFVGNEPFVVMLGDDLMDITNNKVIPLTKQLINDFEATHASTIAVMEVPHEDVSAYGVIAPQGEGVNGLYSVNTFVEKPSPEEAPSNLAIIGRYLLTPEIFNILETQKPGAGNEIQLTDAIDTLNKTQRVFARKFTGDRYDVGDKFGFMKTSIDYALQHPQVKDDLKKYIIDLGKSLEKTSKK

SEQ ID NO: 857 - DNA, 912 bp, Streptococcus pyogenes
atgaccaaagtcagaaaagccattattcctgctgcaggtctaggaacacgttttttacctgctaccaaagctcttgccaaagagatgttgcccatcgttgataaaccaaccatccagtttatcgtcgaagaagcgctaaaatctggcatcgaggaaatccttgtggtgaccggaaaagctaaacgctctatcgaggaccattttgattcaaactttgaattagaatacaacctccaagctaaggggaaaaatgaactgttgaaattagtggatgaaaccactgccattaaccttcattttatccgtcaaagccacccaagagggctgggagatgctgtcttacaagccaaagcctttgtgggcaatgaaccctttgtggtcatgcttggagatgacttaatggacattacaaatgcatccgctaaacctctcaccaaacaactcatggaggactatgacaagacgcatgcatccactatcgctgtgatgaaagttcctcatgaagatgtgtctagctatggggttatcgctcctcaaggcaaggctgtcaagggcctttacagtgtagacacctttgttgaaaaaccacaaccagaagatgcgcctagtgatttggctattattggtcgttacctcctaacccctgaaatttttggtattttggaaagacagacccctggagcaggtaacgaagtgcaactcacagatgctatcgataccctcaataaaactcagcgtgtctttgcacgagaatttaaaggcaatcgttacgatgttggggataaatttggattcatgaaaacatctatcgactatgccttagaacacccacaggtcaaagaggacttgaaaaattacattatcaaactaggaaaagctttggaaaaaagtaaagtaccaacacattcaaag

SEQ ID NO: 858 - protein, 304 aa, Streptococcus pyogenes
MTKVRKAIIPAAGLGTRFLPATKALAKEMLPIVDKPTIQFIVEEALKSGIEEILVVTGKAKRSIEDHFDSNFELEYNLQAKGKNELLKLVDETTAINLHFIRQSHPRGLGDAVLQAKAFVGNEPFVVMLGDDLMDITNASAKPLTKQLMEDYDKTHASTIAVMKVPHEDVSSYGVIAPQGKAVKGLYSVDTFVEKPQPEDAPSDLAIIGRYLLTPEIFGILERQTPGAGNEVQLTDAIDTLNKTQRVFAREFKGNRYDVGDKFGFMKTSIDYALEHPQVKEDLKNYIIKLGKALEKSKVPTHSK

SEQ ID NO: 859 - DNA, 1110 bp, Streptococcus agalactiae
atgatttttttatgttatgatagaaatctgtttttatgtgactataacttattaggaggttcattctcggtgaacagaaaaattattggcttaactctactatctttatctgtactaacattaacagcatgtggtaatcgttcagataagtctgcaaataaatcagatatcaaagttgcgatggtaactaatcaaggtggagtagacgataaatcgtttaatcaatcagcttgggaagggctacaaaagtggggaaaaaagaaggggttgacaaaaggtaatggctttgattatttccagtcatctaatgaatcagatcatgctaataaccttgatacggcagcctctagtggttataatttaatttttggtattggatttggtcttcatgatactattgaaaaagtatcagaaaataataaagatgttaaatacgttattgtagatgatatcattaaaggtaaagaaaatgtagctagtgttacttttgcagacaatgaagctgcttacttagctggagttgctgcagctaagacaactaagacaaaaacagttggttttatcggagggatggaaggcgtcgttgttaagcgatttgaagcaggatttaaggctggagtaaaatcaattgatccggctattaaagttgcggtatcttatgcaggctcatttacagatgcagctaaaggtaaaacgattgctgccacacagtatgcaacaggtgttgatgttatttaccaggctgctggtggtacaggagcaggaatttttagtgaggctaaaactgaaaatgagacccgcaaggaatctaacaaagtctgggtaattggtgttgacagagatcaaagtcaagaaggcaattatgtttcaaaagatggtaagaaagcaaactttgttctggcatctactataaaagaggtggggaaatctctccaatctgtagcagaattaacagagaaaaaacaatatccaggagggaaagtaacagtttttggtctaaaggatagtggtgtagatattaaagagcatcaattgtctagtgagggatctgttgctgtcaaaaaagctaaagaggatattgtttcagggaaaatacaagttcctatgaaa

SEQ ID NO: 860 - protein, 370 aa, Streptococcus agalactiae
MIFLCYDRNLFLCDYNLLGGSFSVNRKIIGLTLLSLSVLTLTACGNRSDKSANKSDIKVAMVTNQGGVDDKSFNQSAWEGLQKWGKKKGLTKGNGFDYFQSSNESDHANNLDTAASSGYNLIFGIGFGLHDTIEKVSENNKDVKYVIVDDIIKGKENVASVTFADNEAAYLAGVAAAKTTKTKTVGFIGGMEGVVVKRFEAGFKAGVKSIDPAIKVAVSYAGSFTDAAKGKTIAATQYATGVDVIYQAAGGTGAGIFSEAKTENETRKESNKVWVIGVDRDQSQEGNYVSKDGKKANFVLASTIKEVGKSLQSVAELTEKKQYPGGKVTVFGLKDSGVDIKEHQLSSEGSVAVKKAKEDIVSGKIQVPMK

SEQ ID NO: 861 - DNA, 1050 bp, Streptococcus pyogenes
atgaacaagaaatttattggtcttggtttagcgtcagtggctgtgctgagtttagctgcttgtggtaatcgtggtgcttctaaaggtggggcatcaggaaaaactgatttaaaagttgcaatggttaccgatactggtggtgtagatgacaaatcattcaaccaatcagcatgggaaggcctgcaatcttggggtaaagaaatgggccttcaaaaaggaacaggtttcgattattttcaatctacaagtgaatctgagtatgcaactaatctcgatacagcagtttcaggagggtatcaactgatttatggtatcggctttgcattgaaagatgctattgctaaagcagctggagataatgaaggagttaagtttgttattatcgatgatattatcgaaggaaaagataatgtagccagtgttacctttgccgaccatgaagctgcttatcttgcaggaattgcagctgcaaaaacaacaaaaacaaaaacagttggtttcgtgggcggtatggaaggaactgtcataactcgatttgaaaaaggttttgaagcaggagttaagtctgttgacgatacaatccaagttaaagttgattatgctggatcatttggtgacgctgcaaaaggaaaaacaatcgcagcagctcagtatgcagcaggtgctgatgttatttaccaggcagcaggaggcactggagcaggtgtatttaatgaagcaaaagctattaatgaaaaacgtagtgaagctgataaagtttgggttattggtgttgaccgtgatcaaaaagacgaaggaaaatacacttctaaagatggcaaagaagcaaactttgtacttgcatcatcaatcaaagaagtcggtaaagctgttcagttaatcaacaagcaagtagcagataaaaaattccctggaggaaaaacaactgtctatggtctaaaagatggcggtgttgaaatcgcaactacaaatgtttcaaaagaagctgttaaagctattaaagaagcgaaagcaaaaattaaatctggtgacattaaagttcctgaaaaa

SEQ ID NO: 862 - protein, 350 aa, Streptococcus pyogenes
MNKKFIGLGLASVAVLSLAACGNRGASKGGASGKTDLKVAMVTDTGGVDDKSFNQSAWEGLQSWGKEMGLQKGTGFDYFQSTSESEYATNLDTAVSGGYQLIYGIGFALKDAIAKAAGDNEGVKFVIIDDIIEGKDNVASVTFADHEAAYLAGIAAAKTTKTKTVGFVGGMEGTVITRFEKGFEAGVKSVDDTIQVKVDYAGSFGDAAKGKTIAAAQYAAGADVIYQAAGGTGAGVFNEAKAINEKRSEADKVWVIGVDRDQKDEGKYTSKDGKEANFVLASSIKEVGKAVQLINKQVADKKFPGGKTTVYGLKDGGVEIATTNVSKEAVKAIKEAKAKIKSGDIKVPEK

SEQ ID NO: 863 - DNA, 675 bp, Streptococcus agalactiae
atgtctatgaagaagttcgctaaagagtatccgacgacagtactcttggtcagtctgacaacccttgtttttttattgatgcaactaacttatggaagtcaagcggagtctagccaagttatttttcaatttggtggaatacaaggtgattatctaaaagcatatccaacaaatctatggagactaataagtcctatctttgttcatattggttgggaacattttttattaaatggtttagctctgtatttcgtaggacaaatgggggaaagtatttggggaagtttgagatttctaattctctatattttatctggcttaatgggtaatatttttacgctattttttactccacatgtggtggcagcaggagcctcaacgtctttatttggtgttttttctgctatagcaatcgcagggtattttggaaaaaatccttatttaaaacaagttggaaaatcatatcaagtgatgatcttgttaaatttattttttaatatcttcacacccggagtgagtttagcaggtcatgttggtggtttagttggtggagtattggtggctatttttttgacaaaacaaaatggttctttattatttaaaacttggcaaagtattttagctttaatgatatttattattgtatcgatcagcttaataggtctatcgttggta

SEQ ID NO: 864 - protein, 225 aa, Streptococcus agalactiae
MSMKKFAKEYPTTVLLVSLTTLVFLLMQLTYGSQAESSQVIFQFGGIQGDYLKAYPTNLWRLISPIFVHIGWEHFLLNGLALYFVGQMGESIWGSLRFLILYILSGLMGNIFTLFFTPHVVAAGASTSLFGVFSAIAIAGYFGKNPYLKQVGKSYQVMILLNLFFNIFTPGVSLAGHVGGLVGGVLVAIFLTKQNGSLLFKTWQSILALMIFIIVSISLIGLSLV

SEQ ID NO: 865 - DNA, 699 bp, Streptococcus pyogenes
atgatattgctgtttaggaggtttatcttagatgacacagttattaaaacgatatcctattactattttccttttagggttaacaggcttaatttttatagcaatgcaagtggtatatggacatttagcaactggtgctcaagctatttatcaagttggaggtatgtttggattactagtaaaagcaatgccagaccagttgtggcgattggtgactccgatatttattcatatcggctttggtcatttttttgtcaatggattaacactatattttgttggtcaaatcgtcgaagacctctggggctcacgccttttttattactttatgttttatcaggtgttatgggcaatgcctttactttttggttgactcctgaaacagtagctgcaggagcatcgacgtcgttatttggactttttgctgctattgtagtattgagttttttgggtaagaaccaagcgttgaaagatttgggcaagtcataccagacgttaattgtagtcaatttactgatgaatctttttatgccaaacgtgagtatggcaggccatattggcggtgtcgtgggtggtgcgttactgagtatagtttttccaactaagatgagagtgataacagtgaagaaaaccaagcgaatgttggctttagtgagctatggtattattttggttggtgtgttagtgcttgggttttta

SEQ ID NO: 866 - protein, 233 aa, Streptococcus pyogenes
MILLFRRFILDDTVIKTISYYYFPFRVNRLNFYSNASGIWTFSNWCSSYLSSWRYVWITSKSNARPVVAIGDSDIYSYRLWSFFCQWINTIFCWSNRRRPLGLTPFLLLYVLSGVMGNAFTFWLTPETVAAGASTSLFGLFAAIVVLSFLGKNQALKDLGKSYQTLIVVNLLMNLFMPNVSMAGHIGGVVGGALLSIVFPTKMRVITVKKTKRMLALVSYGIILVGVLVLGFL

SEQ ID NO: 867 - DNA, 525 bp, Streptococcus agalactiae
atggaaaagaaattattaagaaaagaagttttgataaccttaaaatctcaacctcaagcttacaaatcagaagttgactgtaaacttttagaggcttttataaaaactaaagcttatcaaaatagttgtgtaattgctacttacctatcttttgactacgaatacaatacacaacttcttattaaacaagctttatgtgatggcaaacgtgtccttgttcccaaaacttatccaaaaggtaaaatgatttttgtggactatcaaaaagataacttgaggacaacaccgtttggcttattagaacctgttaatgatagagctgttgaaaaagctagtatagacttaattcatgtgcccggacttatctttaacaataaaggttttcgtataggttatggtgcaggttattttgatcgctatttgagtgattttgaaggtgatactattagtactatttataggtgtcagagacaggattttgtagaagagaagcatgacgtagcagttaaggaggtattatgtcta

SEQ ID NO: 868 - protein, 175 aa, Streptococcus agalactiae
MEKKLLRKEVLITLKSQPQAYKSEVDCKLLEAFIKTKAYQNSCVIATYLSFDYEYNTQLLIKQALCDGKRVLVPKTYPKGKMIFVDYQKDNLRTTPFGLLEPVNDRAVEKASIDLIHVPGLIFNNKGFRIGYGAGYFDRYLSDFEGDTISTIYRCQRQDFVEEKHDVAVKEVLCL

SEQ ID NO: 869 - DNA, 1203 bp, Streptococcus agalactiae
atggacctcccagaaaactatgacaaagaagaattttctcgcattcaaaaagccgctgaaaagattaaatcagatagcgaagtactcgtggttattggtattggtggttcgtaccttggcgcaaaagcagcaattgactttttgaataatcattttgctaatttgcaaaccgcagaagaacgtaaagcgcctcagattctttatgctggaaattctatttcatctacttaccttgccgatttagttgaatacgtccaagataaagaattctcagtaaatgtcatttcaaaatcaggtacaacaactgaaccagcgattgctttccgtgtatttaaagaacttctagttaaaaagtacggtcaagaagaagctaataaacgtatctacgctacaactgataaagttaaaggtgccgtaaaagttgaagcagatgctaacaattgggaaacatttgtagttcctgataatgttggtggtcgtttctcagtactgacagccgtaggtcttcttccaattgctgcttcaggagcagatattactgctcttatggaaggcgcaaatgctgctcgtaaagatttatcttcagataaaatctctgaaaacattgcttatcagtacgctgcagttcgtaatgttctttatcgcaaaggttatatcacagagattttagctaactacgaaccatcattacaatactttggtgaatggtggaaacaattagcaggtgaatcagaaggtaaagatcaaaaaggtatctatcctacatcagcaaacttctcaactgatcttcactcacttggtcaatttattcaagaaggttaccgtaacctctttgagacagttgttcgcgttgagaaacctcgtaaaaatgtgactattcctgaattaaccgaagatttagatggtcttggttatcttcaaggaaaagatgtagattttgttaataaaaaagcaacagatggtgtactccttgctcatacagatggtggggttccaaatatgtttgtaacgcttcctacacaagacgcttacacccttggttacactatttacttctttgagttagcaattggcctttcaggttatcttaactcagtaaatccatttgatcaaccaggggtagaagcatataaacgtaatatgtttgctcttctaggtaaacctggattcgaagagcttagcgctgaattgaatgcacgtctt

SEQ ID NO: 870 - protein, 401 aa, Streptococcus agalactiae
MDLPENYDKEEFSRIQKAAEKIKSDSEVLVVIGIGGSYLGAKAAIDFLNNHFANLQTAEERKAPQILYAGNSISSTYLADLVEYVQDKEFSVNVISKSGTTTEPAIAFRVFKELLVKKYGQEEANKRIYATTDKVKGAVKVEADANNWETFVVPDNVGGRFSVLTAVGLLPIAASGADITALMEGANAARKDLSSDKISENIAYQYAAVRNVLYRKGYITEILANYEPSLQYFGEWWKQLAGESEGKDQKGIYPTSANFSTDLHSLGQFIQEGYRNLFETVVRVEKPRKNVTIPELTEDLDGLGYLQGKDVDFVNKKATDGVLLAHTDGGVPNMFVTLPTQDAYTLGYTIYFFELAIGLSGYLNSVNPFDQPGVEAYKRNMFALLGKPGFEELSAELNARL

SEQ ID NO: 871 - DNA, 1347 bp, Streptococcus pyogenes
atgtcacatattacatttgattattcaaaagtcctcgagtcatttgcgggacaacatgaaattgattttttacaaggccaagtaacagaagctgacaagttattgcgtgaaggaactggaccaggttcagatttcttgggctggcttgatcttccagaaaactatgataaagatgaatttgcacgtatcttgactgctgctgaaaagattaaggcagacagcgaagttcttgtggtgatcggtatcggtgggtcataccttggtgccaaagcagcgattgattttttaaatcatcattttgctaacttgcaaactgccaaagagcgcaaagccccacaaattctttacgctggaaactctatttcatctacttaccttgccgatttagttgaatacgttcaagacaaagagttctcagtaaacgtgatctctaaatcaggtacaaccactgaaccagctattgcctttcgcgtgttcaaagaacttttggttaaaaaatatggccaagaagaagctaacaaacgtatctacgctaccacagacaaagttaagggtgctgttaaggtagaagctgacgctaacaactgggaaacatttgtggtgccagataatgttggtggtcgtttctcagtcttgactgctgttggtttgcttccaattgctgcatcaggtgcagatattactgctcttatggaaggggcaaatgctgctcgtaaagacctttcttcagacaaaatctctgaaaacattgcttaccaatacgctgctgttcgtaatgtgctttaccgtaaaggctacatcactgaaatcttggctaactacgagccatctcttcagtactttggcgaatggtggaaacaattagctggtgaatcagaaggaaaagatcaaaaagggatttacccaacttcagctaacttctcaacagaccttcactcacttggtcaatttatccaagaaggttaccgtaatctctttgaaacagttattcgtgttgataatcctcgtaaaaatgttatcattcctgaattagcagaagacctagatggacttggttaccttcaaggtaaagacgttgatttcgttaacaagaaagctacagatggtgtgcttcttgcccacacagatggcggcgtgccaaacatgtttgtcactcttccagctcaagacgagtttacccttggttacactatttacttctttgagcttgccatcgctgtttcaggctacatgaatgctgttaacccatttgatcaaccaggtgttgaagcttacaaacgtaacatgtttgcgcttcttggaaaaccaggttttgaagcattatcagcagagcttaatgctcgcctc

SEQ ID NO: 872 - protein, 449 aa, Streptococcus pyogenes
MSHITFDYSKVLESFAGQHEIDFLQGQVTEADKLLREGTGPGSDFLGWLDLPENYDKDEFARILTAAEKIKADSEVLVVIGIGGSYLGAKAAIDFLNHHFANLQTAKERKAPQILYAGNSISSTYLADLVEYVQDKEFSVNVISKSGTTTEPAIAFRVFKELLVKKYGQEEANKRIYATTDKVKGAVKVEADANNWETFVVPDNVGGRFSVLTAVGLLPIAASGADITALMEGANAARKDLSSDKISENIAYQYAAVRNVLYRKGYITEILANYEPSLQYFGEWWKQLAGESEGKDQKGIYPTSANFSTDLHSLGQFIQEGYRNLFETVIRVDNPRKNVIIPELAEDLDGLGYLQGKDVDFVNKKATDGVLLAHTDGGVPNMFVTLPAQDEFTLGYTIYFFELAIAVSGYMNAVNPFDQPGVEAYKRNMFALLGKPGFEALSAELNARL

SEQ ID NO: 873 - DNA, 2673 bp, Streptococcus agalactiae
gtgaaacatttaacaaatcaaaaggagtctcaaatgactgaaaaaactaaagcagtagaaactacagatgttgctcttgcaattgatacattggttcaaaatggtttaaaagcacttgatgagatgcgtcaacttaatcaagaacaagttgattatattgtagctaaagcttctgttgcagccttggatgcccatggagaacttgctcttcatgcagtagaagaaactggtcgtggtgtctttgaagataaagcgacaaaaaatttatttgcatgtgaacacgtcgttaacaacatgcgtcatacaaagacagtgggagttattgaagaagacgatgtcacaggcttgacattaattgctgaaccagtgggagttgtctgtggtatcacgccaacaaccaacccaacttcaactgctattttcaagtcattaatctctcttaaaacacgtaatccaattatttttgccttccacccatcagcacaagaatcatcagcacatgcagcacgtattgttcgtgatgctgctattgctgctggagctcctgaaaattgtgtccaatggattgaacaaccatcaattgatgcaactaatgctttgatgaaccatgatggtattgccactatccttgcgacaggtggtaatgcgatggttaaagctgcctactcatgtgggaaacctgcccttggtgtaggtgctgggaatgttccagcttatgttgaaaaatcagctaatatccgacaagccgctcacgatattgttatgtctaaatcatttgataacggtatggtatgtgcatcagaacaggctgttattattgataaagaaatttataaagaatttgttgaagaatttaaatcttatcatacctatttcgttaataagaaagaaaaagctcttcttgaagaattctgttttggtgcaaaagcaaatagcaaaaactgtgctggtgcaaaattaaatccaaatattgttggaaaatcagcagtttggattgctgaacaagctggatttactgttccagaaggaacaaatattcttgccgcagaatgtactgaagttagtgaaaaagaacctttgacacgtgaaaaactatcacctgttattgcagtattgaaagctgaatctacagaagatggtgttgaaaaagctcgtcaaatggttgagtttaatggtctagggcactcagctgctattcatacaaaagatgcagacttagctcgtgaatttggaactagaattcgtgctatccgtgttatttggaattctccttctacttttggtggtattggggatgtttacaatgctttcttgccatcattgactcttggttgtggttcgtatggacgtaactcagttggtgataacgttagtgctataaatctcttgaatatcaaaaaagtaggaagacgtagaaataatatgcaatggtttaaagtcccttcaaaaacatacttcgaacgtgattctattcaatatttgcaaaaatgtcgcgatgttgaacgtgtcatgattgttacagatcacgccatggttgagcttggtttcttggatcgtatcattgaacaacttgatcttcgtcgcaataaagttgtttatcagatttttgctgaagtagaaccagatccagacattacaacagtaatgaaaggaacagatttgatgcgtaccttcaaaccagacactattattgcattaggtggtggttctcctatggatgctgcgaaagttatgtggctcttctatgaacaaccagaagttgatttccatgacctcgttcaaaaattcatggatatccgtaaacgtgcgttcaaattcccagaacttggtaagaaaacaaaatttgttgctattccaacaacttctggaacaggttctgaagtgacaccatttgccgttatctctgacaaagcaaataatcgtaaatatccaatcgctgattattcattaacaccaactgtagctatcgttgatccggcccttgttatgactgttcctggttttattgcggctgatacgggtatggatgtattgacacatgcaacagaggcttatgtttcacagatggcaaatgattatacagacggacttgctcttcaagcaattaaaattgtgtttgactacttagaacgctcagtaaaagatgctgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacagcaacatggcctaagtacaattactatcgtgctgacgaaaagtatcaagatatcgctaaattactcggcttaccagcagcaacaccagaagaagctgtcgaatcatatgcaaaagctgtgtatgaccttggaacacgtttaggtattaagatgaatttccgcgaccaaggcattgatgaaaaagaatggaaagaaaaatctcgtgaactagctttcttagcatatgaagatcaatgttcaccagcaaatccacgccttccgatggtagatcacatgcaagaaatcatcgaagatgcttattatggttatgaggaacgtccaggacgtcgtaag

SEQ ID NO: 874 - protein, 891 aa, Streptococcus agalactiae
MKHLTNQKESQMTEKTKAVETTDVALAIDTLVQNGLKALDEMRQLNQEQVDYIVAKASVAALDAHGELALHAVEETGRGVFEDKATKNLFACEHVVNNMRHTKTVGVIEEDDVTGLTLIAEPVGVVCGITPTTNPTSTAIFKSLISLKTRNPIIFAFHPSAQESSAHAARIVRDAAIAAGAPENCVQWIEQPSIDATNALMNHDGIATILATGGNAMVKAAYSCGKPALGVGAGNVPAYVEKSANIRQAAHDIVMSKSFDNGMVCASEQAVIIDKEIYKEFVEEFKSYHTYFVNKKEKALLEEFCFGAKANSKNCAGAKLNPNIVGKSAVWIAEQAGFTVPEGTNILAAECTEVSEKEPLTREKLSPVIAVLKAESTEDGVEKARQMVEFNGLGHSAAIHTKDADLAREFGTRIRAIRVIWNSPSTFGGIGDVYNAFLPSLTLGCGSYGRNSVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTDLMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVMTVPGFIAADTGMDVLTHATEAYVSQMANDYTDGLALQAIKIVFDYLERSVKDADFEAREKMHNASTMAGMAFANAFLGISHSMAHKIGAQFHTVHGRTNAILLPYVIRYNGTRPAKTATWPKYNYYRADEKYQDIAKLLGLPAATPEEAVESYAKAVYDLGTRLGIKMNFRDQGIDEKEWKEKSRELAFLAYEDQCSPANPRLPMVDHMQEIIEDAYYGYEERPGRRK

SEQ ID NO: 875 - DNA, 2640 bp, Streptococcus pyogenes
atgactgaaggacataatactgttgaaacaacctctgtttctgtgacaattgatgctcttgttcaaaaaggtttagctgctcttgaagagatgcgtaagcttgaccaagaacaagttgattatatcgtagccaaagcttctgttgctgctttggatgctcacggtgaacttgctaaacatgcttatgaagaaacaggtcgcggtgtctttgaagataaagcaacaaaacatctatttgcttgtgagcatgtggttaataacatgcgccatcaaaaaacagtaggaattattgaagaagatgatgtgacaggtttgacattaattgctgagccggtgggtgttatctgtgggattacaccaacaactaacccaacttcaacagctatctttaaatctttgatttcgttaaaaacacgtaatccaattatttttgcctttcacccatcagcacaagaatcatcagcacatgccgctcgtattgttcgtgatgctgctattgccgctggtgctcctgaaaattgtgtgcagtgggttgaaacaccatcacttgaagcaacaaatgctttgatgaatcatgacggcattgccactatccttgcgacaggtggaaatgcgatggttaaagcggcatactcatgtgggaaacctgcccttggggtaggtgctggtaacgttccagcttatgttgaaaaatcagctaatatccgtcaagccgctcatgatattgtgatgtctaaatcatttgataatggtatggtctgtgcctctgaacaagctgttatcatcgataaagaaatctatgacgattttgtagcagaattcaaatcttaccatacttattttgtaaataaaaaagaaaaagcccttcttgaagaattctgttttggtgccaaagcaaatagcaaaaactgtgctggtgcaaaattaaatccaaatattgtaggaaaaccagctacttggattgcagaacaagctggatttactgttccagaaggaaccaatattcttgctgcagaatgtaaagaagtttcagaaaatgagcctttaacacgtgaaaaattatctccagtcattgctgttttaaaatctgaatcacgtgaagacggtgttgaaaaagctcgtcaaatggttgaatttaatggactcggtcactcagctgccattcatacagcagatgcagaattggcaaaagaatttggaactagaatccgtgctatccgcgtcatctggaattcaccttctacatttggtggtatcggggatgtttacaatgctttcttaccatcattgactcttggttgtggttcgtatggacgtaacgcagttggtgataacgttagtgctataaatctcttgaacatcaaaaaagtaggaagacgtagaaataatatgcaatggtttaaagttccttcaaaaacatacttcgaacgtgattcaattcaatatttgcaaaaatgtcgtgacgttgaacgtgtcatgattgttacagatcacgctatggttgagcttggtttcttggatcgtatcattgaacaacttgatcttcgtcgcaataaagttgtttatcagatctttgctgaagtagaaccagatccagacattacaactgttatgaaaggtactgaattaatgcgtaccttcaaaccagacaccattattgcccttggcgggggatcccctatggatgcagccaaagttatgtggctcttctacgagcaaccagaagttgatttccatgacctcgttcaaaaattcatggatatccgcaaacgtgcgttcaaattcccagaacttggtaagaaaacaaaatttgttgctatcccaacaacttctggaacaggttcagaggtgacaccatttgccgttatctctgacaaagcaaataatcgtaaatatccaatcgctgattactcattaacaccaactgtagccattgttgacccagctttggtattgactgttccaggctttattgctgctgatactggtatggacgttttgacacacgcaaccgaagcttacgtgtcacaaatggccaatgactttacggatggtttagctcttcaagccattaaaattgtttttgataatcttgaaaaatcagttaaaacagccgattttgaagcacgtgaaaagatgcataatgcgtcaactatggcaggtatggctttcgccaatgcattcttaggtatttctcactcaatggcgcataaaattggcgcacaattccataccgtacacggacgtacaaatgcaattcttttgccgtatgttatccgctataatgggactcgtccagctaaaacggcgacatggcctaagtataattactaccgtgcggatgaaaaataccaagacattgcgaaattgttagggcttccagcttctacaccagaagaagcagtggaatcttatgcgaaagctgtttatgatctgggttgccgagttggtattcaaatgaacttcaaagctcaaggtatcgacgaaaacgaatggaaagaacattctcgtgaattggcttaccttgcttatgaagaccaatgttcacctgctaacccacgtcttccaatggttgatcacatgcaagaaattattgaagatgcttactatggttatgctgaacgtccaggacgacgtaag

SEQ ID NO: 876 - protein, 880 aa, Streptococcus pyogenes
MTEGHNTVETTSVSVTIDALVQKGLAALEEMRKLDQEQVDYIVAKASVAALDAHGELAKHAYEETGRGVFEDKATKHLFACEHVVNNMRHQKTVGIIEEDDVTGLTLIAEPVGVICGITPTTNPTSTAIFKSLISLKTRNPIIFAFHPSAQESSAHAARIVRDAAIAAGAPENCVQWVETPSLEATNALMNHDGIATILATGGNAMVKAAYSCGKPALGVGAGNVPAYVEKSANIRQAAHDIVMSKSFDNGMVCASEQAVIIDKEIYDDFVAEFKSYHTYFVNKKEKALLEEFCFGAKANSKNCAGAKLNPNIVGKPATWIAEQAGFTVPEGTNILAAECKEVSENEPLTREKLSPVIAVLKSESREDGVEKARQMVEFNGLGHSAAIHTADAELAKEFGTRIRAIRVIWNSPSTFGGIGDVYNAFLPSLTLGCGSYGRNAVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTELMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVLTVPGFIAADTGMDVLTHATEAYVSQMANDFTDGLALQAIKIVFDNLEKSVKTADFEAREKMHNASTMAGMAFANAFLGISHSMAHKIGAQFHTVHGRTNAILLPYVIRYNGTRPAKTATWPKYNYYRADEKYQDIAKLLGLPASTPEEAVESYAKAVYDLGCRVGIQMNFKAQGIDENEWKEHSRELAYLAYEDQCSPANPRLPMVDHMQEIIEDAYYGYAERPGRRK

SEQ ID NO: 877 - DNA, 93 bp, Streptococcus agalactiae
gtgcattatagtgatagcgatactacaggggctgatttatatgttagtaacgtcaaaaaagctattcaaaaatcagctcaacgagctgcaaaa

SEQ ID NO: 878 - protein, 31 aa, Streptococcus agalactiae
MHYSDSDTTGADLYVSNVKKAIQKSAQRAAK

SEQ ID NO: 879 - DNA, 1773 bp, Streptococcus pyogenes
atgagaataaaatggttttcgtttgttagggtaacaggacttttactggttttactctaccacttttttaaaaatgtatttccaggaggttttattggtgttgacattttcttcaccttttcaggatatctaatcacagccctcttgattgatgaatacacaaaaaaagagtctatcgatattatcggttttttaaaaagacgcttttatcgaattgttcctcctttggtgttaatgattttattgaccattccttttacgtttttaattaagaaggatttcattgctaatataggaagtcagattacagctgttttaggatttaccactaatatttatgaaatattgacgggaagtagttatgaaagccaatttattccacatctctttgttcatacgtggagcttagctattgaagttcatttttacttgttttggggtgtatttgtttggttattagctagacgcaaggagactcagaaacaactgagaggactactgtttttgatttctttgggaatatttgctattagtttcttgagcatgtttataagatcttttatgacctcaaatttttccctgatttatttttcgagtctttctcacagttttcccttctttttaggggcgatgtttgccacgataacaggtattaacgagactactgttcgatttcaaaaaaatgtacgtttatggccgcgccagtatgtccttgctgctatgattggagcatttacacttttgcttgtgctaacggtcacattggattttaaccatatcacgacctatctatttggctttgctttggctagcttattcgcatcaattatgatttatgcagcgcgtgttcttcatgagcaaacaccagatgtacaagagcctaaagctatcacttatatagctgatattagctatgggatttacctcttccattggccattttacattatttttagccaattaatgtctcatattttggcagttattctaacagttttcttttcaatcttgtttgccactgtgtcttactatattgtggaacctttggtccaagggagaaaaccaaacctgcttggtttagaaattgactgttctccttactataagtggattgtaggagggtctctcgccttagcattattaactttaggaacttgtatgatagcgcctaaagttggtaagtttgagaaacaattgttggtcagttccctacaacaggctcaaagtaatatggagcggacacatacactagctgcaggagacgctaatgctttgagtgacgtaggtattattggtgattctgtagcattacgctctagtgcagcattctcacaaattatgccacaagcgcaactggatgcagcggtcagtcggaattttaaagaagctttcgatttatttaataaccaaattaaatctaagagtctatctaagactgttgtcttagcagtaggtgttaactcgcttgacaactattctcaagcagttcagtcttttattgaggcattgccaaaaggtcatcgtttagttttggtttctccatataatgccaaaaatgccagtcaggttgcagaagctagagactatggtcttaaattgtccaaaaaatacaagtatgtcactattgcagactggtataaagttgctgttgaacatccagatatttggtatggcagtgatggtgttcattatagtgaagatagtcaaggagcagaactatatgtctccacaatccagactgctgttgagaagtcagctaaaaaaccagctaaa

SEQ ID NO: 880 - protein, 591 aa, Streptococcus pyogenes
MRIKWFSFVRVTGLLLVLLYHFFKNVFPGGFIGVDIFFTFSGYLITALLIDEYTKKESIDIIGFLKRRFYRIVPPLVLMILLTIPFTFLIKKDFIANIGSQITAVLGFTTNIYEILTGSSYESQFIPHLFVHTWSLAIEVHFYLFWGVFVWLLARRKETQKQLRGLLFLISLGIFAISFLSMFIRSFMTSNFSLIYFSSLSHSFPFFLGAMFATITGINETTVRFQKNVRLWPRQYVLAAMIGAFTLLLVLTVTLDFNHITTYLFGFALASLFASIMIYAARVLHEQTPDVQEPKAITYIADISYGIYLFHWPFYIIFSQLMSHILAVILTVFFSILFATVSYYIVEPLVQGRKPNLLGLEIDCSPYYKWIVGGSLALALLTLGTCMIAPKVGKFEKQLLVSSLQQAQSNMERTHTLAAGDANALSDVGIIGDSVALRSSAAFSQIMPQAQLDAAVSRNFKEAFDLFNNQIKSKSLSKTVVLAVGVNSLDNYSQAVQSFIEALPKGHRLVLVSPYNAKNASQVAEARDYGLKLSKKYKYVTIADWYKVAVEHPDIWYGSDGVHYSEDSQGAELYVSTIQTAVEKSAKKPAK

SEQ ID NO: 881 - DNA, 684 bp, Streptococcus agalactiae
  misc_feature (1)..(684): n = a, c, g, or t
atgagaataaaatggttttctttggtacgtataacaggactactacttgttttactttaccatttctttaagaatagttttccaggaggatttgttggcgttgacatcttctttacattttctggttttctgattacggccttattgattgatgaattttctaaaacgaaaaaaattgattttgttagtttttgtcgtagacgtttttaccgtattttcccaccattagtattgatggttttggtgacaataccttttgtatttctggttaaaagcgattttagagcaagtattggctctcaaattatgactgctttaggttttaccagcaacttttacgaaatcttgactggtggtaactacgaaagtcaatttatccctcacttatttgtgcatacctggagtctttctattgaagtccatttttatgttttatggggcttaacggtatggctcttatcgaaaagatcaaaagatcaaaagcaattgagggggactttgttccttatttccatgggaatttttggagtcagcttccttaccatgtttgttagagcctttttcgttgataatttttcaacgatatatttctctacattatcacatatatttccgttctttttaggagcgatggtggctacaatatctggtattcgagagattaccggacgattcaagnnnnnt

SEQ ID NO: 882 - protein, 228 aa, Streptococcus agalactiae
  misc_feature (1)..(228): Xaa = Any Amino Acid
MRIKWFSLVRITGLLLVLLYHFFKNSFPGGFVGVDIFFTFSGFLITALLIDEFSKTKKIDFVSFCRRRFYRIFPPLVLMVLVTIPFVFLVKSDFRASIGSQIMTALGFTSNFYEILTGGNYESQFIPHLFVHTWSLSIEVHFYVLWGLTVWLLSKRSKDQKQLRGTLFLISMGIFGVSFLTMFVRAFFVDNFSTIYFSTLSHIFPFFLGAMVATISGIREITGRFKXX

SEQ ID NO: 883 - DNA, 378 bp, Streptococcus agalactiae
atgaagaattttaaaataacacgaactcatctagaaatattatctttgataattattgttgtttttggtttatcagtatttaccttaacgacttctagtcaaggagtctttagctatgatggcggcaagataaaatatgtgggctctattgttaatcaccatatgactggtaaaggtaaattaacctatgagaatggggattactataagggcgattttgtaaatggagtctttgaagggaaaggaacatttgtttcagttcatggctggtcttatacaggtgactttaaaaaaggtcaacctgatggacaaggtcgcctcaatgctaaaaataagaaagtctataaggggacatttaaacaggggatttatcaaaaa

SEQ ID NO: 884 - protein, 126 aa, Streptococcus agalactiae
MKNFKITRTHLEILSLIIIVVFGLSVFTLTTSSQGVFSYDGGKIKYVGSIVNHHMTGKGKLTYENGDYYKGDFVNGVFEGKGTFVSVHGWSYTGDFKKGQPDGQGRLNAKNKKVYKGTFKQGIYQK

SEQ ID NO: 885 - DNA, 399 bp, Streptococcus pyogenes
atgatagatatgcaagatatagtaaaaaaatggagtattacacgggcgaagttggaaattgtctcggtgattgtcatattggtttgtgcaatttctgtttttagcgtaagaatttcgaataagacaagtttgacctatgataaagggcgtatgcactatactggttacgtgattaaccataaaatgaatggagaagggaagcttgtctaccccaacggtgatatctatgagggtacttttaaggatggcctatttgaaggaaaaggaacttttactgctaagacgggctggttatataacggggagtttcataaaggacaagcaaatggcaaaggtgtgttaaaagcaaagaataataaagtctataaagggatttttaaacaggggatatttcaaaaa

SEQ ID NO: 886 - protein, 133 aa, Streptococcus pyogenes
MIDMQDIVKKWSITRAKLEIVSVIVILVCAISVFSVRISNKTSLTYDKGRMHYTGYVINHKMNGEGKLVYPNGDIYEGTFKDGLFEGKGTFTAKTGWLYNGEFHKGQANGKGVLKAKNNKVYKGIFKQGIFQK

SEQ ID NO: 887 - DNA, 996 bp, Streptococcus agalactiae
atgacaagatttttagatagtgatgcaatgggtgacgaagaattggtagaacgtacacttcgtccgcagtatttaagagagtatattggacaagataaggttaaagatcagctaaaaatatttattgaagctgctaaattgcgtgatgagtcattggatcatgtgttattatttggccctcctggtttagggaaaacaaccatggcatttgtaattgctaatgagttgggtgtcaatctcaaacaaacatcaggtcccgcaattgaaaaatcaggggatttagtagccattttaaatgatttagaaccaggtgatgttctttttattgatgaaattcatcgtatgccgatggcggttgaagaggtactttatagtgcaatggaagacttctatattgacattatgatcggtgcaggagaaactagtagaagtgttcatctagatttgccgccctttaccttaattggtgcaacgacacgtgcaggtatgttatctaatcccttacgtgctcgctttggtattacagggcatatggagtattatgaagaaaatgatttgacagaaattattgagcgtacagcagacatttttgaaatgaaaattacttatgaagctgcttctgaattagcgcgtcgcagtcgtggaacgccacgtatcgctaaccgtttattgaaacgtgttcgagattatgctcaaatcatgggagatggtttgatagatgacaatattacagataaagcattaacgatgttagatgttgatcacgaggggcttgattacgtcgatcaaaaaatcttaagaaccatgattgaaatgtataatggaggtcctgttggtttaggaactctatccgttaatattgctgaagaacgagatactgttgaagacatgtacgaaccttatttaattcaaaaaggttttattatgcgtacccgtaccggtcgtgtagctacggttaaggcatatgaacatttaggttatcagcgatttgataaa

SEQ ID NO: 888 - protein, 332 aa, Streptococcus agalactiae
MTRFLDSDAMGDEELVERTLRPQYLREYIGQDKVKDQLKIFIEAAKLRDESLDHVLLFGPPGLGKTTMAFVIANELGVNLKQTSGPAIEKSGDLVAILNDLEPGDVLFIDEIHRMPMAVEEVLYSAMEDFYIDIMIGAGETSRSVHLDLPPFTLIGATTRAGMLSNPLRARFGITGHMEYYEENDLTEIIERTADIFEMKITYEAASELARRSRGTPRIANRLLKRVRDYAQIMGDGLIDDNITDKALTMLDVDHEGLDYVDQKILRTMIEMYNGGPVGLGTLSVNIAEERDTVEDMYEPYLIQKGFIMRTRTGRVATVKAYEHLGYQRFDK

SEQ ID NO: 889 - DNA, 1068 bp, Streptococcus pyogenes
gtgctgttgactggtggcgattataataaaagtaggccactgctctcttttactttatgttataatagtcttatggctagaattttagacaataatgtaatgggaaatgaggagttttcggatcggactcttcgccctcaatatctacacgaatatattggacaagataaagttaaggaacaattcgctatttttatagaagcagctaaaagacgtgacgaatctttagaccatgttttattatttggacctccaggactgggaaaaacaacaatggcatttgtgattgccaatgaattgggagttaatttaaagcaaacttcaggtcctgccgttgagaaagctggagatttggtagctattttaaatgaattagaaccaggggatattttgtttattgatgaaattcaccgcatgccaatgtctgtcgaggaagtactatatagtgctatggaagacttctatattgatattatgattggcgctggagatactagtcgtagtattcatttggatctgcctccatttacattgattggtgctactacacgtgcaggcatgttatctaatcccctcagagctcgttttggtatcactggtcacatggaatactatcaagaaaaggatttgacagagattgtggagcgtacagctactatttttgaaataaaaatagaccatgaagctgcacggaaattagcttgtcgcagtagaggaacgccccgcattgctaatcgattactaaaacgagtgcgtgactatgctcaaattattggtgatggcatcataacggctcaaataactgatagagctttgactatgttagatgttgaccgcgaaggtctcgattacattgatcagaaaattttacgaacgatgattgagatgtatcagggagggccagttggtttggggacattatctgtgaatattgccgaggagcgtaatacagttgaagagatgtatgaaccctacttaattcaaaaaggctttctcatgcgaacacgaacaggtcgtgtagcgacgcaaaaggcttatcgtcatcttggctatccctatcaaaacact

SEQ ID NO: 890 - protein, 356 aa, Streptococcus pyogenes
VLLTGGDYNKSRPLLSFTLCYNSLMARILDNNVMGNEEFSDRTLRPQYLHEYIGQDKVKEQFAIFIEAAKRRDESLDHVLLFGPPGLGKTTMAFVIANELGVNLKQTSGPAVEKAGDLVAILNELEPGDILFIDEIHRMPMSVEEVLYSAMEDFYIDIMIGAGDTSRSIHLDLPPFTLIGATTRAGMLSNPLRARFGITGHMEYYQEKDLTEIVERTATIFEIKIDHEAARKLACRSRGTPRIANRLLKRVRDYAQIIGDGIITAQITDRALTMLDVDREGLDYIDQKILRTMIEMYQGGPVGLGTLSVNIAEERNTVEEMYEPYLIQKGFLMRTRTGRVATQKAYRHLGYPYQNT

SEQ ID NO: 891 - DNA, 909 bp, Streptococcus agalactiae
atgttaaaacattttggtagtaaagtaagaaatttgagagtaactagaaatattactcgcgaagatttttgtggtgatgaaactgagttatctgtaagacaattagctaggattgaaagtggacagtcaattccaaacttgactaaagctcactacatagctaaacaattgaatgtaaaattggatattttaacaggaggagagagcttagaattacctaaacggtataaagagttgaagtatttgattttaagaattccaacttatgcagatgctgaacgattaaaattaagagaatgtcagtttgatcatattttcgaagaattctatgataatcttccagaagacgagtgcttagcaattgacagtttacaagctaaatttgaagtctatcaaacaggagacattaattttggtgtggaggttttatgcgaatgctttgataaagtaaaatataaagaaaaatatactcttaatgatttgattatcatagatttgtttttaacttgtgcagttgtatctaaatttaacaatagagcatttactaaagaagtatttcaaactatatgtaaaactttgataagtcagaaccacaaacttacagcagaagatttgttttggtttaatcatgtactcctgaattgtgtatttgttggactttgtttaaatagtgaagagtgtcttgcagaaatgttagaagttagccgacaaacgatggtgtcaacacatgattttcataaaatgcctttatattttatgtaccaatggaaatacttcattacaattgacaatgatataaagtctgcagaaaatgcttaccaacaatcaattatgttttcaaaaatgattgatgacaagcatctaattaaaaaattagaattggagtggcaagaagatataacaggacat

SEQ ID NO: 892 - protein, 303 aa, Streptococcus agalactiae
MLKHFGSKVRNLRVTRNITREDFCGDETELSVRQLARIESGQSIPNLTKAHYIAKQLNVKLDILTGGESLELPKRYKELKYLILRIPTYADAERLKLRECQFDHIFEEFYDNLPEDECLAIDSLQAKFEVYQTGDINFGVEVLCECFDKVKYKEKYTLNDLIIIDLFLTCAVVSKFNNRAFTKEVFQTICKTLISQNHKLTAEDLFWFNHVLLNCVFVGLCLNSEECLAEMLEVSRQTMVSTHDFHKMPLYFMYQWKYFITIDNDIKSAENAYQQSIMFSKMIDDKHLIKKLELEWQEDITGH

SEQ ID NO: 893 - DNA, 909 bp, Streptococcus pyogenes
atgttagaacattttggtggaaaagtaaaagtgttaagacttgaaaagaggattagtcgcgaggacttgtgtggggatgagtctgaactttctgttcgtcaattagcacggatagaactaggtcaatccataccaagtttaagtaaggttatttttattgcaaaagccttaaacgttagtgtcggttacttaactgatggtgctgatttagaactacctaagcgttacaaagaattaaaataccttatcttaaggacaccaacttacatggatgatggaaaattacaagtacgagaagagcagtttgatgaaatttttgaggattattatgataaattaccagaggaagagaaaataatcattgattgtttacaggcaactttagatactttattgagtgagaatactaactttggcattgacttacttcaagaatattttaatcaaataaagactaaggtacgctttaggcaaaatgatttaatacttctagaattatatttagcttatcttgatattgagggaatggatggacaatattcagataagattttttatgattctttattagataatctatcagaacaatttgaacaatttgaattagatgaattatttatagttaataagattatcattgatatttcatcactaagcttaaaaaataaccgacttgataatttagaaaaagcgattgaaatgagtcaaaaaattatggcgaaaattcaagattggaatagaatgcctattttaaaactaatagaatggaaatattttttaatcaaacaaaaagatataataaaagcagaacaatcatttatgaaggcatgtttgttcgcccaaatgacagctgatcagtatttggaaaacaagttaattcaagagtgggaaaaagatgttaaaagttat

SEQ ID NO: 894 - protein, 303 aa, Streptococcus pyogenes
MLEHFGGKVKVLRLEKRISREDLCGDESELSVRQLARIELGQSIPSLSKVIFIAKALNVSVGYLTDGADLELPKRYKELKYLILRTPTYMDDGKLQVREEQFDEIFEDYYDKLPEEEKIIIDCLQATLDTLLSENTNFGIDLLQEYFNQIKTKVRFRQNDLILLELYLAYLDIEGMDGQYSDKIFYDSLLDNLSEQFEQFELDELFIVNKIIIDISSLSLKNNRLDNLEKAIEMSQKIMAKIQDWNRMPILKLIEWKYFLIKQKDIIKAEQSFMKACLFAQMTADQYLENKLIQEWEKDVKSY

SEQ ID NO: 895 - DNA, 1296 bp, Streptococcus agalactiae
atgatcgaacgttattcacgccctgagatggcggcaatttggacagaggaaaataaataccgtgcttggttggaggtcgagattttggctgacgaggcatgggctgagttgggtgagattcctaaggaggatgtggctaagattcgtgagaaggcggattttgacattgaccgcattcttgagattgagcaggacacgcgtcacgatgtggtggctttcactcgtgcggtttctgagacgcttggtgaggagcgcaagtgggtgcactacggtttgacgtcgactgacgtggtggacactgcctacggttacctctacaagcaggctaacgatattatccgtcgtgaccttgagaatttcacaaatattgtggctgataaggctaaggagcacaagttcaccatcatgatgggtcgtacccacggtgttcacgctgagccaacgactttcggtcttaagttggcgacctggtacagcgagatgaaacgtaatattgagcgttttgaacatgctgccgcaggtgtggaagctggtaagatttcaggtgccgttggtaactttgctaacattcctccatttgtggaacaatatgtttgtgacaaattgggcatccgtccgcaagagatttcaacacaggttcttccacgtgacctccacgcagaatattttgcagtgcttgcaagcattgcaacttctatcgaacgtatggcgacagagattcgtggtctgcaaaaatcagaacaacgtgaagttgaagaattctttgccaaaggtcagaaaggtagctctgctatgcctcacaaacgcaacccaatcggttcagagaacatgactgggctagcgcgcgtgattcgtggtcacatggtgacggcttatgagaacgtggcactttggcacgagcgtgatatttcgcactcatctgctgagcgtatcatcacacctgacacaacgatcttgattgactacatgctcaaccgttttggcaatatcgttaagaacttgactgtcttcccggaaaatatgatgcgcaatatggaatcaacttttggtttgatttatagtcaacgtgttatgctcaaattgattgaaaaaggaatgacacgagaagaagcttatgacttagttcaacctaagacagcttattcctgggacaatcaagtggatttcaaaccacttttagaagaagacaccaaagttacctcttgtcttacacaggaagaaattgatgaactatttaatccgatttattacacaaaacgtgttgatgatatttttgaaagactaggattagaaaaa

SEQ ID NO: 896 - protein, 432 aa, Streptococcus agalactiae
MIERYSRPEMAAIWTEENKYRAWLEVEILADEAWAELGEIPKEDVAKIREKADFDIDRILEIEQDTRHDVVAFTRAVSETLGEERKWVHYGLTSTDVVDTAYGYLYKQANDIIRRDLENFTNIVADKAKEHKFTIMMGRTHGVHAEPTTFGLKLATWYSEMKRNIERFEHAAAGVEAGKISGAVGNFANIPPFVEQYVCDKLGIRPQEISTQVLPRDLHAEYFAVLASIATSIERMATEIRGLQKSEQREVEEFFAKGQKGSSAMPHKRNPIGSENMTGLARVIRGHMVTAYENVALWHERDISHSSAERIITPDTTILIDYMLNRFGNIVKNLTVFPENMMRNMESTFGLIYSQRVMLKLIEKGMTREEAYDLVQPKTAYSWDNQVDFKPLLEEDTKVTSCLTQEEIDELFNPIYYTKRVDDIFERLGLEK

SEQ ID NO: 897 - DNA, 1290 bp, Streptococcus pyogenes
atgctagaacgttattcacgccctgagatggcggcaatttggacagaggaaaataaataccatgcttggttggaggtcgagattttggctgacgaggcatgggctgagttgggtgagattcctaaggaggatgtggctaagattcgtgagaaggcggattttgacattgaccgcattcttgaaattgagcaggacacgcgtcacgatgtggtggctttcacgcgtgcggtttctgaaacgcttggtgaggagcgcaagtgggtgcactacggtttgacctcgactgacgtggtggacactgcctatggttacctctacaagcaagctaacgacattatccgtcgcgatcttgagaatttcaccaatatcgtggcagacaaggcgcgtgagcacaaaatgaccatcatgatgggtcgtacccacggtgttcacgccgagccaacgactttcggtcttaagttggcgacttggtacagcgagatgaaacgtaatattgagcgttttgaacatgctgccgcaggtgtggaagctggtaagatttcaggtgccgttggtaactttgccaacatcccaccttttgtggaagaatatgtctgtgacaaattaggcattcgtccgcaagaaatttcaacacaagttcttccacgtgaccttcacgcagaatattttgcagtgcttgcaagtattgcaacttctatcgaacgtatggcgacagagattcgaggtctgcaaaagtcagaacaacgtgaagttgaagaattctttgccaaaggtcagaaaggtagctctgctatgcctcacaaacgcaacccaatcggttcagagaacatgacagggctagcgcgcgtgattcgtggtcacatggtgacagcttatgagaacgtgtcactttggcatgagcgtgacatttcgcactcatcagctgagcgtatcatcacacctgacacaactatcttgattgactacatgctcaaccgctttggtaatatcgttaagaacttgactgtcttcccggaaaatatgatgcgcaatatggaatcaacttttggtttgatttatagtcaacgtgttatgctcaaattgattgaaaaaggaatgacacgagaagaagcttatgacttagttcaacctaagacagcttattcctgggacaatcaagtggatttcaaaccacttttagaagaagacaccaaagttacctcttgtcttacacaagaagaaattgatgaactatttaatccgatttattacacaaaacgtgttgatgatatttttaagcgtttagggatt

SEQ ID NO: 898 - protein, 430 aa, Streptococcus pyogenes
MLERYSRPEMAAIWTEENKYHAWLEVEILADEAWAELGEIPKEDVAKIREKADFDIDRILEIEQDTRHDVVAFTRAVSETLGEERKWVHYGLTSTDVVDTAYGYLYKQANDIIRRDLENFTNIVADKAREHKMTIMMGRTHGVHAEPTTFGLKLATWYSEMKRNIERFEHAAAGVEAGKISGAVGNFANIPPFVEEYVCDKLGIRPQEISTQVLPRDLHAEYFAVLASIATSIERMATEIRGLQKSEQREVEEFFAKGQKGSSAMPHKRNPIGSENMTGLARVIRGHMVTAYENVSLWHERDISHSSAERIITPDTTILIDYMLNRFGNIVKNLTVFPENMMRNMESTFGLIYSQRVMLKLIEKGMTREEAYDLVQPKTAYSWDNQVDFKPLLEEDTKVTSCLTQEEIDELFNPIYYTKRVDDIFKRLGI

SEQ ID NO: 899 - DNA, 1389 bp, Streptococcus agalactiae
atgaatagaataataaacagggatattttacctagaatttcaaagatttctaaaaataataaagagaaagatttactatctatagcttatattacttggctaatctttataatatttgctttgggagtagttacagttaatgatttaaaaccgatgtttaatcaattaatagtaaacctcttaaatatttattattatatggaagccttcatattgggtatggacagctatttacaatataaccttccatacagttttgatttttggagtatttttgtagaggctataaatttatttgtaaaagtatttttaattgcttttattccttctgttattagaaaagtattgaaaaaagaaagttttttcaatgaagttgttattttactaggagcgattgttactataattgtaagtttccatttatatttagagatattgatagtagtgggactaatacttttattaattgcttttgtttcaataggtaagaatcgtgtttataattttgttcaaaatttaaactactttgaagaagtgatttggaattattttgaagaaaatccggttaaaataaaagaaaaatcattgattattaaatttttacttactatttcttttgtttttgtaattgattttgcaatggttagattgttgaattttaatataaaattttctacaatattagcttgttctgctattttattagcatggttataccaaaataagtctgttacagaacccttcctattaaaaaagttagttatctattttatttttttcattgccactttaattggtaatttaaaaaatgagttgtcaatcttagaaacaccattactttttattagtatattttttactatggatagaattattgctctatctaaagaaatgcgtgatttgattatatctaagagtattttattttattatgatcatgaaaatataaagccatcaatattacttagtgagataaaagaaattaagtatcttgaaaatgtagatattggagaacttgaacttgttaggcaaatggtaattaggttgcgtctagagttagaggaagaatttttgattttatcagatatatatatgaaaaatggctatgaaaaatatatacaatttgttcaaggaaatgtttattttatcaacttagaattggataaaattcccaactacactaacttgaaattaatactagaatcaatatttgatcataataatcaaaagatatttatacctaaactttatgaggaatacatatacatcttaatttctttaggagaagttgaaaaagctaaagaaatattaaaagaagtgtcggattatttaactgaagaatctttgaattattttgaaaaagaatatgataaagctaagggtagtaat

SEQ ID NO: 900 - protein, 463 aa, Streptococcus agalactiae
MNRIINRDILPRISKISKNNKEKDLLSIAYITWLIFIIFALGVVTVNDLKPMFNQLIVNLLNIYYYMEAFILGMDSYLQYNLPYSFDFWSIFVEAINLFVKVFLIAFIPSVIRKVLKKESFFNEVVILLGAIVTIIVSFHLYLEILIVVGLILLLIAFVSIGKNRVYNFVQNLNYFEEVIWNYFEENPVKIKEKSLIIKFLLTISFVFVIDFAMVRLLNFNIKFSTILACSAILLAWLYQNKSVTEPFLLKKLVIYFIFFIATLIGNLKNELSILETPLLFISIFFTMDRIIALSKEMRDLIISKSILFYYDHENIKPSILLSEIKEIKYLENVDIGELELVRQMVIRLRLELEEEFLILSDIYMKNGYEKYIQFVQGNVYFINLELDKIPNYTNLKLILESIFDHNNQKIFIPKLYEEYIYILISLGEVEKAKEILKEVSDYLTEESLNYFEKEYDKAKGSN

SEQ ID NO: 901 - DNA, 240 bp, Streptococcus agalactiae
atgtcaccaccttatagggagcgacagtcacgccagccttatttgccagaaagtctttttcaaagatacggttttgagaaatgcggagcagatcagtcccctgcggtagctgaccagctgacacaacggcatccagaccatcggcatcgacattctcaaactcataggtcaaaacatcgcaacgcgcagctaatgttcccaaagcctcaacatcatcgtaaggtgccacaatcacctcgc

SEQ ID NO: 902 - protein, 80 aa, Streptococcus agalactiae
MSPPYRERQSRQPYLPESLFQRYGFEKCGADQSPAVADQLTQRHPDHRHRHSQTHRSKHRNAQLMFPKPQHHRKVPQSPR

SEQ ID NO: 903 - DNA, 1125 bp, Streptococcus agalactiae
atgaggaacaaggaaaaatcgcagaggagtcaagcaatgaactcatttaagaccattgggattattggtggtggtcagctggggcagatgatggcgattgcggctatctacatgggccacaaggtcattacgctggatccagctagcgactgccctgcctcccgcgttagcgaggtgattgtggcaccttacgatgatgttgaggctttgggaacattagctgcgcgttgcgatgttttgacctatgagtttgagaatgtcgatgccgatggtctggatgccgttgtgtcagctggtcagctaccgcaggggactgatctgctccgcatttctcaaaaccgtatctttgaaaaagactttctggcaaataaggctggcgtgactgtcgctccctataaggtggtgacatctagccttgacctagaggggcttgacttgaccaagacctatgtcctcaagacagcgacaggtggttatgacggtcatgggcaaaaggttatccgctcagcagaagacctgccagaggcgcagcaattagccaactcagctcagtgtgtcttggaagagtttgtcaacttcgaccttgaaatatcagtcatcgtgtctggaaatggtcaggatgtgacggtctttcccgttcaggaaaatatccaccgcaacaatatcctgtcaaaaaccatcgtaccagctcgcatctcagaccaactagctgacaaggctaaggaaatggctgtgcagattgccaagaaactccagctatcaggaaccctctgtgtggaaatgtttgcgaccgcagatgacatcatcgtcaatgaaattgccccacgtccccacaactcagggcactactctatcgaagcctgcgacttttcacagtttgacacccacatcttgggcgtactgggcgcaccgcttccgccaatcaaactccatgctccagccgttatgttcaatgtcctaggacaacatgtccagcaggcaattgaccatgttgcccaaaaccctagcgcccacctccacatgtatggtaaactagaagcaaaacataaccgcaaaatgggacacgtgacggtgtttagcgatgtacctgatgaggtggaagagtttgaagaaaggatggatttc

SEQ ID NO: 904 - protein, 375 aa, Streptococcus agalactiae
MRNKEKSQRSQAMNSFKTIGIIGGGQLGQMMAIAAIYMGHKVITLDPASDCPASRVSEVIVAPYDDVEALGTLAARCDVLTYEFENVDADGLDAVVSAGQLPQGTDLLRISQNRIFEKDFLANKAGVTVAPYKVVTSSLDLEGLDLTKTYVLKTATGGYDGHGQKVIRSAEDLPEAQQLANSAQCVLEEFVNFDLEISVIVSGNGQDVTVFPVQENIHRNNILSKTIVPARISDQLADKAKEMAVQIAKKLQLSGTLCVEMFATADDIIVNEIAPRPHNSGHYSIEACDFSQFDTHILGVLGAPLPPIKLHAPAVMFNVLGQHVQQAIDHVAQNPSAHLHMYGKLEAKHNRKMGHVTVFSDVPDEVEEFEERMDF

SEQ ID NO: 905 - DNA, 1107 bp, Streptococcus pyogenes
atgaggaacaaggaaaaatcgcagaggagtcaagtggtgaactcatttaagaccattgggattatcggtggtggtcagctggggcagatgatggccattgcggctatctatatgggtcacaaggtcatcacgctggatcctgctagcgacagccctgcctcccgcgttagcgaggtaattgtggcgccttacgatgatgttgaggctttgggacaattggctgcgcgttgcgatgtgttgacttatgagtttgagaatgttgatgcggacggtttggatgccgttgtgtcagcttgtcagctaccgcaggggaccgatctgctccgcatttcccaaaaccgtatcgttgaaaaagactttctggcaaataaggctggtgtgacagtcgctccctataaggtggtgacgtctagccttgacctaggggggcttgatttgaccaagacctatgtcctcaagacagagacaggtggttatgacggtcatgggcaaaagattatccgctcagcagaagatttgccagaggcgcagcaattagctaactcagctcagtgtgtcttggaagagtttgtcaactttgaccttgaaatctcagtcatcgtgtctggaaatggcaaggatgtgacggtctttcccgttcaggaaaatatccaccgcaacaatatcctgtcaaaaaccatcgtaccagctcgcatctcagatcaactggctgataaggctaagaaaacggcggtgcagattgccaagaaactccagctgtcaggaactctctgtgtggaaatgtttacgaccgcagatgatatcattgtcaatgaaattgccccacgcccccacaactcagggcgctattctatcgaagcctgcgacttttcacagtttgacacccacatcttgggtgtgttgggcgcaccacttcctcagattcagctccacgccccagccgtcatgctcaatgtcctaggacaacatgtccagcaggcaactgactatgttgccaaaaaccctagcgcccacctccacatgtatggtaaactagaagcgaaacataaccgcaaaatgggacatgtgacggtgtttgcaaaagatgcggatgaggtgaaggagttt

SEQ ID NO: 906 - protein, 369 aa, Streptococcus pyogenes
MRNKEKSQRSQVVNSFKTIGIIGGGQLGQMMAIAAIYMGHKVITLDPASDSPASRVSEVIVAPYDDVEALGQLAARCDVLTYEFENVDADGLDAVVSACQLPQGTDLLRISQNRIVEKDFLANKAGVTVAPYKVVTSSLDLGGLDLTKTYVLKTETGGYDGHGQKIIRSAEDLPEAQQLANSAQCVLEEFVNFDLEISVIVSGNGKDVTVFPVQENIHRNNILSKTIVPARISDQLADKAKKTAVQIAKKLQLSGTLCVEMFTTADDIIVNEIAPRPHNSGRYSIEACDFSQFDTHILGVLGAPLPQIQLHAPAVMLNVLGQHVQQATDYVAKNPSAHLHMYGKLEAKHNRKMGHVTVFAKDADEVKEF

SEQ ID NO: 907 - DNA, 582 bp, Streptococcus agalactiae
gtgggtacgtcttcgaaatcaaagatttcggacttaccgcatatttttctacgaaaattttcgacaagtcgaaacgtccctttgtatcttaatattatgcaaccaattatttctattatcatgggttccaaatccgactggacaaccatgcaaaaaacggctgaagttctagataactttggcattgcttacgagaagaaagtcgtctctgcccaccgtacgccagacctcatgttcaagcatgctgaggaggcgcgtggtcgtggtatcaagattatcatcgctggagcaggtggagcagcccacttgccgggtatggtagcagctaaaacaaccctgcctgttatcggtgtgcctgtcaaatcacgtgccctctcaggtttggattcgctctactctattgtgcagatgcctggtggtgtgcctgtggcgaccatggctatcggagaagcaggagcgactaacgctgccctgacagccctccgtatcctctctatcgaggatcaaaatctggctgatgcgctagctcatttccatgaggaacaaggaaaaatcgcagaggagtcaagcaatgaactcatt

SEQ ID NO: 908 - protein, 194 aa, Streptococcus agalactiae
MGTSSKSKISDLPHIFLRKFSTSRNVPLYLNIMQPIISIIMGSKSDWTTMQKTAEVLDNFGIAYEKKVVSAHRTPDLMFKHAEEARGRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSNELI

SEQ ID NO: 909 - DNA, 609 bp, Streptococcus pyogenes
atgctaaagcacctagtcgccctgacgtgggttcgtcttcgaaatcaaagatttcggacttacctcatatttttctacggaaagtttcgacaagtcgaaacgcccctttgtatcttaattatgaaaactccaattatttctattatcatgggctccaaatctgactgggcaaccatgcaaaaaacggctgaagttctagacaactttggcattgcttacgagaagaaagtcgtctctgcccaccgtacgccagacctcatgttcaagcatgctgaggaagcacgtggtcgtggcatcaaaatcatcatcgcaggagcaggtggggcagctcacttgcctggtatggtggcagctaaaacaacgctgcctgttatcggtgtgcctgtcaaatcacgtgccctttcaggtttggattcgctatattccattgtgcagatgcctggcggtgtgcctgtggcaaccatggctatcggagaagcgggagcgactaacgctgccctgacagccctccgtatcctctctatcgaggaccaaaatctggctgatgcgctagctcatttccatgaggaacaaggaaaaatcgcagaggagtcaagtggtgaactcatt

SEQ ID NO: 910 - protein, 203 aa, Streptococcus pyogenes
MLKHLVALTWVRLRNQRFRTYLIFFYGKFRQVETPLCILIMKTPIISIIMGSKSDWATMQKTAEVLDNFGIAYEKKVVSAHRTPDLMFKHAEEARGRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSGELI

SEQ ID NO: 911 - DNA, 1263 bp, Streptococcus agalactiae
atgaaattgcttgttgttggttctggtggtcgtgagcatgcgattgctaagaagttgttagcgtctaaggatgtggatcaggtttttgtggcacctggtaatgatggtatgaccttggatggtctagacttggtaaatatcggaatttccgaacattctagactgattgactttgttaaggagaatgagattgcttggacccttattggtcctgatgatgcgctagcagctggtatcgttgatggttttaatagtgctggactcagagcatttggtccaaccaaggcagccgcggagctagagtggtcaaaagactttgccaaggaaatcatggtcaaatacaatgttccaacagcagcctatggcacattttcagattttgaaaaagctaaagcctacatcgaagagcagggcgcaccaatcgtggtcaaggctgacggattggcgttaggcaagggcgtggtcgtggctgaaaccgttgagcaggcggtagaggcggcgcaagagatgcttttggacaacaagtttggcgactcgggtgcgcgcgtggttatcgaggaattcttggatggtgaagagttctcccttttcgccttcgctaatggcgataagttctacatcatgccgacagctcaggatcacaagcgtgcctatgatggtgacaaggggctaaataccggtggtatgggtgcctatgcgccagttccccacctgcctcagagcgtggtggatacagcagttgagactatcgttaagcctgtccttgaaggcatgattgccgaagggcgtccttatctaggtgtcctctatgctgggcttatcctgacggctgatggccctaaggttatcgagttcaactcacgttttggtgaccctgaaactcagattatcctccctcgcctgacttccgatttcgctcagaacatcgacgacatcatgatgggcatcgagccttacatcacttggcagaaggacggcgtgactctgggcgttgtcgttgcctcagaaggctatccgctcgattacgagaaaggtgtgccactgcctgaaaagaccgacggcgacatcatcacctactatgcgggagctaagtttgcggaaaatagcaaagcactgctctcaaacggaggacgtgtctacatgcttgtcaccacagaagacagcgtcaaagcagggcaggacaaaatctatacccaactcgcccaacaagacacaacaggcctcttctaccgaaacgacatcggaagcaaagctattaaggaa

SEQ ID NO: 912 - protein, 421 aa, Streptococcus agalactiae
MKLLVVGSGGREHAIAKKLLASKDVDQVFVAPGNDGMTLDGLDLVNIGISEHSRLIDFVKENEIAWTLIGPDDALAAGIVDGFNSAGLRAFGPTKAAAELEWSKDFAKEIMVKYNVPTAAYGTFSDFEKAKAYIEEQGAPIVVKADGLALGKGVVVAETVEQAVEAAQEMLLDNKFGDSGARVVIEEFLDGEEFSLFAFANGDKFYIMPTAQDHKRAYDGDKGLNTGGMGAYAPVPHLPQSVVDTAVETIVKPVLEGMIAEGRPYLGVLYAGLILTADGPKVIEFNSRFGDPETQIILPRLTSDFAQNIDDIMMGIEPYITWQKDGVTLGVVVASEGYPLDYEKGVPLPEKTDGDIITYYAGAKFAENSKALLSNGGRVYMLVTTEDSVKAGQDKIYTQLAQQDTTGLFYRNDIGSKAIKE

SEQ ID NO: 913 - DNA, 1410 bp, Streptococcus pyogenes
ttggctaatagagtgttccttatttcaagaattgtggtctactatcacatttttacaatgtttcaattattgataactaatacattatgtaaaaaagcgaacgtttatgatataatatctaattataatacgaaagaggtggatgttttgaaattacttgttgttggttcaggtggtcgtgaacatgcgattgctaagaagttgttagcgtctaagggtgtggatcaggtttttgtggcacctggtaatgatggtatgaccttggatggtctggacttggtgaatatagtagtttccgaacattccaggttgattgcctttgctaaggagaatgagatttcttgggcctttattggtcctgatgatgcgctagcagctggtatcgttgatgatttcaacagtgctggactcagagcttttggtccaacaaaggcagcagcggagctagagtggtcaaaagactttgccaaggaaatcatggtcaaatacaatgtcccaacagcagcctatggcacattttcagactttgaaaaagccaaagcctacatcgaagagcagggcgcacctatcgtggtcaaggctgatggcttggcgctaggtaagggtgtggtcgtggctgaaaccgttgagcaggcggtagaggcggcgcaagagatgcttctggacaataagtttggcgattcaggagcgcgtgtggttatcgaggaattcttggatggcgaggagttttccctctttgcctttgctaatggcgataagttctacatcatgccgacagctcaggatcacaagcgtgcctttgacggagacaaggggccaaacactggtggtatgggtgcctatgcgccagttcctcatctacctcagagcgtggtagacacagcggttgagatgatcgttaggcctgtccttgagggcatggttgccgaagggcgtccttatctaggtgtcctctatgtggggcttatcctgacagctgatggacctaaggttatcgagttcaactcacgtttcggtgaccctgaaactcagattatcctccctcgcctgacttctgatttcgctcagaatattgacgatatcatgatgggcattgagccttacatcacttggcagaaggacggtgtgactttgggtgttgtcgttgcctcagaaggctatccattcgattatgagaaaggtgtgccactgcctgaaaagaccgacggcgatatcatcacctactacgcaggagttaagttttcggaaaatagcgagctacttctctcaaacggaggacgtgtctatatgctcgtcaccacagaagacagcgtcaaagcagggcaggacaaaatctatacccaactggcccaacaagacacaacaggtctcttctaccgaaatgatatcggaagcaaagctataagagaa

SEQ ID NO: 914 - protein, 470 aa, Streptococcus pyogenes
LANRVFLISRIVVYYHIFTMFQLLITNTLCKKANVYDIISNYNTKEVDVLKLLVVGSGGREHAIAKKLLASKGVDQVFVAPGNDGMTLDGLDLVNIVVSEHSRLIAFAKENEISWAFIGPDDALAAGIVDDFNSAGLRAFGPTKAAAELEWSKDFAKEIMVKYNVPTAAYGTFSDFEKAKAYIEEQGAPIVVKADGLALGKGVVVAETVEQAVEAAQEMLLDNKFGDSGARVVIEEFLDGEEFSLFAFANGDKFYIMPTAQDHKRAFDGDKGPNTGGMGAYAPVPHLPQSVVDTAVEMIVRPVLEGMVAEGRPYLGVLYVGLILTADGPKVIEFNSRFGDPETQIILPRLTSDFAQNIDDIMMGIEPYITWQKDGVTLGVVVASEGYPFDYEKGVPLPEKTDGDIITYYAGVKFSENSELLLSNGGRVYMLVTTEDSVKAGQDKIYTQLAQQDTTGLFYRNDIGSKAIRE

SEQ ID NO: 915 - DNA, 801 bp, Streptococcus agalactiae
atgactatttatgaccaaattgagtctgctcttgatttaatgactgatttagaacgtgaaattgcttgttattttatggggcagcccatttcaaaagacgctcttgcttctaccattgtcactaagcaactacacatttcacaagcagccttaacgcgttttgctaaaaaatgtgggtttaaaggctatcgtgaatttgtttttgaatatttaaaaagccatgagaccatcagtcaacaattatacggtcttcaaaatgacaacactaagaaagtatttatgaattatcaagagatgatttctaaatctgctgatattattgatgaagaacagcttctagaagtatcacatatgattgagcaagctgatcgtgtttatttttatggcaaagggagctcatcgctagtagctaaagaatttaaaatacgccttatgaggctgggagtgatttgtgaggctctggatgatacagatagtttctcatggactaatagtattgttaatgatagatgcctcgtcattgccttctcactttctgggaacaccaactctgttattggtgccttaaaaatcgcaagttgtcacggagctaaaaccgttctatttacaaaacaacctcacacaattgactatgcttttgacaagattattcaggtggcttctgctaggcatttagactacggcaatagaatttcgcctcagatcccaatgttaatcatggtagatattatctatgcacaatttttagatattaataaaatagaaaaagagcgaatttttagagaaaccattattcaacgc

SEQ ID NO: 916 - protein, 267 aa, Streptococcus agalactiae
MTIYDQIESALDLMTDLEREIACYFMGQPISKDALASTIVTKQLHISQAALTRFAKKCGFKGYREFVFEYLKSHETISQQLYGLQNDNTKKVFMNYQEMISKSADIIDEEQLLEVSHMIEQADRVYFYGKGSSSLVAKEFKIRLMRLGVICEALDDTDSFSWTNSIVNDRCLVIAFSLSGNTNSVIGALKIASCHGAKTVLFTKQPHTIDYAFDKIIQVASARHLDYGNRISPQIPMLIMVDIIYAQFLDINKIEKERIFRETIIQR

SEQ ID NO: 917 - DNA, 840 bp, Streptococcus pyogenes
gtgtgctttgctatgcctaaaaaccaccgcctaattaccaaaatcgaagcatcattggaacatatgaccagtttagaaaaagggattgctcatttttttattacaaccgatctgacacctcaagagttgaccgcatccgagatagttaagcgactacacatctctcaagccgccttgactcgatttgcaaaaaaatgtggttttactggttatcgtgcttttgcctttgattaccttcacagtcttcaagaatcacaagagactttccaatctattcacttagaattgacaaagcgcgtgctgatggactacgacgctcttattaataaaacctatgagctcgttaatgaggaaaaattactgaacttagccaagctgatcgattcttctgagcgagtctatttctttggcaaaggatcttctggactagtagcaagagaaatgaagctacgctttatgcgacttggtttaatctgtgatgcttattcagacactgatggttttacttgggcaaatagcctcgtcaatgaaaattgccttgtttttggtttttctttatctggcaaaacaaactctgtcatcacagcacttcatcaagctagtcagcgaggagccaaaactgtcctcttaacaacagataatcaaaccgaatttgacgactccttagatattattcccgtatcatcaactcaccaactacattatgggaatcgtgtgtcaccacaatttcctcttcttattatgatggacattatttatgcttacgttttagcgattgacaaaccgcacaaagaaaaaatcttcaaaaacactattattgacaaagaaaataacgacctt

SEQ ID NO: 918 - protein, 280 aa, Streptococcus pyogenes
VCFAMPKNHRLITKIEASLEHMTSLEKGIAHFFITTDLTPQELTASEIVKRLHISQAALTRFAKKCGFTGYRAFAFDYLHSLQESQETFQSIHLELTKRVLMDYDALINKTYELVNEEKLLNLAKLIDSSERVYFFGKGSSGLVAREMKLRFMRLGLICDAYSDTDGFTWANSLVNENCLVFGFSLSGKTNSVITALHQASQRGAKTVLLTTDNQTEFDDSLDIIPVSSTHQLHYGNRVSPQFPLLIMMDIIYAYVLAIDKPHKEKIFKNTIIDKENNDL

SEQ ID NO: 919 - DNA, 975 bp, Streptococcus agalactiae
atgattgaaacaatgtcgctagatgacatgagagaatacctaggtcaagaccaaattcccgaggattttgatgacttctggaaaaaacaaacaatgaaatatcaagggaatattgagtatcgtctagacaaaaaagatttcaatattacttttgcacaagcttatgatcttcattttaaaggcagcaataactctattgtctatgccaaatgtttattccctaaaacaaataaaccctatcctgtagttttttattttcatggttaccaaaaccaaagtcctgactggagtgaccaacttaattatgtagcagcaggttacggcgttgtttcaatggatgttcgaggtcaagctggacagtctcaagacaaggggcattttgatggcattacagttaagggccagattgtgcgaggaatgatctcaggaccaaatcatcttttttataaagacatttatcttgatgttttccaattgattgatatcattgctacattagagagtgttgatagtaatcaactttatagttatggctggtctcaaggtggagcacttgctttgatagctgcagctcttaatcccaaaatcgtcaagaccgttgctgtttacccatttttgtcagactttagacgagtattagatttagggggtgtcagtgagccctatgatgaactcttccgctattttaaatatagtgatccttttcataaaacagagaataatgtgttaaaaactttggcttatattgatgttaaaaattttgcacataggatttcttgccccgttgttttactaacagccttaaaagatgatatttgtcctccatcaactcaatttgccatttttaatcgtctgacatcaactaaaaagcatcttttattaccagattatggacatgatccaatgacagtgcaagtaaaagaccatatttttgatcaactgacaggaagtcaatttacaaagcaaaaaatcgag

SEQ ID NO: 920 - protein, 325 aa, Streptococcus agalactiae
MIETMSLDDMREYLGQDQIPEDFDDFWKKQTMKYQGNIEYRLDKKDFNITFAQAYDLHFKGSNNSIVYAKCLFPKTNKPYPVVFYFHGYQNQSPDWSDQLNYVAAGYGVVSMDVRGQAGQSQDKGHFDGITVKGQIVRGMISGPNHLFYKDIYLDVFQLIDIIATLESVDSNQLYSYGWSQGGALALIAAALNPKIVKTVAVYPFLSDFRRVLDLGGVSEPYDELFRYFKYSDPFHKTENNVLKTLAYIDVKNFAHRISCPVVLLTALKDDICPPSTQFAIFNRLTSTKKHLLLPDYGHDPMTVQVKDHIFDQLTGSQFTKQKIE

SEQ ID NO: 921 - DNA, 879 bp, Streptococcus agalactiae
atgaccagaacagtagcaattgatattggcggtacaatgattaagcatggcattgtggataatttaggttgtattgttgaggcaagtgagcttgccacagaagcctacaaaggtggtccaggcattttacaaaaagtttgtcaaattatcgataactatctagcagaagggagcattgatggaattgctatctcatctgctggcatggtagatccagatgaaggatgtatattttactctggtcctcaaattccaaactatgctgggacacaatttaagaaagttttagaagacacttatcaagtacgcacagaaattgaaaatgatgttaattgtgcaggattagctgaagctgtctcaggtagtgccaaagatagttcaatagcgctttgtcttactattggaacaggtattggtggttgtctgattattgataaaacagtttttcatggctttagtaattctgcttgtgaagttggctatatgcacctttcagatggtgattttcaagatttagcctctacaactgcactgattgctgatgttgccaaagcgcatggagatgaaattagccgatgggatggacgtcgtatttttcaggaggctaaaaaaggcaatgaaaaatgtattgcaagtatagaccgtatgataaactaccttggccaaggaatcgctaatatggtttatgtggtaaatcctgaaaaagttgttttaggtggtggaatcatggctcaaaaagattatttacaagataaacttagtgaatctttgaaacgaaatcttgtgacaagtcttgctgaaaaaacagcaatagtctttgcacaacacgaaaaccaagctggtatgctaggagcttactaccattttaaaaacaggggg

SEQ ID NO: 922 - protein, 293 aa, Streptococcus agalactiae
MTRTVAIDIGGTMIKHGIVDNLGCIVEASELATEAYKGGPGILQKVCQIIDNYLAEGSIDGIAISSAGMVDPDEGCIFYSGPQIPNYAGTQFKKVLEDTYQVRTEIENDVNCAGLAEAVSGSAKDSSIALCLTIGTGIGGCLIIDKTVFHGFSNSACEVGYMHLSDGDFQDLASTTALIADVAKAHGDEISRWDGRRIFQEAKKGNEKCIASIDRMINYLGQGIANMVYVVNPEKVVLGGGIMAQKDYLQDKLSESLKRNLVTSLAEKTAIVFAQHENQAGMLGAYYHFKNRG

SEQ ID NO: 923 - DNA, 936 bp, Streptococcus pyogenes
atgaagcattatttagcaattgatattggtggtactgctatcaagtatggcttgatttctgaaacaggagacctgttggaaaaagaggaaatggccactgaggcttataaaggtggtccctctattttggaaaaggtcaagggcttggtaaagacctatcaagaccaaatggatctggctggagtggccatttcttctgcaggaatggttaatcctgatgagggagaaatcttttatgccggccctcagattcctaactatgctggaactcagtttaaaaaagagattgaagagactttcgggttaccgtgtgaagtggaaaacgatgttaactgtgctggtctggccgaagctatttctggtagtgccaaggattatcctgtggctctttgcttgacaattgggacgggaatcggtggctgtttattgtttaattcccaagtttttcatggtagtagtcattcagcttgcgaagttggttaccttcatttgtcagatggtcagtttcaggatctggcatctaccacagctcttgttcaagaggtggtcttagcttatggcgatgacattagccaatgggatggtcgtcgtatttttgagcaggctaaagcgggtgatgcgatttgtatagcagccattagtaagcaggtggattacttaggacaaggtattgctaatatctgctacgttgttaacccaaatgtggtggtgcttggtggcggtatcatggcgcaaaaagactatttagctgataaattaaagacagctcttgatagctacttggtttctagtcttgccaagaaaactcagctgaagtttgctagtcatggaaataatgctggtatattaggagcttactaccattttaaacaaaagaatgagcgatcttgttcatttataactcttgagaaaatcgaaaataatttagcgagtagc

SEQ ID NO: 924 - protein, 312 aa, Streptococcus pyogenes
MKHYLAIDIGGTAIKYGLISETGDLLEKEEMATEAYKGGPSILEKVKGLVKTYQDQMDLAGVAISSAGMVNPDEGEIFYAGPQIPNYAGTQFKKEIEETFGLPCEVENDVNCAGLAEAISGSAKDYPVALCLTIGTGIGGCLLFNSQVFHGSSHSACEVGYLHLSDGQFQDLASTTALVQEVVLAYGDDISQWDGRRIFEQAKAGDAICIAAISKQVDYLGQGIANICYVVNPNVVVLGGGIMAQKDYLADKLKTALDSYLVSSLAKKTQLKFASHGNNAGILGAYYHFKQKNERSCSFITLEKIENNLASS

SEQ ID NO: 925 - DNA, 915 bp, Streptococcus agalactiae
atgaaagatttacaaaaatatcaaggaattattcctgcattttatgcttgctatgatgataagggtgatatttgtcccgaacgagtaaaagccctgaccaattattttattgataaaggtgttcaaggactttatgttaatggttcatccggagaatgtatttaccaaagtgtagcagatcgtaaacttgtactggaaaatgttatgtccgttgctaagggtaaactaacagtaatagcgcatgtggcatgtaataatactaaggatagcgtagagttggctatgcatgctgaagctataggtgttgatgctattgcagcaattccaccaatttattttcgattaccagagtatgccatagcagattattggaatactattagtcaagcagcaccacaaactgattttattatttacaatattcctcaattggcaggggttgctttgacatcggatttatatcgaaaaatgttacaaaatccgcaagtaattggtgttaaaaattcttccatgccagttcaagacattcagaattttgtggctattggaggagaaaatcatattgtttttaatggtccagatgaacaatttttgggtggtcgtctcatgggagccgctgcaggtattggtggtacctatggcgtaatgccagaattatacttgactttaaatcagttaattgttgataaagatttagaaaaagcgcgtgaacttcaatttacaattaacgatattatcacaaagctttgttcgggtcatggtaatatgtatgctgtgatcaaagctgtattggaaatcaatgagcaactaactataggttccgttcggttacctttagcatctgtaacagaagaagataaacctattattaaagaggcagcagaaatgattagacatgctaaaaaacagttttgt

SEQ ID NO: 926 - protein, 305 aa, Streptococcus agalactiae
MKDLQKYQGIIPAFYACYDDKGDICPERVKALTNYFIDKGVQGLYVNGSSGECIYQSVADRKLVLENVMSVAKGKLTVIAHVACNNTKDSVELAMHAEAIGVDAIAAIPPIYFRLPEYAIADYWNTISQAAPQTDFIIYNIPQLAGVALTSDLYRKMLQNPQVIGVKNSSMPVQDIQNFVAIGGENHIVFNGPDEQFLGGRLMGAAAGIGGTYGVMPELYLTLNQLIVDKDLEKARELQFTINDIITKLCSGHGNMYAVIKAVLEINEQLTIGSVRLPLASVTEEDKPIIKEAAEMIRHAKKQFC

SEQ ID NO: 927 - DNA, 912 bp, Streptococcus pyogenes
atgacagatcttacgaaataccaaggcattattcctgccttttacgcttgttacgatgaccaggggaatatcagccctgagcgtgtgcgtgccttgacccagtactatattgacaaaggggttcaggggctttacattaatggctcttctggagagtgtatttaccagagcgtttttgaccgtcaattggtgttagaaaatgtcatggcagtcgctaagggcaagctgacgattattaatcacgttgcctgcaacaacactaaagatagtattgaattggcagctcattcagaacgtttgggcgtggatgccattgcagctattccgcctatttatttccggttaccagaatatgcggttgctgattattggaatgctatttcttcggctgctcctcacacagattttatcatctataatattcctcaactggcaggggttgccttgacgccaagcctttataagactatgttggctaataagcgcgtgattggcgttaaaaattcatctatgccagtgcaggatattcaaaccttctgtgcgattggtggggacgatcatattgtttttaatggcccagatgaacaatttctaggagggcgcttgatgggtgctgctgcaggcattggtggtacctacggggctatgccagaattatttttaaggctgaaccaacttattgctgacaaggatttagaaaaggccaaggcccttcaatatactattaatgagattatcggtgtccttgtttctgctcacggcaatatgtatggggttattaaagaagtacttcgtattaatgagggtcttgatattggttctgttcgatcacctttagctgagttggtcgaggaagatagggttatttgccaacgggctgctgctctgattaatcaggctaaggaaaccttt

SEQ ID NO: 928 - protein, 304 aa, Streptococcus pyogenes
MTDLTKYQGIIPAFYACYDDQGNISPERVRALTQYYIDKGVQGLYINGSSGECIYQSVFDRQLVLENVMAVAKGKLTIINHVACNNTKDSIELAAHSERLGVDAIAAIPPIYFRLPEYAVADYWNAISSAAPHTDFIIYNIPQLAGVALTPSLYKTMLANKRVIGVKNSSMPVQDIQTFCAIGGDDHIVFNGPDEQFLGGRLMGAAAGIGGTYGAMPELFLRLNQLIADKDLEKAKALQYTINEIIGVLVSAHGNMYGVIKEVLRINEGLDIGSVRSPLAELVEEDRVICQRAAALINQAKETF

SEQ ID NO: 929 - DNA, 660 bp, Streptococcus agalactiae
gtgaaaaaagcaaatcaattaatagcagcgatttttgatgttaacaacccctttatgcaaggttgcaatgttgtttttgatctggcattactaaaccttctctttatgataacttgcctaccattggtaactattggtgctgctaaaattagtttgtatcgaacgttgtggcaaaaattagaaggtgatcagacaaatcttttaatattgtatataaaacacctaaaaaaagagtggttccaaggtatgcttttaggtttggttgaactaagtattttggttgtgatcatatttgatttaacaattcttcattatcaaataggtttcattgtgtctttcttgaagataacttgttacgcctttttgttattgactgtgatgacgagcatatacctatttcctatggctgcccgctacgaaatgtctcttttagataccgtgaaaaagagctttataatggcatgtttaaacttgaaatggactggtgtattgatgtttttattaatcatgacttggtttattatggtgcagtctagtctcttatttatgcttacagtgtcagctatatttatttttgcttataccgcctttgcttactttaaaattattattttacaaaaacaatttgcctatttcagcaaacaacaaggagattatcaa

SEQ ID NO: 930 - protein, 220 aa, Streptococcus agalactiae
MKKANQLIAAIFDVNNPFMQGCNVVFDLALLNLLFMITCLPLVTIGAAKISLYRTLWQKLEGDQTNLLILYIKHLKKEWFQGMLLGLVELSILVVIIFDLTILHYQIGFIVSFLKITCYAFLLLTVMTSIYLFPMAARYEMSLLDTVKKSFIMACLNLKWTGVLMFLLIMTWFIMVQSSLLFMLTVSAIFIFAYTAFAYFKIIILQKQFAYFSKQQGDYQ

SEQ ID NO: 931 - DNA, 660 bp, Streptococcus pyogenes
ttgacatcgaaaaaacagggacttttacactctctcttcaagcttgatagtaaatggatgagggctagcgcagcactgtttgatttgctcgtgtttaatctcttatttgtcttgtcctgccttccccttctaacgattggggttgctaaaatggctttgtatgcgagtttgttggattggcgagaaggtcaagttagtcagcttgttactacttatagctctcattttaaatattactttaaaagtgggctacgccttggccttattgagcttgggataatgactatttgtctcttagatcttttcttaattcgaaaccaatcaggcctagtttttcaagggtttaaagtactttgcgttgctgttttatttttggtggttatactctttttgtacgcttatcctcaggccgtcaaaagagacctttccctatctacgctgtttaagcgaagctttttattagcaggactcttttttccatggagttttgctttcttggcttttatttgtctcacgatatttagcctacaattgtctctgttaacgttatttggaggcgtgtctttgctagctatcatcggcatcagtagtctaacttatctctacttgattatcatggaatctcttcttaggcgattcccacttaataatgacattgaa

SEQ ID NO: 932 - protein, 220 aa, Streptococcus pyogenes
LTSKKQGLLHSLFKLDSKWMRASAALFDLLVFNLLFVLSCLPLLTIGVAKMALYASLLDWREGQVSQLVTTYSSHFKYYFKSGLRLGLIELGIMTICLLDLFLIRNQSGLVFQGFKVLCVAVLFLVVILFLYAYPQAVKRDLSLSTLFKRSFLLAGLFFPWSFAFLAFICLTIFSLQLSLLTLFGGVSLLAIIGISSLTYLYLIIMESLLRRFPLNNDIE

SEQ ID NO: 933 - DNA, 441 bp, Streptococcus agalactiae
atgatttacgatcatttattgaatttaacgcattataaagatattaatcctaatttagatttagcgattgattatctactaagtcatgatttaaggaatttagatataggcacctatcatattagcccagaagtgatactcatggtccaatcaaatcaacttagtgagtcatttgatcatatttttgaataccataaaaaataccttgatatacattatgtcattgaaggacatgaagttatcaaattgggaaaaggtgataaggtagaggtggaggaatacttaggcgatataggatttatcaagtgctcagaagagacttcttttgatttgagagataattatatagccttctttttcccagaagaagctcatcagccaaatggtatgggaagtctaggtaattatgtcaaaaaaggggtattgaaagtgttaatggcg

SEQ ID NO: 934 - protein, 147 aa, Streptococcus agalactiae
MIYDHLLNLTHYKDINPNLDLAIDYLLSHDLRNLDIGTYHISPEVILMVQSNQLSESFDHIFEYHKKYLDIHYVIEGHEVIKLGKGDKVEVEEYLGDIGFIKCSEETSFDLRDNYIAFFFPEEAHQPNGMGSLGNYVKKGVLKVLMA

SEQ ID NO: 935 - DNA, 828 bp, Streptococcus agalactiae
atgaaaaagaaaacattcagtgcttataactttttaacggctcttatcctttgtcttttgacagtgctttttatctttccattttattggattatgacaggagcttttaaatctcaacctgatactattatcatccccccacaatggtggcccaaagcaccgaccttagaaaattttaaagctttaactgtacaaaacccagctttgagatggctttggaatagtgtctttatctcaattatgacaatgttcctagtttgctgtacatcgtcaatggcaggctatgttttagctaagaaacgattttacggtcaaaaaatattgttctccctttttattgctgctatggctttacctaaacaagttgttttagtgccattagttagaattatcaattttatggggatacatgataccttatgggcggttattttacctcttgttggttggccttttggggtcttcttgatgaaacagttttctgaaaatattccaacagaattactggaatcagctaaaattgatggttgtggagagattcgaacatttattaatgtagcatttccaattgtcaaacctggatttgctgccctagctattttcacatttatcaatacttggaatgactattttatgcaattagttatgctaacttctagaaataatctgaccatttctcttggggtagctactatgcaggctgaaatggcaacaaactatggcttaattatggcaggtgcagccttagctgctgttcctattgtgacagtattcttagttttccaaaaatcctttactcaggggattacaatgggagctgttaaagga

SEQ ID NO: 936 - protein, 276 aa, Streptococcus agalactiae
MKKKTFSAYNFLTALILCLLTVLFIFPFYWIMTGAFKSQPDTIIIPPQWWPKAPTLENFKALTVQNPALRWLWNSVFISIMTMFLVCCTSSMAGYVLAKKRFYGQKILFSLFIAAMALPKQVVLVPLVRIINFMGIHDTLWAVILPLVGWPFGVFLMKQFSENIPTELLESAKIDGCGEIRTFINVAFPIVKPGFAALAIFTFINTWNDYFMQLVMLTSRNNLTISLGVATMQAEMATNYGLIMAGAALAAVPIVTVFLVFQKSFTQGITMGAVKG

SEQ ID NO: 937 - DNA, 828 bp, Streptococcus pyogenes
atgacgaaaaagaaactaaccgcatcagatatcttaaccactgtgatgctatgtgttttgaccattttgtttatttttccattttattggattatgacaggagcatttaaggctcaagccgataccattatgattccaccgcaatggtggccaaaggcgcctactattgaaaattttaaggccttggtagtgcaaaatccagccttaaaatggttgtggaatagtgtctttatttcggtggcgaccatgttcttggtttgtggaacctcctcgttggctggctatgctttggccaaaaagcggttttatggacagcggcttttgttttcgatttttattgctgctatggccttgccaaaacaggttgttctagtgcctcttgtgcggattgttaattttatgggaatccatgacactttggcggctgttattttgcctcttgtgggctggccatttggtgttttccttatgaaacagttctcagaaaatattccaaccgagttattggaatccgccaagattgatggatgtggcgaaattcgtacctttttcaatgtggctttccctattgtcaaaccaggctttgcagcgctagcgatttttacctttatcaatacttggaatgattattttatgcagttagtgatgttaacctctcgagaaaatttaacgatttcacttggggttgccactatgcaagctgaaatggctactaattatggcttgattatggcaggggctgccatggctgcagtgcctattgtaacagtctttcttgtcttccaaaaatcatttacccaaggcattactatgggtgctgtgaaaggt

SEQ ID NO: 938 - protein, 276 aa, Streptococcus pyogenes
MTKKKLTASDILTTVMLCVLTILFIFPFYWIMTGAFKAQADTIMIPPQWWPKAPTIENFKALVVQNPALKWLWNSVFISVATMFLVCGTSSLAGYALAKKRFYGQRLLFSIFIAAMALPKQVVLVPLVRIVNFMGIHDTLAAVILPLVGWPFGVFLMKQFSENIPTELLESAKIDGCGEIRTFFNVAFPIVKPGFAALAIFTFINTWNDYFMQLVMLTSRENLTISLGVATMQAEMATNYGLIMAGAAMAAVPIVTVFLVFQKSFTQGITMGAVKG

SEQ ID NO: 939 - DNA, 885 bp, Streptococcus agalactiae
atgcgtactaataagttaaagatgagggaaacgatgatagcttatgcttttctagcacctattctcttatttttcttaatttttgtttttgcaccgatggttatgggctttgtcactagtttttttaattattctatgacacagttcacttttattgggttagctaattacaatcgtatgtttcatgattctattttcatgaaatccttgataaatacagtaatcattgtgattggctctgtgccagtagtggttttcttctcactttttgttgctgccaatacttatgaaaaaaatgttttttcacgctctttctaccgttgtgtcttcttcttgccagtagtaactggtagtgttgcagttacagttgtttggaaatggatttatgaccctatgtccggaattttaaattacatcttgaaatcaggtcatgtcattgaacagaatattagctggcttggggataagcactgggcattgcttgctattattattattttgctaacgacctcagttggtcaacctattattctatatattgcggcgatgggaaatattgataattctctttgcgaagctgcgcgtgttgatggagccaatgaaatgcaagttttttggcaaattaaatggccgagtctcttaccaactacactctatattgcagttataacaacaattaattcatttcaatgttttgccttaatccagctcctaacatctggtggaccaaattattcaacaagcactttgatgtattatctttatgaaaaagcctttaaactatcagaatatggctatgctaatactatgggagtattcctagcagtaatgattgctttaataagttttgctcaatttaagatcttaggaaatgatgtggaatat

SEQ ID NO: 940 - protein, 295 aa, Streptococcus agalactiae
MRTNKLKMRETMIAYAFLAPILLFFLIFVFAPMVMGFVTSFFNYSMTQFTFIGLANYNRMFHDSIFMKSLINTVIIVIGSVPVVVFFSLFVAANTYEKNVFSRSFYRCVFFLPVVTGSVAVTVVWKWIYDPMSGILNYILKSGHVIEQNISWLGDKHWALLAIIIILLTTSVGQPIILYIAAMGNIDNSLCEAARVDGANEMQVFWQIKWPSLLPTTLYIAVITTINSFQCFALIQLLTSGGPNYSTSTLMYYLYEKAFKLSEYGYANTMGVFLAVMIALISFAQFKILGNDVEY

SEQ ID NO: 941 - DNA, 987 bp, Streptococcus pyogenes
gtgttcctaacaagtggcttcttttcaatgcacatgtcaaatggtcactggaaagaagcttttctttttagaaaagttgaacagaaaaaagaggtatttcaagtgaacgtcaataaattaaaaatgagagagacgctcatctcatacgctttcttagctccggtcttggttttctttgtgatttttgtcttgataccgatgattatgggctttgtgacgagctttttcaattattccatgacagagtttacctttgttggttttgctaattatgctaggatgtttcaagatcccattttcatgaagtctcttattaacaccttgattattgttattggttcggtacctgttgtagttttcttttccctctttgtggcggctaaaacctacgacaaaaatgtagtggcgcgttcgttttaccgggcagttttctttctgcctgttgttaccggaagtgttgcggtgacggtggtttggaaatggatctatgatccaatgtcagggattttgaattatgtcttaaaatatgctcatgtgattgaacaaaatattagttggctgggagataagcactgggctttgttggctattattgttattttattaaccacatctgttgggcagcctattattctatatattgctgctatgggaaatattgataactctttggtagaagctgcgcgtgtggacggcgccacagaatttcaggtgttttggaatatcaagtggccaagtctgctgccaacaaccttatatattgctgtcataacaaccattaattccttccaatgttttgctttgattcaacttttgacgtctggagggccaaattattcaaccagtaccctcatgtactatttgtatgaaaaggcctttaagctctctgaatacggctatgccaacacaatgggtgtattcttggcagtcatgattgcaatcatcagctttgctcaatttaaaattttaggtaatgatgtggaatat

SEQ ID NO: 942 - protein, 329 aa, Streptococcus pyogenes
VFLTSGFFSMHMSNGHWKEAFLFRKVEQKKEVFQVNVNKLKMRETLISYAFLAPVLVFFVIFVLIPMIMGFVTSFFNYSMTEFTFVGFANYARMFQDPIFMKSLINTLIIVIGSVPVVVFFSLFVAAKTYDKNVVARSFYRAVFFLPVVTGSVAVTVVWKWIYDPMSGILNYVLKYAHVIEQNISWLGDKHWALLAIIVILLTTSVGQPIILYIAAMGNIDNSLVEAARVDGATEFQVFWNIKWPSLLPTTLYIAVITTINSFQCFALIQLLTSGGPNYSTSTLMYYLYEKAFKLSEYGYANTMGVFLAVMIAIISFAQFKILGNDVEY

SEQ ID NO: 943 - DNA, 1314 bp, Streptococcus agalactiae
atgagtatcaaaaaaagtgtgattggtttttgcctcggagctgcagcattatcaatgtttgcttgtgtagacagtagtcaatctgttatggctgccgagaaggataaagtcgaaattacgtggtgggcttttccaacctttactcaagaaaaggctaaggatggagtaggtacttatgagaaaaaagtcatcaaggcttttgaaaagaaaaatcctaatataaaagtaaaactagagacaattgatttcacatctggacctgaaaaaatcactacagcgattgaagcagggacagcacctgatgtgctttttgatgcaccagggcgaattattcaatatggtaaaaatggtaaattagcagatttgaatgatttatttacagaccaatttattaaggatgtcaataataagaatatcattcaagcttctaagtctggcgataaagcctacatgtatccaataagttctgccccattttatatggcgttcaataaaaaaatgcttaaagatgcaggagttttgaaactcgtaaaagaaggttggactactagtgattttgaaaaagtactaaaagcactaaaaaataaaggctatacaccaggttcattctttgcaaacgggcaaggaggagatcaaggaccacgtgcattttttgctaatctttatagtgctccaataacagataaagaagtaacaaaatataccactgacactaaaaattctgtaaaatcaatgaaaaaaatagttgaatggattaagaaaggctacttgatgaatgggtctcagtatgatggctcagctgacattcaaaactttgccaatggacaaactgctttcactatcctatgggctccagctcaacccaaaactcaagcaaaattattagagtcaagtaaagtggattaccttgaagtgccattcccatcagaagatggaaaaccagatttagaataccttgttaatggttttgcggtctttaataataaagatgaaaacaaagtaaaagcctctaagaaatttatcacttttattgctgacgataaaaaatggggaccaaaagatgttatacgtacaggtgctttcccagttagaacatcatttggagatctttataaaggtgataaacgtatgatgaagatttcaaaatggactcaatattattcaccatattacaacactatcgatggattttctgaaatgagaaccttatggttcccaatggttcaatctgtatccaatggtgacgaaaaaccagcagatgctttgaaagactttactcaaaaagcaaatgataccattaaaaaagcagctaaa

SEQ ID NO: 944 - protein, 438 aa, Streptococcus agalactiae
MSIKKSVIGFCLGAAALSMFACVDSSQSVMAAEKDKVEITWWAFPTFTQEKAKDGVGTYEKKVIKAFEKKNPNIKVKLETIDFTSGPEKITTAIEAGTAPDVLFDAPGRIIQYGKNGKLADLNDLFTDQFIKDVNNKNIIQASKSGDKAYMYPISSAPFYMAFNKKMLKDAGVLKLVKEGWTTSDFEKVLKALKNKGYTPGSFFANGQGGDQGPRAFFANLYSAPITDKEVTKYTTDTKNSVKSMKKIVEWIKKGYLMNGSQYDGSADIQNFANGQTAFTILWAPAQPKTQAKLLESSKVDYLEVPFPSEDGKPDLEYLVNGFAVFNNKDENKVKASKKFITFIADDKKWGPKDVIRTGAFPVRTSFGDLYKGDKRMMKISKWTQYYSPYYNTIDGFSEMRTLWFPMVQSVSNGDEKPADALKDFTQKANDTIKKAAK

SEQ ID NO: 945 - DNA, 1317 bp, Streptococcus pyogenes
atgaacatgaagaagttagcttcattagcgatgcttggtgcatctgttttaggactagcagcttgtggcggaaagagccagaaagaggctggtgcaagtaaatctgatactgctaagacagaaatcacatggtgggctttcccggtcttcacgcaagaaaaagctgaagatggtgtgggaacctatgagaagaaattgattgctgcctttgagaaagctaatccagaaatcaaggtaaaattggaaaccattgattttacatctggtcctgagaaaatcacaactgctattgaagctggaacagctcctgatgtcctctttgatgctccaggtcgtatcattcaatatggtaaaaatgggaaattggctgacttgaatgacttgttcacagaagagtttaccaaagatgttaacaatgacaaattgattcaagcctcaaaagcaggagatacagcttacatgtatcctatcagctctgctccattctacatggcgttgaataaaaaaatgctcaaagatgctggcgtccttgatcttgtgaaagagggttggacaacagatgattttgaaaaagtcttgaaagcattgaaggacaaaggatataacccaggttctttctttgctaatggtcaaggtggtgaccaaggaccacgtgccttctttgctaacctttatagtagtcatattaccgatgacaaagtaaccaaatacaccacagatgatgctaactctattaaagccatgaccaagatttccaattggattaaagatggtttaatgatgaatggctctcagtacgatggttcagctgatattcaaaactttgcgaatggccaaacttcctttaccattctttgggcgcctgcacaaccaggcatccaagctaaattgttagaagctagtaaagtggattaccttgaaatcccattcccatcagatgatggcaaaccagaactagaatacctcgtaaatggttttgcggtctttaataacaaagatgaacaaaaagtcgctgcctctaagacatttatccaatttatcgctgatgataaagaatggggacctaaaaatgttgttcgtacaggtgctttccctgtaagaacttcttatggggatctttacaaagacaaacgaatggaaaaaattgctgaatggacaaaattctactcaccatactataacacgattgatgggtttgctgaaatgagaactctttggttcccaatggttcaagccgtctctaatggtgatgaaaagccagaagatgctttgaaagccttcactgaaaaagcaaacaagacaatcaaaaaaacacaa

SEQ ID NO: 946 - protein, 439 aa, Streptococcus pyogenes
MNMKKLASLAMLGASVLGLAACGGKSQKEAGASKSDTAKTEITWWAFPVFTQEKAEDGVGTYEKKLIAAFEKANPEIKVKLETIDFTSGPEKITTAIEAGTAPDVLFDAPGRIIQYGKNGKLADLNDLFTEEFTKDVNNDKLIQASKAGDTAYMYPISSAPFYMALNKKMLKDAGVLDLVKEGWTTDDFEKVLKALKDKGYNPGSFFANGQGGDQGPRAFFANLYSSHITDDKVTKYTTDDANSIKAMTKISNWIKDGLMMNGSQYDGSADIQNFANGQTSFTILWAPAQPGIQAKLLEASKVDYLEIPFPSDDGKPELEYLVNGFAVFNNKDEQKVAASKTFIQFIADDKEWGPKNVVRTGAFPVRTSYGDLYKDKRMEKIAEWTKFYSPYYNTIDGFAEMRTLWFPMVQAVSNGDEKPEDALKAFTEKANKTIKKTQ

SEQ ID NO: 947 - DNA, 696 bp, Streptococcus agalactiae
atgccacatctaagtaaagaagcttttaaaaagcaaataaaaaatggcattattgtgtcatgtcaagctttgcccggggagcctctttatactgaaagtggaggtgttatgcctcttttagctttggcagctcaagaagcaggagcggttggtataagagccaatagtgtccgcgacattaaggaaattcaagaggttactaatttacctatcatcggcattattaaacgtgaatatcctccacaagaaccatttatcactgctacgatgacagaggtggatcaattagctagtttagatattgcagtaatagccttagattgtacacttagagagcgtcatgatggtttgagtgtagttgagtttattcaaaagataaaaaggaaatatcctgaacagttgttaatggctgatataagtacttttgaagaaggcaaaaatgcttttgaagcaggagttgattttgtgggtacaactctatctggatacacagattacagccgccaagaagaaggaccggatatagaactccttaataagctctgtcaagccggtatagatgtgattgcggaaggtaaaattcatactcctaagcaggctaatgaaattaatcatataggtgttgcaggaattgtagttggtggtgctatcactagaccaaaagaaatagcggagcgtttcatctcaggacttagt

SEQ ID NO: 948 - protein, 232 aa, Streptococcus agalactiae [sequence omitted]

SEQ ID NO: 949 - DNA, 702 bp, Streptococcus pyogenes
atgcctgataaaccaaccaaagaaaagctcatggagcagttaaagggtgggattatcgtttcttgtcaggctttgccaggtgagcctctctattcagagactgggggtattatgccactgatggcaaaagctgctcaagaagctggtgctgtcggcatcagagctaattcggttagagacattaaagaaattcaagccataacagacctaccaattatcggtatcatcaaaaaagattacccgccgcaagagccttttattacggcaacgatgaccgaagtggatcaattagctgccttaaatattgcagtgattgctatggattgtaccaagcgtgaccgacatgatggcttggatattgctagctttattcgacaagttaaggaaaagtaccccaatcagcttttgatggcagatattagtacctttgatgaaggactagtggcccatcaggctggcattgattttgttggaaccaccttgtcaggctacaccccgtatagccgtcaggaagcaggtcctgatgtggcattgatagaagctctttgcaaagcaggcattgctgtcattgccgaaggaaagattcattccccagaagaagccaagaaaattaatgacttaggtgtggcaggtattgttgttggaggggccatcacaaggcctaaggaaattgcagagcgttttatcgaagcgctcaaatcc

SEQ ID NO: 950 - protein, 234 aa, Streptococcus pyogenes
MPDKPTKEKLMEQLKGGIIVSCQALPGEPLYSETGGIMPLMAKAAQEAGAVGIRANSVRDIKEIQAITDLPIIGIIKKDYPPQEPFITATMTEVDQLAALNIAVIAMDCTKRDRHDGLDIASFIRQVKEKYPNQLLMADISTFDEGLVAHQAGIDFVGTTLSGYTPYSRQEAGPDVALIEALCKAGIAVIAEGKIHSPEEAKKINDLGVAGIVVGGAITRPKEIAERFIEALKS

SEQ ID NO: 951 - DNA, 1302 bp, Streptococcus agalactiae
atgaaaatgaataaaaaggtactattgacatcgacaatggcagcttcgctattatcagtcgcaagtgttcaagcacaagaaacagatacgacgtggacagcacgtactgtttcagaggtaaaggctgatttggtaaagcaagacaataaatcatcatatactgtgaaatatggtgatacactaagcgttatttcagaagcaatgtcaattgatatgaatgtcttagcaaaaataaataacattgcagatatcaatcttatttatcctgagacaacactgacagtaacttacgatcagaagagtcatactgccacttcaatgaaaatagaaacaccagcaacaaatgctgctggtcaaacaacagctactgtggatttgaaaaccaatcaagtttctgttgcagaccaaaaagtttctctcaatacaatttcggaaggtatgacaccagaagcagcaacaacgattgtttcgccaatgaagacatattcttctgcgccagctttgaaatcaaaagaagtattagcacaagagcaagctgttagtcaagcagcagctaatgaacaggtatcaccagctcctgtgaagtcgattacttcagaagttccagcagctaaagaggaagttaaaccaactcagacgtcagtcagtcagtcaacaacagtatcaccagcttctgttgccgctgaaacaccagctccagtagctaaagtagcaccggtaagaactgtagcagcccctagagtggcaagtgttaaagtagtcactcctaaagtagaaactggtgcatcaccagagcatgtatcagctccagcagttcctgtgactacgacttcaccagctacagacagtaagttacaagcgactgaagttaagagcgttccggtagcacaaaaagctccaacagcaacaccggtagcacaaccagcttcaacaacaaatgcagtagctgcacatcctgaaaatgcagggctccaacctcatgttgcagcttataaagaaaaagtagcgtcaacttatggagttaatgaattcagtacataccgtgcgggagatccaggtgatcatggtaaaggtttagcagttgactttattgtaggtactaatcaagcacttggtaataaagttgcacagtactctacacaaaatatggcagcaaataacatttcatatgttatctggcaacaaaagttttactcaaatacaaacagtatttatggacctgctaatacttggaatgcaatgccagatcgtggtggcgttactgccaaccactatgaccacgttcacgtatcatttaacaaa

SEQ ID NO: 952 - protein, 434 aa, Streptococcus agalactiae
MKMNKKVLLTSTMAASLLSVASVQAQETDTTWTARTVSEVKADLVKQDNKSSYTVKYGDTLSVISEAMSIDMNVLAKINNIADINLIYPETTLTVTYDQKSHTATSMKIETPATNAAGQTTATVDLKTNQVSVADQKVSLNTISEGMTPEAATTIVSPMKTYSSAPALKSKEVLAQEQAVSQAAANEQVSPAPVKSITSEVPAAKEEVKPTQTSVSQSTTVSPASVAAETPAPVAKVAPVRTVAAPRVASVKVVTPKVETGASPEHVSAPAVPVTTTSPATDSKLQATEVKSVPVAQKAPTATPVAQPASTTNAVAAHPENAGLQPHVAAYKEKVASTYGVNEFSTYRAGDPGDHGKGLAVDFIVGTNQALGNKVAQYSTQNMAANNISYVIWQQKFYSNTNSIYGPANTWNAMPDRGGVTANHYDHVHVSFNK

SEQ ID NO: 953 - DNA, 1167 bp, Streptococcus pyogenes
atgattattactaaaaagagcttatttgtgacaagtgtcgctttgtcgttagtacctttggcgacagcgcaggcacaagagtggacaccacgatcggttacagaaatcaagtctgaactcgtcctagttgataatgtttttacttatactgtaaaatacggtgacactttaagcacaattgctgaagcaatggggattgatgtgcatgtcttaggagatattaatcatattgctaatattgacctaatttttccagacacgatcctaacagcaaactacaatcaacacggtcaggcaacgaatttgacggttcaagcacctgcttctagtccagctagcgttagtcatgtacctagcagtgagccattaccccaagcatctgccacctctcaaccgactgttcctatggcaccacctgcgacaccatctgatgtcccaacgacaccattcgcatctgcaaagccagatagttctgtgacagcgtcatctgagctcacatcgtcaacgaatgatgtttcgactgagttgtctagcgaatcacaaaagcagccagaagtaccacaagaagcagttccaactcctaaagcagctgaaacgactgaagtcgaacctaagacagacatctcagaagccccaacttcagctaataggcctgtacctaacgagagtgcttcagaagaagtttcttctgcggccccagcacaagccccagcagaaaaagaagaaacctctgcgccagcagcacaaaaagctgtagctgacaccacaagtgttgcaacctcaaatggcctttcttacgctccaaaccatgcctacaatccaatgaatgcagggcttcaaccacaaacagcagccttcaaagaagaagtggcttctgcctttggtattacgtcatttagtggttaccgtccaggtgatccaggagatcatggtaaaggtttggccattgattttatggtgcctgaaaattctgctcttggtgatcaagttgctcaatatgccattgaccatatggcagagcgtggtatttcatacgttatttggaaacagcgattctatgcgccatttgcaagtatttacggaccagcctacacatggaaccccatgccagatcgcggcagtattacagaaaaccattatgatcatgttcatgtctcctttaatgct

SEQ ID NO: 954 - protein, 389 aa, Streptococcus pyogenes
MIITKKSLFVTSVALSLVPLATAQAQEWTPRSVTEIKSELVLVDNVFTYTVKYGDTLSTIAEAMGIDVHVLGDINHIANIDLIFPDTILTANYNQHGQATNLTVQAPASSPASVSHVPSSEPLPQASATSQPTVPMAPPATPSDVPTTPFASAKPDSSVTASSELTSSTNDVSTELSSESQKQPEVPQEAVPTPKAAETTEVEPKTDISEAPTSANRPVPNESASEEVSSAAPAQAPAEKEETSAPAAQKAVADTTSVATSNGLSYAPNHAYNPMNAGLQPQTAAFKEEVASAFGITSFSGYRPGDPGDHGKGLAIDFMVPENSALGDQVAQYAIDHMAERGISYVIWKQRFYAPFASIYGPAYTWNPMPDRGSITENHYDHVHVSFNA

SEQ ID NO: 955 - DNA, 897 bp, Streptococcus agalactiae
ttgaataaatggttagttaaggcaagttccttagttgttttaggtggtatggttttatctgcgggttcccgagttttagcggatacttatgtccgtccaattgataatggtagaattacaacaggtttcaatggttatcctggacattgtggggtggattatgctgttccgactggaacgattattagggcagtggcagatggtactgtgaaatttgcaggagctggagccaacttttcttggatgacagacttagcaggaaattgtgtcatgattcaacatgcggatggaatgcatagtggttacgctcatatgtcacgtgtggtggctaggactggggaaaaagtcaaacaaggagatatcatcggttacgtaggagcaactggtatggcgacgggacctcaccttcattttgaatttttaccagctaaccctaattttcaaaatggtttccatggacgtatcaatccaacgtcactaattgctaatgttgcgacctttagtggaaaaacgcaagcatcagctccaagcattaagccattacaatcagctcctgtacagaatcaatctagtaaattaaaagtgtatcgagtagatgaattacaaaaggttaatggtgtttggttagtcaaaaataacaccctaacgccgactgggtttgattggaacgataatggtataccagcatcagaaattgatgaggttgatgctaatggtaatttgacagctgaccaggttcttcaaaaaggtggttactttatctttaatcctaaaactcttaagactgtagaaaaacccatccaaggaacagctggtttaacttgggctaagacacgctttgctaatggtagttcagtttggcttcgcgttgacaacagtcaagaactgctttacaaa

SEQ ID NO: 956 - protein, 299 aa, Streptococcus agalactiae
MNKWLVKASSLVVLGGMVLSAGSRVLADTYVRPIDNGRITTGFNGYPGHCGVDYAVPTGTIIRAVADGTVKFAGAGANFSWMTDLAGNCVMIQHADGMHSGYAHMSRVVARTGEKVKQGDIIGYVGATGMATGPHLHFEFLPANPNFQNGFHGRINPTSLIANVATFSGKTQASAPSIKPLQSAPVQNQSSKLKVYRVDELQKVNGVWLVKNNTLTPTGFDWNDNGIPASEIDEVDANGNLTADQVLQKGGYFIFNPKTLKTVEKPIQGTAGLTWAKTRFANGSSVWLRVDNSQELLYK

SEQ ID NO: 957 - DNA, 1545 bp, Streptococcus agalactiae
atgactaaacgtgctttaatctcagtttctgacaaatcaggaattattgactttgcaaaagaattgaaaaacttgggttgggatattatctcaactggtgggactaaggttgcccttgatgatgctggtgttgagaccattgccatcgacgatgtgactggattcccagaaatgatggacggtcgtgttaagaccctccacccaaacattcacggtgggcttctggctcgtcgcgacgctgacagccaccttcaggctgctaaggacaacaatattgagttgattgacctcgtggttgtcaacctctatcccttcaaggagaccatccttcgcccagacgtgacctacgatttggcggtggaaaatatcgacatcggcggtccatcaatgcttcgctcagctgctaaaaaccacgctagcgtaaccgttgtggttgattcagctgactatgccactgttttgggagaattggctgacgctagtcagacgacatttaaaactcgtcaacgcttggcagctaaggccttccgtcatacggcagcctacgacgctttgattgctgagtacttcacagctcaagtgggagaggctaagcctgaaaaattgaccatcacttatgaccttaaacaggctatgcgttacggagaaaatccacagcaagacgctgatttctaccaaaaagccttaccaacagactactcaatcgcttcagctaaacagctcaatggaaaagaattgtccttcaataatatccgtgatgctgatgcagcaatccgtattatccgcgatttcaaagacagtccaacggttgttgccctcaaacacatgaacccatgtggtatcggacaggctgatgatattgagacagcttgggattacgcttatgaagctgatccagtttcaatctttggtggaattgttgtccttaaccgtgaagttgacgcagcgacagctgagaagatgcaccctatcttcttggaaatcatcatcgcaccatcatactcagaagaagcgctagctattctcacaaataaaaagaaaaacttgcgtatccttgagttgccgtttgatgcccaagctgccagcgaagtggaagctgagtacactggcgtagttggtggacttttggtgcaaaaccaagacgttgtggctgaaaatccatctgactggcaagtggtgacagaccgccagccaacagaacaagaggcgactgcccttgagtttgcctggaaggctatcaagtatgttaagtctaacgggattattattactaacgatcacatgacgcttggactcggtgcaggtcaaaccaaccgtgtcggctcagtcaagattgctatcgagcaggctaaggaccaccttgacggtgccgttctagcatcagatgccttcttcccatttgcggacaacattgaagaaatcgctgccgcagggatcaaagcaatcatccaaccaggtggttcagttcgtgaccaagaatctattgacgccgcaaacaaacatggcttgaccatgatcttcacaggcgtgagacattttagacat

SEQ ID NO: 958 - protein, 515 aa, Streptococcus agalactiae
MTKRALISVSDKSGIIDFAKELKNLGWDIISTGGTKVALDDAGVETIAIDDVTGFPEMMDGRVKTLHPNIHGGLLARRDADSHLQAAKDNNIELIDLVVVNLYPFKETILRPDVTYDLAVENIDIGGPSMLRSAAKNHASVTVVVDSADYATVLGELADASQTTFKTRQRLAAKAFRHTAAYDALIAEYFTAQVGEAKPEKLTITYDLKQAMRYGENPQQDADFYQKALPTDYSIASAKQLNGKELSFNNIRDADAAIRIIRDFKDSPTVVALKHMNPCGIGQADDIETAWDYAYEADPVSIFGGIVVLNREVDAATAEKMHPIFLEIIIAPSYSEEALAILTNKKKNLRILELPFDAQAASEVEAEYTGVVGGLLVQNQDVVAENPSDWQVVTDRQPTEQEATALEFAWKAIKYVKSNGIIITNDHMTLGLGAGQTNRVGSVKIAIEQAKDHLDGAVLASDAFFPFADNIEEIAAAGIKAIIQPGGSVRDQESIDAANKHGLTMIFTGVRHFRH

SEQ ID NO: 959 - DNA, 1545 bp, Streptococcus pyogenes
atgactaaacgtgctttaatctcagtgtctgacaagtcaggaattgttgactttgcaaaagaattgaaaaacttgggttgggatattatctcaactggtgggactaaggttacccttgacgatgctggtgttgagaccattgccatcgacgatgtgactagattcccagagatgatggacggtcgtgttaagaccctccacccaaacattcacggtgggcttttggctcgtcgcgacgctgacagccaccttcaggctgctaaggacaacaatatcgagctgattgacctcgtggttgtcaacctctatcccttcaaggagactatccttcgtccagacataacctatgatttggcggtggaaaacatcgacatcggcggtccatcaatgcttcgctcagccgctaaaaatcacgctagcgtgaccgttgtggttgacccagcggattatgcgactgttttgggagaattggctgacgctggtcagacgacatttgaaacgcgtcaacgcttggcagctaaggtctttcgtcacacagcagcctacgacgctttgattgctgagtacttcacaactcaagtgggagaggctaagcctgaaaaattaaccatcacttacgaccttaaacaggctatgcgttacggagaaaatccacaacaagacgctgatttctatcaaaaagccttgccaacagactactcaattgcttctgctaaacagctcaacggaaaagaattgtctttcaataatatccgtgatgccgatgcggcaatccgtattatccgcgatttcaaagaccgtccaactgttgttgctctcaaacacatgaacccatgtggtatcggacaggctgatgacattgagactgcttgggattacacttataaagctgacccagtttcaatctttggcggaattattgtccttaaccgtgaagttgacgcagcgacagccaagaagatgcaccctatcttcttggaaatcatcatcgcaccatcatactcagaagaagcgctagctattctcacaaataaaaagaaaaacttgcgaatccttgagttgccgtttgatgcccaagctgccagcgaagtggaagctgagtacactggcgtagttggtggacttttggtgcaaaaccaagacgttgtggctgaaaatccatctgactggcaagtggtgacagaccgccaaccaacagaacaagaggcgactgcccttgagtttgcctggaaggctatcaagtatgttaagtctaacgggattattattactaacgatcacatgacgcttggactcggtgcaggtcaaaccaaccgtgtcggctcagtcaagattgctatcgagcaggctaaagaccaccttgacggtgccgttctagcatcagatgccttcttcccatttgcggacaacattgaagaaatcgctgccgcagggatcaaagcaatcatccaaccaggtggttcagttcgtgaccaagactctattgacgccgcaaacaaacatggcttgaccatgatcttcacaggtgtgagacattttaggcat

SEQ ID NO: 960 - protein, 515 aa, Streptococcus pyogenes
MTKRALISVSDKSGIVDFAKELKNLGWDIISTGGTKVTLDDAGVETIAIDDVTRFPEMMDGRVKTLHPNIHGGLLARRDADSHLQAAKDNNIELIDLVVVNLYPFKETILRPDITYDLAVENIDIGGPSMLRSAAKNHASVTVVVDPADYATVLGELADAGQTTFETRQRLAAKVFRHTAAYDALIAEYFTTQVGEAKPEKLTITYDLKQAMRYGENPQQDADFYQKALPTDYSIASAKQLNGKELSFNNIRDADAAIRIIRDFKDRPTVVALKHMNPCGIGQADDIETAWDYTYKADPVSIFGGIIVLNREVDAATAKKMHPIFLEIIIAPSYSEEALAILTNKKKNLRILELPFDAQAASEVEAEYTGVVGGLLVQNQDVVAENPSDWQVVTDRQPTEQEATALEFAWKAIKYVKSNGIIITNDHMTLGLGAGQTNRVGSVKIAIEQAKDHLDGAVLASDAFFPFADNIEEIAAAGIKAIIQPGGSVRDQDSIDAANKHGLTMIFTGVRHFRH

SEQ ID NO: 961 - DNA, 750 bp, Streptococcus agalactiae
atgaaactagtgaaaaatttagagatagtagagtctatttttggtgattgggacgagaccataatctggtcgtgtgtccaaggtattatgggagaagtttttgtagatagtttagaccaaccaaaatcttctttggcaaaattgggaaggaaatcatcttttggttttctagcaggtcagcctactttatttctactagaagtttgctctggggaggatattatccttgttcctcagcataaaggatggtcagatttgattgaatcaacttatggtcagaatgctcattcttttaagcgttatgcgacgaaaaaagatactttgtttgagcgaagtaggttagagaagtttgttactcagttgccaaatggttttgaattacgtgctattgatgagaaagtttacaactcttgcttagaaaaggaatggtcacaggatttagtagcaaattacgctacttatcagtactataaaaaacaaggtataggttatgttgtatattatcaggggaatatcattgcaggagcttcatcttattcaacctataaaaatgggattgagatagaagtagatacgcatccagattttcgtcggcgtggtttagcaacaatagttgcagctcagttaatactaacttgtttagataagggaatttatcctagctgggatgctcatacaaggacttcattgaatttatctgaaaaactcggttatgaattttctcatgaatacatagcctatgaaatagat

SEQ ID NO: 962 - protein, 250 aa, Streptococcus agalactiae
MKLVKNLEIVESIFGDWDETIIWSCVQGIMGEVFVDSLDQPKSSLAKLGRKSSFGFLAGQPTLFLLEVCSGEDIILVPQHKGWSDLIESTYGQNAHSFKRYATKKDTLFERSRLEKFVTQLPNGFELRAIDEKVYNSCLEKEWSQDLVANYATYQYYKKQGIGYVVYYQGNIIAGASSYSTYKNGIEIEVDTHPDFRRRGLATIVAAQLILTCLDKGIYPSWDAHTRTSLNLSEKLGYEFSHEYIAYEID

SEQ ID NO: 963 - DNA, 546 bp, Streptococcus agalactiae
atgaaaatcgctgtttttgcttctggtaatggttccaactttcaggtcatagcagagcagtttcaagttagttttgtcttttcagatcatcgtgatgcctatgttttagagcgtgctcagaacttagccattccaagcttcgcttttgaactcaaagagtttgagaataaggcggcttacgagcaagccgtcgttgatttgttggacaaacacgagattgacttggtctgtctggcgggctacatgaagattgtcggagaaaccttgctctcagcctatgaagggcgtatcatcaatattcacccaacctatctgcctgaatttccaggtgctcacggtatcaaggatgcttgggaggcaggtgttgaccagtctggtgtgaccatccattgggtggactctggtgtggataccggtcaggtcatccaacaagtgcacgtgccacgcctagcagatgatagtctagaaagctttgaaacccgcatccacgaaaccgaataccaactctacccagctgtcttagatagcttgggcataaagagaaaa

SEQ ID NO: 964 - protein, 182 aa, Streptococcus agalactiae
MKIAVFASGNGSNFQVIAEQFQVSFVFSDHRDAYVLERAQNLAIPSFAFELKEFENKAAYEQAVVDLLDKHEIDLVCLAGYMKIVGETLLSAYEGRIINIHPTYLPEFPGAHGIKDAWEAGVDQSGVTIHWVDSGVDTGQVIQQVHVPRLADDSLESFETRIHETEYQLYPAVLDSLGIKRK

SEQ ID NO: 965 - DNA, 552 bp, Streptococcus pyogenes
atgaaaatcgctgtttttgcttctggtaatggttccaactttcaggtcatagcagagcagtttccagttagttttgtcttttcagatcatcgtgatgcctatgttttagagcgtgctcagaatttagccattccaagcttcgcttttgaactcaaggagtttgagaataaggtggcttacgagcaagccatcgttgatttgttggacaaacacgagattgacttagtctgtctggcaggctatatgaagattgttggagaaaccttactcttggcctatgagaggcgtattatcaatattcacccagcctacctgcctgaatttccaggtgcccacggtatcgaggatgcttgggaagctggtgttgaccagtctggcgtgaccatccactgggttgactctggtgtggataccggtcaggtcatccaacaagtgcgcgtgccacgcctagcagacgatagcctagaaagctttgaaacccgtatccatgaaaccgaatatcaactctacccagctgtcttagatagcttgggagtggagaggaaagtaatc

SEQ ID NO: 966 - protein, 184 aa, Streptococcus pyogenes
MKIAVFASGNGSNFQVIAEQFPVSFVFSDHRDAYVLERAQNLAIPSFAFELKEFENKVAYEQAIVDLLDKHEIDLVCLAGYMKIVGETLLLAYERRIINIHPAYLPEFPGAHGIEDAWEAGVDQSGVTIHWVDSGVDTGQVIQQVRVPRLADDSLESFETRIHETEYQLYPAVLDSLGVERKVI

SEQ ID NO: 967 - DNA, 1020 bp, Streptococcus agalactiae
atgtctgaaaaaaatgcttatgcccagtctggtgttgatgtagaagcgggctacgaagttgtcgaacgtatcaagaaacacgttgctcgcacagaacgtgctggtgtcatgggagctctcggtggctttggtggtatgtttgacctgtcacaaacaggtgttaaagaacctgtcttgatttcagggactgacggtgtcggaactaaactcatgcttgctatcaagtacgacaagcacgacacaatcggtcaagactgtgttgccatgtgtgtcaacgatattattgcagcaggtgctgagcccctttacttccttgactatgtcgcgactggtaaaaacgaacctgccaaattggaacaggttgtcgctggtgttgctgaaggttgtgttcaagctagcgcagctcttatcggtggtgaaacggctgagatgcctggtatgtatggcgaagatgattatgaccttgcaggctttgctgttggtgtggctgaaaaatctcaaatcatcgacggttcaaaggtaaaagaaggggatattcttcttggacttgcttcaagtggtatccattcaaatggttattcattggtacgtcgtgtctttgctgactacactggtgatgaggtgcttccagagcttgaaggcaaacaactcaaggatgtccttcttgagccaactcgtatctatgttaaagcagctctgccattgatcaaggaagaactagttaacggtatcgcccacatcacgggtggtggttttatcgagaatgttcctcgtatgtttgcggatgatttggctgcggaaatcgatgaggataaggtgcctgtacttccgattttcaaggcgcttgaaaaatatggtgacatcaagcacgaagaaatgtttgaaatcttcaacatgggtgtcggtcttatgctggatgttaaccctgaaaatgttgaccgtgtcaaagaacttttggacgaaccagtctatgaaatcggtcgtatcatcaagaaagcagacgatagtgtggtgattaaa

SEQ ID NO: 968 - protein, 340 aa, Streptococcus agalactiae
MSEKNAYAQSGVDVEAGYEVVERIKKHVARTERAGVMGALGGFGGMFDLSQTGVKEPVLISGTDGVGTKLMLAIKYDKHDTIGQDCVAMCVNDIIAAGAEPLYFLDYVATGKNEPAKLEQVVAGVAEGCVQASAALIGGETAEMPGMYGEDDYDLAGFAVGVAEKSQIIDGSKVKEGDILLGLASSGIHSNGYSLVRRVFADYTGDEVLPELEGKQLKDVLLEPTRIYVKAALPLIKEELVNGIAHITGGGFIENVPRMFADDLAAEIDEDKVPVLPIFKALEKYGDIKHEEMFEIFNMGVGLMLDVNPENVDRVKELLDEPVYEIGRIIKKADDSVVIK

SEQ ID NO: 969 - DNA, 1020 bp, Streptococcus pyogenes
atgtctgaaaaaaatgcttatgcaaaatctggtgttgatgttgaagctggttatgaagtggttgaaagaataaaaaaacacgttgctcgtacagaacgtgcgggagtcatgggagctctaggtggctttggtgggatgtttgacttgagtaaaacaggagttaaagagcctgtcttggtttcagggactgacggtgtcggaacaaaacttatgcttgctatcaagtacgacaagcacgacacaatcggtcaagactgtgttgccatgtgtgtcaatgatattattgcagcaggtgctgagccattatattttttagattatattgcgacaggaaaaaataacccagtcaaacttgaagaagttgtttctggtgttgcagaaggttgtgttcaagcaggagcagcactcattggaggtgagaccgctgaaatgcctggaatgtatggtcaagatgattatgaccttgcaggctttgctgttggtgtggctgaaaaatctcaaatcatcgacggttcaaaagtaaaagaaggcgatattcttttgggacttgcttcaagtggtatccattcaaacggttattctttggtacgtcgtgtctttgctgactatactggtaaagagctgcttccagagcttgaaggcaaacaacttaaggatgtcctccttgagccaactcgtatctatgttaaagcagctctgccattaatcaaggaagaactagtcaaaggtatcggccacatcacgggtggtggctttatcgagaatattcctcgtatgtttgcggatgatttggctgcggaaatcgatgaggacaaggtgccagtgcttccgattttcaaggcgcttgaaaaatatggtgacatcaagcacgaagaaatgtttgaaatcttcaatatgggtgtcggtcttatgctagctgttagtcctgaaaatgttaaccgcgtcaaagagctcttggatgaaccagtttatgaaatcggtcgtatcatcaagaaagcagacgctagtgtggtgattaaa

SEQ ID NO: 970 - protein, 340 aa, Streptococcus pyogenes
MSEKNAYAKSGVDVEAGYEVVERIKKHVARTERAGVMGALGGFGGMFDLSKTGVKEPVLVSGTDGVGTKLMLAIKYDKHDTIGQDCVAMCVNDIIAAGAEPLYFLDYIATGKNNPVKLEEVVSGVAEGCVQAGAALIGGETAEMPGMYGQDDYDLAGFAVGVAEKSQIIDGSKVKEGDILLGLASSGIHSNGYSLVRRVFADYTGKELLPELEGKQLKDVLLEPTRIYVKAALPLIKEELVKGIGHITGGGFIENIPRMFADDLAAEIDEDKVPVLPIFKALEKYGDIKHEEMFEIFNMGVGLMLAVSPENVNRVKELLDEPVYEIGRIIKKADASVVIK

SEQ ID NO: 971 - DNA, 1452 bp, Streptococcus agalactiae
atgacatacgaagtaaaatctctaaatgaagaatgtggagtctttggtatctgggggtatcctcaggcagctcaagtcacttactttgggcttcatagccttcaacatcgcggtcaagaaggagctggtattatttcaaatgataatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgatgggcaatttgctttatgtcataatggtaatttgacaaatgctatttcctcaaggaaagaattagaaaagcaaggtgcaattttcaatgcctcctcagatactgaaattttaatgcatttgattcgtcgaagccataacccaagttttatggggaaggtaaaagaagctttaagcactgtaaagggaggtttcgcctatctactgatgacagaagataaattaattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggtgaagttattcttatagacgatagtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggccttgtaaaaaatcagtatacgcagcgaacctttattcaaccgacacaagaattaagggaacaaggtgttcgaatgaaattatcagcggtatctggtgttgtcaaaggaaagcgcgttgttatgattgatgactcaattgtaagaggaacgacttctagaaggattgtaggattattaagagaagcaggagctactgaagtacatgttgctatagctagtccagaattaaagtatccttgtttttatggaattgatattcaaacaagacgagaattaatttcagcaaatcacgctgttgacgaagtgtgtgatattattggcgcagatagtctaacttatctatcaatcgatgggttaattaaatcaattggactcgaaacaaaagcaccaaatggtggtttatgcgtagcttactttgatggacattatccaacaccgctttatgattatgaagaagaatacctcagaagtttagaagaaaaaacaagtttttatattcaaaaagtgaaa

SEQ ID NO: 972 - protein, 484 aa, Streptococcus agalactiae
MTYEVKSLNEECGVFGIWGYPQAAQVTYFGLHSLQHRGQEGAGIISNDNGKLYGYRNVGLLSEVFKNQSELDNLTGNAAIGHVRYATAGSADIRNIQPFLYKFHDGQFALCHNGNLTNAISSRKELEKQGAIFNASSDTEILMHLIRRSHNPSFMGKVKEALSTVKGGFAYLLMTEDKLIAALDPNAFRPLSIGQMQNGAWVISSETCAFEVVGAKWVRDVEPGEVILIDDSGIQCDRYTDETQLAICSMEYVYFARPDSTIHGVNVHTARKNMGKRLAQEFKQDADIVIGVPNSSLSAAMGFAEESGLPNEMGLVKNQYTQRTFIQPTQELREQGVRMKLSAVSGVVKGKRVVMIDDSIVRGTTSRRIVGLLREAGATEVHVAIASPELKYPCFYGIDIQTRRELISANHAVDEVCDIIGADSLTYLSIDGLIKSIGLETKAPNGGLCVAYFDGHYPTPLYDYEEEYLRSLEEKTSFYIQKVK

SEQ ID NO: 973 - DNA, 1509 bp, Streptococcus pyogenes
ttgtgcgaaaaactttctattttcgctttacttgacagcctttgtatcgaggtaaaaatgacatacgaagtaaaatctctaaatgaagaatgtggagtctttggtatctggggacatcctcaggcagctcaagtcacttactttgggcttcatagccttcaacatcgcggtcaagaaggagctggtattgtttcaaatgacaatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgacgggcaatttgctttatgccataatggtaatttgacaaatgctatttccttaaggaaagaattagaaaagcaaggtgcaattttcaatgcctcctcagatactgaaattttgatgcacttgattcgtcgaagccataactcaagtttcatgggaaaggtaaaagaagctctaaatacagtaaagggtggctttgcctatctactgatgacagaaaataaactcattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggcgaagttattcttatagacgatcgtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggtcttgtaaaaaatcagtatacgcagcgaacctttattcaaccgacacaagaattaagggaacaaggtgttcgaatgaaactatcagcggtatccggtgttgtcaaaggaaagcgcgttgttatgattgatgactcaattgtaagaggaacgacttctagaaggattgtcggattattaagagaagcaggagctagtgaagtacatgttgctatagctagtccagaattaaagtatccttgtttttatggtattgatattcagactcgtcgtgagttgatttcagccaatcactctgttgatgaagtgtgtgatattattggcgcagatagtctgacctatctctcactggatgggttgattgaatcaattggactcgaaacaaaagcaccaaatggtggtttatgcgtagcttactttgatgggcattatccaacaccgctttatgattatgaagaagaatacctcagaagtttagaagagaaaacaagtttttatattcaaaaagtgaaa

SEQ ID NO: 974 - protein, 503 aa, Streptococcus pyogenes
LCEKLSIFALLDSLCIEVKMTYEVKSLNEECGVFGIWGHPQAAQVTYFGLHSLQHRGQEGAGIVSNDNGKLYGYRNVGLLSEVFKNQSELDNLTGNAAIGHVRYATAGSADIRNIQPFLYKFHDGQFALCHNGNLTNAISLRKELEKQGAIFNASSDTEILMHLIRRSHNSSFMGKVKEALNTVKGGFAYLLMTENKLIAALDPNAFRPLSIGQMQNGAWVISSETCAFEVVGAKWVRDVEPGEVILIDDRGIQCDRYTDETQLAICSMEYVYFARPDSTIHGVNVHTARKNMGKRLAQEFKQDADIVIGVPNSSLSAAMGFAEESGLPNEMGLVKNQYTQRTFIQPTQELREQGVRMKLSAVSGVVKGKRVVMIDDSIVRGTTSRRIVGLLREAGASEVHVAIASPELKYPCFYGIDIQTRRELISANHSVDEVCDIIGADSLTYLSLDGLIESIGLETKAPNGGLCVAYFDGHYPTPLYDYEEEYLRSLEEKTSFYIQKVK

SEQ ID NO: 975 - DNA, 114 bp, Streptococcus agalactiae
gtgaaggcgaggttagatagaaattcgctatcttttgaacgaagcgagcttaaccgtatctttccgccgtattggtatttgggagtcattgagactaaggttcaatggctagct

SEQ ID NO: 976 - protein, 38 aa, Streptococcus agalactiae
MKARLDRNSLSFERSELNRIFPPYWYLGVIETKVQWLA

SEQ ID NO: 977 - DNA, 111 bp, Streptococcus agalactiae
ttgcggctgtccgctgttgtcacaccgaaagctaccaaggttggtggtactgtcaattcttcgaaagtaccagacatagagtccttaccgccgattgatggcaaaccaaat

SEQ ID NO: 978 - protein, 37 aa, Streptococcus agalactiae
MRLSAVVTPKATKVGGTVNSSKVPDIESLPPIDGKPN

SEQ ID NO: 979 - DNA, 3798 bp, Streptococcus agalactiae
ttgggcttactgaaatctcaatttcagacgtcctcctattttcgagtcgctcccttgtcggacttggtatcttatatgaataaacgtatttttgttgagaaaaaggctgactttggcattaaatcggctagtcttgtgaaagagttgacgcataatctacaactggcttctttgaaggatttgcgtatcgtgcaggtctatgatgtcttcaatttggctgaggatttgctggcgcgtgctgagaagcatattttctctgagcaggtgacagaccgtcttttgacagaagctgaaatcactgcggagcttgataaggttgccttctttgccattgaggcgcttcctggtcaatttgaccaacgtgctgctagttcgcaagaagctttgctattgcttggaagtgacagtcaggtcaaggtcaatacagctcagctttacttggtcaataaggatattgcagaagcagagcttgaagccgttaagaactatcttttgaatcccgttgattcacgtttcaaggatattaccttgccacttgaagtgcaggctttctctgtgtctgataagacaatctctaatcttgatttcttcgaaacttatcaggctgacgattttgcagcctataaggcagagcagggattggctatggaggtcgatgaccttctcttcatccaagattatttcaaatcaatcgggcgtgtgccaactgagactgagttgaaagttttggatacgtattggtcagaccactgccgtcacacaacctttgaaactgaattgaaaaacattgatttttcggcctctaaattccaaaaacaattgcaggcgacttatgacaaatacattgccatgcgtgatgagcttggtcgttctgaaaagccgcagacacttatggatatggcgactatctttggtcgttatgagcgtgccaatggtcgtctggacgatatggaagtctcagatgaaatcaatgcctgctcagttgaaattgaagtagatgttgatggtgtgaaagagccttggctcctcatgtttaagaacgagactcacaaccacccaacagaaattgagccatttggtggagcggcgacttgtatcggtggtgccattcgtgacccattgtcaggacgttcatacgtttatcaggctatgcgtatttcaggcgcaggagatatcacgactccgattgcggaaacacgtgctggtaaattgccacaacaggttatttctaagactgcggcgcacggctattcttcatatggtaaccaaattgggcttgcgacaacttatgtgcgtgagtacttccaccctggcttcgtagctaaacgcatggagcttggagctgtggttggtgctgcacctaaggaaaatgtggttcgtgaaaaaccagaggcaggcgatgtggttgtcttgctcggtggtaaaacaggtcgtgacggtgtcggcggtgcgacaggttcatctaaggttcaaacggttgaatctgtggaaacagctggcgcagaggtacaaaaagggaatgccatcgaagaacgtaagattcaacgccttttccgtgatggtaatgtcactcgcctaatcaagaaatcaaatgacttcggtgcaggtggtgtctgtgttgccatcggtgaattagctgatggtcttgaaatcgatttggacaaggtgccacttaaataccaaggtcttaatggtactgaaattgctatctcagaatctcaagaaaggatgtcagttgttgttggtccaagtgatgtggatgccttcatcgcagcctgtaacaaggaaaatatcgatgcagttgttgttgcgacagttactgaaaaaccaaatcttgtcatgacttggaatggtgaaacaattgttgatttggaacgctgtttccttgataccaacggtgttcgtgtcgtagttgatgccaaagtcgttgacaaggacttaacagttccagaagcgcgcacaacatcagcagagacacttgaagcagatatgcttaaggtcttgtctgacctcaatcacgctagtcaaaaaggtcttcaaactatctttgactcatctgttggtcgttcaaccgttaaccacccaatcggtggtcgttaccaaatcacaccgacagaaagttctgttcaaaaattgccagttcaatatggtgtgacaacaacagcatctgttatggctcaaggttacaatccttatattgcagagtggtcaccttatcacggtgctgcctatgctgttattgaagcgacagctcgcttggtagcaacgggtgctgactggtctcgtgcacgtttctcttaccaagagtatttcgagcgtatggataaacaggcagagcgttttggtcagccagtatcagctcttcttggttctattgaggctcagattcaatttggtttgccatcaatcggcggtaaggactctatgtctggtactttcgaagaattgacagtaccaccaaccttggtagctttcggtgtgacaacagcggacagccgcaaggttctctctcctgagtttaaagcggctggtgagaatatctactacattccaggtcaagctatttcagaagatattgattttgaccttatcaaggctaactttagccagtttgaggctattcaagctcaacataagattaccgctgcctcagccgttaaatacggtggtgtcctagaaagtcttgctctcatgacttttggtaaccgtatcggtgcttctgttgaaattgcagagcttgacagcagcttgacagctcaactcggaggctttgtctttacatcagttgaggaaattgctgacgttgtgaagatcggtcaaactcaggcagactttacagtcactgtcaatggaaatgacctagctggtgcaagccttctatcagccttcgaaggtaaattagaagaagtttacccaacagagtttgaacaggtagatgctattgaggaagttcctgctgtggtatcagatgttgttatcaaggctaaggaaattattgaaaaaccagtagtttacatcccagtctttcctggtactaactcagagtacgattcagctaaggcctttgaacaggttggagctagcgtcaacttggtgccatttgtaaccttgaatgaggctgctattgctgagtcagttgatacgatggttgctaatattgctaaggcaaatatcatcttctttgctggaggtttctcagcagcggatgaaccagatggctctgctaagtttatcgtcaatatcttgcttaacgagaaggttcgcgcagctattgacagcttcatcgaaaaaggtggccttatcatcggtatctgtaatggtttccaagcccttgttaaatcaggtcttcttccatacggaaacttcgaggaagctggtgagacaagtccaaccctcttctataacgatgctaaccagcacgttgcaaagatggttgagactcgtatcgcaaataccaattcaccttggttggcaggagttgaggtcggcgatattcatgtcattccagtttcacacggtgaaggtaaatttgttgtcagcgcttctgaatttgcagagctaagagacaatggtcaaatctggagccaatatgtggactttgacggacaaccatctatggattctaaatacaatccaaacggctctgtcaatgccatcgaagggattaccagcaagaatggtcaaatcatcggtaagatggggcactcagaacgctgggaagacggactcttccaaaatatccctggaaacaaagaccaaaaactctttgaaagtgctgtaaaatactttacagggaag

SEQ ID NO: 980 - protein, 1266 aa, Streptococcus agalactiae
MGLLKSQFQTSSYFRVAPLSDLVSYMNKRIFVEKKADFGIKSASLVKELTHNLQLASLKDLRIVQVYDVFNLAEDLLARAEKHIFSEQVTDRLLTEAEITAELDKVAFFAIEALPGQFDQRAASSQEALLLLGSDSQVKVNTAQLYLVNKDIAEAELEAVKNYLLNPVDSRFKDITLPLEVQAFSVSDKTISNLDFFETYQADDFAAYKAEQGLAMEVDDLLFIQDYFKSIGRVPTETELKVLDTYWSDHCRHTTFETELKNIDFSASKFQKQLQATYDKYIAMRDELGRSEKPQTLMDMATIFGRYERANGRLDDMEVSDEINACSVEIEVDVDGVKEPWLLMFKNETHNHPTEIEPFGGAATCIGGAIRDPLSGRSYVYQAMRISGAGDITTPIAETRAGKLPQQVISKTAAHGYSSYGNQIGLATTYVREYFHPGFVAKRMELGAVVGAAPKENVVREKPEAGDVVVLLGGKTGRDGVGGATGSSKVQTVESVETAGAEVQKGNAIEERKIQRLFRDGNVTRLIKKSNDFGAGGVCVAIGELADGLEIDLDKVPLKYQGLNGTEIAISESQERMSVVVGPSDVDAFIAACNKENIDAVVVATVTEKPNLVMTWNGETIVDLERCFLDTNGVRVVVDAKVVDKDLTVPEARTTSAETLEADMLKVLSDLNHASQKGLQTIFDSSVGRSTVNHPIGGRYQITPTESSVQKLPVQYGVTTTASVMAQGYNPYIAEWSPYHGAAYAVIEATARLVATGADWSRARFSYQEYFERMDKQAERFGQPVSALLGSIEAQIQFGLPSIGGKDSMSGTFEELTVPPTLVAFGVTTADSRKVLSPEFKAAGENIYYIPGQAISEDIDFDLIKANFSQFEAIQAQHKITAASAVKYGGVLESLALMTFGNRIGASVEIAELDSSLTAQLGGFVFTSVEEIADVVKIGQTQADFTVTVNGNDLAGASLLSAFEGKLEEVYPTEFEQVDAIEEVPAVVSDVVIKAKEIIEKPVVYIPVFPGTNSEYDSAKAFEQVGASVNLVPFVTLNEAAIAESVDTMVANIAKANIIFFAGGFSAADEPDGSAKFIVNILLNEKVRAAIDSFIEKGGLIIGICNGFQALVKSGLLPYGNFEEAGETSPTLFYNDANQHVAKMVETRIANTNSPWLAGVEVGDIHVIPVSHGEGKFVVSASEFAELRDNGQIWSQYVDFDGQPSMDSKYNPNGSVNAIEGITSKNGQIIGKMGHSERWEDGLFQNIPGNKDQKLFESAVKYFTGK

SEQ ID NO: 981 - DNA, 3771 bp, Streptococcus pyogenes
atgtcctcctattttccagtcgctcccttgtcggacttggtatcttatatgaataaacgtatttttgttgagaaaaaggctgactttggtattaaatcggctagtcttgtgaaagagttgacgcataatctacaactgacctctttgaaggctttgcgtattgtgcaggtctatgatgtcttcaatttggctgaggatttgctggcgcgtgctgagaagcatattttctctgagcaggtgacagactgtcttttgacggaaactgaaatcactgcggagcttgataaggttgccttctttgccattgaggcgcttcctggtcaatttgaccaacgtgctgctagttcgcaagaagctttgctattatttggaagtgacagtcaggttaaggtcaatacagcccagctatacttggtcaataaggatattacagaagcagagcttgaagccgttaagaactatcttttgaaccctgttgattcgcgtttcaaggacattactttgccgcttgaagagcaggctttctctgtatctgataagacgatccctaatcttgatttctttgaaacttatcaagctgacgattttgcgacttataaggcagagcagggcttggctatggaggtcgatgaccttctcttcatccaaaattatttcaaatcaatcggatgtgtgccaactgagactgagttgaaagttttggatacttactggtcagaccactgccgtcacacaacctttgaaactgaattgaagaacattgatttttcagcttctaaattccaaaaacaattgcagacaacttatgacaaatatatcgccatgcgtgatgagcttggtcgttctgaaaagccacaaacacttatggatatggcgactatttttggtcgttatgagcgtgccaacggtcgtctggacgatatggaagtctcagatgaaatcaatgcctgctcagttgagattgaagtagatgttgatggtgtgaaagagccttggctcctcatgtttaagaacgagactcacaatcacccaacagaaattgagccattcggtggagcggcgacttgtatcggtggtgctattcgtgacccattgtcaggacgttcatacgtttatcaggctatgcgtatttcaggcgcaggcgatatcacgactccgattgcggaaacacgtgctggtaaattgccacaacaagttatttctaaaactgcggcgcacggctattcttcatatggtaaccaaattgggcttgcgacaacttatgtgcgcgagtacttccaccctggcttcgtagccaaacgtatggagcttggagctgtggttggtgctgcacctaaggaaaatgtggttcgtgaaaaaccagaagcaggcgatgtggtcatcttgctcggtggtaaaacaggtcgtgatggtgtcggtggtgcgacaggttcatctaaggttcaaacggttgaatctgtggaaacagctggcgcagaggtacaaaaagggaatgccattgaagaacgtaagattcaacgtcttttccgtgatggcaatgtcactcgtcttattaagaaatcaaatgacttcggtgcaggtggtgtctgtgttgccatcggtgaattggctgacggtcttgaaatcgatttggacaaggtgcctcttaaataccaaggtcttaatggtactgaaattgcaatctcagaatctcaagagcgtatgtcagtcgttgttcgtccaaatgatgtggatgccttcatcgcagcctgcaacaaggaaaatatcgatgcagtcgttgttgcgaccgttactgaaaaaccaaatcttgtcatgacttggaatggcgaaatcatcgttgatttggaacgccgtttccttgataccaatggtgtccgtgtcgttgttgatgctaaagtcgttgacaaggacttgacagttccagaagcacgcacaacatcagcagagacacttgaagcagatacgcttaaggtcttgtctgacctcaaccacgctagtcaaaaaggtcttcaaactatctttgactcatctgttggtcgttcaaccgttaaccacccaatcggtggtcgttaccaaatcacaccgacagaaagttctgttcaaaaattgccagttcaacatggtgtgacaacaactgcatctgttatggctcaaggttacaatccttatattgcagagtggtcaccttatcacggtgctgcctatgctgtcattgaagcgacagctcgcttggtagcaacgggtgctgactggtctcgtgcacgtttctcttaccaagagtactttgagcgtatggataaacaggcagagcgttttggtcagccagtatcagctcttcttggttctattgaggctcagattcaacttggtttgccatcaatcggcggtaaggactctatgtctggtactttcgaagacttgacagtaccaccaaccttggtagctttcggcgtgacaacagcggacagccgcaaggttctctctcctgagtttaaagcggctggcgaaaacatttactatatcccaggtcaagctatttcagaagatattgattttgaccttatcaaggataactttagccagtttgaagctattcaagctcaacataagattacagctgcctcagccgctaaatacggtggtgtcctagaaagtcttgctctcatgacttttggtaaccgtatcggtgcttctgttgaaattgcagagcttgacagcagcttgacagctcaactcggaggttttgtctttacatcagctgaggaaattgctgacgcggtgaaaatcggtcaaactcaggcagactttacagtcactgtcaatggaaatgaccttgctggcgctagccttctagcagccttcgaaggcaaattggaagaggtttacccaacagaatttgagcagacagatgttcttgaagaagttcctgctgtggtatcagatactgttatcaaggctaaggaaacaattgaaaaaccagtggtttacattccagtcttccctggtaccaactcagaatacgattcagctaaggcctttgaacaggttggagctagtgtcaacttggtaccatttgtaaccttgaatgaggttgctattgctgagtcagttgacactatggttgctaatattgctaaggcaaatatcatcttctttgctggaggtttctcagcagcggatgaaccagatgggtctgctaagtttatcgtcaatatcttgcttaacgagaaggtccgcgcagctattgacagcttcatcgaaaaaggtggccttatcatcggtatctgtaatggtttccaagcccttgttaaatcaggtcttcttccatacggaaacttcgaggaagctggtgagacaagtccaactctcttctataatgatgctaatcagcatgttgccaagatggttgagactcgtatcgcaaataccaactcaccttggttggcaggagttgaggtcggcgatattcatgccattccagtttcacatggtgaaggtaaacttgttgtcagcgcttctgaatttgcagagctaagagacaatggtcaaatctggagccaatatgtggactttgacggacaaccatctatggattctaaatacaatccaaacggctctgtcaatgccatcgaagggattaccagcaagaatggtcaaatcatcggtaagatgggacactcagaacgctgggaagacggactcttccaaaatatccctggtaacaaagaccaaatcctctttgcaagtgctgtaaaatactttacagggaag

SEQ ID NO: 982 - protein, 1257 aa, Streptococcus pyogenes
MSSYFPVAPLSDLVSYMNKRIFVEKKADFGIKSASLVKELTHNLQLTSLKALRIVQVYDVFNLAEDLLARAEKHIFSEQVTDCLLTETEITAELDKVAFFAIEALPGQFDQRAASSQEALLLFGSDSQVKVNTAQLYLVNKDITEAELEAVKNYLLNPVDSRFKDITLPLEEQAFSVSDKTIPNLDFFETYQADDFATYKAEQGLAMEVDDLLFIQNYFKSIGCVPTETELKVLDTYWSDHCRHTTFETELKNIDFSASKFQKQLQTTYDKYIAMRDELGRSEKPQTLMDMATIFGRYERANGRLDDMEVSDEINACSVEIEVDVDGVKEPWLLMFKNETHNHPTEIEPFGGAATCIGGAIRDPLSGRSYVYQAMRISGAGDITTPIAETRAGKLPQQVISKTAAHGYSSYGNQIGLATTYVREYFHPGFVAKRMELGAVVGAAPKENVVREKPEAGDVVILLGGKTGRDGVGGATGSSKVQTVESVETAGAEVQKGNAIEERKIQRLFRDGNVTRLIKKSNDFGAGGVCVAIGELADGLEIDLDKVPLKYQGLNGTEIAISESQERMSVVVRPNDVDAFIAACNKENIDAVVVATVTEKPNLVMTWNGEIIVDLERRFLDTNGVRVVVDAKVVDKDLTVPEARTTSAETLEADTLKVLSDLNHASQKGLQTIFDSSVGRSTVNHPIGGRYQITPTESSVQKLPVQHGVTTTASVMAQGYNPYIAEWSPYHGAAYAVIEATARLVATGADWSRARFSYQEYFERMDKQAERFGQPVSALLGSIEAQIQLGLPSIGGKDSMSGTFEDLTVPPTLVAFGVTTADSRKVLSPEFKAAGENIYYIPGQAISEDIDFDLIKDNFSQFEAIQAQHKITAASAAKYGGVLESLALMTFGNRIGASVEIAELDSSLTAQLGGFVFTSAEEIADAVKIGQTQADFTVTVNGNDLAGASLLAAFEGKLEEVYPTEFEQTDVLEEVPAVVSDTVIKAKETIEKPVVYIPVFPGTNSEYDSAKAFEQVGASVNLVPFVTLNEVAIAESVDTMVANIAKANIIFFAGGFSAADEPDGSAKFIVNILLNEKVRAAIDSFIEKGGLIIGICNGFQALVKSGLLPYGNFEEAGETSPTLFYNDANQHVAKMVETRIANTNSPWLAGVEVGDIHAIPVSHGEGKLVVSASEFAELRDNGQIWSQYVDFDGQPSMDSKYNPNGSVNAIEGITSKNGQIIGKMGHSERWEDGLFQNIPGNKDQILFASAVKYFTGK

SEQ ID NO: 983 - DNA, 702 bp, Streptococcus agalactiae
gtgactaaccagcttatttatacaggaaaagcgaaagatatttatagtacaaaagatgaaaatgtgattagaacggtctataaagaccaagctactatgttgaatggagctcgtaaggagactattgatggcaagggagcactaaataatcagatttcatctcttatttttgagaaattaaatatggctggtgtggtgacacattatattgagcaaatttcaaaaaacgaacaattgaataaaaaagttgatattattccacttgaggtggtgctacggaatgtgacagcaggctcattttcaaaacgttttggagtggaagaaggacacgttcttgaaacgccaatcgtggaattttactacaaaaatgataatctgaatgatccttttatcaatgatgagcatgtgaagtttttgggtattgttaatgatgaggagattgcttatctgaaaggagagactcgccatattaatgaactcttgaaagattggtttgctcagattgggcttaacttgattgacttcaagttggagttcggatttgacaaggatggcaaaatcatcttggctgatgagttctcacctgacaactgccgtctctgggatgctgatggtaatcatatggacaaggatgtttttcgtagggatcttggtagcttgaccgatgtctatcaagttgtacttgagaagttgatagcattg

SEQ ID NO: 984 - protein, 234 aa, Streptococcus agalactiae
MTNQLIYTGKAKDIYSTKDENVIRTVYKDQATMLNGARKETIDGKGALNNQISSLIFEKLNMAGVVTHYIEQISKNEQLNKKVDIIPLEVVLRNVTAGSFSKRFGVEEGHVLETPIVEFYYKNDNLNDPFINDEHVKFLGIVNDEEIAYLKGETRHINELLKDWFAQIGLNLIDFKLEFGFDKDGKIILADEFSPDNCRLWDADGNHMDKDVFRRDLGSLTDVYQVVLEKLIAL

SEQ ID NO: 985 - DNA, 732 bp, Streptococcus pyogenes
atgaaaacagaaagaaaggcgaataatcaagtgactaaccagcttatttataaaggaaaagcgaaagatatttatagtacaaaagatgaaaatgtgattagaacggtctataaagaccaagctactatgttgaatggagctcgtaaggagactattgatggcaagggagcactaaataatcagatttcatctcttatttttgagaaattaaataaggctggtgtggtgacacattatattgagcaaatttcaaaaaacgaacaattgaataaaaaagttgatattattccacttgaggtggtgttacggaatgtgacagcaggctcattttcaaaacgttttggagtggaagaaggacatgttcttgaaacgccaattgtggaattttactacaaaaatgatgatctggatgatccttttatcaatgatgagcatgtgaagtttttgggtattgttaatgatgaggagattgcttatctgaaaggagagactcgccgtattaatgaactcttgaaaggttggtttgctcagattgggcttaacttgattgacttcaagttggagttcggatttgatcaagaaggtacaattatcttagcagatgaattttcgcctgataactgtcgcctatgggataagaatggtaaccatatggacaaggatgtttttagaagagaccttggcaacctgacggatgtctatcaagttgtacttgagaagttgatagcattg

SEQ ID NO: 986 - protein, 244 aa, Streptococcus pyogenes
MKTERKANNQVTNQLIYKGKAKDIYSTKDENVIRTVYKDQATMLNGARKETIDGKGALNNQISSLIFEKLNKAGVVTHYIEQISKNEQLNKKVDIIPLEVVLRNVTAGSFSKRFGVEEGHVLETPIVEFYYKNDDLDDPFINDEHVKFLGIVNDEEIAYLKGETRRINELLKGWFAQIGLNLIDFKLEFGFDQEGTIILADEFSPDNCRLWDKNGNHMDKDVFRRDLGNLTDVYQVVLEKLIAL

SEQ ID NO: 987 - DNA, 270 bp, Streptococcus agalactiae
ttgatgcctttacagatgaataggagtgaactcatgtcaagagatgaagtttttgaaaagatgctggaattattaaggcagcaacttggtgacccacagttagatatcacaccagagtcatcgttacatgatgatttagcaattgactctatcgctttaacagagtttattatcaatttggaagatgtgtttcatctagagattccagatgaggctgtcgaacacatgtcaagcgtccaacaactattagattatatcattgaacataag

SEQ ID NO: 988 - protein, 90 aa, Streptococcus agalactiae
MMPLQMNRSELMSRDEVFEKMLELLRQQLGDPQLDITPESSLHDDLAIDSIALTEFIINLEDVFHLEIPDEAVEHMSSVQQLLDYIIEHK

SEQ ID NO: 989 - DNA, 240 bp, Streptococcus pyogenes
atgactagacaggagatttttgaaaggctgattaacttaattcagaagcaaagaagctatttgagtgtagctattacagaacaaacacatttaaaaaatgatttagcggttgactctattgaactagttgaatttattattaatgttgaagatgaatttcatattgctattcctgatgaagatgttgaggatatggtatttatgagagacattttagattatttagttcagcgtttgact

SEQ ID NO: 990 - protein, 80 aa, Streptococcus pyogenes
MTRQEIFERLINLIQKQRSYLSVAITEQTHLKNDLAVDSIELVEFIINVEDEFHIAIPDEDVEDMVFMRDILDYLVQRLT

SEQ ID NO: 991 - DNA, 1005 bp, Streptococcus agalactiae
atgaggagttcattcatgaagaaaattgctatagatgctatgggtggagattacgctcccaaagctattgtagagggtgttaatcaagctatttcagattttagtgatattgaagtacaactctatggcgatcagaaaaaaattgagaaatatttaacagtaacggagcgagttagtattattcatactgaagaaaaaattaattctgatgatgagcctgctaaagctgttcgtcgtaaaaaacagtcttcgatggtcttaggagctaaggcagtcaaagatggtgttgcacaggcctttatttctgcagggaatacaggagctttattagctgctggtttgtttgtagtaggacgtataaaaggtgttgatcgaccaggcttaatgtcaactatgcctacgttagatggtgtgggttttgatatgcttgatttaggagctaatgcagaaaacacagcttctcatcttcatcaatatgctattttagggtcgttttatgcaaaaaatgtccgtggtattgaagttcctcgtgtaggtctcttaaataacggaacggaagaaacaaaaggcgattctcttcataaagaagcttatgaactgttagcagcagagccttctattaattttattggaaatattgaagcacgtgatttgatgtctagtgtagcagatgttgttgtcactgatggttttactggaaatgctgttctaaagacaatggaaggtacagctatgagtattatgggaagcctaaaatcttcaattaaatcaggtggcgtgaaagctaaattaggagcacttctattaaaagatagcctatatcagctaaaagatagtatggactattcaagcgcgggtggagcggttctttttggtttaaaagctccaatagtaaaatgccatggatcaagtgattctaaagctgtttattctactttgaagcaagttcgtacaatgttggaaactcaagtagttgatcaattagttgatgcctttacagatgaa

SEQ ID NO: 992 - protein, 335 aa, Streptococcus agalactiae
MRSSFMKKIAIDAMGGDYAPKAIVEGVNQAISDFSDIEVQLYGDQKKIEKYLTVTERVSIIHTEEKINSDDEPAKAVRRKKQSSMVLGAKAVKDGVAQAFISAGNTGALLAAGLFVVGRIKGVDRPGLMSTMPTLDGVGFDMLDLGANAENTASHLHQYAILGSFYAKNVRGIEVPRVGLLNNGTEETKGDSLHKEAYELLAAEPSINFIGNIEARDLMSSVADVVVTDGFTGNAVLKTMEGTAMSIMGSLKSSIKSGGVKAKLGALLLKDSLYQLKDSMDYSSAGGAVLFGLKAPIVKCHGSSDSKAVYSTLKQVRTMLETQVVDQLVDAFTDE

SEQ ID NO: 993 - DNA, 1083 bp, Streptococcus pyogenes
ttggtttcagaatatgctataataaaaatattattaatagattgtgtaagaacacaagatataattaaaggagtggaaatgaagagaattgcaatagatgctatgggtggagataacgctcctaaagctattgttgagggtgttaatcaagcaatagaagcattttcagatatcgaaattcaactttacggtgatcagacaaagattaactcctatcttattcaatcagatcgtgttgctattattcatacagatgaaaaaattatgtcagatgatgaacctgcaaaagctgttcgccgtaaaaagaaggcttcaatggttttagcagctaaggcagtgaaagaaggaaaagcagatgccattatttcagcagggaatacaggtgctcttttagctgtaggtttgtttgttgtggggcgtatcaagggagttgatcgtccaggattattatcaactattcccacagtaaccggattaggatttgatatgttggatcttggagctaatgctgaaaatacggcaaaacatttacatcaatatgctattttaggctctttctatgctaagaatgtacgtgggattgctaatccacgtgttggtctattaaacaatggtacagaagaaacaaaaggagatccccttcgtaaggccacttatgaacttttaacagcagataatacaatatcttttgttggtaatgtcgaggcgcgagaacttatgtcaggtgttgcagatgttattgtatcagatggtttcacgggaaacgcagtgttgaaatcaatagaaggaacagctattagcattatggggcaactgaaacagataattaatagcggcggtattaagactaaaattggagctagtctacttaaaagtagtctttacgagatgaagaagactcttgactactctagtgctggaggtgcagttttatttggtttaaaggcacctgttgtaaagtctcatggttctagtgatgtaaaagctattttttcaacgataaaacaagtacgtacgatgctagacactaacgtggtcggacaattagtagaagaatttgctaaggagactcaagtaaatgac

SEQ ID NO: 994 - protein, 361 aa, Streptococcus pyogenes
LVSEYAIIKILLIDCVRTQDIIKGVEMKRIAIDAMGGDNAPKAIVEGVNQAIEAFSDIEIQLYGDQTKINSYLIQSDRVAIIHTDEKIMSDDEPAKAVRRKKKASMVLAAKAVKEGKADAIISAGNTGALLAVGLFVVGRIKGVDRPGLLSTIPTVTGLGFDMLDLGANAENTAKHLHQYAILGSFYAKNVRGIANPRVGLLNNGTEETKGDPLRKATYELLTADNTISFVGNVEARELMSGVADVIVSDGFTGNAVLKSIEGTAISIMGQLKQIINSGGIKTKIGASLLKSSLYEMKKTLDYSSAGGAVLFGLKAPVVKSHGSSDVKAIFSTIKQVRTMLDTNVVGQLVEEFAKETQVND

SEQ ID NO: 995 - DNA, 90 bp, Streptococcus agalactiae
atgcaagaaataaaaagaaaaaaggtccaaaagaaaaggaattgctggaagaaatttccacaaaacctgataaccagtggcaaatataaa

SEQ ID NO: 996 - protein, 30 aa, Streptococcus agalactiae
MQEIKRKKVQKKRNCWKKFPQNLITSGKYK

SEQ ID NO: 997 - DNA, 876 bp, Streptococcus agalactiae
atggaattaatttttaggatatttgagatgaaaaaaacattatacattaccaataaactcttttttgctaactggtttgtgccagttattggtgcagttctaattcaagttatcggcatcattgtaagtagacgccttgtagtaaaattgctacctgatgattataaattcaatttatacattgcgcttttactatttgttcctattttggcaagtattttactatttttaatctattttcaaaaaagggattttacttccttgggatttactaaagataataatgttttaacaacgatctcaggatttattactggtagtttactgatgttttttatttatatttgccactggttatcaggttttgtggaaatttcttccagcaattccttttcttttggaccttttttctttttatttcttgcatactttatccaaagcttgacagaggaaattttatttagaggatatgttatgacaacagttaccaaatttaaaggtagttttgcaggtgttttatgtaattctatgttgttttcttttatccactttagaaactatggtatcacagcaatagcactttttaatttatttttacttggtattattttttctattctttttaatatgaccaaaaatattctttttgttacaggagttcatactacatggaattttactatgggatgtgtattaggtaataaggttagtgggggggattctcctgtttctctttttagaattactgaaaattctagctttgctctttggaatggtggggattttggttttgaagggggagtactatgttctttgatattagtaggttgtttagcatacttttctttggaaagcgtgagagtatctgttagatat

SEQ ID NO: 998 - protein, 292 aa, Streptococcus agalactiae
MELIFRIFEMKKTLYITNKLFFANWFVPVIGAVLIQVIGIIVSRRLVVKLLPDDYKFNLYIALLLFVPILASILLFLIYFQKRDFTSLGFTKDNNVLTTISGFITGSLLMFFIYICHWLSGFVEISSSNSFSFGPFFFLFLAYFIQSLTEEILFRGYVMTTVTKFKGSFAGVLCNSMLFSFIHFRNYGITAIALFNLFLLGIIFSILFNMTKNILFVTGVHTTWNFTMGCVLGNKVSGGDSPVSLFRITENSSFALWNGGDFGFEGGVLCSLILVGCLAYFSLESVRVSVRY

SEQ ID NO: 999 - DNA, 759 bp, Streptococcus agalactiae
atgagggttagtcaaacatacggtctcgttttgtataatcgtaattatcgtgaagatgataaattagttaaaatctttacggagactgaggggaaaaggatgttttttgtaaagcatgcttcaaagtcaaaattcaatgctgtgctccaacctttgactattgctcattttattttaaaaattaatgataatggtctttcttatattgatgattataaagaagttttagcatttcaagaaaccaattcagacttgtttaagttgtcatatgcgagttatattacttctttggctgatgtggctattagtgataatgtagcggatgctcaattatttattttcctaaagaaaacgttagaattgattgaggacggtttagattatgagattctaacgaatatttttgaagtacaactactagagaggttcggtgttgctttaaattttcatgattgtgttttttgtcatagggtaggattaccttttgatttttcacacaaatattctggattattatgtccaaaccattattataaagacgagagaagaaaccacctagatcctaatatgctgtacttaatcaatcgttttcagtcaattcaatttgatgatttacaaacaatttctgtgaaacctgagatgaaacttaaaattcgtcaatttttggacatgatttacgatgaatatgtagggattcatcttaaaagtaaaaaatttattgatgatttgtctagttggggaagtattatgaaatcagat

SEQ ID NO: 1000 - protein, 253 aa, Streptococcus agalactiae
MRVSQTYGLVLYNRNYREDDKLVKIFTETEGKRMFFVKHASKSKFNAVLQPLTIAHFILKINDNGLSYIDDYKEVLAFQETNSDLFKLSYASYITSLADVAISDNVADAQLFIFLKKTLELIEDGLDYEILTNIFEVQLLERFGVALNFHDCVFCHRVGLPFDFSHKYSGLLCPNHYYKDERRNHLDPNMLYLINRFQSIQFDDLQTISVKPEMKLKIRQFLDMIYDEYVGIHLKSKKFIDDLSSWGSIMKSD

SEQ ID NO: 1001 - DNA, 753 bp, Streptococcus pyogenes
atgcaactaacagaatcactaggcatcgttctttttaataggaattatcgagaagatgataaattagtcaaaatatttactgaagtagcaggtaagcagatgtttttcgtgaaacatattagtcgttccaaaatgtcctcaatcattcaaccactaacgattgctgattttattttcaagttaaatgatacaggcttgtcttatgttgttgactatagtaacgttaacacttatcggtatattaataatgatatttttcgattagcctatgctagttatgtcttagcattagctgatgctgcgattgcagataatgaatcagattcgcatttgtttacgtttttgaaaaaaacacttgatttgatggaagagggcctagattatgaaattttgacaaatatttttgaaattcagatattagatcgttttggtattagtctaaactttcatgagtgtgccatttgtcatcgcactgatttaccgcttgatttttcccatcgtttttcagctgtactttgttctgaacattattacaaagacaaccgacgtaatcatttagatccaaatgttatctacttgttgagtcgatttcaaaaaatcacatttgatgatttgagaactatttcattgaataaagacatcaaaaagaagcttcgtcagttcattgatgagttgtatcacgactatgtaggaatcaaattaaaaagtaaaacattcattgataatttagttaagtggggagatattatgaaa

SEQ ID NO: 1002 - protein, 251 aa, Streptococcus pyogenes
MQLTESLGIVLFNRNYREDDKLVKIFTEVAGKQMFFVKHISRSKMSSIIQPLTIADFIFKLNDTGLSYVVDYSNVNTYRYINNDIFRLAYASYVLALADAAIADNESDSHLFTFLKKTLDLMEEGLDYEILTNIFEIQILDRFGISLNFHECAICHRTDLPLDFSHRFSAVLCSEHYYKDNRRNHLDPNVIYLLSRFQKITFDDLRTISLNKDIKKKLRQFIDELYHDYVGIKLKSKTFIDNLVKWGDIMK

SEQ ID NO: 1003 - DNA, 1284 bp, Streptococcus agalactiae
atgacaaaaaacctgttattaacaggttttttatcatttaatgacggaaaactggacacaaattatttttcttgtataattaaatatattatttcttatcaggaggttatgatgacattagagaaacgatttaataagtacttagatagaatagaggtctccttaattcgtcagtttgatcaatctatttcagatatacctggaatggtaaaattaactcttggagaaccagattttaccactcctgatcatgttaaagaagcagctaaatcagctattgatgcgaatcaatcgtattacactggtatgagcggtttattagctctaaggcaagctgctgcagattttgcaaaggataaatataatcttacttataatcctgattgtgagatcttggttacgataggtgccacagaagctctgtctgcatctcttatagctattttagaagctggtgatgttgttctattacctgcccccgcttatccaggatatgagccaatagttaaccttgtaggagctgatatcgtagaaattgatactagagaaaatgactttagactaactcctgaaatgttagaaacggctattatccaacaaggtgaaaaattaaaggctgttttacttaattatcctactaaccctacaggtattacctattcaaggcaagaaattgctgcattagctgaagtccttaaaaaatatgatatttttgttattagtgatgaagtttattctgagttaacttacactggtcagcagcatgtttcaattgcagaatatttacctaaccaaactatcttaattaatggcttatcaaaatcacatgctatgactggttggagagttggattggtgtatgctcctgaagcatttattgctcaaatcattaaaagtcatcaatacatggtgacagctgctagtactatttcgcaatttgctggggtagaagccttatctgtgggtaaaaatgatacgttacctatgcgtcaaggatatattaaacgtagagattatatcattgataaaatgtctaaacttggtttcaaaataattaaaccgagtggcgctttttatatctttgctaaaatacctgatagctatccacaggattctttcaagttttgtcaggattttgcttatcaacaagctgtagctattattccaggagtggcttttggtaaatatggtgaaggatatatacgtctttcttatgctgctagtatggaagttattgaaacagcaatggctagattgaaagtttttatggaatcatatgagggt

SEQ ID NO: 1004 - protein, 428 aa, Streptococcus agalactiae
MTKNLLLTGFLSFNDGKLDTNYFSCIIKYIISYQEVMMTLEKRFNKYLDRIEVSLIRQFDQSISDIPGMVKLTLGEPDFTTPDHVKEAAKSAIDANQSYYTGMSGLLALRQAAADFAKDKYNLTYNPDCEILVTIGATEALSASLIAILEAGDVVLLPAPAYPGYEPIVNLVGADIVEIDTRENDFRLTPEMLETAIIQQGEKLKAVLLNYPTNPTGITYSRQEIAALAEVLKKYDIFVISDEVYSELTYTGQQHVSIAEYLPNQTILINGLSKSHAMTGWRVGLVYAPEAFIAQIIKSHQYMVTAASTISQFAGVEALSVGKNDTLPMRQGYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 1005 - DNA, 1191 bp, Streptococcus pyogenes
atgcccaaactatcaaagcgagttttagaaatgaaagagagtgttactctggctgcaggtgctagagctaaggctttgaaagcgcagggccgcgatgtactgaatttaactttaggagaaccagatttttttacacctaagcacattcaagacaaggcgattgaatctattcaaaatggtacggctagcttttatacaaatgcttctgggcttccagaattaaaagctgcgattgccacatacctgaaaaatcagtatgggtatcacttgtctcctgatcagattgtggcaggaacaggtgccaagttcatcctttatgccttttttatggctgttttaaatcctggtgaccaagttctcattccaacaccatattgggtatcttattctgaccaagtaaaaatggcagaaggtcagccgatcttcgttcaaggactagaagaaaatcaattcaaggtaactgttgaccagctggaaagagcaaggacaagtaagactaaagttgtccttatcaattctccttccaatccaacaggcatgatttatggtgctgaggaattaagggccattggagaatgggcggtgcacaacgatattcttattctggcagatgatatttacgggtccttagtctataacggcaatcagtttgttcctatttcaacactctcagaagcgattcggcgtcaaaccattacggtcaatggcgtggctaaaagttatgccatgacaggctggcgggttggttttgcagcaggtgaaccagagatcatttcggcaatgagtaagatcatcgggcagactacctctaacctgacaaccgtttcacaatatgctgctatcgaggctttctgtggtagtcagtcatcacttgaagagatgcgattagcatttgaagagcgccttaatatcacttatccattgttgtgtcaggtccctgggtttgaggttgttaaaccacaaggagctttttacttctttccaaacgttaagaaagccatggaaatgacaggtttttccgatgtgacaagctttgctaatgctattttagaggaagtcggattagctgttgtgagtggagcaggctttggcgcaccggaaaatgttcgtctgagttatgctacagatatcgaaacccttaaagaagctgttcgtagactgcatgtctttatggaaagtaatgaaattaat

SEQ ID NO: 1006 - protein, 397 aa, Streptococcus pyogenes
MPKLSKRVLEMKESVTLAAGARAKALKAQGRDVLNLTLGEPDFFTPKHIQDKAIESIQNGTASFYTNASGLPELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIETLKEAVRRLHVFMESNEIN

SEQ ID NO: 1007 - DNA, 978 bp, Streptococcus agalactiae
ttggaggaaatcatgtcttattctaatttaaaattgtttgcactgtcatcaaacaaagaactagcgaaaaaagtgtctcagacgattggaattccgctaggtcaatcgacagttcgccaattttctgatggtgagattcaagttaatattgaagagtctattcgtggccatcatgtttttattttacaatcaacaagctcaccagttaatgataatttgatggaaattttaattatggttgacgctttaaagcgtgctagtgcggagtctgttagtgtggtaatgccttactatgggtatgctcgtcaagatcgcaaggcacgttctcgtgaacctattacttcgaaactcgttgcgaacatgctagaagttgctggtgttgatcgtcttttaacagttgatttacatgcagctcaaattcagggattctttgatattcccgttgatcaccttatgggggctccccttattgcagattactttgatcgtcagggattggttggtgatgatgttgttgtcgttagtcctgatcatggtggcgtaacacgtgcacgtaagctggcacagtgtttaaagacaccgattgctatcattgataagcgccgtagtgttactaaaatgaatacatctgaagtaatgaatattattggtaatatcaaaggtaaaaaatgtattttaattgatgatatgattgatactgcaggtactatttgccatgctgcagacgctttagctgaagcaggggcaacagcggtttatgcttcatgtactcaccctgttttatcagggccggctttggataatattcaaaattcagctattgaaaaattaattgtgttagatacgatttacctccctgaagaacgtttgattgataagattgaacaaatttcaattgcggaattgattggtgaagctattatccgtattcacgagaaacgtcctttatcaccattatttgaaatgaataaactaaaa

SEQ ID NO: 1008 - protein, 326 aa, Streptococcus agalactiae
MEEIMSYSNLKLFALSSNKELAKKVSQTIGIPLGQSTVRQFSDGEIQVNIEESIRGHHVFILQSTSSPVNDNLMEILIMVDALKRASAESVSVVMPYYGYARQDRKARSREPITSKLVANMLEVAGVDRLLTVDLHAAQIQGFFDIPVDHLMGAPLIADYFDRQGLVGDDVVVVSPDHGGVTRARKLAQCLKTPIAIIDKRRSVTKMNTSEVMNIIGNIKGKKCILIDDMIDTAGTICHAADALAEAGATAVYASCTHPVLSGPALDNIQNSAIEKLIVLDTIYLPEERLIDKIEQISIAELIGEAIIRIHEKRPLSPLFEMNKLK

SEQ ID NO: 1009 - DNA, 972 bp, Streptococcus pyogenes
ttggaggaaaaaatgtcttattctgatttaaaattgtttgctttatcgtcaaacaaggaattagcagaaaaagttgcgtctgcaatgggtattcaacttggaaagtctacggttcgccagttttcagatggtgaaatccaagtaaatattgaagaatcaattcgtggtcatcatgtctttattttgcaatcaactagctcacctgtcaatgataatttaatggaaattttgattatggtcgatgctttaaagcgtgctagtgctgaaaaaatttcagttgtgatgccttactacggctatgcacgccaagaccgtaaagcgcgttctcgtgaacctattacttcaaaattagttgctaatatgttagaagttgctggtgtagatcgcttattaacggttgatttacatgctgctcaaattcaagggttctttgatattccagttgatcacttgatgggtgcacctttaattgcagactattttgatcgtcatggtttagtgggtgaagatgttgtcgttgttagtcctgaccatggtggtgtgactcgtgcgcgtaaattagcacaattcctccaaacaccaattgcaattatcgataagcgtcgtagtgtggataagatgaacaccagtgaagtgatgaatattatcggaaatgtttcggggaagaaatgtatcttgattgacgatatgattgataccgcagggactatttgccatgcagcagatgcgcttgctgaagcgggggcaacagctgtgtatgcgtcatgtacgcatcccgttctttctggaccagcacttgataatattcaacgttcggctatcgaaaaactaattgttcttgatactatttatctgccaaaagaacgccttattgataaaattgaacaaatttcaattgctgatttggttgcagaagcgattattcgtattcatgaaaaacgtccgttgtcacctttatttgagatgggcaat

SEQ ID NO: 1010 - protein, 324 aa, Streptococcus pyogenes
LEEKMSYSDLKLFALSSNKELAEKVASAMGIQLGKSTVRQFSDGEIQVNIEESIRGHHVFILQSTSSPVNDNLMEILIMVDALKRASAEKISVVMPYYGYARQDRKARSREPITSKLVANMLEVAGVDRLLTVDLHAAQIQGFFDIPVDHLMGAPLIADYFDRHGLVGEDVVVVSPDHGGVTRARKLAQFLQTPIAIIDKRRSVDKMNTSEVMNIIGNVSGKKCILIDDMIDTAGTICHAADALAEAGATAVYASCTHPVLSGPALDNIQRSAIEKLIVLDTIYLPKERLIDKIEQISIADLVAEAIIRIHEKRPLSPLFEMGN

SEQ ID NO: 1011 - DNA, 1185 bp, Streptococcus agalactiae
gtgactgctattaaaggacaagttggtgctttagagtctcaacaatcagaattagaagcgcaaaatgctcaacttgaggctgtatctcagcagttaggtcaagagattcaaactctttctaataaaattgttgcacgtaacgaatctttgaaaaagcaagttcgtagtgctcaaaagggtaacttgactaactatattaatactattttaaattcgaaatcagtatctgatgctgttaatcgtgttgttgctattcgtgaggttgtttcagctaatgaaaagatgttagcacaacaagaggctgacaaagcggccttagaagctaaacaaattgaaaatcaaaatgctataaatactgtagcagctaacaagcaagctatcgaaaataataaagcagccttagcaacacaaagagcacaattagaagcagctcaattagagttatctgctcaattgactacagtccaaaatgaaaaagcatctttaattcaggcaaaagcacaagctgaggaagctgcgcgtaaggcagctgaagcacaagcagcagctgaagcgaaagcacaagctgaagcgaaagcacaagctgagtctgtagcaaaagcacaggcagcagcacaagttgagtctgccacagctcctactgaaacagttcaaacacaaccgagaactgaaataaagccttctaatcttacggctacttcttcggcaactactgttgctacaactacagctacagctactaatgagccaaaagttactcaaccttctgtagtaactaaagcagttgaagcacctaaagcagttgtttcttcaacacctagagcggtatcaaaacctgttgtcagaagttatgattcaagtaacacatacccaatgggacaatgtacttggggagctaagtcaatggcttcttgggttggtaactattggggaaatgctaatcagtggggtgctagtgcacgtgcagctggttattctgtaggaactacccctcgtgttggtgcagtagctgtttggccatatgatggtggtggttacgggcacgttgcagtagtaacgtcagtggctaacaattcatctatccaagttatggaatcaaactatgctggaaatatgagtattggcaattaccgtggttcatttaaccctagtgcttctggctctgtttactatatttacccaaat

SEQ ID NO: 1012 - protein, 395 aa, Streptococcus agalactiae
MTAIKGQVGALESQQSELEAQNAQLEAVSQQLGQEIQTLSNKIVARNESLKKQVRSAQKGNLTNYINTILNSKSVSDAVNRVVAIREVVSANEKMLAQQEADKAALEAKQIENQNAINTVAANKQAIENNKAALATQRAQLEAAQLELSAQLTTVQNEKASLIQAKAQAEEAARKAAEAQAAAEAKAQAEAKAQAESVAKAQAAAQVESATAPTETVQTQPRTEIKPSNLTATSSATTVATTTATATNEPKVTQPSVVTKAVEAPKAVVSSTPRAVSKPVVRSYDSSNTYPMGQCTWGAKSMASWVGNYWGNANQWGASARAAGYSVGTTPRVGAVAVWPYDGGGYGHVAVVTSVANNSSIQVMESNYAGNMSIGNYRGSFNPSASGSVYYIYPN

SEQ ID NO: 1013 - DNA, 1194 bp, Streptococcus pyogenes
atgaaaaaaagaattttatcagcagttcttgtaagtggtgttaccctcggagcagctacaactgtaggagcggaggatttaagtactaagattgctaagcaagattctattatctcaaatctgactacagagcaaaaagctgcacagaatcaagtttcagcgttacaggctcaagtaagttcactacaatctgaacaagataaactgaccgcaagaaatacagaacttgaggcgctttcaaagcgatttgagcaagaaattaaggctctaacaagtcaaattgttgctcgtaatgaaaaattaaaaaatcaagctcgtagtgcttataaaaacaatgaaacttctggttatattaatgcacttttgaattctaaatcaatttctgatgttgtaaaccgtttagtagcaattaatagagctgtctctgctaacgctaaattgttagaacaacaaaaagctgataaagtttcccttgaagaaaagcaagctgctaaccaaacagctattaataccattgccgctaatatggcaatggctgaagaaaaccaaaatacattacgtactcaacaagctaatttggtagctgcaactgcaaatttagctctccaattagcatctgctactgaagataaagctaatttggtagctcaaaaagaagctgcagaaaaagctgctgctgaagccttagcacaagaacaggctgctaaagttaaggcacaagaacaggctgcacaacaagcagcatctgttgaagcagcaaaatctgctattactccagcaccacaagctactccggcagcgcaaagtagtaatgctattgaaccagctgcactcacggctccggcagctccttctgcaggaccacaaacatcatatgattcttctaatacttatccagttggacaatgcacatggggagctaaatctttagctccttgggcaggaaataattggggaaatggtggtcaatgggcttatagtgctcaagcagctggttatcgtactggttcaacgccgatggtaggtgcgattgccgtttggaacgatggtggttatggacatgtcgccgttgtagttgaggttcaaagtgcctcaagtattcgtgtgatggagtctaactacagtggtagacagtacattgctgaccaccgtggctggtttaatccaacaggtgttacatttatttatccacac

SEQ ID NO: 1014 - protein, 398 aa, Streptococcus pyogenes
MKKRILSAVLVSGVTLGAATTVGAEDLSTKIAKQDSIISNLTTEQKAAQNQVSALQAQVSSLQSEQDKLTARNTELEALSKRFEQEIKALTSQIVARNEKLKNQARSAYKNNETSGYINALLNSKSISDVVNRLVAINRAVSANAKLLEQQKADKVSLEEKQAANQTAINTIAANMAMAEENQNTLRTQQANLVAATANLALQLASATEDKANLVAQKEAAEKAAAEALAQEQAAKVKAQEQAAQQAASVEAAKSAITPAPQATPAAQSSNAIEPAALTAPAAPSAGPQTSYDSSNTYPVGQCTWGAKSLAPWAGNNWGNGGQWAYSAQAAGYRTGSTPMVGAIAVWNDGGYGHVAVVVEVQSASSIRVMESNYSGRQYIADHRGWFNPTGVTFIYPH

SEQ ID NO: 1015 - DNA, 228 bp, Streptococcus agalactiae
ttgattactgaatcagtagcagcaattttcgagtcaaagtcatcagcgtttactgttacggcagcagttccaagagttactccactcacaaggactgctgataatattctttttttcatttttattaaactactcctttacgataagacattaaatattttaccaaaaaattcacgaaattatattacgtcattgttacatttatatttgaaatcaactatttctaaa

SEQ ID NO: 1016 - protein, 76 aa, Streptococcus agalactiae
MITESVAAIFESKSSAFTVTAAVPRVTPLTRTADNILFFIFIKLLLYDKTLNILPKNSRNYITSLLHLYLKSTISK

SEQ ID NO: 1017 - DNA, 102 bp, Streptococcus agalactiae
atgggcacgagtggactcgaaccaccgacctcacgcttatcaggcgtgcgctctaaccacctgagctacgcgcccaagcaaatgcttggttttacttttatg

SEQ ID NO: 1018 - protein, 34 aa, Streptococcus agalactiae
MGTSGLEPPTSRLSGVRSNHLSYAPKQMLGFTFM

SEQ ID NO: 1019 - DNA, 1212 bp, Streptococcus agalactiae
ttggaggcttttcctaaaatggcaaaagaaaaatacgatcgtagtaaaccacacgttaacattggtacaatcggacacgttgaccacggtaaaactactttaacagcagctatcacaactgtattggcacgtcgcttgcctacttcagttaaccaaccaaaagattacgcttctatcgatgctgctccagaagagcgcgaacgcggaatcacaatcaacactgcacacgttgagtacgaaactgaaaaacgtcactatgcccacatcgacgctccaggacacgcggactacgttaaaaacatgatcactggtgctgctcaaatggacggagctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgacgaaaaatacgaagacatcatcatggaattgatgagcactgttgatgagtacattccagaaccagaacgtgatactgacaaacctttacttcttccagttgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactagatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaaggtactactttctcaatccgtgaaggtggacgtactgttggttcaggtatcgtttcagaaatcgaagct

SEQ ID NO: 1020 - protein, 404 aa, Streptococcus agalactiae
MEAFPKMAKEKYDRSKPHVNIGTIGHVDHGKTTLTAAITTVLARRLPTSVNQPKDYASIDAAPEERERGITINTAHVEYETEKRHYAHIDAPGHADYVKNMITGAAQMDGAILVVASTDGPMPQTREHILLSRQVGVKHLIVFMNKVDLVDDEELLELVEMEIRDLLSEYDFPGDDLPVIQGSALKALEGDEKYEDIIMELMSTVDEYIPEPERDTDKPLLLPVEDVFSITGRGTVASGRIDRGTVRVNDEVEIVGIKEDIQKAVVTGVEMFRKQLDEGLAGDNVGVLLRGVQRDEIERGQVLAKPGSINPHTRFKGEVYILSKEEGGRHTPFFNNYRPQFYFRTTDVTGSIELPAGTEMVMPGDNVTIEVELIHPIAVEQGTTFSIREGGRTVGSGIVSEIEA

SEQ ID NO: 1021 - DNA, 1245 bp, Streptococcus pyogenes
atggcctaccgtctatctataaaatatattttattggaggcttttcctaaaatggcaaaagaaaaatacgatcgtagtaaaccccacgttaacattggtacaatcggacacgttgaccatggtaaaactactttaacagctgcaatcacaactgtattggcacgtcgcttgccttcatcagttaaccaaccaaaagattacgcttctatcgatgctgctccagaagaacgcgaacgcggaatcactatcaacactgcacacgttgagtacgaaactgcaactcgtcactatgcgcacatcgacgctccaggacacgcggactacgttaaaaacatgatcactggtgccgctcaaatggacggagctatccttgtagttgcttcaactgatggaccaatgccacaaactcgtgagcacatccttctttcacgtcaggttggtgttaaacaccttatcgtgttcatgaacaaagttgaccttgttgatgacgaagagttgcttgaattagttgagatggaaattcgtgaccttctttcagaatacgatttcccaggtgatgaccttccagttatccaaggttcagctcttaaagctcttgaaggcgacactaaatttgaagacatcatcatggaattgatggatactgttgattcatacattccagaaccagaacgcgacactgacaaaccattgcttcttccagtcgaagacgtattctcaattacaggtcgtggtacagttgcttcaggacgtatcgaccgtggtactgttcgtgtcaacgacgaaatcgaaatcgttggtatcaaagaagaaactaaaaaagctgttgttactggtgttgaaatgttccgtaaacaacttgacgaaggtcttgcaggagacaacgtaggtatccttcttcgtggtgttcaacgtgacgaaatcgaacgtggtcaagttattgctaaaccaagttcaatcaacccacacactaaattcaaaggtgaagtatatatcctttctaaagacgaaggtggacgtcacactccattcttcaacaactaccgtccacaattctacttccgtacaactgacgtaacaggttcaatcgaacttccagcaggtacagaaatggttatgcctggtgataacgtgacaatcaacgttgagttgatccacccaatcgccgtagaacaaggtactactttctcaatccgtgaaggtggacgtactgttggttcaggtatcgtttcagaaatcgaagct

SEQ ID NO: 1022 - protein, 415 aa, Streptococcus pyogenes
MAYRLSIKYILLEAFPKMAKEKYDRSKPHVNIGTIGHVDHGKTTLTAAITTVLARRLPSSVNQPKDYASIDAAPEERERGITINTAHVEYETATRHYAHIDAPGHADYVKNMITGAAQMDGAILVVASTDGPMPQTREHILLSRQVGVKHLIVFMNKVDLVDDEELLELVEMEIRDLLSEYDFPGDDLPVIQGSALKALEGDTKFEDIIMELMDTVDSYIPEPERDTDKPLLLPVEDVFSITGRGTVASGRIDRGTVRVNDEIEIVGIKEETKKAVVTGVEMFRKQLDEGLAGDNVGILLRGVQRDEIERGQVIAKPSSINPHTKFKGEVYILSKDEGGRHTPFFNNYRPQFYFRTTDVTGSIELPAGTEMVMPGDNVTINVELIHPIAVEQGTTFSIREGGRTVGSGIVSEIEA

SEQ ID NO: 1023 - DNA, 486 bp, Streptococcus agalactiae
ttggatgattatttaaaggcatcaaggttgattattttttcatttttttcttgtggcttatattgctcttctgcttctttcattatgagttcctttttctcgttagcatcaatattaagcacgaatccgatcgctacagaaagtaccaagaggctgttccctccttgggataagaaaggaaatgtcactccagttgaggggattaacccagaaataccaccaatgttaacaaaaacttgcatcaatagcattgctccaataccaagagcgatcattgagttgaaaggatctttagcctttatacctacgtgcataatacgtaaaattaagaagaaaaccaaagctaaaataaaccctgcaccaataactcctaattcctcaataacaattgaaaagacaaagtctgttgttgcttctggtaagtaccctaatttttcaatagaattcccaagtcctcgaccaaaccagccaccgttgctcattgca

SEQ ID NO: 1024 - protein, 162 aa, Streptococcus agalactiae
MDDYLKASRLIIFSFFSCGLYCSSASFIMSSFFSLASILSTNPIATESTKRLFPPWDKKGNVTPVEGINPEIPPMLTKTCINSIAPIPRAIIELKGSLAFIPTCIIRKIKKKTKAKINPAPITPNSSITIEKTKSVVASGKYPNFSIEFPSPRPNQPPLLIA

SEQ ID NO: 1025 - DNA, 492 bp, Streptococcus agalactiae
ttggctaattcktwttatgcaatgagcaacggtggctggtttggtcgaggacttgggaattctattgaaaaattagggtacttaccagaagcaacaacagactttgtcttttcaattgttattgaggaattaggagttattggtgcagggtttattttagctttggttttcttcttaattttacgtattatgcacgtaggtataaaggctaaagatcctttcaactcaatgatcgctcttggtattggagcaatgctattgatgcaagtttttgttaacattggtggtatttctgggttaatcccctcaactggagtgacatttcctttcttatcccaaggagggaacagcctcttggtactttctgtagcgatcggattcgtgcttaatattgatgctaacgagaaaaaggaactcataatgaaagaagcagaagagcaatataagccacaagaaaaaaatgaaaaaataatcaaccttgatgcctttaaa

SEQ ID NO: 1026 - protein, 164 aa, Streptococcus agalactiae
  misc_feature (1)..(164): Xaa = Any Amino Acid
MANSXYAMSNGGWFGRGLGNSIEKLGYLPEATTDFVFSIVIEELGVIGAGFILALVFFLILRIMHVGIKAKDPFNSMIALGIGAMLLMQVFVNIGGISGLIPSTGVTFPFLSQGGNSLLVLSVAIGFVLNIDANEKKELIMKEAEEQYKPQEKNEKIINLDAFK

SEQ ID NO: 1027 - DNA, 1302 bp, Streptococcus pyogenes
atgattatctcaagaagtagagggaaaactatgaagattgataaaaggcacctcttaaattattctatattattgccttatttaattttatcggtgataggcttaataatggtttactcaaccacaagtgtcagcttgattcaagcacatgctaatccatttaaatcggtgattaaccagggagttttttggataataagtctagtggctattacatttatctataaattaaaattaaattttttaacgaatacaagggtattaactgtggttatgttaggagaggcctttcttttaatcattgcccgcttctttacaactgctatcaaaggagcgcatggttggattgtgatcggaccagtcagctttcagcctgctgagtatttaaagatcattatggtatggtatttggcattgacctttgctaagatccaaaaaaacattagcctttatgattatcaagcactaactcgtcgaaaatggtggccaacacaatggaacgatttacgggactggcgtgtttattctttgttgatggtacttttggttgctgctcagcctgacttgggaaatgcttccattattgtattgacagccattattatgttttctatcagtggcattggttaccgatggttttcggctatcctagtcatgattaccggtctatccacggtctttcttgggactattgccgttattggggtagaaagagttgctaagattcctgtttttggctatgtcgctaaacgttttagtgccttttttaatccttttcatgacttgaccgattcaggtcaccaattagccaattcttactatgctatgagtaatggtgggtggtttggccaagggttaggaaattccattgaaaagcgtggctatttgcccgaagcacagacagactttgtcttttcagttgtcattgaagagttaggtctaataggagcagggtttattttggcacttgttttcttcttaattttacgtattatgaatgttggtattaaagcaaaaaatccttttaatgccatgatggctttaggagtaggcggtatgatgctcatgcaagtctttgttaatattggtggtatctcaggcttaattccatctactggtgttaccttcccttttttgtctcaaggtggaaatagcttacttgtcttatctgttgcagtgggttttgtactaaatattgatgctagcgaaaagcgagatgatatatttaaagaagctgaattatcttatcgaaaggacactcgaaaagaaaatagtaaagttgtaaatatcaagcaatttcaa

SEQ ID NO: 1028 - protein, 434 aa, Streptococcus pyogenes
MIISRSRGKTMKIDKRHLLNYSILLPYLILSVIGLIMVYSTTSVSLIQAHANPFKSVINQGVFWIISLVAITFIYKLKLNFLTNTRVLTVVMLGEAFLLIIARFFTTAIKGAHGWIVIGPVSFQPAEYLKIIMVWYLALTFAKIQKNISLYDYQALTRRKWWPTQWNDLRDWRVYSLLMVLLVAAQPDLGNASIIVLTAIIMFSISGIGYRWFSAILVMITGLSTVFLGTIAVIGVERVAKIPVFGYVAKRFSAFFNPFHDLTDSGHQLANSYYAMSNGGWFGQGLGNSIEKRGYLPEAQTDFVFSVVIEELGLIGAGFILALVFFLILRIMNVGIKAKNPFNAMMALGVGGMMLMQVFVNIGGISGLIPSTGVTFPFLSQGGNSLLVLSVAVGFVLNIDASEKRDDIFKEAELSYRKDTRKENSKVVNIKQFQ

SEQ ID NO: 1029 - DNA, 654 bp, Streptococcus agalactiae
  misc_feature (1)..(654): n = a, c, g, or t
atgaaaattgataaaaggcatcttctgaattattccatcctcattccctatttgatattgtctattctaggcttaattgtaatttattcgacaactagtgcaactctaattcagcttggagctaacccttttcgttcagtaatcaaccagggtgtcttttgggcagtcagtttggttgcaattatctttatctataaactgaaactaaattttttgaaaaattctaaagtgttgactatggcagtattggtagaagtatttttactactaatagcgcgcttttttacacaagaagttaatggagcacatggttggattgttattggtcctattagttttcaacctgctgaatatttaaaagttatcattgtatggtatttagcgtttacttttgctcgaaggcaaaaaaagatagaaatatatgattatcaagctttgacaaaagggagatggcttccgagatcactaagcgacctaaaagattggcgattttattctttatttatgattggtttggtaattgcacaacctgatttaggaaatggttcgataattgttctaacggtcattattatgtactgtattagtggtattggttatcgatggttttcagctttacttggtctaatcgtcgtggggtcaactttannnnnt

SEQ ID NO: 1030 - protein, 218 aa, Streptococcus agalactiae
  misc_feature (1)..(218): Xaa = Any Amino Acid
MKIDKRHLLNYSILIPYLILSILGLIVIYSTTSATLIQLGANPFRSVINQGVFWAVSLVAIIFIYKLKLNFLKNSKVLTMAVLVEVFLLLIARFFTQEVNGAHGWIVIGPISFQPAEYLKVIIVWYLAFTFARRQKKIEIYDYQALTKGRWLPRSLSDLKDWRFYSLFMIGLVIAQPDLGNGSIIVLTVIIMYCISGIGYRWFSALLGLIVVGSTLXX

SEQ ID NO: 1031 - DNA, 171 bp, Streptococcus agalactiae
ttggagaaagaggctaagcagatcattgatttaaaaaggaatcttttcaaaattgatgtccgggcacaaaaggatgaagagaaagttttcatgcgtacggcgtgttgctattctcccttttactttacttcgaaagatgatataatgcataatggtaattttttgatatat

SEQ ID NO: 1032 - protein, 57 aa, Streptococcus agalactiae
MEKEAKQIIDLKRNLFKIDVRAQKDEEKVFMRTACCYSPFYFTSKDDIMHNGNFLIY

SEQ ID NO: 1033 - DNA, 204 bp, Streptococcus pyogenes
ttggagaaagaggctaagcagatgattgatttaaaaaggaatcttttcaaaattgatgtccgggcacaaaaggatgaagagaaagttttcatgcgtacggcgtgtagacaatctagggtttacttgctatttcatcttgtttatggtatcatttcacaggctaagggtgcttcatggataacaacgagattttgtattcctaaa

SEQ ID NO: 1034 - protein, 68 aa, Streptococcus pyogenes
LEKEAKQMIDLKRNLFKIDVRAQKDEEKVFMRTACRQSRVYLLFHLVYGIISQAKGASWITTRFCIPK

SEQ ID NO: 1035 - DNA, 1140 bp, Streptococcus agalactiae
gtgactacgatgattgattttattatttctattgatgattgcgcagttgaattggatagtcgtcaatcttggaaaattcgctaccccttatcaaccattctatttcttgtctttgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaatcatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 1036 - protein, 380 aa, Streptococcus agalactiae; identical to SEQ ID NO: 502

SEQ ID NO: 1037 - DNA, 2820 bp, Streptococcus agalactiae
gtgagatttaagagaggaagtgatggtttgtcccacccgaaattagaaagtagtagcaataaagaaatcattaccgaagaggtcggtttactgaagcagcttttggatgaagcaacgcaaaaattgattggtagtgaatcatttgacaagattgaaaaaatagtttcattatcattaactgacgattatactggtctgaaggaaactatttcggctttaagcaacgaggagatggttattgtttctcgttacttctctattttgccgctcttaattaatatttcagaagacgttgatttagcatatgaaattaattataaaaataatcttaaccaagattacctaggaaagttatcaacgactattgatgttgtagctggccatgaaaatgctaaagatattcttgaacacgtcaatgttgtgcctgtgctaacagctcatcctactcaggtgcagcgtaaaacggtgctcgaattaacgtctaagattcatgatttattacgtaaatacagagatgtcaaggcaggaatcgtgaatcaagaaaaatggtatgctgacttgcgtcgttacatcggcattatcatgcaaacagacactattcgcgagaaaaaattgaaagtcaaaaatgagataaccaatgtaatggaatattacaaccgttctcttattaaagcagttaccaaattaacagcagaatataaggcactggcagctaaaaaaggtattcacttggagaatcctaagcctctgactatggggatgtggattggtggtgatagagatggcaatccctttgtaactgctgagacactaagattatcagctatggtacaaagtgaagtgattattaaccattatattgagcagctaaatgaactttatcgtaatatgtcactttcaataaatctaactgaagtctctcccgaacttgttacattggcaaaccagtcacaagataattcggtatatagggaaaatgaaccttaccgtaaagctttcaattttatccaagataaactggtacaaaccctactaaatttaaaagttggttcttccccaaaagagaaatttgttagtcgccaagaatcttctgatattgtaggaaggtatataaaatcacatatcgctcaagtagcttctgacatacagacagaagaactaccagcatacgctactgctgaggagtttaaacaagatttgttacttgtgaagcaatctttagttcaatatggacaagattctcttgttgatggcgaattagcttgtcttattcaagcagtagatatctttggattttatttagctactattgatatgcgtcaagattctagtattaatgaagcttgtgtagcagaattattgaagtctgccaatattgtagatgattacagttctctttcagaagaagaaaaatgtcaacttctcttaaaagaattaacagaagatcctagaacattatcttctacgcatgctcctaaatccgagttacttcaaaaagaattggctattttccaaacagcacgtgagttaaaagatcaattgggtgaagacattataaaccagcatatcatttctcacacagagagcgtttcggatatgtttgagttagctatcatgttaaaagaagttggactaattgatgccaatcaagctcgtattcagattgtaccgttatttgaaaccatcgaagatttggataattcacgtgatattatgacccagtatctacattatgaattagttaaaaaatggattgctactaacaacaattatcaagaaataatgctaggttattcagatagtaataaagatggtggctatttatcatctggttggactctatataaagctcaaaatgagctaacaaaaataggtgaagaaaacggtattaaaatcacatttttccacggtcgtggtggaactgttggtcgtggtggtggtccatcttatgaagctatcacatcacaaccttttggttcaatcaaagatcgaattcgcctaacagagcaaggtgaaatcattgagaataaatatggtaatcaagatgcagcctattataaccttgaaatgcttatttcagcttccatagaccgcatggtaacacgtatgattactaaccctaatgaaattgataatttccgtgagacaatggatggtattgtgtctgaaagtaatgccgtttatagaaatttagtttttgataatccttatttctatgactatttctttgaagcaagtccaattaaagaggtatcaagtttaaatattggttctcggccagcagcacgtaaaacaattacagaaatttcaggtttacgtgcaattccatgggtattttcatggtcacaaaatcgtattatgtttccaggatggtatggtgttggatcagccttcaagcactttattgaacaagatgaggcaaacttagcaaaattacaaaccatgtatcaaaaatggccattctttaattctcttttatctaatgtagatatggttttatcaaaatcaaatatgaatattgcgcttcagtatgctcagttagctggaagtaaagaagttcgagatgtttttaatatcatccttaatgaatggcagttaactaaagatatgattttagctattgaacagcatgataatttattagaagaaaacccaatgttacatgcaagtttagattatcgtttgccatatttcaatgttttgaattatgttcaaattgaattgattaaacgtcttcgtagtaaccaactagatgaagactatgagaagttgattcatattactattaatggtattgcaacaggtttacgaaattcaggt

SEQ ID NO: 1038 - protein, 940 aa, Streptococcus agalactiae
MRFKRGSDGLSHPKLESSSNKEIITEEVGLLKQLLDEATQKLIGSESFDKIEKIVSLSLTDDYTGLKETISALSNEEMVIVSRYFSILPLLINISEDVDLAYEINYKNNLNQDYLGKLSTTIDVVAGHENAKDILEHVNVVPVLTAHPTQVQRKTVLELTSKIHDLLRKYRDVKAGIVNQEKWYADLRRYIGIIMQTDTIREKKLKVKNEITNVMEYYNRSLIKAVTKLTAEYKALAAKKGIHLENPKPLTMGMWIGGDRDGNPFVTAETLRLSAMVQSEVIINHYIEQLNELYRNMSLSINLTEVSPELVTLANQSQDNSVYRENEPYRKAFNFIQDKLVQTLLNLKVGSSPKEKFVSRQESSDIVGRYIKSHIAQVASDIQTEELPAYATAEEFKQDLLLVKQSLVQYGQDSLVDGELACLIQAVDIFGFYLATIDMRQDSSINEACVAELLKSANIVDDYSSLSEEEKCQLLLKELTEDPRTLSSTHAPKSELLQKELAIFQTARELKDQLGEDIINQHIISHTESVSDMFELAIMLKEVGLIDANQARIQIVPLFETIEDLDNSRDIMTQYLHYELVKKWIATNNNYQEIMLGYSDSNKDGGYLSSGWTLYKAQNELTKIGEENGIKITFFHGRGGTVGRGGGPSYEAITSQPFGSIKDRIRLTEQGEIIENKYGNQDAAYYNLEMLISASIDRMVTRMITNPNEIDNFRETMDGIVSESNAVYRNLVFDNPYFYDYFFEASPIKEVSSLNIGSRPAARKTITEISGLRAIPWVFSWSQNRIMFPGWYGVGSAFKHFIEQDEANLAKLQTMYQKWPFFNSLLSNVDMVLSKSNMNIALQYAQLAGSKEVRDVFNIILNEWQLTKDMILAIEQHDNLLEENPMLHASLDYRLPYFNVLNYVQIELIKRLRSNQLDEDYEKLIHITINGIATGLRNSG

SEQ ID NO: 1039 - DNA, 2760 bp, Streptococcus pyogenes
ttgccacttaaaaagttagagagtagtaacaatcaagatatcattgctgaagaagttgctcttttgaaagaaatgttggaaaatatcacacgacggatgattggagatgatgcgtttacagttatcgagtctattatggtgttatctgaaaaacaagattacatagaattagaaaaagttgtcgccaatatttcaaatcaagaaatggaagtgatttccaggtatttttctattttacccttgctaatcaatatttcagaagatgtcgatttagcctatgaaatcaattatcaaaataatacggatactgattatttaggaaaattagccctaaccatcaaggatcttgctggaaaagataatggtaaagacattttggagcaggttaatgtggttcctgttttaacagcacatccgacgcaagtacaacgtaaaacgattctggaattgacaactcacattcataaacttctgcgcaaataccgtgatgctaaggctggtgtgattaatcttgagaaatggcgtcaggagctatatcgttatattgaaatgatcatgcagacagatattattcgcgagaaaaagcttcaggtgaaaaacgagataaaaaatgtcatgcagtattacgatggttctctcattcaagcagtgaccaagttgacaacagagtacaaaaacttagcccaaaaacacggtctagagttagacaatcccaaacccattaccatggggatgtggattggtggggaccgtgatgggaacccctttgtcacagctgaaaccttgtgcttgtcagctacggttcaaagtgaggttatcctcaattactacattgacgaattagcagccctttaccgaacattttcactgtcgtcaaccttggtacaacccaactcggaagtggaacgtttagccagtttgtctcaggaccaatcgatttaccgtggaaatgaaccttatcgcagagcttttcattatattcaatcgcgtcttaaacaaacacaaattcaactaactaatcagccagcagctagtatgagtagtagtgtgggactaaacacatctgcttggtcctcaccagctagtttagaaaatcccatcttagcctatgactctcctgttgattttaaagctgatttaaaggctattgagcagtcgctacttgataatggcaactccgctttgattgagggggatttgcgagaagtcatgcaagctgttgatatttttggcttcttcttagcaagcattgacatgaggcaagactccagtgtccaagaagcttgtgtggcagagttattaaaaggagccaatattgttgacgattatagctctctttcagaaactgaaaaatgcgatgttctcttacaacaattaatggaggagccaaggactttatcctcagcggcagttgctaaatcagacctattggaaaaagaactggctatctatactacggcacgagaattgaaagataagcttggagaagaggttattaaacaacatattatttcacatacagaaagtgtctctgatatgtttgagttggccatcatgcttaaagaagtgggattggttgaccagcagcgggctcgtgtgcaaattgttcccctctttgaaaccattgaggatttagataatgcccgtgacatcatggcagcctatttaagccatgacattgtcaaatcttggattgcaacgaatcgtaattaccaagaaatcatgttaggttattctgacagtaataaagatggtggctacttggcatcgggttggactctttataaagctcagaatgaattaacggctattggtgaggaacatggagtgaagatcaccttcttccatggtcgtggaggaacagttggtcgaggaggtggcccttcttatgatgccattacttcacaaccttttggttccatcaaagatcggattcgtctgacagagcaaggggaaattattgaaaacaaatacggcaataaagatgtggcttattaccatttagaaatgttgatttcagcttctatcaatcgtatggtgactcaaatgataacagatcctaatgagattgatagttttcgagaaatcatggatagcattgttgctgatagcaatatcatttatcgaaaattggtttttgacaatccccatttctatgattatttctttgaggcaagtccgattaaggaagtttccagtctcaacattgggtcaagaccagcggcccgtaaaacgattacggaaattacaggcttgcgtgccattccttgggtcttttcatggtcacaaaatcgcatcatgtttccaggttggtatggggtaggttcagcctttaaacgttatattgaccgagcacaaggtaaccttgaacgcctccaacatatgtatcagacgtggccttttttccattccttgttatcaaatgttgatatggtattatctaaatcaaacatgaatattgcctttcagtatgcacaactagctgaaaggcaggatgttcgagatgttttttatgagattttggatgagtggcaattgacaaaaaatgttattcttgctatccaagaccatgatgatctattggaggataatccttcccttaagcatagcttgaaatcacgcttgccgtattttaatgtgttgaactatattcaaattgaattgattaaacgttggcgtaataatcaacttgacgaaaatgatgaaaaattgatccatacaactatcaatggcatagcgactggtttacgtaattcaggc

SEQ ID NO: 1040 - protein, 920 aa, Streptococcus pyogenes
LPLKKLESSNNQDIIAEEVALLKEMLENITRRMIGDDAFTVIESIMVLSEKQDYIELEKVVANISNQEMEVISRYFSILPLLINISEDVDLAYEINYQNNTDTDYLGKLALTIKDLAGKDNGKDILEQVNVVPVLTAHPTQVQRKTILELTTHIHKLLRKYRDAKAGVINLEKWRQELYRYIEMIMQTDIIREKKLQVKNEIKNVMQYYDGSLIQAVTKLTTEYKNLAQKHGLELDNPKPITMGMWIGGDRDGNPFVTAETLCLSATVQSEVILNYYIDELAALYRTFSLSSTLVQPNSEVERLASLSQDQSIYRGNEPYRRAFHYIQSRLKQTQIQLTNQPAASMSSSVGLNTSAWSSPASLENPILAYDSPVDFKADLKAIEQSLLDNGNSALIEGDLREVMQAVDIFGFFLASIDMRQDSSVQEACVAELLKGANIVDDYSSLSETEKCDVLLQQLMEEPRTLSSAAVAKSDLLEKELAIYTTARELKDKLGEEVIKQHIISHTESVSDMFELAIMLKEVGLVDQQRARVQIVPLFETIEDLDNARDIMAAYLSHDIVKSWIATNRNYQEIMLGYSDSNKDGGYLASGWTLYKAQNELTAIGEEHGVKITFFHGRGGTVGRGGGPSYDAITSQPFGSIKDRIRLTEQGEIIENKYGNKDVAYYHLEMLISASINRMVTQMITDPNEIDSFREIMDSIVADSNIIYRKLVFDNPHFYDYFFEASPIKEVSSLNIGSRPAARKTITEITGLRAIPWVFSWSQNRIMFPGWYGVGSAFKRYIDRAQGNLERLQHMYQTWPFFHSLLSNVDMVLSKSNMNIAFQYAQLAERQDVRDVFYEILDEWQLTKNVILAIQDHDDLLEDNPSLKHSLKSRLPYFNVLNYIQIELIKRWRNNQLDENDEKLIHTTINGIATGLRNSG

SEQ ID NO: 1041 - DNA, 1797 bp, Streptococcus agalactiae
atgaaacttaaaaaacgctctgaattccctgaaaatgaactttgggatctgactgctctctacaaagatcgtcaagattttttactggctattgaaaaagctcttgaggatatcaaggttttcaaaaaaaattacgagggaaaacttaattgtgttgaggattttactagtgcccttatggaaatcgagcatatttatatccagatgagtcacattgatacgtatgcttttatgcctcaaactactgactttagcaacgaagagtttgcacaaatttctcaagcaggatcagacttcgcaactaaagctaatgtactactttctttctttaatactgccctagcaaatgcagatataaagattttagattctttagaaaataaccctcatttcaaagcaactattcgccaagctaaaattcaaaagcaacacttattaagtccagaagtcgaaaaagctttgacaaacttaaatgaagtcctaaatacaccatatgatatttatactaaaatgcgtgctggcgattttgatatggaagattttgaagttgacggaaaaacctacaaaaatagttttgtaacttatgaaaattactttcaaaatcacgaaaatgcagagatacgtgaaaaatccttccgttcattctcgaaaggtctacgtaagcaccaaaatgctgcagctgcggcttatcttgcaaaagtcaaatctgaaaagttaattgctgatatgcgtggttacgatagtgtttttgattatcttctttccgaacaagaagttgaccgttcaatgtttgacagacaaattgatcttatcatggatgaatttggtccagtagctcaacgattcctcaaacatatcgccgatgttaatggtattgaaaagatgacttttgcagattggaaattagacattgataacgaacttaatcccgaagtaagtatcaatgatgcttatgacttagtaatgaaatcagttgctcctttaggaaaagaatattctcaagaggttgagcgctatcaaaaagagcgttgggttgattttgcagctaacgctaataaagattctggaggatatgctgcggatccttacaaagttcatccctatgtactcatgagctggacggggcgtatgagcgatgtctacacacttattcatgagattggacattctggtcaatttatcttctcagataatcaccaaagttttttcaatactcacatgtccacttactatgttgaagctccatctacttttaacgaacttttacttagtgactacttagaaaaccaatttgatacagcacgtcaaaaacgctttgctcttgcacatcgcttaactgatacttacttccacaatttcattactcacttacttgaagctgctttccaacgtaaagtttacactctaattgaggagggaggaacttttggagcagaacaattaaatgctattatgaaggaagtattaacacaattctggggagatgctattgaaatagatgacgatgccgctttgacatggatgagacaagctcattactacatggggctctatagctatacttactctgctggattagtaatctcgacagccggctatctcaatctcaaaaataatccaaacggagcaaaagagtggttagcattcttgaaatctggtgggagccgtacccctttagaaacagctctattaatcagtgctgatatttctactgataagcctctgcgcgatactattaatttcttatctaacactgtagaccaaattattaattacagtaatcttattgagcaaggc

SEQ ID NO: 1042 - protein, 599 aa, Streptococcus agalactiae
MKLKKRSEFPENELWDLTALYKDRQDFLLAIEKALEDIKVFKKNYEGKLNCVEDFTSALMEIEHIYIQMSHIDTYAFMPQTTDFSNEEFAQISQAGSDFATKANVLLSFFNTALANADIKILDSLENNPHFKATIRQAKIQKQHLLSPEVEKALTNLNEVLNTPYDIYTKMRAGDFDMEDFEVDGKTYKNSFVTYENYFQNHENAEIREKSFRSFSKGLRKHQNAAAAAYLAKVKSEKLIADMRGYDSVFDYLLSEQEVDRSMFDRQIDLIMDEFGPVAQRFLKHIADVNGIEKMTFADWKLDIDNELNPEVSINDAYDLVMKSVAPLGKEYSQEVERYQKERWVDFAANANKDSGGYAADPYKVHPYVLMSWTGRMSDVYTLIHEIGHSGQFIFSDNHQSFFNTHMSTYYVEAPSTFNELLLSDYLENQFDTARQKRFALAHRLTDTYFHNFITHLLEAAFQRKVYTLIEEGGTFGAEQLNAIMKEVLTQFWGDAIEIDDDAALTWMRQAHYYMGLYSYTYSAGLVISTAGYLNLKNNPNGAKEWLAFLKSGGSRTPLETALLISADISTDKPLRDTINFLSNTVDQIINYSNLIEQG

SEQ ID NO: 1043 - DNA, 1872 bp, Streptococcus pyogenes
ttggataggtttagtctccatattccactaaaattctgttatactagtcttgactatattgttaaggagacaactatggaattgaaaaaacgttcagaattccctgaaaatgaactttgggatctaacagcgctctacaaagaccgccaagattttttactcgctattgaaaaagccttacaagatattgacctgtttaagcgcaattatgaaggccgcttaacgtcggtggacgatttcactcaggccttaatagaaattgagcatatttatattcaaatgagtcatattggcacttatgcctttatgcctcaaaccactgacttttcagatgaaagttttgctcaaattgctcaggctggcgatgatttcatgactaaagctagcgttgcccttagcttctttgacaccgccttagccaatgccgaccttgacgtgttagatacattagaaaagaacccttatttcagcgcagctattcgcatggcaaaaattcaaaaagaacacctcttaagtcctgatgtggaaaaagctttggctaacttacgcgaggttatcaatgcgccctatgatatttacaccaaaatgcgggctggtgactttgacatggatgattttgaggtggatggtaaaacctataaaaatagctttgtttcttacgaaaatttctatcaaaatcacgaaaatgctgagattcgtgaaaaagccttccgctctttttcaaaaggtctccgtaaacaccaaaatacagctgcagcggcttacttagccaaggttaaatctgaaaaattgttagcggatatgaaaggctacgcttctgtctttgattacctcctagctgaacaggaagtggatcgtagcttgttcgaccgccaaattgacctcatcatgactgaatttggaccggttgctcagaaattcttaaaacatgtcgcccaagtcaatggtcttgagaaaatgacttttgctgactggaagctagatattgacaatgatctcaatccagaggtcagcattgatggtgcctatgacctcgtgatgaaatctctagccccattagggcaagaatacacgaaagaaatcgaacgttatcagacagaacgctgggttgactttgctgctaacgccaataaggattctggtggttatgccgctgatccctacaaggttcatccgtatgtcttaatgagttggactggaagaatgtctgatgtttatacccttattcatgaaatcggtcactctggccaattcattttttcagataatcaccaaagttacttcaacacccatatgtcaacttattacgtcgaagcgccatcgacctttaatgaattgatgcttagtgattacttggaacatcagtttgatgaccctcgtcaaaaacgttttgcccttgctcaccgtttaacagatacttactttcataacttcatcactcacctattggaagcggctttccaacgtaaggtttacacccttattgaagaaggcggtacctttggagctgaccaattaaatgcgatgatgaaagaggtcttaacagacttctggggagatgccgttgacattgacgatgacgcagctcttacctggatgcgccaagcacattactacatgggcttatatagttatacctattctgctgggcttgttatttcaacagctggttacctcaaccttaaacataatccaaatggtgccaaggagtggcttgacttcctaaaatcaggtggcagccgtacgcctcttgatactgcaatgctcattggggcagacattgccactgaaaagcctcttcgagataccattcaattcttgagtgataccgttgaccaaattatcagttacaccgaggatatgtcacatgcc

SEQ ID NO: 1044 - protein, 624 aa, Streptococcus pyogenes
LDRFSLHIPLKFCYTSLDYIVKETTMELKKRSEFPENELWDLTALYKDRQDFLLAIEKALQDIDLFKRNYEGRLTSVDDFTQALIEIEHIYIQMSHIGTYAFMPQTTDFSDESFAQIAQAGDDFMTKASVALSFFDTALANADLDVLDTLEKNPYFSAAIRMAKIQKEHLLSPDVEKALANLREVINAPYDIYTKMRAGDFDMDDFEVDGKTYKNSFVSYENFYQNHENAEIREKAFRSFSKGLRKHQNTAAAAYLAKVKSEKLLADMKGYASVFDYLLAEQEVDRSLFDRQIDLIMTEFGPVAQKFLKHVAQVNGLEKMTFADWKLDIDNDLNPEVSIDGAYDLVMKSLAPLGQEYTKEIERYQTERWVDFAANANKDSGGYAADPYKVHPYVLMSWTGRMSDVYTLIHEIGHSGQFIFSDNHQSYFNTHMSTYYVEAPSTFNELMLSDYLEHQFDDPRQKRFALAHRLTDTYFHNFITHLLEAAFQRKVYTLIEEGGTFGADQLNAMMKEVLTDFWGDAVDIDDDAALTWMRQAHYYMGLYSYTYSAGLVISTAGYLNLKHNPNGAKEWLDFLKSGGSRTPLDTAMLIGADIATEKPLRDTIQFLSDTVDQIISYTEDMSHA

SEQ ID NO: 1045 - DNA, 387 bp, Streptococcus agalactiae
atgaaaaaatacattaaattattcttgctaacagtattcgctacaactttagtagcttgcgggcaaccatctacatcgaataagacaacaactagctcaacgttagaagttggtaaggttgaattggtggttaaagaagatacgaacgtgttaagtgaaaaggttgtttaccataaaggtgatactgttttggatgtgcttaaagctaactataaagttaaagaaaaagatggtttcattacttcaattgatggcatcagccaagatgaaaccaaagggctttattggatgttcaaggtcaataataaattagctcctaaggcagcaaaccaaattaaagttaaaaagaatgacaaaattgaattttatcaggaagtttacaaaaaa

SEQ ID NO: 1046 - protein, 129 aa, Streptococcus agalactiae
MKKYIKLFLLTVFATTLVACGQPSTSNKTTTSSTLEVGKVELVVKEDTNVLSEKVVYHKGDTVLDVLKANYKVKEKDGFITSIDGISQDETKGLYWMFKVNNKLAPKAANQIKVKKNDKIEFYQEVYKK

SEQ ID NO: 1047 - DNA, 384 bp, Streptococcus pyogenes
gtgaacaaaagatttaaaacaggatttctagcgcttgttgctatgctacttgttgcttgctcgcaaggaacaaaacaaatacagacgactccaagcgttccaaaagcagaccatcacgttcgcttagttgtcaaagaagataccaatactgttgacgaaaaagtttcttttggaaaaggagatacggtgcttgaggttctcaaagataattatgaggttaaagaaaaagatggttttatcacagcaattgatggtatcgagcaagacacgaaagctaacaaatactggctttttaaggtgaatggaaagatggcagataagggtgccgatcaaattaccgttaaagatggtgatagcattgaattttatcaagaagtttttaat

SEQ ID NO: 1048 - protein, 128 aa, Streptococcus pyogenes
VNKRFKTGFLALVAMLLVACSQGTKQIQTTPSVPKADHHVRLVVKEDTNTVDEKVSFGKGDTVLEVLKDNYEVKEKDGFITAIDGIEQDTKANKYWLFKVNGKMADKGADQITVKDGDSIEFYQEVFN

SEQ ID NO: 1049 - DNA, 522 bp, Streptococcus agalactiae
atgataaagaattcaactttaactaaattgactagagtcgctatattatctgctttgtgtgttgtgttgagatatgcttttgcgcctctgcctaacattcagccaattactgccatttttttgattacagttgtcttattcgatttaaaagaaggtgtagctactgtaactataacaatgctagtttcttcttttttaatgggctttgggccatgggtctttttgcaaatcatttccttcactttaattttatgcttgtggaaatttctgatatatccgctgacaaaagctgtatgttttggtaaaataacggaggtagtacttcaaactttctttgcaggagggttaggggttgtttatggcgtcattattgatacctgttttgcttggttatatcatatgccttggtggacttatgtattagcaggacttagttttaatatggcacacgctttatcaacttgtttattttatcctcttttgttaccgattttaaggagatttaggaatgaaaaaatacat

SEQ ID NO: 1050 - protein, 174 aa, Streptococcus agalactiae
MIKNSTLTKLTRVAILSALCVVLRYAFAPLPNIQPITAIFLITVVLFDLKEGVATVTITMLVSSFLMGFGPWVFLQIISFTLILCLWKFLIYPLTKAVCFGKITEVVLQTFFAGGLGVVYGVIIDTCFAWLYHMPWWTYVLAGLSFNMAHALSTCLFYPLLLPILRRFRNEKIH

SEQ ID NO: 1051 - DNA, 501 bp, Streptococcus pyogenes
atgtcagctaagcttatgagtcgcattgctatcatgtcagccctatgtgttgtgttgagaatggtttttagcagcctgcctaacgtgcagcctgtgacggcatttttactcagttatcttctttactttgggttagccgaggctgtattagttatgatgttgtgcttgtttttatcagcctttttgctgggatttggcccttgggtcttttggcaagttacttgttttgtgcttgttcttttattatggcgttttgtcttgtaccctttgtctcagcaattccccaaatatcagcttggctgtcaggctttcttggtcgccttatgtggcctcctttatggggtgttgatagatacttgttttgcgtatttgtatagtatgccttggtggagctatgttctagctgggatgccttttaatatagcgcatgctttatcaactctcgtcttttttccagttgtgatgatgttatttaggaggttaatcggtgaacaaaagatt

SEQ ID NO: 1052 - protein, 167 aa, Streptococcus pyogenes
MSAKLMSRIAIMSALCVVLRMVFSSLPNVQPVTAFLLSYLLYFGLAEAVLVMMLCLFLSAFLLGFGPWVFWQVTCFVLVLLLWRFVLYPLSQQFPKYQLGCQAFLVALCGLLYGVLIDTCFAYLYSMPWWSYVLAGMPFNIAHALSTLVFFPVVMMLFRRLIGEQKI

SEQ ID NO: 1053 - DNA, 846 bp, Streptococcus agalactiae
atgagaagaagaattaaacctattgttgttgcggtttttttcagtttatttggacttttattaattattggtcatttacattcgacaaatactttgaaaaaagaattagttgaagctaaaaagacaattccatccgtaaaagcttcaaaagtaccgcaaaaatcaacatcatcgaaagataaagagtttgttcttaaaccgattatcgatgtctctggttggcaacttcctaaggagattgattacgatacgctttcaaaaaatatttcaggtgttgttattcgtgtctttggtggatcaaagatatctaagactaataacgctgcttatacaactggaatcgataaatcgtttaagacccatatcaaagaatttcaaaagcgaaatatcccagtagctgtctacagttatgcacttggttcaagtgttaaagaaatgaaagaagaggctcagatattttataagaatgcagctccttacaaaccaactttttattggattgacgtagaagaggagacaatgtctaacatgaataaaggtgtccaagcattccgaaaagaattaaaaagacttggtgctaaaaatgttggtatctacattggtacttactttatgactgagcaaggcatctctgtaaaaggatttgacgctgtttggattccaacttatggtagcgattctggatactatgaagcggctccgcaaactgaacttaaatacgatttacaccaatacacctctcaaggttatctaccaggattcaatcaaccgcttgatttaaatcaaattgcagttaataaagacaagaagaaaacttatgagaaactttttggaaaagtaaaagag

SEQ ID NO: 1054 - protein, 282 aa, Streptococcus agalactiae
MRRRIKPIVVAVFFSLFGLLLIIGHLHSTNTLKKELVEAKKTIPSVKASKVPQKSTSSKDKEFVLKPIIDVSGWQLPKEIDYDTLSKNISGVVIRVFGGSKISKTNNAAYTTGIDKSFKTHIKEFQKRNIPVAVYSYALGSSVKEMKEEAQIFYKNAAPYKPTFYWIDVEEETMSNMNKGVQAFRKELKRLGAKNVGIYIGTYFMTEQGISVKGFDAVWIPTYGSDSGYYEAAPQTELKYDLHQYTSQGYLPGFNQPLDLNQIAVNKDKKKTYEKLFGKVKE

SEQ ID NO: 1055 - DNA, 846 bp, Streptococcus pyogenes
atgagaagaaaaataaaacctattgttgtgctagtcttctttattttactggcaatggtattgattatcggaaaaagacaagctaatcatgcgaaacaaaaagaagttgaagacgctaagagtcatattcctattgcaaccagtaatcctggtaaagcaaaaactagcacttctgaaaccgaagactttattttaaatcctattgttgatgtttccggctggcaactccctgaagaaattgattatgacacattgtcacgtcacatctctggcgcaattgtacgtgtctatggaggatcgcaaattacagctcataacaacgctgcttttacaactggaattgacaaatcttttaaaacgcatatcaaagaatttcaaaaacgaaatgttcctgtagctgtttacagttacgcacttggtcgtagtactaaagagatgaaagaagaggcccgagctttctacaaaaacgctgctccctataatccaacttactactggattgatgtcgaagaagccactatgaaagatatgaataaaggcgtaacagccttccgagaagagcttaaaaaacttggtgctgaaaatgttggtctctatattggaacttattttatggcagaacaagatatttcaacaaaaggtttcgattctgtatggattccgacttatggtagtgattctggctattatgaggctgctcctaatacaaccttagattacgatttacaccaatacacctcacaaggttatctcagtggttttaacaatgctttagatttaaatcaaattgccgtaacaaaagacactaaaaaaacgtttgagaagttatttggcaactccaacaat

SEQ ID NO: 1056 - protein, 282 aa, Streptococcus pyogenes
MRRKIKPIVVLVFFILLAMVLIIGKRQANHAKQKEVEDAKSHIPIATSNPGKAKTSTSETEDFILNPIVDVSGWQLPEEIDYDTLSRHISGAIVRVYGGSQITAHNNAAFTTGIDKSFKTHIKEFQKRNVPVAVYSYALGRSTKEMKEEARAFYKNAAPYNPTYYWIDVEEATMKDMNKGVTAFREELKKLGAENVGLYIGTYFMAEQDISTKGFDSVWIPTYGSDSGYYEAAPNTTLDYDLHQYTSQGYLSGFNNALDLNQIAVTKDTKKTFEKLFGNSNN

SEQ ID NO: 1057 - DNA, 672 bp, Streptococcus agalactiae
ttgacaaggcatataaaaatttctatactaaatttacaaaatgaaggagagggaactatggaaatactgattgcaggtggtagtggttttttaggaaagcagataataaaagcagcgcttacaaaagggcataaagtggcttacttatcaagacatgaaggtaaaggtgatatatttaaggatcctagattaacctacattaggggagatattacagaagctgataagattcatttagaagacagaacttttgatatattaattgactgtattggagcgattaagcccaatcaactagatgagcttaacgttaaagcaacccaaaaagcagtagcactctgtcacaaaaatcaaataccaaagttagtttatatttcagccaacagcggctattcagcttacattaaaagtaaaaggaaggcagagcagataatcaaagcaagcggtctggattatctttttgtaagaccaggtttgatgtatggtgaagagcgacctctctcgattttccaagccaagtgtataaagttatttagtcatttgcctttcttaggtattgttgtacaaaaggtctttccaactaaggttgtgatagtggcagaagcaatcgttactacgcttaggaaaaaaccaacccaaaaaatcctttctattgaagaattaaataataaa

SEQ ID NO: 1058 - protein, 224 aa, Streptococcus agalactiae
MTRHIKISILNLQNEGEGTMEILIAGGSGFLGKQIIKAALTKGHKVAYLSRHEGKGDIFKDPRLTYIRGDITEADKIHLEDRTFDILIDCIGAIKPNQLDELNVKATQKAVALCHKNQIPKLVYISANSGYSAYIKSKRKAEQIIKASGLDYLFVRPGLMYGEERPLSIFQAKCIKLFSHLPFLGIVVQKVFPTKVVIVAEAIVTTLRKKPTQKILSIEELNNK

SEQ ID NO: 1059 - DNA, 471 bp, Streptococcus agalactiae
atgagtaaaaagaataaaatcaaaaaaactttagttgatcaaattttagataaagcaaaaatcgaacatgatagtctacaattggatgctttacagggagatttacccaacggtattcaaaaacaagatatctttaagacattagcgctaatcggtgataaaaccggtcccataataggtatcttacctctcaccgagcatttatccgaaaaaaagttagctaaaatttcaggaaacaaaaaggtacaaatgatacctcaaaaagatctccagaaaataaccggttatattcacggagcaaataatccaattggaattcgccaaaaacataattaccctatttttatcgatactatcgctttagaaaaacaagaactcattgtctctgcaggagaaattggacgttctattcgtattaatagtgaggttcttgcagatttcgtaaatgctaaatttgccgatataaaggaa

SEQ ID NO: 1060 - protein, 157 aa, Streptococcus agalactiae
MSKKNKIKKTLVDQILDKAKIEHDSLQLDALQGDLPNGIQKQDIFKTLALIGDKTGPIIGILPLTEHLSEKKLAKISGNKKVQMIPQKDLQKITGYIHGANNPIGIRQKHNYPIFIDTIALEKQELIVSAGEIGRSIRINSEVLADFVNAKFADIKE

SEQ ID NO: 1061 - DNA, 477 bp, Streptococcus pyogenes
atggctaaaaaaacaaaactcaaaaaaaccttagtagaacaaatcctcgataaggctaatattgctcatcaaggactcaagcttaatgctttagaaggcgactttccagatgatcttcaaccatcagatatttacaagacacttgctctgactggtgatcaaacaggtcctctaattggcattattccattaacagaacacttatcagaaaaacaattggcaaaagtatcaggtaacaaaaaagtgtccatggttcctcaaaaagacttgcaaaagacaacaggctatattcacggtgccaataatcctgttgggattcgtcaaaaacattcatatcctatttttattgaccaaactgcactggaaaaaggtcaaataatcgtttcagctggtgaagttgggcgttctataaagatttctagccaggctctagctgatttcgttggcgcaagctttgctgatttaaagaagagaaaa

SEQ ID NO: 1062 - protein, 159 aa, Streptococcus pyogenes
MAKKTKLKKTLVEQILDKANIAHQGLKLNALEGDFPDDLQPSDIYKTLALTGDQTGPLIGIIPLTEHLSEKQLAKVSGNKKVSMVPQKDLQKTTGYIHGANNPVGIRQKHSYPIFIDQTALEKGQIIVSAGEVGRSIKISSQALADFVGASFADLKKRK

SEQ ID NO: 1063 - DNA, 651 bp, Streptococcus agalactiae
ttggagaaaaatatgaaattttatcttgttagacacggaaaaacacaatggaatttagaggggcgtttccaaggtgctaacggagactcacctctccttgaagaagctattgaagaattagaagaacttggacaatacctatcatctattcattttgatgctgtttattctagcgacttaggtcgtgctagagatactgttaatatcctcaatgatgctaattcatgcccaaaagaaatccactatactcctcaacttcgtgaatgggcattgggaactttagaaggttgtaaaattgcaactatgcaagctatctatcctcgtcaaatgaccgcattttatcaaaatcccttacaatttaaacatgacatgttcggtgcagaatctctttatcagacaacgcatcgtgtagagagtttcttacgttctctagcttcaaaaaattacgacaaggtccttattgtaggacatggagcaaacctaactgcgtctattcgttccttactgggttatcaatatggtagtttacactacaaagataaacttgataatgccagcctcacaatcatagaaactcatgattttaaagacttcaactgtctgacttggaacgataaatcttatttaaggcaagaggtcaaaatgacacac

SEQ ID NO: 1064 - protein, 217 aa, Streptococcus agalactiae
MEKNMKFYLVRHGKTQWNLEGRFQGANGDSPLLEEAIEELEELGQYLSSIHFDAVYSSDLGRARDTVNILNDANSCPKEIHYTPQLREWALGTLEGCKIATMQAIYPRQMTAFYQNPLQFKHDMFGAESLYQTTHRVESFLRSLASKNYDKVLIVGHGANLTASIRSLLGYQYGSLHYKDKLDNASLTIIETHDFKDFNCLTWNDKSYLRQEVKMTH

SEQ ID NO: 1065 - DNA, 621 bp, Streptococcus pyogenes
atgaaattatattttgtaagacatgggaaaaccctttggaatttagaaggtcgctttcaaggcgctgggggcgattcgccattacttgaagaggcaaaagacgaaattcacttacttggcaaagagttagctaaggtggcttttgatgccgtttatactagcgaccttcaaagagctatggcaacagcagctattatcttagatgcttttgaccaacagccaaaactttaccacaccgaccagcttcgggagtggagattaggtaaattggaaggggctaaaatagcaacaatggcagctatatatccccaacaaatgctggcttttcgagagaatctagcccagttcaaaccagatcagttcgaggctgaatcaatttaccaaacgactcaacgtgtctgccatcttatccaatcgtttaaagataaacattatcaaaacgttcttattgtaggacacggcgctaacttaacagcaactattcgctcattattaggttttgaacctgctcttttactcgctaaaggtggcttagataatgccagtcttactattcttgaaactaaagattatttaacttatgactgtttaatttggaatgataaatcttttctagaggtg

SEQ ID NO: 1066 - protein, 207 aa, Streptococcus pyogenes
MKLYFVRHGKTLWNLEGRFQGAGGDSPLLEEAKDEIHLLGKELAKVAFDAVYTSDLQRAMATAAIILDAFDQQPKLYHTDQLREWRLGKLEGAKIATMAAIYPQQMLAFRENLAQFKPDQFEAESIYQTTQRVCHLIQSFKDKHYQNVLIVGHGANLTATIRSLLGFEPALLLAKGGLDNASLTILETKDYLTYDCLIWNDKSFLEV

SEQ ID NO: 1067 - DNA, 900 bp, Streptococcus agalactiae
atgattacttcaattgtttttgatgttgatgatacgatttacgatcaacaagcaccttaccgtattgctgtggagaaatgctttcctgattttgatatgagcgctattaaccaagcttatattcgctttcgtcattattcagatattggctttccacgagtaatggctggtgaatggacaacagaatattttcgtttctggcgatgcaaagaaacgcttttagagtttggttatcgtgaaattgacgaagctactggtatttattttcaagaaatatacgaacatgaacttgaaaatattacaatgcttgatgagatgcgtatgacacttgactttttgaaatcaaaaaatgtaccaatgggaattattacaaatggtcctacggaacatcaattgaaaaaagttaaaaaattgggactttatgactatgttgatccaaaacgtgttatagttagtcaagcaactggttttcaaaagcctgaaaaggagatttttaatttagcagcagagcaatttgatatgaacccttcaactacactttatgtgggtgattcatatgataatgatattatgggtgcatttaatggtggttggcattctatgtggttcaaccatagaggacgttctttaaaaccgggaattaaaccagtttatgatgttgctattgataactttgagcaattattcggtgctgttaaagtgttgtttgacttacctgataataaatttatttttgatatcaacgataaaagtaatccagtccttgaaatgggacttaataatggtttaatgatggcagcagagcgtctgcttgagagtaatatgagcgttgacaaagttgttattttactgcgcctaactgcaaaacaagaaaaagtattacgcatgaagtatgctaga

SEQ ID NO: 1068 - protein, 300 aa, Streptococcus agalactiae
MITSIVFDVDDTIYDQQAPYRIAVEKCFPDFDMSAINQAYIRFRHYSDIGFPRVMAGEWTTEYFRFWRCKETLLEFGYREIDEATGIYFQEIYEHELENITMLDEMRMTLDFLKSKNVPMGIITNGPTEHQLKKVKKLGLYDYVDPKRVIVSQATGFQKPEKEIFNLAAEQFDMNPSTTLYVGDSYDNDIMGAFNGGWHSMWFNHRGRSLKPGIKPVYDVAIDNFEQLFGAVKVLFDLPDNKFIFDINDKSNPVLEMGLNNGLMMAAERLLESNMSVDKVVILLRLTAKQEKVLRMKYAR

SEQ ID NO: 1069 - DNA, 900 bp, Streptococcus pyogenes
atgattactgctattgtttttgatgtggatgacacaatttacgaccagcaagcgccttatcgaatcgccatggaaaagtgcttcccagattttgatatgtcagtaatgaatcaagcttatattcgctttcgtcactattcagatgttggattcccaagagtaatggcaggggagtggaccacagaatatttccgattctggcgttgcaaggaaacactgcttgagtttggctatcgagaaatcgacgaagctgcgggagtacattttcaagaagtctatgagcacgaacttgagaacattaccatgttagatgagatgcgcatgacccttgactttttaaaatcaaagaatgttcctatggggattattaccaatgggccaacagaacatcagctgaaaaaagttcgtaaattagggctttatgattatattgatgctaagcgtgtcattgtgagccaagcaacaggctttcaaaaaccagaaaaagaaatttttaacctggcagcagaacaatttgacatgaacccacaaaccacactatatgttggggactcttatgacaatgatatcatgggtgcctttaatggtggttggcattccatgtggtttaatcatagaggtcgtcagctaaaaccaggcactaagcctgtttatgatgtggctattgataactttgaacagctctttggtgccgttaaagtactctttgatttacctgataataaatttatttttgatgtcaatgacaagaaaaatccaattttacagatgggaatcaataatggcttgatgatggcagcagagcgtttacttgaaagcaacatgagcattgacaaggtggttatcttgcttcggttaaccaagcaacaagaaaaagttttgcgcttaaaatatgccaga

SEQ ID NO: 1070 - protein, 300 aa, Streptococcus pyogenes
MITAIVFDVDDTIYDQQAPYRIAMEKCFPDFDMSVMNQAYIRFRHYSDVGFPRVMAGEWTTEYFRFWRCKETLLEFGYREIDEAAGVHFQEVYEHELENITMLDEMRMTLDFLKSKNVPMGIITNGPTEHQLKKVRKLGLYDYIDAKRVIVSQATGFQKPEKEIFNLAAEQFDMNPQTTLYVGDSYDNDIMGAFNGGWHSMWFNHRGRQLKPGTKPVYDVAIDNFEQLFGAVKVLFDLPDNKFIFDVNDKKNPILQMGINNGLMMAAERLLESNMSIDKVVILLRLTKQQEKVLRLKYAR

SEQ ID NO: 1071 - DNA, 1599 bp, Streptococcus agalactiae
atggtgaaaagtctattaaaaatgagaataacaccagaaactcataaaataaattatgaattatcagtgtttttgtggtacaataggatgaatactaacttggaggaaattatgtctaaccaacatattgaagaattaaatgaccaacagattgttcgtcgtgaaaaaatggctgctttgactgaacaaggcattgatccttttggtaaacgatttgaacgtacagcaacatctggtcaattaaatgaaaaatacgctgacaaatcaaaagaagacttgcacgacattgaagaaactgctacaatcgctggtcgtttaatgactaagcgcggtaaggggaaagttggctttgcgcatatccaagatcgcgaaggtcaaattcaaatttatgtccgtaaagattctgttggcgaagaaaactacgaaatctttaaaaaagctgatttaggtgacttccttggtgttgaagggcaagtaatgcgtacagatatgggagaactttctatcaaggctactcatattactcacctttcaaaagcactccgtccacttcctgaaaaattccacggcctaactgatattgaaacaatctatcgtaaacgtcatcttgatttaatctcaaatcgtgacagctttgaccgttttgtaacacgctcaaaaatcatttcagaaattcgtcgctttatggatagcaatggtttcttagaggttgaaacacctgttcttcataatgaagctggtggtgcttctgctcgcccatttatcacacatcacaatgcacaagacattgacatggttcttcgtatcgcaactgaattgcatctaaaacgtcttattgtaggtggtatggagcgtgtttatgaaatcggacgtattttccgtaatgaagggatggatgcaacccacaatccagagttcacatctattgaagcctaccaagcctatgctgactaccaggatattatggacttgacagaaggtattatccagcatgttacaaaaactgtaaaaggtgatggaccaattaattatcaaggcacagaaattaaaattaatgaaccattcaaacgtgttcatatggttgatgcggttaaagaaatcactggtattgacttctggaaagaaatgactcttgaagaagcacaagctttggcacaagaaaaaaatgttccgcttgaaaaacatttcacaacagttggtcacatcattaatgccttcttcgaagaatttgttgaagacactttaattcaaccaacttttgtctttggtcatccagttgaagtgtctccacttgctaagaaaaatgatacagaccctcgttttacagaccgtttcgaactctttatcatgactaaagaatacgctaatgcttttacagaattaaatgacccaattgatcagctatctcgctttgaagcacaagcatctgctaaagaacttggcgatgatgaagcaactggagttgattacgattatgttgaagcacttgaatatggtatgccacctactggtggactaggtattggtatcgaccgtctctgtatgctgttaactgatacaacaactatccgagacgtcctacttttccctacaatgaaa

SEQ ID NO: 1072 - protein, 533 aa, Streptococcus agalactiae
MVKSLLKMRITPETHKINYELSVFLWYNRMNTNLEEIMSNQHIEELNDQQIVRREKMAALTEQGIDPFGKRFERTATSGQLNEKYADKSKEDLHDIEETATIAGRLMTKRGKGKVGFAHIQDREGQIQIYVRKDSVGEENYEIFKKADLGDFLGVEGQVMRTDMGELSIKATHITHLSKALRPLPEKFHGLTDIETIYRKRHLDLISNRDSFDRFVTRSKIISEIRRFMDSNGFLEVETPVLHNEAGGASARPFITHHNAQDIDMVLRIATELHLKRLIVGGMERVYEIGRIFRNEGMDATHNPEFTSIEAYQAYADYQDIMDLTEGIIQHVTKTVKGDGPINYQGTEIKINEPFKRVHMVDAVKEITGIDFWKEMTLEEAQALAQEKNVPLEKHFTTVGHIINAFFEEFVEDTLIQPTFVFGHPVEVSPLAKKNDTDPRFTDRFELFIMTKEYANAFTELNDPIDQLSRFEAQASAKELGDDEATGVDYDYVEALEYGMPPTGGLGIGIDRLCMLLTDTTTIRDVLLFPTMK

SEQ ID NO: 1073 - DNA, 1503 bp, Streptococcus pyogenes
ttggaggaaaatatgtctaatcaacacatcgaagaattaaatgaccaacagattgtccgtcgtgaaaaaatgacggcgctggctgaacaaggaattgatcctttcggtaaacgctttgaccgcacagccaattctgctgaattaaaagaaaagtatgctgataaaacaaaagaagaattacatgagttaaacgaaacagctattgttgctggccgcttgatgacaaaacgtggcaaaggtaaggttggttttgctcatcttcaagaccgtgaaggccaaatccaactttatgttcgcaaggactctgttggcgaagacaactatgaaatcttcaaaaaagccgatttaggcgactttatcggcgttgaaggcgaagtcatgcgtacagacatgggcgagttgtcaatcaaggcaaccaagttgactcacctttctaaatcacttcgtcctcttcctgaaaaattccacggattaactgatattgaaaccatttaccgtaagcgtcaccttgatttaatttcaaatcgtgaaagctttgaccgcttcgtgacccgttccaaaatgatttcagaaatccgtcgttatttagacggtcttgatttcctagaagtagaaacgcctgtgcttcataacgaggctggtggtgctgctgctcgtcctttcgttactcaccataatgctcaaaacattgatatggtgcttcgtatcgcaacagaacttcatttgaaacgtttgattgttggtggtatggaacgtgtctatgaaattggtcgtatcttccgtaacgagggaatggatgctactcataatcctgagttcacttctattgaggtttaccaagcctatgcagactatcttgatatcatgaacctgacagaaggcattatccaacatgctgctaaagctgttagaggtgatggccctattgattatcaaggaactgaaatccgtatcaatgaacctttcaaacgtgttcacatggtagatgctatcaaggaagtgacaggtgctgatttctggcctgaaatgactgtcgaagaagctattgcacttgccaaagaaaaacaggtcccactcgaaaaacacttcataagtgtcggacatatcatcaacgctttcttcgaggaatttgttgaagaaaccttggtccaaccaacctttgtgtttggtcatcctgttgaagtatcgcctttggctaagaagaatccagaagatacccgcttcaccgaccgcttcgaacttttcatcatgaccaaagaatacgccaatgctttcacagagttgaatgatcccattgaccaattatctcgttttgaagcacaagcacaagctaaagaacttggtgatgacgaagcaactggcattgactacgacttcgttgaagctcttgaatatggtatgccgccaaccggtggactcggaatcgggattgatcgtctttgcatgttattaacaaacacaacaacaatcagagatgtgcttttattcccaacgatgaaacct

SEQ ID NO: 1074 - protein, 501 aa, Streptococcus pyogenes
LEENMSNQHIEELNDQQIVRREKMTALAEQGIDPFGKRFDRTANSAELKEKYADKTKEELHELNETAIVAGRLMTKRGKGKVGFAHLQDREGQIQLYVRKDSVGEDNYEIFKKADLGDFIGVEGEVMRTDMGELSIKATKLTHLSKSLRPLPEKFHGLTDIETIYRKRHLDLISNRESFDRFVTRSKMISEIRRYLDGLDFLEVETPVLHNEAGGAAARPFVTHHNAQNIDMVLRIATELHLKRLIVGGMERVYEIGRIFRNEGMDATHNPEFTSIEVYQAYADYLDIMNLTEGIIQHAAKAVRGDGPIDYQGTEIRINEPFKRVHMVDAIKEVTGADFWPEMTVEEAIALAKEKQVPLEKHFISVGHIINAFFEEFVEETLVQPTFVFGHPVEVSPLAKKNPEDTRFTDRFELFIMTKEYANAFTELNDPIDQLSRFEAQAQAKELGDDEATGIDYDFVEALEYGMPPTGGLGIGIDRLCMLLTNTTTIRDVLLFPTMKP

SEQ ID NO: 1075 - DNA, 468 bp, Streptococcus agalactiae
atgacaattattgaaggacaattagtggcaaacgaaatgaaaataggaatcgtagtctcacgtttcaatgaattgattacatctaaattattatcaggagcagtagatggactgctgagacatggtgtttcagaagaagatatagatattgtatgggtacctggtgcttttgaaatcccctatatggctagaaaaatggcattatataaagattatgatgctattatctgtcttggggtagtcattaaaggcagcactgatcattatgattatgtttgtaatgaggtgacaaaaggtattggtcatttaaatagccagtcagatatccctcatatctttggtgttctaacaacggataacatcgaacaagctattgagagggcaggaacaaaagcaggaaataaaggttatgattgtgctctttcggctattgaaatggtgaaccttgataaaaaattgcgtgagcga

SEQ ID NO: 1076 - protein, 156 aa, Streptococcus agalactiae
MTIIEGQLVANEMKIGIVVSRFNELITSKLLSGAVDGLLRHGVSEEDIDIVWVPGAFEIPYMARKMALYKDYDAIICLGVVIKGSTDHYDYVCNEVTKGIGHLNSQSDIPHIFGVLTTDNIEQAIERAGTKAGNKGYDCALSAIEMVNLDKKLRER

SEQ ID NO: 1077 - DNA, 1239 bp, Streptococcus agalactiae
ttggtcttttttatcagaaaatggctactaagagagaggagaaagctaatggcctttagtccaataaaaaaacttttacaagacatcaaatcagggaaaatggtagtgttgatggatgacgaaaatagagagaatgaaggagaccttatttgtgcggctgaaatggtgacaaaagagtcgattaattttatggctaaatttgggaaaggattaatttgcttacctctgtctaattactatgctgaaaagttagaattagctcaaatggctagccataatactgataatcatgaaacagcttttaccatatctattgatcatctatcaactagtactgggatttctgcggaagatagagctttgacagctaagatggttgctaacgacagtagcaaagctaaagactttagacgtcctgggcacttatttcccttgttagccaaggaaggaggtgttttagctagaaatggacatactgaagcaaccgttgatctatgtcgtttagctggattaaaggaatgtggactttgttgtgaaataatggctgaagatggtagtatgatgagaaaggatgagttattagcatttgctcaaaagcacgatttagctatcgctaccataaaacaattgcaagactatagacgtcaagaagagggaggggtggttagagaaattgagattcagctaccaacgcaattcggtcattttacggcttatggatatagcgaagttgtggcaaataaggaacatgttgcccttgttaaaggggatattagtagtggtgaagatgttttatgtcgtttacactcagaatgtttgacaggtgatgtctttcattccttgagatgtgattgtggggaacaactggctaatgccctccaacaaatagaggctgaaggtcgtggagtccttctttatatgagacaggaaggtcgaggaattggtttgattaataagttaaaagcttatcatttgcaagaagaaggcttagatactttagaagctaatttggctttaggttttgaaggagatgagagagactatggagttagtgctcaacttttaaaagatttaggtataaattctataaacttactaaccaataatccagataaaatccaacaacttgaagcagaaggaatttgcgtcaaaaacagagtgccattacaggtggcagtaacagcttatgaccttaattatttaaaaactaaaaaagaaaaaatgggacatcttttagat

SEQ ID NO: 1078 - protein, 413 aa, Streptococcus agalactiae
MVFFIRKWLLRERRKLMAFSPIKKLLQDIKSGKMVVLMDDENRENEGDLICAAEMVTKESINFMAKFGKGLICLPLSNYYAEKLELAQMASHNTDNHETAFTISIDHLSTSTGISAEDRALTAKMVANDSSKAKDFRRPGHLFPLLAKEGGVLARNGHTEATVDLCRLAGLKECGLCCEIMAEDGSMMRKDELLAFAQKHDLAIATIKQLQDYRRQEEGGVVREIEIQLPTQFGHFTAYGYSEVVANKEHVALVKGDISSGEDVLCRLHSECLTGDVFHSLRCDCGEQLANALQQIEAEGRGVLLYMRQEGRGIGLINKLKAYHLQEEGLDTLEANLALGFEGDERDYGVSAQLLKDLGINSINLLTNNPDKIQQLEAEGICVKNRVPLQVAVTAYDLNYLKTKKEKMGHLLD

SEQ ID NO: 1079 - DNA, 648 bp, Streptococcus agalactiae
atgtttacaggaattattgaggaaatgggtcaagtcagtcgtattcggaatggcataaagtcccaacaattaagtattgatgctcccaaactagtccctttattaagaaaaggggatagcgtagctgttaatggtgtttgtttgacggttcttgacaaaagtgaaacagcttttatagcagacgtcatgccagaaagtatgatgcgaacaagcttagctgctttacgacttcattctaaagttaacttagaattagcactcagaagtgactcaaggttaggggggcattttgttcttggacatgtggatggggttggaaaaatagaaaaaatccaaaaagatgatattgctgtcagattttcaattgatgctccacctagtattatgtcttatattatagagaaaggttcggtggctctagatgggattagcttaacagtggtatcatttacagagcattcttttgaagtttcggtcattccccacacgatggctcaaactaatctatccttaaaaaaggttggggatttattaaatatcgaagtggatgttttaggcaaatatgctgagaaatttttagcacccactaatagaactaatcacacttcatcggtaatggattggtcttttttatcagaaaatggctac

SEQ ID NO: 1080 - protein, 216 aa, Streptococcus agalactiae
MFTGIIEEMGQVSRIRNGIKSQQLSIDAPKLVPLLRKGDSVAVNGVCLTVLDKSETAFIADVMPESMMRTSLAALRLHSKVNLELALRSDSRLGGHFVLGHVDGVGKIEKIQKDDIAVRFSIDAPPSIMSYIIEKGSVALDGISLTVVSFTEHSFEVSVIPHTMAQTNLSLKKVGDLLNIEVDVLGKYAEKFLAPTNRTNHTSSVMDWSFLSENGY

SEQ ID NO: 1081 - DNA, 1107 bp, Streptococcus agalactiae
atgatgaaaaaagaagactacatggcattagccttgaaagaggctgagaaaggtatggggttcgttgctcccaacccattagtaggtgctgttattgttaaagatgatcgtataatttccaaaggttatcataaacgatttggagatttacatgcggaaagacaggctattaaaaatgctgatgaggatatctctggaagtactctgtacgtgactttagaaccatgctgtcatgttggtaagcaaccaccttgtactgaagctcttattaaatctggtatcaaaaaagtagtagttggaagtttagatccaaatcctttagtttcaggaaaagggattgccttgttgagaaaagaaggtttaaatgttgaagttggtatcttaagagaagaatgcgatgctctgaatgaaagatttatttttcacatgacctataagcagccttttgtttatttgaaatatgctatgactttagatgggaagatagctacaaagacgggcgattctaagtggatatcaaatgagcactcaagacaatctgttcagaaattgaggcaaaaatgtagtgctattatggtcggtatcaatactgtattagctgataatccacgtttaacttgccgtattcctaaaggtgaagcgcttgtgaggatcgtatgtgatagtcagttgaagatacctttagactcttacctagttaagagcgctaaaacaataccaacatggattgcaacatgttcagataatcttgctcagcaacaaacattaaaagaaatgggttgccgtttgattaaggtcccaagaaaagatggaaagctggatttgaaagtattaatgactattttaggacaagaagggattgatagccttcttattgaaggaggaagtagtttacatttttcagctttaaaagctggtattgttaacagactaattgtttttattgcacccaaaataataggaggtctgaaagcaaaaacagctatttctggagaaggtttggattggcttaaccaagctttcagagtaaaagatattgaacttagtcgtatggattctgacgttgttattgaaggaaaggtagaacattatgtttacaggaattat

SEQ ID NO: 1082 - protein, 369 aa, Streptococcus agalactiae
MMKKEDYMALALKEAEKGMGFVAPNPLVGAVIVKDDRIISKGYHKRFGDLHAERQAIKNADEDISGSTLYVTLEPCCHVGKQPPCTEALIKSGIKKVVVGSLDPNPLVSGKGIALLRKEGLNVEVGILREECDALNERFIFHMTYKQPFVYLKYAMTLDGKIATKTGDSKWISNEHSRQSVQKLRQKCSAIMVGINTVLADNPRLTCRIPKGEALVRIVCDSQLKIPLDSYLVKSAKTIPTWIATCSDNLAQQQTLKEMGCRLIKVPRKDGKLDLKVLMTILGQEGIDSLLIEGGSSLHFSALKAGIVNRLIVFIAPKIIGGLKAKTAISGEGLDWLNQAFRVKDIELSRMDSDVVIEGKVEHYVYRNY

SEQ ID NO: 1083 - DNA, 537 bp, Streptococcus pyogenes
ttggaacttggggagtctttcttgatgccatatagtttagaagagcaaacttatttcatgcaagaggctttaaaagaagccgaaaaatccttacagaaagctgaaatccccattggctgtgtcattgtcaaggatggtgagattattggtcgtgggcacaatgcgcgtgaagagagtaaccaagccattatgcacgctgaaatgatggctattaacgaggctaacgctcatgaaggcaactggcgtttattagataccacactctttgtgaccatcgagccttgtgtgatgtgtagtggtgccattgggctagcaaggattccgcatgttatttatggagccagcaatcaaaaatttggtggagtagacagcctttaccagattttgacagatgagcgcttaaaccatcgcgtgcaagttgaacgaggcctgctagcagcagactgtgctaacatcatgcaaacctttttccgccaagggcgagagcgcaaaaaaatagctaagcatttgatcaaggaacagtcagatccctttgac

SEQ ID NO: 1084 - protein, 179 aa, Streptococcus pyogenes
LELGESFLMPYSLEEQTYFMQEALKEAEKSLQKAEIPIGCVIVKDGEIIGRGHNAREESNQAIMHAEMMAINEANAHEGNWRLLDTTLFVTIEPCVMCSGAIGLARIPHVIYGASNQKFGGVDSLYQILTDERLNHRVQVERGLLAADCANIMQTFFRQGRERKKIAKHLIKEQSDPFD

SEQ ID NO: 1085 - DNA, 1338 bp, Streptococcus agalactiae
atgaatcaaaatcattccgtcaaaagatccttatccgaagttaatcagagcgttgaggttcctcacaatagctctttttggaacactttaagagcttttcttggacctggagctttggttgcagttggttatatggatccaggtaactggattactagcgttattggtggagctacctatcgttacttactattgtttgttgttttagtatcttctttgatggcgatgcaattacaacaaatggctggcaagcttggcattgttacacgacaggacttagcacaagcaacagcttctcgactcccaaaaccgcttcgttacctgctatttattatcattgagttagcccttatcgctactgatttagcagaagtcattggctctgccattgctcttcacttattatttggctggcccctgttactgtctatcatgattactattttggatgtattcttacttttactcttaatgaagttaggcgtccaaaaaattgaagcctttgtttctgttctcatattgacaattttgataatctttacatatttagttgttttatcacaacctgatttagatgctatgttcaaaggatttttaccacaccatgagctttttaacatatcacatgaagggaaaaatagtcctttaaccctcgctcttggcattatcggcgcaacagtcatgccacataatctttatttacattcttctttatctcagactagacgcgtggattatcataataaatcttcaataaaaaaagctgtacgtttcatgaccttagattctaacattcagctatcacttgcatttgtcgtgaattcgctactattagtcttaggagctagtctattttatgggcatgctaatgatatcagtgccttttctcaaatgtatcttgccctatctgataaaactattactggtgcagtagccagttctttcctttctaccctttttgcagttgccctactagcaagtggtcaaaattcaacgattacaggtactttaacaggacaaatcgttatggaaggtttccttcacttcaaattacctcaatggttaataaggctttgtactagattattaactcttcttccaatttttgttatcgccctactagttggaggcgaagaaaatacgttagatcaactaatcgtctattcacaagtttttctttccttagctttaccattttcaatctttccattgatttatttcacgtcgcaaaaatcaattatgggagagcatgctaatgctaaatggaatacctatttagcataccttgtcgccatcattttaacattactcaatttgaaattaatcatggatttactt

SEQ ID NO: 1086 - protein, 446 aa, Streptococcus agalactiae
MNQNHSVKRSLSEVNQSVEVPHNSSFWNTLRAFLGPGALVAVGYMDPGNWITSVIGGATYRYLLLFVVLVSSLMAMQLQQMAGKLGIVTRQDLAQATASRLPKPLRYLLFIIIELALIATDLAEVIGSAIALHLLFGWPLLLSIMITILDVFLLLLLMKLGVQKIEAFVSVLILTILIIFTYLVVLSQPDLDAMFKGFLPHHELFNISHEGKNSPLTLALGIIGATVMPHNLYLHSSLSQTRRVDYHNKSSIKKAVRFMTLDSNIQLSLAFVVNSLLLVLGASLFYGHANDISAFSQMYLALSDKTITGAVASSFLSTLFAVALLASGQNSTITGTLTGQIVMEGFLHFKLPQWLIRLCTRLLTLLPIFVIALLVGGEENTLDQLIVYSQVFLSLALPFSIFPLIYFTSQKSIMGEHANAKWNTYLAYLVAIILTLLNLKLIMDLL

SEQ ID NO: 1087 - DNA, 795 bp, Streptococcus agalactiae
atgattagacattcatttaaaagtaaggtgttattgttagtctttatcttaacaataatagtgaattatttatccgcaacaggttttttaacagggaacagtcagaagagtctgtctgatcgttatcaaacgctcttgacaccagcaccattagccttttcaatttggtcagtcatctatttattgacctttttagtaatattaagagctatattcagtaagagtcaatcttaccaagataactttgctagcatttttccatactttttgggtcttctattagttaataatatatggactgtattttttacgagtaatttgattggcctatcaacaataataatttttgcttactgtattcttctggttatcattatcaagatactaagtaaaaataaatcaaaattactgcttagaataacatttggaattcatgcaggatggttgctagttgcgtcattggtcaatttagcggtctacttagttaaaattgattttaattacccattaccaaaggtatatatagctatcattgccttgatttttataactgttttaagtctttacctagctagagtattacaaaatgcttacttaatcttatccgttttttgggcttggttgatggtttttaaagcacatttagaaggaaattttcaacacctatattttagtatccaaattttatctttgattgcagcaattatccttggcgtatcgtttttcatcatcggttattataatgtcaaggagaggtacaagcaaaaaaatactagcccttactcacgggttctt

SEQ ID NO: 1088 - protein, 265 aa, Streptococcus agalactiae
MIRHSFKSKVLLLVFILTIIVNYLSATGFLTGNSQKSLSDRYQTLLTPAPLAFSIWSVIYLLTFLVILRAIFSKSQSYQDNFASIFPYFLGLLLVNNIWTVFFTSNLIGLSTIIIFAYCILLVIIIKILSKNKSKLLLRITFGIHAGWLLVASLVNLAVYLVKIDFNYPLPKVYIAIIALIFITVLSLYLARVLQNAYLILSVFWAWLMVFKAHLEGNFQHLYFSIQILSLIAAIILGVSFFIIGYYNVKERYKQKNTSPYSRVL

SEQ ID NO: 1089 - DNA, 210 bp, Streptococcus agalactiae
atgtcagaatttacatttgaaattgttgagaagttattggtcctatctgaaaatgaaaaaggttggacaaaagagttgaatcgtgtgagcttcaacggagcgccagctaaatttgatttgcgtacatggagtccagatcatacaaaaatgggtaaaggtatcactttatctaatgaagaatttaaagtcattttagatgcttttcgtaaa

SEQ ID NO: 1090 - protein, 70 aa, Streptococcus agalactiae
MSEFTFEIVEKLLVLSENEKGWTKELNRVSFNGAPAKFDLRTWSPDHTKMGKGITLSNEEFKVILDAFRK

SEQ ID NO: 1091 - DNA, 210 bp, Streptococcus pyogenes
atggcagaatttacattcaacattgaggaacatttactcaccttatcagaaaatgataaaggttggacgaaagaattgaaccgcgtcagctttaatggcgcagaagcgaaatgggatatccgcacgtggagtccagaccatacgaaaatggggaaaggcattactcttactaatgaagaatttaaaaccatcttagacgcttttcgtaag

SEQ ID NO: 1092 - protein, 70 aa, Streptococcus pyogenes
MAEFTFNIEEHLLTLSENDKGWTKELNRVSFNGAEAKWDIRTWSPDHTKMGKGITLTNEEFKTILDAFRK

SEQ ID NO: 1093 - DNA, 1284 bp, Streptococcus agalactiae
atgtctaatgtaaaaaaacgccctgaggttttatcacctgcaggaacactagaaaaattaaaagttgctattgattatggagcagatgctgtatttgttggaggtcaagcgtatggtcttcgaagtagagctggtaacttttctatggaagagttacaagagggaataaactatgctcatgcaagagatgctaaagtttatgtagcggctaatatggttactcatgaaggtaatgagcttggggcaggtccgtggtttcgtgaattacgtgatatgggactagatgcagtcattgtttcagatcctgctcttattgttatttgtgctacagaagcaccaggcttagaaattcatttgtcaactcaagcctcttccacgaactatgaaacttttgaattttggaaagagatggggcttactcgtgtcgtattagcacgtgaggttactatggcagagttggctgaaatcaggaagaggacagatgttgagatagaagcatttgttcatggcgcgatgtgtatttcatactcaggacgatgtgttctatcaaaccatatgagccatcgtgatgctaatcgtggcggttgctctcagtcatgtcgttggaaatatgacctctacgatatgccatttggacaagaacgtcaatcgttaaaaggcgagattccagaacctttctcaatgtcagctgtggatatgtgtatgattgagcatattccagatatgattgaaaatggtgtagatagtttaaaaatagaaggacgtatgaaatccattcattatgtttctacagtaactaattgctataaagctgctgtagatgcctatatggaaagtccagaagcttttgaagctattaaagaagacttgattgatgaactttggaaggttgcacaacgcgaattagcaacaggtttctactaccatacaccaactgaaaatgaacaactctttggagctcgtcgtaaaattcctcaatacaaatttgttggggaagtggtttcatttgacaatgctaaaatggaggctacaattcgtcagcgtaatgttattatggaaggagatcgcgtagaattctatggtcctggcttccgtcactttgaatgttttattgatggtctgcgtgatgctgaaggaaataaaatagaccgtgctccaaatccgatggaattattaaccataacattaccaaatccagtaaaaaaaggggatatgattcgtgcttgtaaagaaggattagtgaacctttatcaaaatgatggtactagcaagactgtaagagct

SEQ ID NO: 1094 - protein, 428 aa, Streptococcus agalactiae
MSNVKKRPEVLSPAGTLEKLKVAIDYGADAVFVGGQAYGLRSRAGNFSMEELQEGINYAHARDAKVYVAANMVTHEGNELGAGPWFRELRDMGLDAVIVSDPALIVICATEAPGLEIHLSTQASSTNYETFEFWKEMGLTRVVLAREVTMAELAEIRKRTDVEIEAFVHGAMCISYSGRCVLSNHMSHRDANRGGCSQSCRWKYDLYDMPFGQERQSLKGEIPEPFSMSAVDMCMIEHIPDMIENGVDSLKIEGRMKSIHYVSTVTNCYKAAVDAYMESPEAFEAIKEDLIDELWKVAQRELATGFYYHTPTENEQLFGARRKIPQYKFVGEVVSFDNAKMEATIRQRNVIMEGDRVEFYGPGFRHFECFIDGLRDAEGNKIDRAPNPMELLTITLPNPVKKGDMIRACKEGLVNLYQNDGTSKTVRA

SEQ ID NO: 1095 - DNA, 1284 bp, Streptococcus pyogenes
atgtcacatatgaaaaaacgtcccgaggtcttatcacctgctggaacacttgaaaaattaaaagttgcgattgactatggcgcagatgctgtttttgttggagggcaggcctatggcctaagaagccgcgctggtaacttctctatggaagaattgcaagaaggcattgattatgcacatgcgcgtggagctaaggtctatgttgctgctaacatggttacccacgaagggaacgaaattggtgcgggcgagtggtttcgtcaactgcgtgatatggggcttgatgcggtcattgtttcagatccagccttgattgttatttgttcaacagaagccccaggtttggaaattcatttgtcaacgcaagcttcatctaccaattacgagacctttgaattttggaaagccatgggcttgacccgagttgttttagctcgcgaggttaatatggccgagttagcagaaatccgcaagcggacagatgtggaaattgaagcctttgtccatggagccatgtgtatctcttattcaggccgctgtgttttgtcaaaccacatgagtcaccgtgatgccaacaggggcggctgctcacagtcttgccgctggaagtatgatttgtatgacatgccatttggaggagagcgccgctccttaaaaggggaaattccagaagactattctatgtcctctgttgacatgtgtatgattgaccatattcctgacctgattgaaaatggggttgatagcttaaaaattgaaggccgaatgaaatctatccactacgtctcaaccgtaaccaactgttacaaggcggctgtaggtgcttacatggaaagcccagaagctttttatgctatcaaagaggaattgattgacgagttgtggaaggttgcccagcgcgagttggctacaggtttttactatggtatcccaactgaaaatgaacaattatttggtgctcgccgcaaaattccacaatataaatttgtcggagaagtagttgcctttgactcagctagcatgacagcgaccattcgtcagcgtaatgtcatcatggaaggcgatcggattgaatgttatggaccaggtttccgtcattttgaaacggttgttaaggacttacatgatgcggatggccaaaagattgaccgtgccccaaatccaatggaactcttaaccatctctttaccgagagaagttaagccaggggatatgattagggcttgcaaggaaggtctggttaacctctatcaaaaagatggcaccagtaaaactgttagaaca

SEQ ID NO: 1096 - protein, 428 aa, Streptococcus pyogenes
MSHMKKRPEVLSPAGTLEKLKVAIDYGADAVFVGGQAYGLRSRAGNFSMEELQEGIDYAHARGAKVYVAANMVTHEGNEIGAGEWFRQLRDMGLDAVIVSDPALIVICSTEAPGLEIHLSTQASSTNYETFEFWKAMGLTRVVLAREVNMAELAEIRKRTDVEIEAFVHGAMCISYSGRCVLSNHMSHRDANRGGCSQSCRWKYDLYDMPFGGERRSLKGEIPEDYSMSSVDMCMIDHIPDLIENGVDSLKIEGRMKSIHYVSTVTNCYKAAVGAYMESPEAFYAIKEELIDELWKVAQRELATGFYYGIPTENEQLFGARRKIPQYKFVGEVVAFDSASMTATIRQRNVIMEGDRIECYGPGFRHFETVVKDLHDADGQKIDRAPNPMELLTISLPREVKPGDMIRACKEGLVNLYQKDGTSKTVRT

SEQ ID NO: 1097 - DNA, 924 bp, Streptococcus agalactiae
atggaaaaaataattttgacagcgacagctgaatctattgaacaagtaaagcaattgctagcaataggaattgaccgcatctatgtaggggaagaaaattacggtcttcgtttaccacattcattttcagacgatgaattgcgtgaaatcgctaaattagtacatgatgctggtaaagaattgacagtagcttgtaatgcactcatgcatcaagagatgatggataatatcaaaccatttttggagttgatgaaagaaattaatgtggattatttggtagttggtgatgcaggagtattttatatcaacaagcgtgatggttataacttcaaacttatctacgacacttctgtcttcgttacatcaagtcgtcaagttaatttttggggacaacatggagcagtagaaacggttttagcacgtgaaataccttctgaagaactttttaagatgtctgagaatcttgaatttcctgctgagattttagtttatggggcttctgtaattcatcactctaagcgtccgttattgcaaaactattataattttactcatatcactgatgaaaaaacacgtgagcgtggtctttttttagcagaaccaggtgatccagaaagtcactattctatttacgaagataagcatgggactcatatttttattaacaatgatatcaatatgatgactaaagtgactgaactagttgaacatcactttactcactggaaattagatggtatttattgtccaggagataattttgttgctattgctgaaatttttgtcgaaacagctcgtttgattgaaaatggaacattcactcaggatcaggctttcttgtttgatgaacgaattagaaaactgcaccctaaaggacgtggtttagatactggattttatgattttgacccatcaacagtaaaa

SEQ ID NO: 1098 - protein, 308 aa, Streptococcus agalactiae
MEKIILTATAESIEQVKQLLAIGIDRIYVGEENYGLRLPHSFSDDELREIAKLVHDAGKELTVACNALMHQEMMDNIKPFLELMKEINVDYLVVGDAGVFYINKRDGYNFKLIYDTSVFVTSSRQVNFWGQHGAVETVLAREIPSEELFKMSENLEFPAEILVYGASVIHHSKRPLLQNYYNFTHITDEKTRERGLFLAEPGDPESHYSIYEDKHGTHIFINNDINMMTKVTELVEHHFTHWKLDGIYCPGDNFVAIAEIFVETARLIENGTFTQDQAFLFDERIRKLHPKGRGLDTGFYDFDPSTVK

SEQ ID NO: 1099 - DNA, 924 bp, Streptococcus pyogenes
atggaaaaaataattattacagccacagctgaaagcattgagcaagtcaaagctttattagctgctggtgttgatcgtatttatgttggtgaagccaattacgggttacgtcttccccataatttttcttatgatgaattgagacaaattgccaaactagtgcatgatgcaggcaaagagttgacagtagcttgcaatgctttgatgcatcaagatatgatggatcagatcaaaccctttttagacttaatgatagagattgctgttgattatcttgtggttggtgatgcaggtgtgttttatgtcaataaaagggatggctataactttaaactgatttatgatacctctgtttttgtgacttctagccgtcaggtaaatttctgggggcaacatggtgctgttgaaagtgttttagcaagggaaatcccatcagcagagttattcaccttagctgaaaatttggaatttccagcagaggtgctagtttacggcgcctcggtgattcatcactcgaaacgtcccttgctagaaaattattaccattttacaaagattgatgatgaggttagtcgtgaacgaggacttttcttggcagaaccaggagatgctagcagccattactccatttatgaagacaatcatggcactcatattttcattaataacgatatcgacatgatgtctaaattgggtgagctgtatgcgcatggcttaactcattggaagctagatggcatttactgtccaggtgatgattttgtcgctattactaaattgtttattcaggctaaaaccttattagaagctgggcaatttacccaagaagaagctgaaaagcttgatcaagcagtgcatgcccatcatccagctggccgtggattagatactggcttttatgagttcgatccaaaaaccgttaaa

SEQ ID NO: 1100 - protein, 308 aa, Streptococcus pyogenes
MEKIIITATAESIEQVKALLAAGVDRIYVGEANYGLRLPHNFSYDELRQIAKLVHDAGKELTVACNALMHQDMMDQIKPFLDLMIEIAVDYLVVGDAGVFYVNKRDGYNFKLIYDTSVFVTSSRQVNFWGQHGAVESVLAREIPSAELFTLAENLEFPAEVLVYGASVIHHSKRPLLENYYHFTKIDDEVSRERGLFLAEPGDASSHYSIYEDNHGTHIFINNDIDMMSKLGELYAHGLTHWKLDGIYCPGDDFVAITKLFIQAKTLLEAGQFTQEEAEKLDQAVHAHHPAGRGLDTGFYEFDPKTVK

SEQ ID NO: 1101 - DNA, 429 bp, Streptococcus agalactiae
atgagtaaattatttaaaactttagttatcagtgctgcatcaggtgcagcagcagcttattttttaacaacaaaaaaaggaaaagagctaaggaaaaatgcagaaaaattctatggagaatataaagaaaatccagaagaatatcatcaaatagctaaagataaagcaagtgaatattcaaatttagctgttgatacttttaaagattataaaggtaaatttgaatcaggtgaattgacaacagaggatatcgtctcagccgttaaggaaaaaagcggagaagtagttgactttgctaatgattttgtcaatcaagctaaatcaaaattctcagacgaggatactgctaaaaaagaagataaggctcctgaaacaaaagtagaagatattgtcattgattataaagaaaacacagaagataaagaaaaa

SEQ ID NO: 1102 - protein, 143 aa, Streptococcus agalactiae
MSKLFKTLVISAASGAAAAYFLTTKKGKELRKNAEKFYGEYKENPEEYHQIAKDKASEYSNLAVDTFKDYKGKFESGELTTEDIVSAVKEKSGEVVDFANDFVNQAKSKFSDEDTAKKEDKAPETKVEDIVIDYKENTEDKEK

SEQ ID NO: 1103 - DNA, 447 bp, Streptococcus pyogenes
ttggaaaaaaaggagaaaagcatgaataaaagtttcaaaaacttagtgattggagctgtttcaggagtagcggcagcttacttcttatcaacagaaaaaggcaaggctttgaaaaatcgtgctgaaaaagcttatcaagcctacaaagaaagtccagatgattaccaccaatttgctaaagaaaaaggtagtgaatacagccatttagcacgtgacactttctatgatgtgaaagataagttggcttctggtgacttaactaaagaggacatgttagacttgctcaaagataaaacaacagctttcgtgcaaaaaacaaaagaaacccttgccgaagttgaagcgaaagaaaagcaagatgatgttatcattgatttaaatgaagaagacatcatcattgactatactgaacaagatgagcctgttagtgatacactagataaacac

SEQ ID NO: 1104 - protein, 149 aa, Streptococcus pyogenes
LEKKEKSMNKSFKNLVIGAVSGVAAAYFLSTEKGKALKNRAEKAYQAYKESPDDYHQFAKEKGSEYSHLARDTFYDVKDKLASGDLTKEDMLDLLKDKTTAFVQKTKETLAEVEAKEKQDDVIIDLNEEDIIIDYTEQDEPVSDTLDKH

SEQ ID NO: 1105 - DNA, 396 bp, Streptococcus agalactiae
atgatagaaattgctgtattaattattgccattgcgtttgttgttttagttttaggaatacttttcgttctgaaaaaagtatcagaaacgattgaggaaaccaagcaaactattaaagtattaacaagcgatgttaacgtgactctttaccaaactaatgaaattttagccaaagctaatgttttagttgatgatgttaatggtaaagtatctactattgatcctctttttgtagctattgctgacttatcagaatctgtatctgatttaaacctacaggcaagacatattggacaaaaggcaagtagtgcaacctcaagtgttactaaggcaggttcagctttagctattggaaaagcggcttcaaaaatttttcgtaaaaaaggagacaaaaaa

SEQ ID NO: 1106 - protein, 132 aa, Streptococcus agalactiae
MIEIAVLIIAIAFVVLVLGILFVLKKVSETIEETKQTIKVLTSDVNVTLYQTNEILAKANVLVDDVNGKVSTIDPLFVAIADLSESVSDLNLQARHIGQKASSATSSVTKAGSALAIGKAASKIFRKKGDKK

SEQ ID NO: 1107 - DNA, 405 bp, Streptococcus pyogenes
atggacttagttggaatctcactgatgattattgcactcgcatttgttgctttggtgattttcttgattattgtattaaagaaagtctcagaaacaattgatgaagccaaaaaaacgatttctgtattgacaagtgatgttaatgtgacacttcatcaaactaatgatattttagcaaaagctaatatccttgttgaagatgttaatggtaaagtagcaaccatcgatccactgtttgttgctattgctgatttgtcagaaagtctttcagatttaaatagtcaagcaaggcattttgggcaaaaagcaactaatgctacaggtaatgtttcaaaagctggaaaattagcattagttggtaaagtagcctcaaaagtatttggaaaaaaaggagaaaagcatgaa

SEQ ID NO: 1108 - protein, 135 aa, Streptococcus pyogenes
MDLVGISLMIIALAFVALVIFLIIVLKKVSETIDEAKKTISVLTSDVNVTLHQTNDILAKANILVEDVNGKVATIDPLFVAIADLSESLSDLNSQARHFGQKATNATGNVSKAGKLALVGKVASKVFGKKGEKHE

SEQ ID NO: 1109 - DNA, 114 bp, Streptococcus agalactiae
atggcttgggcaatcatcactcctggagcagcaatatccagaaaatcaatgggattaatcaagcgacgatatgaaaaaatcacaaggagaatggccccggtaattaaccctccg

SEQ ID NO: 1110 - protein, 38 aa, Streptococcus agalactiae
MAWAIITPGAAISRKSMGLIKRRYEKITRRMAPVINPP

SEQ ID NO: 1111 - DNA, 774 bp, Streptococcus agalactiae
atgatgattaatccagtagcaatacgattaggccccttttctattcgctggtatgctatttgcatagtgtctggtatgttgttagcagtttacttagcaatgaaagaggcccctcgtaagaacattaagtcggatgatattctagatttcattctcatggcttttccactatccattgttggagctcgtatttattatgttatcttcgaatgggcttattactctaagcacccagtagagattatcgccatctggaatggcggtattgctatttacggagggttaattaccggggccattctccttgtgattttttcatatcgtcgcttgattaatcccattgattttctggatattgctgctccaggagtgatgattgcccaagccataggtaggtgggggaattttattaatcaagaagcatacggtagggcagtaaaaaatctgaattacgtaccaaactttataaaaaatcaaatgtatattgatggagcttaccgagtacctacatttttatatgagtctctttggaacttcctaggttttgtcatcatcatgtctattcgtcatcgaccgcgcactttaaaacaaggtgaagtggcatgtttttatttagtttggtatggatgtggacggttcattattgaagggatgaggacagatagcctttatttggcgggtttgcgcgtgtcacaatggttatcagttattttagttattatcggaattgtcatgattatttatcgtcgtcgtgaacaacatatttcatattat

SEQ ID NO: 1112 - protein, 258 aa, Streptococcus agalactiae
MMINPVAIRLGPFSIRWYAICIVSGMLLAVYLAMKEAPRKNIKSDDILDFILMAFPLSIVGARIYYVIFEWAYYSKHPVEIIAIWNGGIAIYGGLITGAILLVIFSYRRLINPIDFLDIAAPGVMIAQAIGRWGNFINQEAYGRAVKNLNYVPNFIKNQMYIDGAYRVPTFLYESLWNFLGFVIIMSIRHRPRTLKQGEVACFYLVWYGCGRFIIEGMRTDSLYLAGLRVSQWLSVILVIIGIVMIIYRRREQHISYY

SEQ ID NO: 1113 - DNA, 777 bp, Streptococcus pyogenes
atgatcaatcccattgccttaaaatgtggtccactagccatccactggtatgctctatgtatcttgtcaggacttgttttggcggtttacttagcatcaaaagaagcacccaaaaaaggaatatcatctgatgctattttcgattttattctgattgcttttccacttgctattgttggtgcaagaatttactatgttatttttgaatggtcttattatgtcaagcatttagatgaaatcatagccatttggaatggcggtattgctatttatggcggtctcattacaggagctcttgtacttttggcttactgttataacaaggtgctcaatcccattcattttttagatattgccgcaccaagtgtcatggtcgctcaagctatcggtcgctggggaaattttatcaaccaagaagcctatggtaaagctgtgagccagttaaattacttaccaagctttattcaaaagcaaatgtttatagagggaagttaccgcattccgacctttctctatgaatcactttggaatcttttgggctttgtcattattatgatgtggcgtcgtaagccaaaaagtctattagatggagaaatctttgcattttacttaatttggtatggtagtggaagactagtcattgaaggtatgcgaacagatagtcttatgtttttaggtattcgcatctcccaatatgtgtctgccttattaattattattggcttaatctttgttataaaaagacgtcgtcaaaaaggaatttcttattatcaagaa

SEQ ID NO: 1114 - protein, 259 aa, Streptococcus pyogenes
MINPIALKCGPLAIHWYALCILSGLVLAVYLASKEAPKKGISSDAIFDFILIAFPLAIVGARIYYVIFEWSYYVKHLDEIIAIWNGGIAIYGGLITGALVLLAYCYNKVLNPIHFLDIAAPSVMVAQAIGRWGNFINQEAYGKAVSQLNYLPSFIQKQMFIEGSYRIPTFLYESLWNLLGFVIIMMWRRKPKSLLDGEIFAFYLIWYGSGRLVIEGMRTDSLMFLGIRISQYVSALLIIIGLIFVIKRRRQKGISYYQE

SEQ ID NO: 1115 - DNA, 933 bp, Streptococcus agalactiae
atggcagttactgttcaaatgttagttgaccgcttaaagttaaatgtcatctatggtgatgaacatctattatctaagcggattacaacagctgacatttcacgtcctggtctagaaatgacagggtattttgattattatgcaccagagcgtttgcaacttgttggtatgaaagagtggtcatatttaatggctatgacaggacataatcgttatcaagtgttacgtgaaatgttccaaaaagaaacaccagctattgttgtagcacgtgatttagaaattccagaagagatgtatgaggcggctaaagataccggtattgctattcttcaaagtaaggcccctacaagtcgtttatcaggtgaagtttcttggtatttagattcttgcttagctgagaggacaagtgttcatggtgtcttgatggatatctatggtatgggtgttctgattcaaggtgattccggtattggtaagagtgagacaggactagagctagttaagcgaggacatcgtttggtagcagatgatcgtgttgatgtttatgctaaagacgaagagacgctttggggagagcctgctgagatattacgtcatttacttgaaattagaggtgtgggaatcattgatattatgagcctatatggagctagtgcggttaaagattcatcgcaagtgcaattagctatataccttgaaaactttgaaactggaaaagtttttgatagactcgggaatggcaatgaagagatcgaattatctggagttaaggttcctcggatacgtattcctgttaaaacaggccgaaacgtgtcagtagttattgaagcagcggctatgaatcacagagctaaacaaatggggtttgatgctacccagacttttgaggatcgtttaacacatttgattagtcagaacgaggtcaatgatgat

SEQ ID NO: 1116 - protein, 311 aa, Streptococcus agalactiae
MAVTVQMLVDRLKLNVIYGDEHLLSKRITTADISRPGLEMTGYFDYYAPERLQLVGMKEWSYLMAMTGHNRYQVLREMFQKETPAIVVARDLEIPEEMYEAAKDTGIAILQSKAPTSRLSGEVSWYLDSCLAERTSVHGVLMDIYGMGVLIQGDSGIGKSETGLELVKRGHRLVADDRVDVYAKDEETLWGEPAEILRHLLEIRGVGIIDIMSLYGASAVKDSSQVQLAIYLENFETGKVFDRLGNGNEEIELSGVKVPRIRIPVKTGRNVSVVIEAAAMNHRAKQMGFDATQTFEDRLTHLISQNEVNDD

SEQ ID NO: 1117 - DNA, 1023 bp, Streptococcus pyogenes
ttggtgtcgttgttctcatttagtagtgaaaaaatgagtatttgcaagggtctaacggtcgatttgtgttataatattgaaaaaggagaaattatgaccgttactgtaaagatgctagtgcaaaaagttaaacttgatgtggtttatgctacagataacttgctgtcaaaagagataacaacatcagatatttcacgtccaggtcttgaaatgactggttattttgattattatgctccagaaaggttgcagctatttggaatgaaagagtggtcttatcttacacagatgacttctcacaaccgttattctgttttaaaagagatgttcaaaaaggacactcctgcagtggttgtctctagaaatttagccattccaaaagaaatggttcaagctgcaaaagaagaaggtatttcacttttaagtagccgtgtttcaactagccgcttagctggagaaatgtcttattttcttgacgcttctttagctgaacgtactagtgttcacggcgttttaatggatatttatggtatgggggttcttatccaaggggattctggaattggtaaaagtgagactggtttagaattagttaagcgagggcatcgtttggttgcagatgaccgtgtggatgtctatgccaaagatgaagaaaccctttggggagagccagcagagatcttgcgccacttgcttgaaattcgtggggtaggtattattgatgtgatgtcgctttatggagctagtgctgtgaaggactcatcacaagttcaattggccatttaccttgaaaactttgaggctggtaaagtttttgatcgtctcggaaacggaaatgaggagataactttctcaggagtgagaatccctcgtattcgtattccggtaaaaacaggtcgaaatgtttcagtggttattgaagccgctgcgatgaatcatcgggctaaagaaatgggctttgatgctacaaaaacttttgaagatcgtttaactcaactaatcaccaaaaatgaggtgagtcaa

SEQ ID NO: 1118 - protein, 341 aa, Streptococcus pyogenes
LVSLFSFSSEKMSICKGLTVDLCYNIEKGEIMTVTVKMLVQKVKLDVVYATDNLLSKEITTSDISRPGLEMTGYFDYYAPERLQLFGMKEWSYLTQMTSHNRYSVLKEMFKKDTPAVVVSRNLAIPKEMVQAAKEEGISLLSSRVSTSRLAGEMSYFLDASLAERTSVHGVLMDIYGMGVLIQGDSGIGKSETGLELVKRGHRLVADDRVDVYAKDEETLWGEPAEILRHLLEIRGVGIIDVMSLYGASAVKDSSQVQLAIYLENFEAGKVFDRLGNGNEEITFSGVRIPRIRIPVKTGRNVSVVIEAAAMNHRAKEMGFDATKTFEDRLTQLITKNEVSQ

SEQ ID NO: 1119 - DNA, 183 bp, Streptococcus agalactiae
ttgaaacaagaagacaaggtcccagaagacgtaaagatgctgaacctgttgatgatgacggttggttctggtaattcatataaaggagatttgctagatgaatctccttttttcttagctttatttagaccactttttcaaaatatcttctttttttcagaaaaacgcgttagcgcttacttt

SEQ ID NO: 1120 - protein, 61 aa, Streptococcus agalactiae
MKQEDKVPEDVKMLNLLMMTVGSGNSYKGDLLDESPFFLALFRPLFQNIFFFSEKRVSAYF

SEQ ID NO: 1121 - DNA, 261 bp, Streptococcus agalactiae
atgaaatcaagcttctacaaacaacgaaaaggtaagttggtctgcggtgttgtcgccggtctagctgataagtataactgggatttagctctttcacgggtgttgattgcactgattttgtattttaccaaatttggtcttttgctatatattttattagctgttttcttaccctataaagaagatattattgaaacaagaagacaaggtcccagaagacgtaaagatgctgaacctgttgatgatgacggttggttctgg

SEQ ID NO: 1122 - protein, 87 aa, Streptococcus agalactiae
MKSSFYKQRKGKLVCGVVAGLADKYNWDLALSRVLIALILYFTKFGLLLYILLAVFLPYKEDIIETRRQGPRRRKDAEPVDDDGWFW

SEQ ID NO: 1123 - DNA, 270 bp, Streptococcus pyogenes
gtggaaactaaattctataaacagcgaaaaaatcgcttggttgcaggtgttattgctggtttagcagataagtatggttgggatcttgctctagcgcgtgtcttagcggctcttcttatttacggaactggttttggagttttgctttatattttgttggccatcttcttaccttacaaggaagacttgcttgaagaacgttatggccgaggtcctcgtcgtcgtaaagacgctgatgtcttaaatgaagaagaagatggttggttctgg

SEQ ID NO: 1124 - protein, 90 aa, Streptococcus pyogenes
VETKFYKQRKNRLVAGVIAGLADKYGWDLALARVLAALLIYGTGFGVLLYILLAIFLPYKEDLLEERYGRGPRRRKDADVLNEEEDGWFW

SEQ ID NO: 1125 - DNA, 2241 bp, Streptococcus agalactiae
ttgttagattataaaaacgctatcttgaaatcgctttttaaaactcttcgtaagtcaaaaatatgctataataaaagcgttatggaaaatttaaatattacacaaattgctattgatttaggtattaaagcgtcacaaatcgaaaaggttttagaattaacagatgaaggaaatactattccttttattgcccgttatcgtaaagaaatgacaggtaatttggatgaagttcaaatcaaatcaattattgaccttgataagagtatgacagctctttcagatcgtaaaactacggtcttagccaaaattgaagaacaaggaaagttgactcaagaactcaaaaaggctattgaagaagcaactaaactagcagatgttgaggaactctacctaccttataaagaaaaacgtcgtacgaaagctacgattgcacgtgaagcaggtctttttcctttagcacgtcttattttacaaaataaggataaccttgaggaagaagctcaaaactatcttacagatggttttgagacaactacgaaggcactttctggagcagtagatattcttatcgaagctttttctgaggataataaattacgttcatggacatataatgagatctggaactacagctcaatcactgcagttgttaaagatgagtcacttgatgaaaaacaggtcttcaaaatctactatgacttttctgaaaaaataagtaaactccatggctatcaagttttagcattgaatcgtggtgagaaaatgggtgttcttaaggttaattttgagcataaccttgaaaaaatgtttcgcttttttgctgttcgatttaaagaaactagccaatatatagatgaccttattgtacagactgtcaagaaaaaaatcgttccagctatggaacgccgtatccgtacagaactaagtgaaggagcagaagatggtgcaatttcactgttttcagagaatcttcgtaacttattgttagtctcaccgcttaaggggaaaatggtgttaggttttgaccctgcctttcgtacaggagcaaaattagcagtagtagaccaaactggaaaattaatgacaacacaagtgatttatccagttcctccagctaatcaagcaaaaatcgaacaatcaaaaatagagttagcaaaacttatcaaagaattcaatatagaaattattgctatagggaatggaacagcgagtcgtgaatcagaagcatttgttgcagaagttttacaagattttccagacgtatcctatgtgattgttaacgaaagtggtgcctctgtttattcagcctcagaattggcacgtcatgaatttccagacttaacggttgaaaaacgttcggccatctcaattgcaagacgtctgcaagacccattagcagaactagtcaaaattgatccaaaatctattggtgtgggtcaatatcaacatgatgttagccaaaaaaaattagcagaaaatcttgattttgttgttgaaactgtagttaaccaagtaggtgttaatgttaatacagcaagtccagccttgttagctcatgtttcaggtttaaataaaacaatatctgaaaatattgttaaatatcgtgaagagaatgggcaaattaagtcacgtgctgaaattaagaaagtgcccagattaggagcaaaagcttttgagcaagctgctggattcttacgtattcctaatgctaaaaatttcttggataatacaggtgttcaccctgagtcttatgaagctgttaaaaagttgcttgaccaactgactatcaaagaattagatgatcttgctaaagagaagttacaaaaccttgacttaattgcaacagcagaaagtattggggtaggtcaagaaacattaaaagacattatagaagatcttttgaaaccaggtcgtgatttgcgtgatgattttgaagcgcctgttttgagacatgatgttttagatgtcagtgatttaaaagttggacaggaattgcaaggaactgttcgaaacgtcgttgattttggtgcttttgttgatattggtgttcatgaagatggtctaatccaccagtctcgccttattaagcgaaaacgcgataaaaaaactagaaaaatgcctcctttacaacatccaagcaaatatctctctgttggtgatattgtaactgtttgggttgtagaggtagatgcggagcgtagcagaattggacttagtcttatcaagccagacggacttgac

SEQ ID NO: 1126 - protein, 747 aa, Streptococcus agalactiae
MLDYKNAILKSLFKTLRKSKICYNKSVMENLNITQIAIDLGIKASQIEKVLELTDEGNTIPFIARYRKEMTGNLDEVQIKSIIDLDKSMTALSDRKTTVLAKIEEQGKLTQELKKAIEEATKLADVEELYLPYKEKRRTKATIAREAGLFPLARLILQNKDNLEEEAQNYLTDGFETTTKALSGAVDILIEAFSEDNKLRSWTYNEIWNYSSITAVVKDESLDEKQVFKIYYDFSEKISKLHGYQVLALNRGEKMGVLKVNFEHNLEKMFRFFAVRFKETSQYIDDLIVQTVKKKIVPAMERRIRTELSEGAEDGAISLFSENLRNLLLVSPLKGKMVLGFDPAFRTGAKLAVVDQTGKLMTTQVIYPVPPANQAKIEQSKIELAKLIKEFNIEIIAIGNGTASRESEAFVAEVLQDFPDVSYVIVNESGASVYSASELARHEFPDLTVEKRSAISIARRLQDPLAELVKIDPKSIGVGQYQHDVSQKKLAENLDFVVETVVNQVGVNVNTASPALLAHVSGLNKTISENIVKYREENGQIKSRAEIKKVPRLGAKAFEQAAGFLRIPNAKNFLDNTGVHPESYEAVKKLLDQLTIKELDDLAKEKLQNLDLIATAESIGVGQETLKDIIEDLLKPGRDLRDDFEAPVLRHDVLDVSDLKVGQELQGTVRNVVDFGAFVDIGVHEDGLIHQSRLIKRKRDKKTRKMPPLQHPSKYLSVGDIVTVWVVEVDAERSRIGLSLIKPDGLD

SEQ ID NO: 1127 - DNA, 2130 bp, Streptococcus pyogenes
atggaaaataacaataatcacaacattgcagaggctttgtcagttagtctccatcaaattgaacaggtgcttgccctaacagcacaaggcaataccattccctttattgcacgttaccgtaaagaagtaacaggaaatctagatgaagtggtgattaagtccattattgatatggataagtctctcactaccctgaatgagcgcaaagcaaccattctcgctaaaattgaggaacagggaaaactgacagatcagttacgaacgagtattgaagcaaccgagaaactcgctgatttggaagagttgtacctgccttataaggaaaaacgccgtacaaaagcgacgattgcgcgtgaagcaggcttgttcccattagcacgtttgattttacaaaatgcgcaaaaccttgaaacagcagcagaaccctttgtcacagaaggatttgccagcccacaagaagctctagcaggagctgtggacatccttgtggaggccatgtcagaagatgctaaattacgctcttggacctacaatgagatttggcagtacagccgcttagtatcaacgcttaaagatgagcagttggatgagaaaaaggttttccaaatctattacgatttttctgaccaagtgtctaacatgcaaggatatcgtactttagcccttaaccgtggcgaaaagttaggcatcttaaaagtgtcttttgagcataacttggagaaaatgcaacgctttttcagtgtgcggttcaaagaaaccaacccttatattgaagaggtcatcaatcagaccatcaaaaagaaaattgttccagctatggaaagacgggttcgttcagaactcagtgatgccgcagaagatggggctatccacctcttttctgaaaatctccgtcatcttttgttagtgtctcctttaaaagggaaaatggttcttgggtttgaccctgcctttcgaacaggtgcaaaattggctatcgttgatcagactggaaaattgttgactactcaggttatttatcccgtagcaccagctagccaaacgaagattcaagcagctaaagaaacactgactcagctcattgagacttaccagattgatattattgccattggaaacggaacagccagtcgggaaagtgaagcctttgtagcagacgttttgaaagatttcccaaatacgtcctatgtcatcgttaacgaaagcggtgcttctgtttattcagcgtcagagttagcccgccatgagtttccagacctcacagtggagaagcgctctgctatttctattgctcgtcgcttgcaagacccactcgcagaattggttaaaattgatcctaaatctattggcgtcggtcagtaccagcacgatgtgagtcagaaaaagttgagtgagaatcttggttttgttgtggatactgtggttaaccaagtcggtgttaatgtgaacacggctagtccatctttattagcacatgtgtcaggtttgaacaaaacgatttcagaaaatattgtcaaataccgcgaagaaaatggagcactgacatcacgcgctgacatcaaaaaagtgccgcgtttaggagccaaggcgtttgagcaagcagcaggttttctcagaattccaggagccaaaaatattttagacaacacaggagttcaccccgagtcctacccagcagtcaaagaactctttaaggtacttggtattcaggacttggacgacgctgccaaggcaactttagcagcagttcaagttccccaaatggcagaaacattggctattgggcaggaaacccttaaagatatcattgctgatctccttaaaccgggtcgtgaccttcgtgatgactttgaagcaccaatcttacgtcaagatatccttgatttgaaagatttggaaattggccagaagcttgaaggaactgtgagaaacgtcgttgactttggtgcttttgtagacattggtgttcatgaagatgggcttattcacatttctgaaatgagcaaaacctttgtcaaccaccctagtcaagttgtttcagtgggtgacttggtaactgtttgggtctctaagattgacttggaccgccacaaggtcaatctcagcctattgccaccgcgtgacactcac

SEQ ID NO: 1128 - protein, 710 aa, Streptococcus pyogenes
MENNNNHNIAEALSVSLHQIEQVLALTAQGNTIPFIARYRKEVTGNLDEVVIKSIIDMDKSLTTLNERKATILAKIEEQGKLTDQLRTSIEATEKLADLEELYLPYKEKRRTKATIAREAGLFPLARLILQNAQNLETAAEPFVTEGFASPQEALAGAVDILVEAMSEDAKLRSWTYNEIWQYSRLVSTLKDEQLDEKKVFQIYYDFSDQVSNMQGYRTLALNRGEKLGILKVSFEHNLEKMQRFFSVRFKETNPYIEEVINQTIKKKIVPAMERRVRSELSDAAEDGAIHLFSENLRHLLLVSPLKGKMVLGFDPAFRTGAKLAIVDQTGKLLTTQVIYPVAPASQTKIQAAKETLTQLIETYQIDIIAIGNGTASRESEAFVADVLKDFPNTSYVIVNESGASVYSASELARHEFPDLTVEKRSAISIARRLQDPLAELVKIDPKSIGVGQYQHDVSQKKLSENLGFVVDTVVNQVGVNVNTASPSLLAHVSGLNKTISENIVKYREENGALTSRADIKKVPRLGAKAFEQAAGFLRIPGAKNILDNTGVHPESYPAVKELFKVLGIQDLDDAAKATLAAVQVPQMAETLAIGQETLKDIIADLLKPGRDLRDDFEAPILRQDILDLKDLEIGQKLEGTVRNVVDFGAFVDIGVHEDGLIHISEMSKTFVNHPSQVVSVGDLVTVWVSKIDLDRHKVNLSLLPPRDTH

SEQ ID NO: 1129 - DNA, 1041 bp, Streptococcus agalactiae
atgattgaattaggtattacaacattcggagagacaacaatccttgaagaaacaaaccaaagctattcacatcctgagaggattcgccaattagttgctgagattgaactagctgatcaagttggtttagatgtatatggtattggagagcaccatcgtgaagattttgcggtctctgcacccgaaattgtcctagcagcaggagcggttagaactaataatatccgtttatctagtgcagtaacgattctctcttccaatgatcctattcgcgtctaccagcaattttcaacgattgacgcactttcaaatggtagagcagaaattatggcagggcgtggttcctttattgagtcttttccattgtttggatacgatttagcggattatgatgatttatttaatgaaaaaatggatatgttgttagcaattaactcagcgacaaatctcgattggaaaggtcatttgacacaaacagttaatgagcgaccaatttatccaagagcattacagagacagttaccaatatgggtggcaacaggaggaaatgttgattctacaattcgtattgcagaacaaggtttgccaattgtttatgcaactattggtgggaatcccaaagcatttcgtcaattggtccatatttataaagaagttggtagtcgtaatggacacaaaccagaacaactaaaagttgctgctcactcttggggatggattgaagaggataatcaaaccgctattgaccgttattttttccctacgaaacagaccgtcgataatattgctaagggacgccctcattggtctgaaatgaccaaagagcagtatttacgttcagtaggtccagaaggtgctatttttgtaggaagtcctgaagtggttgcacataaaattataggacttgttgaagcacttgagttagaccgttttatgttacatctaccagttggctctatgcctcacaaagacgtcctaaatgctatcaaactttatggtaaggaagtagcaccaattgttcgaaaatattttgaaaagaat

SEQ ID NO: 1130 - protein, 347 aa, Streptococcus agalactiae
MIELGITTFGETTILEETNQSYSHPERIRQLVAEIELADQVGLDVYGIGEHHREDFAVSAPEIVLAAGAVRTNNIRLSSAVTILSSNDPIRVYQQFSTIDALSNGRAEIMAGRGSFIESFPLFGYDLADYDDLFNEKMDMLLAINSATNLDWKGHLTQTVNERPIYPRALQRQLPIWVATGGNVDSTIRIAEQGLPIVYATIGGNPKAFRQLVHIYKEVGSRNGHKPEQLKVAAHSWGWIEEDNQTAIDRYFFPTKQTVDNIAKGRPHWSEMTKEQYLRSVGPEGAIFVGSPEVVAHKIIGLVEALELDRFMLHLPVGSMPHKDVLNAIKLYGKEVAPIVRKYFEKN

SEQ ID NO: 1131 - DNA, 135 bp, Streptococcus agalactiae
gtgccattaatggctattacgcacaaacgtcaagatgacttagaaagtatgttcgctagttttgctaaagtaccaaaacctaaaaaagttgattctgattcaaaacctgaacagaaagatgattctcagaaagat

SEQ ID NO: 1132 - protein, 45 aa, Streptococcus agalactiae
MPLMAITHKRQDDLESMFASFAKVPKPKKVDSDSKPEQKDDSQKD

SEQ ID NO: 1133 - DNA, 153 bp, Streptococcus pyogenes
atggcaattacccataaaaaaaatgatgaacttgaaaaaatgctagcaggctttgcatcaatccctagttttgataagcctttggaagtcaatactgatggtaaactagcgaccaaagaaaaaacgacagaacaaacaaaaccaagcaaacca

SEQ ID NO: 1134 - protein, 51 aa, Streptococcus pyogenes
MAITHKKNDELEKMLAGFASIPSFDKPLEVNTDGKLATKEKTTEQTKPSKP

SEQ ID NO: 1135 - DNA, 240 bp, Streptococcus agalactiae
gtgtatgaaggcactttcttttcaaggaatcgattaataataggaatgataccacattcgcaagaaggaaagacaaagccaacgaaggttccaaataagactctgagaaatttatttttcggtaagaacttattgactatatcaggtgttataaagacttcaataattcctgataaaatagttccaagcaaaacaaaaggaagtgcctcaataataatggaaatgaaaatggcaaaccat

SEQ ID NO: 1136 - protein, 80 aa, Streptococcus agalactiae
MYEGTFFSRNRLIIGMIPHSQEGKTKPTKVPNKTLRNLFFGKNLLTISGVIKTSIIPDKIVPSKTKGSASIIMEMKMANH

SEQ ID NO: 1137 - DNA, 900 bp, Streptococcus agalactiae
atggatatctttaatcaattaccggatagtgtccttcaatggtttgccattttcatttccattattattgaggcacttccttttgttttgcttggaactattttatcaggaattattgaagtctttataacacctgatatagtcaataagttcttaccgaaaaataaatttctcagagtcttatttggaaccttcgttggctttgtctttccttcttgcgaatgtggtatcattcctattattaatcgattccttgaaaagaaagtgccttcatacacggcagttccgtttcttgctactgcccctattattaatcctattgttttatttgcgacctactcagcatttggaaattccatacgcttcctgatattacgctttgtaggtgctaccattgtagccattgctttaggagtcatgcttgcctttttagtagatgataatattctaaaagaagacgctaaacctactcattttcatgattattctgataagaagtggtatcaaaaaatctttctagccttagctcatgccatcgatgaattttttgatacaggacgctatctagtatttggtactttaattgcttcagctatgcaaatttatttaccaactcgagttcttactactatcggacatagccctatcacagccatcttagttatgatgttgcttgctttcatcttgtcattgtgtagtgaagctgacgcttttataggtgcttctttattatcaacctttggaatcgcgccagtgatggctttccttttaattggacccatgattgatattaagaatttaatgatgatggtaaattcttttaaaacaaggtttattgtccaattcattagtgtatcttctcttattattattatctattgtttatttgtgggggtaata

SEQ ID NO: 1138 - protein, 300 aa, Streptococcus agalactiae
MDIFNQLPDSVLQWFAIFISIIIEALPFVLLGTILSGIIEVFITPDIVNKFLPKNKFLRVLFGTFVGFVFPSCECGIIPIINRFLEKKVPSYTAVPFLATAPIINPIVLFATYSAFGNSIRFLILRFVGATIVAIALGVMLAFLVDDNILKEDAKPTHFHDYSDKKWYQKIFLALAHAIDEFFDTGRYLVFGTLIASAMQIYLPTRVLTTIGHSPITAILVMMLLAFILSLCSEADAFIGASLLSTFGIAPVMAFLLIGPMIDIKNLMMMVNSFKTRFIVQFISVSSLIIIIYCLFVGVI

SEQ ID NO: 1139 - DNA, 900 bp, Streptococcus pyogenes
atgtcactcttttccaaccttcctcccagtgtcttgcaatggtttgcgatttttatgtccattatcattgaagctcttccttttgtgctcctaggaactattttatctggttgtattgaagtctttgtaacgccagaattggttcaaaaatacctacctaagcaaaaatgcttgcgcattctgtttggaacctttgttggatttgtttttccttcttgtgaatgcgggattattcccatcatcaaccgctttttggaaaaaaaggtgcctagttatacggccgtcccttttctggcaacagcgcctatcattaatcctattgttttgttcgctacttattctgcttttgggaattctttgcgctttctgatacttcgcttggtcggtgctgcactagtagccattacacttggggtaatgttagcttttattgtagatgataacattctcaaggataatgctcaacccgtgcattttcatgattattctcatgaaagcttgccaaaacgcatttatctagcactggtacatgctattgatgaattcttcgacaccggtaggtatctcgtatttggaaccttgattgcctctgccatgcaaatatatgtcccaactcgtgtgttgacaacgattgggcacaatcccttgacagccattttgatcatgatgctgatggctttcattctatcattatgtagtgaagccgatgcctttatcggagcttccttattatccacctttggagtggctccagttcttgcctttcttttaattggtcctatggtggatattaaaaaccttatgatgatggtaaaggcttttaaaggacgcttcattgtccaatttatcggcgtatccgttcttatgattgccgtttattgtttacttgtgggggtgctc

SEQ ID NO: 1140 - protein, 300 aa, Streptococcus pyogenes
MSLFSNLPPSVLQWFAIFMSIIIEALPFVLLGTILSGCIEVFVTPELVQKYLPKQKCLRILFGTFVGFVFPSCECGIIPIINRFLEKKVPSYTAVPFLATAPIINPIVLFATYSAFGNSLRFLILRLVGAALVAITLGVMLAFIVDDNILKDNAQPVHFHDYSHESLPKRIYLALVHAIDEFFDTGRYLVFGTLIASAMQIYVPTRVLTTIGHNPLTAILIMMLMAFILSLCSEADAFIGASLLSTFGVAPVLAFLLIGPMVDIKNLMMMVKAFKGRFIVQFIGVSVLMIAVYCLLVGVL

SEQ ID NO: 1141 - DNA, 111 bp, Streptococcus agalactiae
ttggcagagactgtggttgagtctaaactaactgtaggtactaacaaacctactaaaacgggaaatactaaaatcattgggcttgttgatttagctattttaccatgtagg

SEQ ID NO: 1142 - protein, 37 aa, Streptococcus agalactiae
MAETVVESKLTVGTNKPTKTGNTKIIGLVDLAILPCR

SEQ ID NO: 1143 - DNA, 834 bp, Streptococcus agalactiae
ttgtttatttgtgggggtaatataatgattcgatttcttattcttgctggttattttgaattaagcatgtatttaaagttatcaggtaaactaaatcagtatattaatactcattatacctatttggcctatatttcaatggtcctatcttttattttagcaattgtacagctaattatttgggttaaaaatatgaaaatgcatagtcacctacatggtaaaatagctaaatcaacaagcccaatgattttagtatttcccgttttagtaggtttgttagtacctacagttagtttagactcaaccacagtctctgccaagggatataatttccctctagcagccggctctactggtactgtaagtcaagatgggacacgcgttcaatatttgaaaccagataccagcacttattttacttcttcagcctatgaaaaagaaatgcaaaaagagcttaaaaaatataaaggctctggtacattaaccatcacaactgaaaattacatggaagttatggaactaatttatctctatcccgagcaattcatggatcgccaaatacaatatactgggtttgtttataacgaacccaaacacgaaggatatcaatttattttccgctttggaatcattcattgtattgccgattcaggagtttatggtctactaacgactggaaatcaaaaaagttatccggacaatacttgggtaactgttagaggtacaattaaatccgagtataatcaattgttacaacaaaacttaccagtcttacacattgaagagtctcgtcaagtttctaaagctaataatccttatgtttatcgtgtcttt

SEQ ID NO: 1144 - protein, 278 aa, Streptococcus agalactiae
MFICGGNIMIRFLILAGYFELSMYLKLSGKLNQYINTHYTYLAYISMVLSFILAIVQLIIWVKNMKMHSHLHGKIAKSTSPMILVFPVLVGLLVPTVSLDSTTVSAKGYNFPLAAGSTGTVSQDGTRVQYLKPDTSTYFTSSAYEKEMQKELKKYKGSGTLTITTENYMEVMELIYLYPEQFMDRQIQYTGFVYNEPKHEGYQFIFRFGIIHCIADSGVYGLLTTGNQKSYPDNTWVTVRGTIKSEYNQLLQQNLPVLHIEESRQVSKANNPYVYRVF

SEQ ID NO: 1145 - DNA, 837 bp, Streptococcus pyogenes
ttgtttacttgtgggggtgctctaatgattcgctttttaattttagctggctattttgaactaaccatgtatctccagctgtctggcaaactggatcagtacatcaatgttcggtattcttaccttgcttatatttccatgattttatctttcattttagctcttgttcaactctatacctggatgaaaaacattaaggtacatagccatttaacaggaaaaatcgcaaggctgacgagtccttttatcttggtctttcctgttttgattggtctccttgtgccgaccgtgaccttagattccaccacggtttctgctaaaggctatactttcccattggctgcgggagcctctaaaacgggagtcagtgatgacggtaccaccattcaatacctcaaacctgataccagcctttactttacaaagtctgcctaccaaaaggagatgcgtcaagaactccataaatataaaggcaagaaaccggtcaccattaccactgaaaattatatggaagtgatggaattgatctatctctacccagatgagtttcttgatcgtgacatccaatacactggctttgtttataacgaaccgggccatgacaactaccaattccttttccgcttcggcattattcactgtattgccgactcaggagtgtacggacttttgaccacaggtaatcaaaccagctaccctaacaacacatggctaacagttaaaggtcgccttcatatggaatatgataaaaacttagaacaacatctacctgtccttcaacttgctgaggttcatcaaaccaaagaacctaataatccttatgtttaccgcgttttt

SEQ ID NO: 1146 - protein, 279 aa, Streptococcus pyogenes
LFTCGGALMIRFLILAGYFELTMYLQLSGKLDQYINVRYSYLAYISMILSFILALVQLYTWMKNIKVHSHLTGKIARLTSPFILVFPVLIGLLVPTVTLDSTTVSAKGYTFPLAAGASKTGVSDDGTTIQYLKPDTSLYFTKSAYQKEMRQELHKYKGKKPVTITTENYMEVMELIYLYPDEFLDRDIQYTGFVYNEPGHDNYQFLFRFGIIHCIADSGVYGLLTTGNQTSYPNNTWLTVKGRLHMEYDKNLEQHLPVLQLAEVHQTKEPNNPYVYRVF

SEQ ID NO: 1147 - DNA, 1608 bp, Streptococcus agalactiae
atgggattatttgaccgcctatttggacataagaaaaaagataaagaaccagaaattgaagcatcagaatctgttgttttagaagatgaagattcagttattgataaagaggagggcagcaacttttcgaaggagtcaactttgaatcgaacctctgaagtccctgttgcagaagatgattctttcttagaattagaaagagatacagcattgtcagaatcacatcaaccagttacctctgaaattcatcctttagagtcagaagataccgatgaaattcctgtaaaagaagacgatagttttttagaactagaagatagggctaagacaaaggtagcagatacttctgaggtagaaaatgtagttcctgattccacgactctttctgacaatgtttctgctaaatctgaggcatcttttagtgataaggagcaattaagtgatagtcaggcttcagatcagttttcagaaactccccttcaagaagagatgtctagtggaaaaactgaggtacaaacagagtcagaggatacatctgcggctgatgcttttttagcagattactatgctaaacgtaaagcaattgagaaagaaatctcgtctaattcgctgtcaacagatgagtcagaattttctgaggcacaggaagttttatcgcaatcacaggcagacactataaaagctgagagtcaagaggaaaaatataatcgtagcctgaaaaaaacacgcacaggttttagtgcacgccttaatgctttcctttctaacttccgtcgtgttgacgaagagttctttgaagaattagaagaaatgttaatcttatctgacgttggggtaaatgttgcaacacagttaaccgaagatcttcgttatgaagcaaaattagagaatgccaagaaatcagaggatttaaaacgtgttatcgttgaaaaattagttgaaatctacgaaaaagatggtatttataatgaggctatcaatttccaagaaggtttaaccgtaatgctttttgtaggtgttaatggtgttggaaaaacgacatctataggtaagttagctcatcaatacaagtctcaagggaaaaaagttatgttagtagcagctgatactttccgtgcaggtgctgtggctcaactagtagaatggggacgccgtgttgatgtaccagttgtcactggagaagaaaaagcagatccggctagcgttgtctttgatggcatggaaaaagccgttgctcaaggcgttgatgtcttgttaattgatacagcaggacgtctgcaaaataaagaaaaccttatggcagagttggaaaaaattggacgtattattaagcgtgtcgtacctgatgctccccacgaaactttgcttgctttagatgcatctacaggacaaaatgctttaagtcaagctaaagagttctcgaaaattacaccattaactggccttattctgactaaaattgatggtactgctaagggtggtgtggtactggctattcgtcaagaactagatattcctgttaaattcattggtttcggcgaaaaaatcgatgatattggtgaatttaattcagaagatttcatgcgtggccttctggaaggaatttta

SEQ ID NO: 1148 - protein, 536 aa, Streptococcus agalactiae
MGLFDRLFGHKKKDKEPEIEASESVVLEDEDSVIDKEEGSNFSKESTLNRTSEVPVAEDDSFLELERDTALSESHQPVTSEIHPLESEDTDEIPVKEDDSFLELEDRAKTKVADTSEVENVVPDSTTLSDNVSAKSEASFSDKEQLSDSQASDQFSETPLQEEMSSGKTEVQTESEDTSAADAFLADYYAKRKAIEKEISSNSLSTDESEFSEAQEVLSQSQADTIKAESQEEKYNRSLKKTRTGFSARLNAFLSNFRRVDEEFFEELEEMLILSDVGVNVATQLTEDLRYEAKLENAKKSEDLKRVIVEKLVEIYEKDGIYNEAINFQEGLTVMLFVGVNGVGKTTSIGKLAHQYKSQGKKVMLVAADTFRAGAVAQLVEWGRRVDVPVVTGEEKADPASVVFDGMEKAVAQGVDVLLIDTAGRLQNKENLMAELEKIGRIIKRVVPDAPHETLLALDASTGQNALSQAKEFSKITPLTGLILTKIDGTAKGGVVLAIRQELDIPVKFIGFGEKIDDIGEFNSEDFMRGLLEGIL

SEQ ID NO: 1149 - DNA, 1548 bp, Streptococcus pyogenes
atgggattatttgatcgtttatttgggaaaaaagaaaccccgaaggtagctgaggaaaagttagaagaaaatcttttgacagaaacaactcagaaagaggagctttctgaaaaagccaatgagcaagacaagattgaggcggttcaacaagaggacgtttcttcagagggcgcaggttcggtggaaaatggtcccgaagcagcttcagtaaacgcactggttgaggaagaaacaggtgacaatagtaatcatccatcagaagataccaatgagtttgctgccgacaaaacagaccttaaggtaagtgaacttagtcaatctacggcatcagaaccaaaagaccttgttgaccagccagttgtggaacagtttccaacaaaacaagcccaagctgatgcctcaaatgattcggcgaatgaagaagcagtagacacttcaaaagagcaatccagtagccaacaggttatggaagactactaccgtcgtaaggctgctcttgaaaaaagccttcaagaaaaagcagcggcaacggttccagtgatgccagaagaagttccacaagaaaatcaggcctctacctcagcagaagcttctcaaaacaaggcaacccacgataccattcctgagacagatcaagaaaaatacaagcgtagcttgaaaaaaacgcggactggcttctcagctcgtctgaacagtttctttgccaatttcaggcgagtggatgaagaattctttgaagacttggaagaaatgctgatcttatcagatgtcggtgtacatgtggcgacaactttgacagaggagttgcgttatgaagccaaactggaaaatgcgaaaaaaccagatgccttgaaacgtgtgattgtggaaaaattggtagatatctatgaaaaagatgggcgttataatgaagccattaattatcaagatggcttgacggttatgctttttgtaggtgttaacggggttggtaaaacgacttcaatcgggaagctggcttaccgttacaaacaagaaggtaaaaaagtcatgttggtggcagcagataccttccgagcaggggctgtggctcagctagtcgaatggggacgccgagtagatgtgccagtcattactggccctgaaaaggctgatccagcgtctgttgtttttgacgggatggaaaaagctgtggcaaaaggtgtagatattctcctgattgacacggctggtcgcctgcaaaacaaagaaaatctcatggcagagctggaaaaaatgggtcgtatcattaagcgcgtgctaccagatgcccctcatgaaacgcttttggccttagatgcgtcaacaggacaaaatgcgcttagccaagccaaggaattttcaaaaataacaccattaacaggtttgattttaacgaaaattgatggcacggccaaaggtggtgtagtcctagccatccgtcaagaattagacattccagtcaagtttatcggatttggtgaaaaagtggatgatattggagaattccactcagaagactttatgaaaggccttttggaaggtatctta

SEQ ID NO: 1150 - protein, 516 aa, Streptococcus pyogenes
MGLFDRLFGKKETPKVAEEKLEENLLTETTQKEELSEKANEQDKIEAVQQEDVSSEGAGSVENGPEAASVNALVEEETGDNSNHPSEDTNEFAADKTDLKVSELSQSTASEPKDLVDQPVVEQFPTKQAQADASNDSANEEAVDTSKEQSSSQQVMEDYYRRKAALEKSLQEKAAATVPVMPEEVPQENQASTSAEASQNKATHDTIPETDQEKYKRSLKKTRTGFSARLNSFFANFRRVDEEFFEDLEEMLILSDVGVHVATTLTEELRYEAKLENAKKPDALKRVIVEKLVDIYEKDGRYNEAINYQDGLTVMLFVGVNGVGKTTSIGKLAYRYKQEGKKVMLVAADTFRAGAVAQLVEWGRRVDVPVITGPEKADPASVVFDGMEKAVAKGVDILLIDTAGRLQNKENLMAELEKMGRIIKRVLPDAPHETLLALDASTGQNALSQAKEFSKITPLTGLILTKIDGTAKGGVVLAIRQELDIPVKFIGFGEKVDDIGEFHSEDFMKGLLEGIL

SEQ ID NO: 1151 - DNA, 822 bp, Streptococcus agalactiae
atgtcggatattaaaatacttgccttagatttagatggcactttatttacaacagataagaaagtttcagaagaaaataaagtggccttaaaagcagctagagaaaaaggtataaaagttgttattacaacagggcgtcctttaaaagcaattggtaatttgttagaggacctagagttagtatctgatgaagattacagcattacttttaacggtggtttagttcaacaaaatacagggaaaatcttagctaaaactgcaatgacacgacaagaagtggaagatatccatgaggagttgtatcaagtgggtttgccaacagatatcttaagtgagggaacggtatatagtatcgctaacaagggacaccattctcaatatcatttagccaacccgctcttagaatttatagaagttgatgatttagagcaagtgccaaaggatgtagtttataataaaattgttagtgttattgatgctacatatcttgatcaacaaattgctaaacttcctgatagacttaaagttgactatgaaatgtttaaatcacgtgatatcattttagaattgatgcctaaaggtgttcataaagcagtcggcttagaactactgacaaaacaccttgggttagatagtagtcaagttatggcaatgggagatgaagcaaatgatttatcaatgctagagtgggcaggcttaggagttgcaatggctaatggtattccagaagctaaggcaatagcaaaagcgacaactatttgtaataacgatgagtctggagtcgccgaagcaattgggaaatatattttaagtgaggaaaat

SEQ ID NO: 1152 - protein, 274 aa, Streptococcus agalactiae
MSDIKILALDLDGTLFTTDKKVSEENKVALKAAREKGIKVVITTGRPLKAIGNLLEDLELVSDEDYSITFNGGLVQQNTGKILAKTAMTRQEVEDIHEELYQVGLPTDILSEGTVYSIANKGHHSQYHLANPLLEFIEVDDLEQVPKDVVYNKIVSVIDATYLDQQIAKLPDRLKVDYEMFKSRDIILELMPKGVHKAVGLELLTKHLGLDSSQVMAMGDEANDLSMLEWAGLGVAMANGIPEAKAIAKATTICNNDESGVAEAIGKYILSEEN

SEQ ID NO: 1153 - DNA, 822 bp, Streptococcus pyogenes
atgaatattagaattttggcgcttgatttagacggtaccctctacaacactgaaaaaattgtcacagatgccaataaaaaagccttagcagcggctagagaaaaaggggttaaggtggttattaccacaggtcgccctctaaaggccatcggtaacttgctagaagagttggacttgcttgaccacgatgactacagtattacctttaatggggggttggttcagcgaaatacaggggaggttttggataagagttctctcagttttgaccaggtttgccagattcagcaagctttagaggcggttggcttaccaacagatattatcagtggtggggatgtgtatagcattccaagtaaggacggtaggcattcgcagtaccatctagctaacccactgttgacctttattgaggtgacatctgtagcggaactaccaaaagacattacctataacaaaattgtgacagtcaccgatccagactttttggatcagcagattataaagctatccccaagcttatttgaggattttgaagcctttaaatcacgagatattatttttgaaatcatgccaaaaggcattgataaagcttttggattaaacttgctttgtcagcaccttggccttgatgctagacatgtcatggctatgggagacgaagctaacgactttgcgatgttagaatgggcaggacttggagtagctatggctaatggtgtttcaggagctaaagccgatgccgatgccgtgaccaccttgaccaatgatgagtctggagttgcagaagctgtgaagacatttattttagaagaggagagt

SEQ ID NO: 1154 - protein, 274 aa, Streptococcus pyogenes
MNIRILALDLDGTLYNTEKIVTDANKKALAAAREKGVKVVITTGRPLKAIGNLLEELDLLDHDDYSITFNGGLVQRNTGEVLDKSSLSFDQVCQIQQALEAVGLPTDIISGGDVYSIPSKDGRHSQYHLANPLLTFIEVTSVAELPKDITYNKIVTVTDPDFLDQQIIKLSPSLFEDFEAFKSRDIIFEIMPKGIDKAFGLNLLCQHLGLDARHVMAMGDEANDFAMLEWAGLGVAMANGVSGAKADADAVTTLTNDESGVAEAVKTFILEEES

SEQ ID NO: 1155 - DNA, 795 bp, Streptococcus agalactiae
atgataaaattagtagcaaccgatatggacggtacattcttagatgaaaacggtacctatgataaaaaacgtttagcaaatgtgctaaaaaaatttaaagaacaaggaattgtctttacggcagcaagtgggcgttccttattatcacttgaacaattatttgctgactttcgtgatcagatggcttttatagcagaaaacggaagtgcagcagtcttatttaatcgcttggcatatgaacagcacttgagtcgagaacaatacttagatattattgaccatttgagtaagagcccttatatggagaataatgaatatgtcttatctggcaaggatggtgcatatattctaagtgatgccaatccagattatattgaattcatcactcattattatgataatttgcaaaaagtttctcactttgaagatgttgatgatattattttcaaagtaacggctaactttactgaagagactgttagacaagctgaggagtgggtaaatcaagctataccgtatgccacagcagtgacaacaggttttaaatccattgatattattctaagctcagttaataaacgaaatggtttagagcacctctgtgaacaatacggtattagagcagaagaagtcttatcttttggtgacaatattaatgatttagaaatgctagagtggtcaggaaaagctatcgcaacagaaaatgctagaccagaagttaaagagatagcagattgtattataggtcatcacaataatcaagctgtaatggcttatttagaaagtatggtggat

SEQ ID NO: 1156 - protein, 265 aa, Streptococcus agalactiae
MIKLVATDMDGTFLDENGTYDKKRLANVLKKFKEQGIVFTAASGRSLLSLEQLFADFRDQMAFIAENGSAAVLFNRLAYEQHLSREQYLDIIDHLSKSPYMENNEYVLSGKDGAYILSDANPDYIEFITHYYDNLQKVSHFEDVDDIIFKVTANFTEETVRQAEEWVNQAIPYATAVTTGFKSIDIILSSVNKRNGLEHLCEQYGIRAEEVLSFGDNINDLEMLEWSGKAIATENARPEVKEIADCIIGHHNNQAVMAYLESMVD

SEQ ID NO: 1157 - DNA, 795 bp, Streptococcus pyogenes
atgataaaactaatagcaacagatatggatggtactttcctagctgaagatggtacttataatcaagagcaactagctgcgctcttgccaaagttagccgaaaaaggcattttatttgcggtttcgagtggccgctcgctcttagccattgatcagctctttgagccctttttggatcagattgctgttattgcagaaaatggttccgtggttcaataccgtggtgagattctatttgcagatatgatgaccaaagagcagtataccgaagttgcaaaaaagattttagccaatcctcactatgtagaaacaggtatggttttttctgggcaaaaggcagcctatattttaaaaggcgcatcagaagagtacattcaaaaaacaaaacattactatgctaatgttaaggttattaatggttttgaagatatggagaatgacgccatttttaaagtttctaccaacttcacaggccataccgtcttagaaggaagcgattggttgaatcaagccctcccttatgccactgcagtgaccaccggctttgattccattgatattatcttaaaagaggtgaataagggctttggtatggagcatctttgtcaagccttgggcattaagaaagcagaaacgattgcttttggggataattttaatgattaccagatgttggagtttgctggtagggctattgctacggaaaatgcaagacctgaaatcaaagtgatttcagaccaagtcattggccactgtaatgacggagcagtactaacgtatttaaaaggactagtg

SEQ ID NO: 1158 - protein, 265 aa, Streptococcus pyogenes
MIKLIATDMDGTFLAEDGTYNQEQLAALLPKLAEKGILFAVSSGRSLLAIDQLFEPFLDQIAVIAENGSVVQYRGEILFADMMTKEQYTEVAKKILANPHYVETGMVFSGQKAAYILKGASEEYIQKTKHYYANVKVINGFEDMENDAIFKVSTNFTGHTVLEGSDWLNQALPYATAVTTGFDSIDIILKEVNKGFGMEHLCQALGIKKAETIAFGDNFNDYQMLEFAGRAIATENARPEIKVISDQVIGHCNDGAVLTYLKGLV

SEQ ID NO: 1159 - DNA, 114 bp, Streptococcus agalactiae
atgacaaatggaattgtcttaacacggataatggcaaataataatgctaacgctgataatgctttttcaccacctgacatcaagtttaaagactggatttttttaccaggaggt

SEQ ID NO: 1160 - protein, 38 aa, Streptococcus agalactiae
MTNGIVLTRIMANNNANADNAFSPPDIKFKDWIFLPGG

SEQ ID NO: 1161 - DNA, 3537 bp, Streptococcus agalactiae
atgtttttaaaagaaattgaaatgcaaggctttaagtcctttgcggataaaactaaggtagaatttgatcaaggagttactgctgttgtaggtccaaatggatcaggtaaaagtaatatcacagagagtttacgttgggcattgggagaatcaagcgcaaaaagtttacgaggaggtaagatgccagacgttatatttgctggtacagaaaatcgtaagccccttaattatgcgcaagtgagtgttactttagataatagcgaccattttatcgaaaatatagctgacgaagttcgagttgaacgtcgtatttttcgaaacggagatagtgaatatttaatagatggacgcaaagttcgcttacgtgatattcatgatttatttatggatactggattaggaagagattctttttctattatttcccaaggacgcgttgaagctatttttaatagtaaaccagaagagcgccgtgccatatttgaagaagccgctggtgttctgaaatacaaaacacgtaagaaagaaacacaatccaaattagaacaaactcaagggaacttagatcgcttagaggatattatttatgaattggacatgcaagtccaaccattagaaaaacaagcaagtattgccaagcgttttttagtattagatgaggaacgacaaggactccacttatctattttgattgaagatattttacaacatcaatcagatttaactactgttgaggaaaagctattgacagtaagaaaagagttagcaacttattaccaacaacgtcagtcccttgaagatgaaaatcaatcgttaaaacagaaacgtcaccatttatctgaagaaattgaggctaaacagttagctcttttagacgttacaaagttaaagtcagatttggaacgccaaattgatctgattcgtttagagtcaaaccaaaaggctgaaaaaaaagaagaggcaggtcaacgcttagcagagttagaaattaaagctaaagattgtagtgaccagattacccaaaaaaatatagagttaactactctgtcggaaaaaatagcccaaataagatcagaaattgttagtacagaaagttccttggagcgtttttcaactaatccggatcagattattgaaaaacttcgagaagactttgttaccttgatgcaagaagaagccgacacttcaaacgctttaacagctttactagctgatatagagaatcaaaaacaagcttctcaagctaaatctcaagaaatacaagaagttagcaaaaatttagaagtattaaaaagtaacgcaaaggtagcattggaacgatttgaggctgcaaagaagaatgttcgtcagttattatctcactaccaagatttaggtcaaaccttgcaaaatctagaaggtgagtataagaatcagcagtcaattttatttgatcatttagatgaaatcaaatcaaagcaagcacgtatttcgagtttagaatctattttgaaaaatcatagtaatttctatgctggagtgaagtcagttctacaggctaaggaccagcttggaggtatcataggtgctgttagtgagcatcttagctttgacaaacattaccaaacagcattggagatagctttgggaggtagcagccaacacatcattgttgaagacgagagtgctgccaaacgttcaattgcttttttaaagaaaaaccgccaaggtagagcgacatttctgcctttaactacaataaaaccaagagaattagcacaacattatctctcaaaattacaaagttctcaagggtttttaggaatagctagtgaattggtaacctatgatcaacgcttgtcaaacatttttaaaaataacttagggttaactgctatttttgatacggttgataatgctaatgtagctgcgagacaattgaattatcaagtacgtttagtaaccttagatggaacagagttacgccctggagggtcgtactcagggggagcaaatcgtcaaaataatactgtttttatcaagcctgaattggataatctaaaaaaagaattgaaacaggcacaaagtaaacaattaattcaagaaaaagaagttgccacattgttagagcaactcaaagagaaacaagaaaccttagcacaacttaagaatgatggagaacaagctcgtcttgaggaacaaagagctgatatagagtatcaacaactatcagaaaagcttgctgatttaaataaactatataatggcttgcaattaagcagcggggcgttggaacaaactacttctgaaaatgaaaaaaatcgtttagaaaaagaacttgaacaatttgctattaaaaaagaagagttgacaacttcaattgctcaaattaaggaagataaagattcaattcaagaaaaagtcaataatctaacaacattattgtcagaggcacagctagaagaacgtgatttgctaaacgagcagaaatttgaacgtgccaactgtacacgtctagagattaccttgtctgaaataaaacgtgacattagtaatttacaaacattactaagccatcaggacagtcaattagacaaagaagagcttccacgtatagaaaaacagttgctacaagtaaataatagaagagaaaatgacgaagaaaagcttgtgagtctccgttttgaattggaggattgtgaagctgctttagatgatttagctgcttctctggctaaagagggacaaaaaaatgaaagtcttattcgtcagcaagctcaattagagtcacaatgtgaacaattatctcaacaattgatgatattctcacgtcaattatcagaagactatcagatgacattggatgaagcgaaggtaaaagcaaatgtcttggaagatattttgatggcgcgtgaacaattgaaatctctacaagctaaaattaaagctttaggacctgttaatattgatgcaattgctcaatttgaagaagttcatgaacgattgaccttccttaacacacagcgagacgacttagttcatgccaaaaatttattactagagacgattacagatatggatgatgaagttaagactcgttttaaatcgacatttgaagccattcgtcatagtttcaaagaaacctttgtacagatgtttggtggaggttctgcggaccttattctgacagaaggtgatttattatcagctggggttgatatttcggttcaacctcctggtaaaaaaatccagtctttaaacttgatgtcaggtggtgaaaaagcattatcagcgttagcattattatttgccattatccgtgttaagacaattccatttgtcatcttggatgaagttgaggccgctttagatgaagcaaatgttaagcgatttggcgattatcttaatcgatttgataaatcaagtcaatttatcgttgttactcaccgaaaagggactatgtctgctgctgatagtatctatggggtaacgatgcaagaatcaggcgtttccaaaattgtttctgtaaaattaaaagaagctcaagaaatgaccaat

SEQ ID NO: 1162 - protein, 1179 aa, Streptococcus agalactiae
MFLKEIEMQGFKSFADKTKVEFDQGVTAVVGPNGSGKSNITESLRWALGESSAKSLRGGKMPDVIFAGTENRKPLNYAQVSVTLDNSDHFIENIADEVRVERRIFRNGDSEYLIDGRKVRLRDIHDLFMDTGLGRDSFSIISQGRVEAIFNSKPEERRAIFEEAAGVLKYKTRKKETQSKLEQTQGNLDRLEDIIYELDMQVQPLEKQASIAKRFLVLDEERQGLHLSILIEDILQHQSDLTTVEEKLLTVRKELATYYQQRQSLEDENQSLKQKRHHLSEEIEAKQLALLDVTKLKSDLERQIDLIRLESNQKAEKKEEAGQRLAELEIKAKDCSDQITQKNIELTTLSEKIAQIRSEIVSTESSLERFSTNPDQIIEKLREDFVTLMQEEADTSNALTALLADIENQKQASQAKSQEIQEVSKNLEVLKSNAKVALERFEAAKKNVRQLLSHYQDLGQTLQNLEGEYKNQQSILFDHLDEIKSKQARISSLESILKNHSNFYAGVKSVLQAKDQLGGIIGAVSEHLSFDKHYQTALEIALGGSSQHIIVEDESAAKRSIAFLKKNRQGRATFLPLTTIKPRELAQHYLSKLQSSQGFLGIASELVTYDQRLSNIFKNNLGLTAIFDTVDNANVAARQLNYQVRLVTLDGTELRPGGSYSGGANRQNNTVFIKPELDNLKKELKQAQSKQLIQEKEVATLLEQLKEKQETLAQLKNDGEQARLEEQRADIEYQQLSEKLADLNKLYNGLQLSSGALEQTTSENEKNRLEKELEQFAIKKEELTTSIAQIKEDKDSIQEKVNNLTTLLSEAQLEERDLLNEQKFERANCTRLEITLSEIKRDISNLQTLLSHQDSQLDKEELPRIEKQLLQVNNRRENDEEKLVSLRFELEDCEAALDDLAASLAKEGQKNESLIRQQAQLESQCEQLSQQLMIFSRQLSEDYQMTLDEAKVKANVLEDILMAREQLKSLQAKIKALGPVNIDAIAQFEEVHERLTFLNTQRDDLVHAKNLLLETITDMDDEVKTRFKSTFEAIRHSFKETFVQMFGGGSADLILTEGDLLSAGVDISVQPPGKKIQSLNLMSGGEKALSALALLFAIIRVKTIPFVILDEVEAALDEANVKRFGDYLNRFDKSSQFIVVTHRKGTMSAADSIYGVTMQESGVSKIVSVKLKEAQEMTN

SEQ ID NO: 1163 - DNA, 3537 bp, Streptococcus pyogenes
atgtttttaaaagaaattgagttggaagggttcaagtcctttgcggacaagactaaaattgaatttgataagggagtaactgcagtcgtaggaccaaatggttcaggtaaaagtaatattacagaaagtttacgttgggctttaggagaatcaagtgctaaaaatctgcgtgggggcaagatgccagatgtcatttttgctgggacacaaaaccgtaatcctctaaactatgctaaggtagcggttgttcttgataattccgatcattttataaaaactgccaagaaagaaatccgtgtcgaaaggcatatttaccgaaatggagatagtgactatctgattgatggtcgcaaggtaaggctccgtgatattcatgatttgtttatggatacagggcttggtcgtgattctttctccattatttctcaaggtcgcgtagaggaaattttcaatagtaaacctgaagaaaggcgcgccatttttgaagaagcagctggtgttttaaaatataaaacacgtaaaaaagaaactcagattaaattaaatcaaactcaagataatttagaccgtctagaggatattatttatgagctagacacgcagttggcaccacttgaaaagcaagctaaagtagctaaacaatttttagaacttgatgccaatcgtaagcaactacaactagatattctagtcaaagatattgatatagctcaagaaagacagactaaagatactgaagctttagctgctttacaacaagacttagcatcttattacgctaagcgtcaatctatggaagaagattaccaaaaattcaagcaaaaaaagcaggttcttagtcaagagtcagatcaaacccaaacaacattattagaattaaccaagctaatagctgacttggaaaagcaaattgaattggttaagctagaaagtggccaagaagcagagaaaaaggcagaagccaaaaaacatctcgaacagttacaagaacaattggatggttttcaagcagaagaaaagcagtgtacagaacaattattgcatattgatcaacaactttgtgatgtcaaacaacagttaaacgaattgagcaatgcattagagcgtttttcaagtgatcccgaccaattaatggaaactctaagagaagagtttgtattattgatgcaaaaagaggcggccttatcaaatcagctgacagctttaaaagcccatttagacaaagaaaaacaggctcgtcaacataaggctcaagaatatcagctacttgttactaagcttgatcaacttaatgacgagtctcaaaaagctcaagctcattataaagctcaaaaagagcaagtcgaaatgttgctccaaaattatcaagaaggtgataaacgcgttcaggaattagaaagagattaccaactgaatcaagaaagactatttgacttgttggatcaaaaaaaaggaaaagaagctcgtaaggctagcttagaatctattcaaaaaagtcatagtcaattctatgcgggagtacgagctgtccttcaatcacaaaaaaagcttggagggatcataggtgcagtcagtgaacacctttcttttgattctgattaccaaacagctcttgaagttgcattaggtgctaatagtcagcatattattgtaacagacgaagctgcagcaaaaagagcaattgcttatttgaaaaaaaatcgccaaggacgagcaacttttttacctttaactactataaaggctagatcattatcagaacactatcatcgtcaattggcgacttgtgaaggttatctgggaactgcagaatcattgattcgctatgatgatagtctttcagctattatccaaaatcttttatctagtactgctatctttgaaactattgatcaagctaatattgcagcgcgcttattaggatataaggtaagaattgttactcttgatggaacagaattacgaccaggtggttctttttcaggaggagctaatagacaaagcaatacaacttttatcaaaccagagttagaacaaatcagtgaggaattaacgcgattagttgagcaattaaaaataactgaaaaagaagtagctgccttgcaaagcgatttgatagcaaaaaaagaagaactgacacaattgaaattagccggtgaccaggcacgcttagctgaacaaagagctcaaatggcttatcagcaattgcaagaaaaacaagaagattcaaaggctttgttagctgcccttgatcaaagtcagacgactcattctgatgaatctttattggcagaacaagctcgtattgaagaagcattaacagctattgctaagaaaaaaaatgccttaacttgtgatattgatgatatcaaagaaaacaaagatttgattaggcaaaaaacacaaaacattcaccaagctttatctcaagctcgtttgcaagaaagagatttacttaatgaaaagaaatttgagcaagctaatcaatctcgtctaagaactcagctgaagcaatgccagcaaaatattctcaaacttgaaagcatactaaacaataacgtaagtcaagacagcattcaaagactaccccagtggcaaaaacagttacaagatgccacagagcataagtctggtgctcaaaaacgtttagtccaattaagatttgaaatagaggactatgaggcccgcttagaagaaacagcagaaaaaataaccaaagaaagcgaaaaaaatgacacatttattcgtcgtcaaaccaagttagagacacatttagagcaagtggctaatcgcttacgagcctatgctaaaagtttatcagaagattttcaaatgacactagcagacgcaaaggaggtaacaaatagtattgatcacttagaaagtgccaaagaaaaattacaccatttacaaaagactattcgtgcactaggaccaattaatagtgatgctattaatcagtatgaggaagtgcatgagcgtttgacttttttaacaagtcaaaagacagatctgacaaaagctaaaaatcttttgctagagactattaatagtatggatagcgaagtgaaggctcgtttcaaagtgacttttgaggcaattcaaaaaagttttaaagaaacctttactcagatgtttggtgggggttctgctgatttggttttaacggaaacagacctcttgtctgctggtatagagatttctgtgcagcctcctggtaagaaaattcaatctcttaacttgatgtcaggcggagaaaaagctttgtcagcactggctttattgtttgctattatacgtgttaaaacgattccgtttgtgattttagatgaggtagaagcggctcttgatgaagcaaatgttaagcgctttggggatttcctcaatcgctttgacaaagatagtcaatttattgtcgtgacccatcgtaaaggaacaatggctgcagcagatagtatttatggaattaccatgcaggaatcgggggtctctaaaattgtatctgtaaaattaaaagaagctcaagagatgaccaat

SEQ ID NO: 1164 - protein, 1179 aa, Streptococcus pyogenes
MFLKEIELEGFKSFADKTKIEFDKGVTAVVGPNGSGKSNITESLRWALGESSAKNLRGGKMPDVIFAGTQNRNPLNYAKVAVVLDNSDHFIKTAKKEIRVERHIYRNGDSDYLIDGRKVRLRDIHDLFMDTGLGRDSFSIISQGRVEEIFNSKPEERRAIFEEAAGVLKYKTRKKETQIKLNQTQDNLDRLEDIIYELDTQLAPLEKQAKVAKQFLELDANRKQLQLDILVKDIDIAQERQTKDTEALAALQQDLASYYAKRQSMEEDYQKFKQKKQVLSQESDQTQTTLLELTKLIADLEKQIELVKLESGQEAEKKAEAKKHLEQLQEQLDGFQAEEKQCTEQLLHIDQQLCDVKQQLNELSNALERFSSDPDQLMETLREEFVLLMQKEAALSNQLTALKAHLDKEKQARQHKAQEYQLLVTKLDQLNDESQKAQAHYKAQKEQVEMLLQNYQEGDKRVQELERDYQLNQERLFDLLDQKKGKEARKASLESIQKSHSQFYAGVRAVLQSQKKLGGIIGAVSEHLSFDSDYQTALEVALGANSQHIIVTDEAAAKRAIAYLKKNRQGRATFLPLTTIKARSLSEHYHRQLATCEGYLGTAESLIRYDDSLSAIIQNLLSSTAIFETIDQANIAARLLGYKVRIVTLDGTELRPGGSFSGGANRQSNTTFIKPELEQISEELTRLVEQLKITEKEVAALQSDLIAKKEELTQLKLAGDQARLAEQRAQMAYQQLQEKQEDSKALLAALDQSQTTHSDESLLAEQARIEEALTAIAKKKNALTCDIDDIKENKDLIRQKTQNIHQALSQARLQERDLLNEKKFEQANQSRLRTQLKQCQQNILKLESILNNNVSQDSIQRLPQWQKQLQDATEHKSGAQKRLVQLRFEIEDYEARLEETAEKITKESEKNDTFIRRQTKLETHLEQVANRLRAYAKSLSEDFQMTLADAKEVTNSIDHLESAKEKLHHLQKTIRALGPINSDAINQYEEVHERLTFLTSQKTDLTKAKNLLLETINSMDSEVKARFKVTFEAIQKSFKETFTQMFGGGSADLVLTETDLLSAGIEISVQPPGKKIQSLNLMSGGEKALSALALLFAIIRVKTIPFVILDEVEAALDEANVKRFGDFLNRFDKDSQFIVVTHRKGTMAAADSIYGITMQESGVSKIVSVKLKEAQEMTN

SEQ ID NO: 1165 - DNA, 726 bp, Streptococcus agalactiae
ttgtttaatattttatctatgattgaaatcaaggagaaaaaaatgaaagaattaagatcaaagctggaaaaagactatggtattgtttttgctaatcaagaattattagatacagcttttacccatacatcatacgcaaatgagcatcgcctcctaaacatttcacataatgaacgtttggaatttttaggagacgctgttctacaattacttatttcacagtatctttttacaaagtaccctcaaaaggcagaaggtgatttatcaaaattacgttcaatgattgttcgtgaggaaagtcttgcaggtttttcacgtctatgtggctttgatcactatattaaacttggaaaaggagaagaaaaatctggtggacgtaatcgtgacactattttaggagatttatttgaggcttttttaggagctttattattagacaaaggtgttgaagtggttcatgcctttgttaacaaggtaatgatccctcacgttgaaaaagggacctatgagcgtgttaaagattacaagacaagcttgcaagaattacttcaatctcatggggatgtaaaaatagattatcaagttactaatgaaagtggtccagcacatgcaaaggaatttgaggtgactgtatctgtcaaccaagaaaatttgagccaaggaattggacgatcaaagaaagctgctgaacaagacgctgccaaaaatgctttagcaacgttacaa

SEQ ID NO: 1166 - protein, 242 aa, Streptococcus agalactiae
MFNILSMIEIKEKKMKELRSKLEKDYGIVFANQELLDTAFTHTSYANEHRLLNISHNERLEFLGDAVLQLLISQYLFTKYPQKAEGDLSKLRSMIVREESLAGFSRLCGFDHYIKLGKGEEKSGGRNRDTILGDLFEAFLGALLLDKGVEVVHAFVNKVMIPHVEKGTYERVKDYKTSLQELLQSHGDVKIDYQVTNESGPAHAKEFEVTVSVNQENLSQGIGRSKKAAEQDAAKNALATLQ

SEQ ID NO: 1167 - DNA, 690 bp, Streptococcus pyogenes
atgaaacagcttgaagagttactctcaacatcttttgatattcaatttaatgatttgactttactagaaacagcttttacccacacctcttacgctaacgagcatcgtctcctaaacgtttcacataatgaacgcttggaatttttaggagacgctgttctacaattgattatttcagagtatttatttgcaaagtatcctaaaaagacagaaggagatatgtctaagttacgttccatgattgtacgtgaggaaagcttggcaggtttttcacgattttgttcttttgacgcttatatcaaactaggaaaaggtgaggaaaagtcaggtggtcgccgtcgtgatactattttaggagacttatttgaagcctttttaggtgctcttttattagataaggggattgatgcagtacgtcgcttcttgaaacaagtcatgattcctcaggtggaaaaagggaattttgaaagggttaaagactataaaacttgtcttcaagagtttttgcaaacaaaaggtgatgtggctattgattatcaagtcattagtgagaaaggacctgcccatgctaaacaatttgaggtatcgatagttgttaatggtgctgtccttagtaaaggtttaggtaagtctaaaaaattagcggagcaagatgctgctaaaaatgcccttgcccaacttagtgaggtt

SEQ ID NO: 1168 - protein, 230 aa, Streptococcus pyogenes
MKQLEELLSTSFDIQFNDLTLLETAFTHTSYANEHRLLNVSHNERLEFLGDAVLQLIISEYLFAKYPKKTEGDMSKLRSMIVREESLAGFSRFCSFDAYIKLGKGEEKSGGRRRDTILGDLFEAFLGALLLDKGIDAVRRFLKQVMIPQVEKGNFERVKDYKTCLQEFLQTKGDVAIDYQVISEKGPAHAKQFEVSIVVNGAVLSKGLGKSKKLAEQDAAKNALAQLSEV

SEQ ID NO: 1169 - DNA, 366 bp, Streptococcus agalactiae
ttgaaaaagattttttacattagtttaggatttattagtttagggataggcattgcaggtattgtcttgccggtagttccaacgactccattagtattgctttcagctttttgcttttcgagaagctctgaaaaatttgatatttggttgcgtcaaactaaagtttataaatactacgctgcagattttgttgaaagcagaagtattgccccagcgcgtaaaaagtcaatgatttggcaaatttatatcttgatgggaatttcaatctattttgctcctctaatgtggctcaaactgggattattgattggaactattgtaggaacttatgtgcttttttatgtagtacctgataaaattgatgaa

SEQ ID NO: 1170 - protein, 122 aa, Streptococcus agalactiae
MKKIFYISLGFISLGIGIAGIVLPVVPTTPLVLLSAFCFSRSSEKFDIWLRQTKVYKYYAADFVESRSIAPARKKSMIWQIYILMGISIYFAPLMWLKLGLLIGTIVGTYVLFYVVPDKIDE

SEQ ID NO: 1171 - DNA, 807 bp, Streptococcus agalactiae
atgtcagaaataggatttaaatatagtatcttagcttcaggttcaactggaaattgtttttatattgagacaccccaaaaacgtcttttaattgacgctggtttaacaggcaagaaagtgactagccttcttgcagaaattaatcgtaaaccagaagatttagatgctatactagttacccatgaacattctgaccacattaaaggtgttggcgtattggctaggaaatatcaccttgatatttatgccaatgagcagacgtggaaagttatggatgagcgtaacatgttaggcaaagttgatgttagtcaaaagcatgtttttggacgcggtaaaaccttaactttcggggatttagatattgagagctttggtgtaagtcatgatgctgtggatccccaattttaccgtatgatgaaagatgataagagctttgtgatgttgacagatacaggatatgttagcgaccgaatggcaggcttgattgagaatgcagatggttatttgatcgagtcaaatcacgacattgagattctacgttcgggttcttatccttggacacttaagcaacgtattttatcagataaaggacatttatctaatgaagatggttcagaaaccatgattcgcactataggtaaccgtactaaacacatctatttaggacacttgagtaaggaaaataatattaaggaacttgctcacatgactatggaaaacaatttaatgagagctgactttggtgtgggcacagatttttctgttcacgatacttcacctgattcagctaccccactgacgaggatt

SEQ ID NO: 1172 - protein, 269 aa, Streptococcus agalactiae
MSEIGFKYSILASGSTGNCFYIETPQKRLLIDAGLTGKKVTSLLAEINRKPEDLDAILVTHEHSDHIKGVGVLARKYHLDIYANEQTWKVMDERNMLGKVDVSQKHVFGRGKTLTFGDLDIESFGVSHDAVDPQFYRMMKDDKSFVMLTDTGYVSDRMAGLIENADGYLIESNHDIEILRSGSYPWTLKQRILSDKGHLSNEDGSETMIRTIGNRTKHIYLGHLSKENNIKELAHMTMENNLMRADFGVGTDFSVHDTSPDSATPLTRI

SEQ ID NO: 1173 - DNA, 807 bp, Streptococcus pyogenes
atgaatgagagtggttttaaatacagtattttagcatctgggtccacaggaaattgtttttatttagaaacacctaaaaaacgcttattgattgatgcagggcttactggtaagaaaattaccagtcttcttgctgaaattgaccgcaaacctgaggatttggatgctattttgattacccatgagcactctgaccatattaagggtgtaggcgttatggcccgcaaataccatttggatatctatgctaatgaaaaaacatggcagctgatggatgagtgcaatatgctaggtaagcttgatgcctcacaaaaacatattttccaaagggataaagttttgacctttggagatgttgatatcgaaagttttggagtcagccatgacgctattgatcctcaattttatcggattatgaaagataataagtcttttgtgatgttgacagatacaggatatgtcagtgataggatgacaggtattattgaaaatgcagatggctacttgattgaatccaatcatgatattgaaattttgagatcaggctcttatccttggagcttaaagcagcgtattttatctgatttaggacatttatcaaatgaagatggagcgggagccatgattagaagcctggggtacaataccaaaaaaatatacctaggtcatctgagtaaagaaaataacatcaaagagttagcgcatatgacgatggtcaatcaactggctatggcagatttagcagtaggtacagactttacggtccatgatacctctccagatactgcttgtccattaactgatatt

SEQ ID NO: 1174 - protein, 269 aa, Streptococcus pyogenes
MNESGFKYSILASGSTGNCFYLETPKKRLLIDAGLTGKKITSLLAEIDRKPEDLDAILITHEHSDHIKGVGVMARKYHLDIYANEKTWQLMDECNMLGKLDASQKHIFQRDKVLTFGDVDIESFGVSHDAIDPQFYRIMKDNKSFVMLTDTGYVSDRMTGIIENADGYLIESNHDIEILRSGSYPWSLKQRILSDLGHLSNEDGAGAMIRSLGYNTKKIYLGHLSKENNIKELAHMTMVNQLAMADLAVGTDFTVHDTSPDTACPLTDI

SEQ ID NO: 1175 - DNA, 1347 bp, Streptococcus agalactiae
atgaataatagtgctgcaaatattaggtcgtttgagctagccttactttttttactagtttttgttgctgtttattttgtttatctagcggttagagattttaaaatgtctaaaaatatccggcttttgaattggaaagtcagagatttgatagcaggaaattattcagatagtattctaattcaaggtgatgcagatttggtagaattaggtgaaagtctaaatgatttatctgatgtcttccgaatggcacatgataacttagaacaagaaaagaatcgcttagcaagtatcttaacttatatgactgacggtgtgctggctacagatcgttcaggaaaaatcgttatgattaatgagacagcccaacagcagttcaatctagcatatgatgaagctttatcaatgaatattgttgatatgttagggtcgggaagtccatattcgttccaagatttagtctctaaaacgccagaggtagttcttaatagacgtgatgaaaacggtgaatttgttaccttacggattcgatttgctttgaaccgtcgtgaaagtggttttatttccggtttagttgcagtgtcacacgatgctactgagcaagagaaagaagagcgtgaaagaagactttttgtatctaatgtttctcatgaacttcgtacacctttgacatctgtaaaatcttatttagaagctttagatgagggagcgcttaatgaagaagttgctccaagcttcattaaggtatctctagatgaaacaaatcgtatgatgcgtatgatatcagatttattaagtttatcgcgcattgataatgaagtaacgcatttagatgttgaaatgacgaattttacagctttcatgacctcaattttgaatcgatttgatcagattagaaatcaaaaaacagtcacaggaaaagtttatgaaattgtcagagattatcctcttaagtcaatttgggtggaaattgatacagataagatgactcaagtgattgataacattttaaataatgcagtcaagtattcaccagatggtggtaagatcacagttaatctacgcacaactaaaacgcagatgattttatcaatatcagaccaaggcttaggtattcccaaaaaagatttacctctcatctttgatcgtttttatcgtgttgataaggcgagaagtcgtaaacagggtgggactggacttggtttgtcaattgcaaaagaaattgttaagcagcataagggatttatttgggctaagagtgagtatggtaaagggtctacttttacaatagtcttgccttatgataaagatgctgtaacttatgaagaatgggaggacgttgaagat

SEQ ID NO: 1176 - protein, 449 aa, Streptococcus agalactiae
MNNSAANIRSFELALLFLLVFVAVYFVYLAVRDFKMSKNIRLLNWKVRDLIAGNYSDSILIQGDADLVELGESLNDLSDVFRMAHDNLEQEKNRLASILTYMTDGVLATDRSGKIVMINETAQQQFNLAYDEALSMNIVDMLGSGSPYSFQDLVSKTPEVVLNRRDENGEFVTLRIRFALNRRESGFISGLVAVSHDATEQEKEERERRLFVSNVSHELRTPLTSVKSYLEALDEGALNEEVAPSFIKVSLDETNRMMRMISDLLSLSRIDNEVTHLDVEMTNFTAFMTSILNRFDQIRNQKTVTGKVYEIVRDYPLKSIWVEIDTDKMTQVIDNILNNAVKYSPDGGKITVNLRTTKTQMILSISDQGLGIPKKDLPLIFDRFYRVDKARSRKQGGTGLGLSIAKEIVKQHKGFIWAKSEYGKGSTFTIVLPYDKDAVTYEEWEDVED

SEQ ID NO: 1177 - DNA, 1350 bp, Streptococcus pyogenes
atgactagagatatcattggaaacttatccacatttgaattagcgatccttatcttacttgtttttgttgctttttactttatccatcttgcggtgcgtgattaccgaaatgcacgtattattcggatgatgagccataaaatccgagacttgattaatggtcgctatactgatataatcgacgaaaaagcagacattgagttaatggagctttcagaccagttaaatgacctgtcagatgtttttcgcttgacgcatgaaaatcttgcccaagaaaaaaatcgcttggcaagtattttggcttatatgtcagatggtgtacttgctacagaccggtctggtaaaatcatcatgattaacgagacagctcgcaagcaattaaatttaagtaaagaagaggcactaaagaaaaacattacagatttgttagaaggtgatacttcatatacctaccgtgatttggtatccaaaacaccagtggtaactgttaatagccgaaatgatatgggtgagtttgtctcattacgcttgcgctttgcgttgaataggagagagagtggttttatttcgggcttggttgtggtgctccatgacaccacagaacaggaaaaagaagaacgtgaacgccgtctttttgtctctaatgtaagtcatgaattaaggacccctttaacttcggttaaatcctacttggaggctcttgatgaaggtgcacttaaagaagatattgctccaagtttcataaaagtttctcttgatgaaactaatcggatgatgcgtatgatttcagatcttttaaacctgtctcggattgataatcaagtaacccaattagcagtagagatgactaattttactgcttttataacttctattttaaacagatttgatttggttaaaaatcagcatacaggtacaggaaaagtctatgaaattgtaagagattaccctattacctctgtctggattgaaattgataatgataaaatgacacaggttatcgagaatattttgaacaatgccattaagtattctccagatggtggaaaaattacagtccgtatgaaaacaacagatacccaattaattatttccatttcagaccaaggactaggtatccctaaaacagatttgcctcttatttttgatcggttctatcgtgtagacaaggcaagaagtcgtgcccaaggagggaccggtctaggccttgccattgctaaagaaatcatcaagcagcaccatggctttatctgggctaagagtgactatggtaaaggatcgacctttactattgtcttgccttatgaaaaagatgcagccatctatgaagaatgggaggaagatgtagac

SEQ ID NO: 1178 - protein, 450 aa, Streptococcus pyogenes
MTRDIIGNLSTFELAILILLVFVAFYFIHLAVRDYRNARIIRMMSHKIRDLINGRYTDIIDEKADIELMELSDQLNDLSDVFRLTHENLAQEKNRLASILAYMSDGVLATDRSGKIIMINETARKQLNLSKEEALKKNITDLLEGDTSYTYRDLVSKTPVVTVNSRNDMGEFVSLRLRFALNRRESGFISGLVVVLHDTTEQEKEERERRLFVSNVSHELRTPLTSVKSYLEALDEGALKEDIAPSFIKVSLDETNRMMRMISDLLNLSRIDNQVTQLAVEMTNFTAFITSILNRFDLVKNQHTGTGKVYEIVRDYPITSVWIEIDNDKMTQVIENILNNAIKYSPDGGKITVRMKTTDTQLIISISDQGLGIPKTDLPLIFDRFYRVDKARSRAQGGTGLGLAIAKEIIKQHHGFIWAKSDYGKGSTFTIVLPYEKDAAIYEEWEEDVD

SEQ ID NO: 1179 - DNA, 708 bp, Streptococcus agalactiae
atgaaaaaaatacttatcgttgatgatgaaaaaccaatttcagatattatcaaatttaatttaaccaaagaaggatatgagacggcgacagctttcgatggccgtgaagctttagtacaatatgcagaatttcaaccagatttaatcattttggatttaatgcttcctgaactagatggtttagaagtggctaaggaagttcgtaaaaccagccatattcctattattatgctttctgcaaaagacagtgagtttgacaaagtcattggtttagaaatcggtgcagatgattatgttactaaacctttttcaaatcgtgaacttttggcacgggtcaaagcacatttacgacgtactgaaaatattgaaacagctgtagcagaagaaagtgctcaaaatgcttcttcagatattactattggtgagttgcaaattttaccagatgcctttattgctaagaaacgtggcgaagaaattgaattaacgcaccgagaatttgaattacttcaccatttagcgacacatatcggacaagtcatgacacgcgaacatttattggaaacagtttggggatatgattattttggagatgtccgtacagttgatgtgacggtgagacgtttacgtgaaaagattgaagatactcctggtcgtccagaatatattttgactcgacgtggtgtaggttattacatgaagtcttatgaa

SEQ ID NO: 1180 - protein, 236 aa, Streptococcus agalactiae
MKKILIVDDEKPISDIIKFNLTKEGYETATAFDGREALVQYAEFQPDLIILDLMLPELDGLEVAKEVRKTSHIPIIMLSAKDSEFDKVIGLEIGADDYVTKPFSNRELLARVKAHLRRTENIETAVAEESAQNASSDITIGELQILPDAFIAKKRGEEIELTHREFELLHHLATHIGQVMTREHLLETVWGYDYFGDVRTVDVTVRRLREKIEDTPGRPEYILTRRGVGYYMKSYE

SEQ ID NO: 1181 - DNA, 708 bp, Streptococcus pyogenes
atgaaaaaaatacttattgtggatgatgaaaaaccgatttctgacattattaagtttaatttgacaaaagaaggttatgacattgttacagcttttgatggacgcgaagcggtaacaatttttgaagaagaaaagccagatttaattattcttgatttgatgctccctgagttggacggtcttgaagtagccaaggaaattcgtaaaaccagtcatgtcccgattattatgttgtcggctaaagatagtgagtttgacaaggttattggacttgaaattggggctgatgattacgtgaccaagcccttttctaatcgggaattgctggcgcgtgtcaaggctcatctgcgtcgtaccgaaactattgaaacggctgttgcagaagaaaatgcttcttcaggtacacaggaactgaccattggtaatttacagattttaccagatgcgtttgttgctaaaaaacatggtcaagaggtagagttgacccatcgtgaatttgaactattgcatcatctagctaaccatatggggcaggtgatgacacgagaacacttattggaaattgtttggggatatgattattttggcgatgtgcgcacggttgatgtgactgttcgtcgcctccgtgaaaaaattgaagacacaccaagtcgtcctgagtatattttaacaagacgtggtgttgggtactacatgaaatcttatgac

SEQ ID NO: 1182 - protein, 236 aa, Streptococcus pyogenes
MKKILIVDDEKPISDIIKFNLTKEGYDIVTAFDGREAVTIFEEEKPDLIILDLMLPELDGLEVAKEIRKTSHVPIIMLSAKDSEFDKVIGLEIGADDYVTKPFSNRELLARVKAHLRRTETIETAVAEENASSGTQELTIGNLQILPDAFVAKKHGQEVELTHREFELLHHLANHMGQVMTREHLLEIVWGYDYFGDVRTVDVTVRRLREKIEDTPSRPEYILTRRGVGYYMKSYD

SEQ ID NO: 1183 - DNA, 753 bp, Streptococcus agalactiae
atgtcactcatatcttataagaatgttaacaagtattatggagattatcacgcccttcgtcagattaatttggaaatagagccagggcaagtggttgttctattaggaccttctggatcaggtaaatcaacacttattagaacaatgaacgctctcgaatctattgacgatggtagtttggtcgtgaatggacatgaattagcaaatatttcatctaaagaattggtcaacctccgtaaagaagttggtatggtttttcaacattttaacctttatcctcacaaaaccgtgttagaaaatattacattagctcctattaaagtattaaaacaatctaaaaaagaagctatggaaattgctgaaaaatatttaaaatttgtcaatatgtgggaaagaaaagattcctacccatctatgctatcaggtggtcaaaaacaaagaattgctattgctagagggcttgccatgcatccaaaactcctcctctttgatgagcctacctctgcccttgatcccgaaaccatcggagacgttctttcagtgatgcaaaaattggcaaatgacggaatgaatatggtcgttgtaactcatgaaatgggatttgcacgagaagttgctgatcgtattatttttatggctgatggggaaattttagtggatactacagatgtacaagacttttttgataatcccagagaaccacgtgctaaacaatttttaagcaacattatcaaccataccagtactgacctt

SEQ ID NO: 1184 - protein, 251 aa, Streptococcus agalactiae
MSLISYKNVNKYYGDYHALRQINLEIEPGQVVVLLGPSGSGKSTLIRTMNALESIDDGSLVVNGHELANISSKELVNLRKEVGMVFQHFNLYPHKTVLENITLAPIKVLKQSKKEAMEIAEKYLKFVNMWERKDSYPSMLSGGQKQRIAIARGLAMHPKLLLFDEPTSALDPETIGDVLSVMQKLANDGMNMVVVTHEMGFAREVADRIIFMADGEILVDTTDVQDFFDNPREPRAKQFLSNIINHTSTDL

SEQ ID NO: 1185 - DNA, 735 bp, Streptococcus pyogenes
ttgatgactgaggctattatttcaattaaagacttgcacaagtattatgggcacaatgaagtgcttaagggaattgatttagacattatgccaggagaggttgtggtgattattggcccttctggttctggaaaatcgaccttacttcgaaccatgaatcttttggaagtaccaactaagggacagattaggtttgaggggattgatattaccgataagaagaatgatattttcagcatgcgtgaaaaaatgggaatggttttccagcagtttaacctctttcccaatatgactattttagaaaatatcactttatcgccaatcaaaactaagggaatggctaaagcagaggctgacaaaacagccttgagcttgttggacaaagttggattatcagaaaaagccaaggcttatcctgctagtctttctggtgggcaacagcagcggattgcgattgcgcgtggactggctatggatccagatgttttactctttgatgaaccaacttcagctctagacccagaaatggtgggtgaggtcttggctgtcatgcaagatttggctaaatctgggatgactatggttattgtgactcatgaaatgggctttgctaaagaagtcgcagaccgtgtgatgtttatggatggcggcgttattgtggaagaaggaagtcctaaccaactttttgatctgactaaagaagaacgtacaaaagattttttgagtagagtatta

SEQ ID NO: 1186 - protein, 245 aa, Streptococcus pyogenes
LMTEAIISIKDLHKYYGHNEVLKGIDLDIMPGEVVVIIGPSGSGKSTLLRTMNLLEVPTKGQIRFEGIDITDKKNDIFSMREKMGMVFQQFNLFPNMTILENITLSPIKTKGMAKAEADKTALSLLDKVGLSEKAKAYPASLSGGQQQRIAIARGLAMDPDVLLFDEPTSALDPEMVGEVLAVMQDLAKSGMTMVIVTHEMGFAKEVADRVMFMDGGVIVEEGSPNQLFDLTKEERTKDFLSRVL

SEQ ID NO: 1187 - DNA, 798 bp, Streptococcus agalactiae
atgctgagacgaaaaagattaacgttctatctattatcctgtatttttattttcctgttattttatcctaactcaacgtcagctaatcaattatcagaaatcaaaaaatcgggcgtccttaaagttggagtcaaacaagatgtgcctaactttggttattataatgctgagacgaatcaatacgaaggaatggaaattgatattgccaaaaaaattgccaaatccttaggtgtcaaaccagtttttgtaccgacaaccgcacaaaccagagagcctctgatggacaatgggcaaattgatattctaatcgcaacatacactatcacgcccgaaagaaaagctaactataatatttctaaagcttattatcacgatgaaattggatttttggtgcgtaaaaatagtcatatcaaaactataaaagaattggatggtaaacacattggtgtggctcaaggtgccactacaaaagtcaatttagaaaaatatgctaaagaacacaagctaaaatttagctatgctcaattagggagtttcccagaattagcgatatcgctgtacgctaatcgtattgatgctttttcagttgataaatctatccttagcggctaccttagccctcatacaaccatattaaaagaagggttcaatacgcaagaatacggtattgcaaccagtaaacaggacaaagtcttgattccctacgttaataagttactggtatcatgggaaaaagatggtagtttaaaacacatttatcaaaaatttaagcttaaacccgctaaagtaaaaaaagaa

SEQ ID NO: 1188 - protein, 266 aa, Streptococcus agalactiae
MLRRKRLTFYLLSCIFIFLLFYPNSTSANQLSEIKKSGVLKVGVKQDVPNFGYYNAETNQYEGMEIDIAKKIAKSLGVKPVFVPTTAQTREPLMDNGQIDILIATYTITPERKANYNISKAYYHDEIGFLVRKNSHIKTIKELDGKHIGVAQGATTKVNLEKYAKEHKLKFSYAQLGSFPELAISLYANRIDAFSVDKSILSGYLSPHTTILKEGFNTQEYGIATSKQDKVLIPYVNKLLVSWEKDGSLKHIYQKFKLKPAKVKKE

SEQ ID NO: 1189 - DNA, 897 bp, Streptococcus pyogenes
atgttatactattcttatcttaataaaggagttactatgaagaaatcagttacattactgtctatcggacttgccagccttttattggcagcatgtgcgccacatcaatctcaaaaatcaagttgggacactatcaaagaaaaaggggtgttaaaagtagctaccccaggaacctatcagccaacttctttttacaacgataataatgagttagtaggttacgaagtagatatggtcaaagaaatcggtaaacgacttaacattaaagtcaagtttgttgaaacaggatttgaccaagcctttacctcagttgatagtggtcgagtggatatttctttgaacaactttgacattaccccaaaacgtcagaaaaaatacaatatctctacgccttataaatacggggtaggaggcatgattgtccgtgctgatggcagctcaaacatagctaaaaaagatcttagcgactggaaaggaaaaaaagcagccggcgcttctggaacagaatacatgaaagtagcgcaaaaacagggagctgaactggtgacctacgataatgttacaggagatgtttatctaaacgatgtggctaacggtcgaacagatttcatcccaaatgattacccagctcaaaaattatttgtggattacatgttatctcaaaatccaaatctaaatgtcaaaatgagcgatgttcagtacaacccaaccgaacaaggaattgttatgaacaaaaaagacgatagcctcaagaaaaaaatagatgctgttattaaagacatgataaaagatggtagcttgaagaaaatctctgaaacctactatgctggtcaagatctgacaaaaccttttggcaaagacaaaaaaattcccgtcattgatacgaaagacgttaac

SEQ ID NO: 1190 - protein, 299 aa, Streptococcus pyogenes
MLYYSYLNKGVTMKKSVTLLSIGLASLLLAACAPHQSQKSSWDTIKEKGVLKVATPGTYQPTSFYNDNNELVGYEVDMVKEIGKRLNIKVKFVETGFDQAFTSVDSGRVDISLNNFDITPKRQKKYNISTPYKYGVGGMIVRADGSSNIAKKDLSDWKGKKAAGASGTEYMKVAQKQGAELVTYDNVTGDVYLNDVANGRTDFIPNDYPAQKLFVDYMLSQNPNLNVKMSDVQYNPTEQGIVMNKKDDSLKKKIDAVIKDMIKDGSLKKISETYYAGQDLTKPFGKDKKIPVIDTKDVN

SEQ ID NO: 1191 - DNA, 693 bp, Streptococcus agalactiae
atgactttattaaacatcagtccttttgccatttcaaggtggggcgctttctttaaccatttcgacctattctttaaaggcttcttatatactctaggtatttcgtttggtgcactcctacttgctctgatattaggaattctctctggtggtttatcaacttctaaaagtaaagttggtaagttgatatcacgtatctatgttgaagtttttcaaaacacacctcttttagttcaaatggtttttgtctactatggactagcaatcattagtaatggacatgttatgattagtgcttttttcaccgccgttttgtgcgttggactataccatggtgcctatatttctgaagttattcgctcaggaattgaagctgtccctaaaggacaaacagaggctgctttagctcaaggattcacagctaatcaaaccatgcaacttatcattttgcctcaagctgtcagaacaattttaccaccaatgaccaaccaagttgttaatctaatcaagaatacctctaccgtagcaatcatttctggagccgatatcatgtttgtagctaaggcctgggcttatgatacgactaattatatcccagcttttgcaggagctgctatcttctattttgttatttgtttcccactagcaagctgggcaagaaaacaagaagaattaaataagaaaacttattct

SEQ ID NO: 1192 - protein, 231 aa, Streptococcus agalactiae
MTLLNISPFAISRWGAFFNHFDLFFKGFLYTLGISFGALLLALILGILSGGLSTSKSKVGKLISRIYVEVFQNTPLLVQMVFVYYGLAIISNGHVMISAFFTAVLCVGLYHGAYISEVIRSGIEAVPKGQTEAALAQGFTANQTMQLIILPQAVRTILPPMTNQVVNLIKNTSTVAIISGADIMFVAKAWAYDTTNYIPAFAGAAIFYFVICFPLASWARKQEELNKKTYS

SEQ ID NO: 1193 - DNA, 1584 bp, Streptococcus pyogenes
ttgaaacaggagacctatatgaaaaagctaatccttagctgtttggtcgccttggcccttctgtttggaggaatgagccgggctcaagcaaaccaatatttaagagtcggaatggaagcagcctatgctccttttaactggactcaagatgacgcttcaaacggggctgttccaattgaaggaactagccaatacgccaacggttacgatgtccaagtcgctaaaaaagtcgctaaagctatgaacaaagaacttttagtcgttaagacctcttggaccggtttaattccagcattaacttctggaaaaatcgatatgatcgctgctggtatgagtcctaccaaagagcgtagaaacgaaattagcttctcaaacagctcctacactagccaacctgttctagtcgtaactgccaatggcaaatatgctgatgcaacaagcctcaaggatttttctggagctaaagtaactgcccagcaaggcgtttggcatgtcaatctcttaactcaactaaaaggtgctaagttacaaacaccaatgggagatttctctcaaatgcgacaagcccttacttcgggtgttatcgatgcctatatttctgaacgacctgaagccatgactgctgaagctgctgatagccgtttgaaaatgatcactcttaaaaaagggtttgctgttgctgaatcagatgctgctatcgctgtcggaatgaaaaaaaatgacgatcgtatggcaactgtcaaccaagtgcttgaaggattttctcaaacagatcgtatggccctgatggatgatatggttaccaaacaacccgtggaaaagaaagccgaagatgctaaagcatcatttctaggccaaatgtgggctatttttaaaggtaactggaagcaattcttacgtggaactggaatgacccttctgatttccatggtcggaaccattacaggtctctttattggattattaatcggtattttccgtacagctcctaaagctaagcataaagtagctgccttgggacaaaaactctttggttggttactcactatttatatcgaaatcttccgtgggacacctatgattgttcaatctatggttatctactacggaacagcgcaagcctttggtatttcgatcgaccgtaccctagcggctatttttatcgtatctatcaatacgggggcctatatgagtgaaattgttcgcgggggtattttcgctgtcgacaaaggtcaattcaaagcagcaactgctcttggctttactcacggacaaaccatgcgtaaaatcgtgctaccacaagttgttcgcaacattttaccagcaacaggtaatgagtttgtcatcaatatcaaagatacttctgtcttgaatgttatctctgttgtggaactttacttctcaggtaataccgtagccacacaaacctaccaatatttccaaacctttacgattatcgccattatctactttgttcttaccttcacggtgacacgtatccttcgttatattgaacgccgtttcgatgccgatacttacaccactggagcaaaccaaatgcagattgcggaggtctcaaatgtc

SEQ ID NO: 1194 - protein, 528 aa, Streptococcus pyogenes
LKQETYMKKLILSCLVALALLFGGMSRAQANQYLRVGMEAAYAPFNWTQDDASNGAVPIEGTSQYANGYDVQVAKKVAKAMNKELLVVKTSWTGLIPALTSGKIDMIAAGMSPTKERRNEISFSNSSYTSQPVLVVTANGKYADATSLKDFSGAKVTAQQGVWHVNLLTQLKGAKLQTPMGDFSQMRQALTSGVIDAYISERPEAMTAEAADSRLKMITLKKGFAVAESDAAIAVGMKKNDDRMATVNQVLEGFSQTDRMALMDDMVTKQPVEKKAEDAKASFLGQMWAIFKGNWKQFLRGTGMTLLISMVGTITGLFIGLLIGIFRTAPKAKHKVAALGQKLFGWLLTIYIEIFRGTPMIVQSMVIYYGTAQAFGISIDRTLAAIFIVSINTGAYMSEIVRGGIFAVDKGQFKAATALGFTHGQTMRKIVLPQVVRNILPATGNEFVINIKDTSVLNVISVVELYFSGNTVATQTYQYFQTFTIIAIIYFVLTFTVTRILRYIERRFDADTYTTGANQMQIAEVSNV

SEQ ID NO: 1195 - DNA, 648 bp, Streptococcus agalactiae
atgtcatcagtcttaacactaacaaagatactatttctccttcaagggttcggtttaaccttatatatatcttttatttccattttactatcaatgttttttggaactctattagcaattatgagaaatagcaaaaatcctatctggaaattaatagctagtatctatatcgaatttgtcagaaatgttccaaatctactttggatttttatcattttcttagtattccagatgaaatcagtcagcgctggtattacttcgtttacaatttttacctccgctgctttagcagaaattattcggggaggtttaaatggagtcgataaaggacaaacagaagctggactttctcaaggattcacttatttgcaagttttcattattattattttcccacaagcttttcgcaaaatgttgccagccattatttctcagtttgtaacggttataaaagatacatcactactttattctgttatagctattcaagaaatcttcggaaaaagtcaaattctaatgggaagatatttcgaagctggacaagtttttacactctacgctattataactgctgtctatttcattacaaactttatcatctcaagtttttcacgtaaactttcaaaacgttgggagcaagctactgag

SEQ ID NO: 1196 - protein, 216 aa, Streptococcus agalactiae
MSSVLTLTKILFLLQGFGLTLYISFISILLSMFFGTLLAIMRNSKNPIWKLIASIYIEFVRNVPNLLWIFIIFLVFQMKSVSAGITSFTIFTSAALAEIIRGGLNGVDKGQTEAGLSQGFTYLQVFIIIIFPQAFRKMLPAIISQFVTVIKDTSLLYSVIAIQEIFGKSQILMGRYFEAGQVFTLYAIITAVYFITNFIISSFSRKLSKRWEQATE

SEQ ID NO: 1197 - DNA, 2172 bp, Streptococcus pyogenes
atgacgcacaaaataaaagtattgctgcttgcgataatgtctatttttttgacatgcaatattgcaagtgctgaaactattgctattgtttcagatacagcttatgccccatttgaatttaaagactcagatcaaatttacaaaggaattgacgttgatattattaatgaagtagccaaacgtcaatcttgggatttcagtatgagtttcccgggttttgatgcagctgtaaatgctgttcaatctggtcaagcgagtgctctaatggccggtacaaccattacgaatgctcgtaagaaagtctttcatttctcagagccatattacgataccaaaattgtcattgcgacacgtaaagccaatgccatcaaaaaatacagtgacttaaaaggaaaaacggtcggtgttaaaaatggaacagcggctcaagcctttttgaataactataaaaaaaagtatgattatactgttaaaacatttgacacaggtgatcttatgtataatagtttatctgctggttctattgccgctgttatggatgatgaggcggttatccaatacgcaatcagccaaaaccaagatattgctattaacatgaaaggagagcccattggaagctttgggtttgctgtcaaaaagggaagcggatatgattatctagttaatgatttcaatacagctcttaaagctatgaaagctgatggtacctaccaagctatcatgaccaagtggttaggcacagatgataaagctaccaccagtcaggcaacgggaaatccatctgccaaagctacacctacaaaggacagttataaaattgtctctgattcgtcttttgcaccgtttgaatttcaaaatggtaagggcaaatacgttggtattgacatagaattaatcaaagctattgctaaacaacaaggtttcaaaattgaaatcgctaatccaggtttcgatgctgccttaaatgctgtgcaatctagccaagcagatggggtcattgctggtgcaactattactgacgctcgtaaagctatctttgatttttctgatccttattatacttctaatatcattttagctgttaaagctggaaaaaacatcaagaactatgaagacttagacagaaaaacagtcggtgctaaaaacggcacttcatcttactcttggttaaaagaaaacgctcctaaatatggttataatgtcaaggcatttgatgatggttctagcatgtatgatagcttaaattcaggttctgtagatgctatcatggatgatgaggcggttcttaaatacgctatctctcaaggtcgtcgctttgaaacacctcttgagggcatttctactggtgaagttggttttgctgtcaagaaaggaactaatccagaattaatcgaaatgttcaacaatggcttagctgctctcaaaaaatctggtcagtatgatgacattatagataaataccttgactctaagaaagctgcaactccttctgaaaaaggtgctgatgagtctactatttcaggcctattatcaaataactacaaacaactattggcaggacttggaaccacgctcagtttaacccttatttcatttgctattgctataattatcgggatcatctttgggatgatggccgtgtcaccaactaaatcacttcgacttatttcaacggtctttgtggacgttgttcgagggattcctttgatgattgtggctgccttcattttctggggagtaccaaaccttatcgagagtatgaccggccaccagtcaccgattaatgatttcttagctgctacaattgcactgtcacttaatggcggagcctatattgctgaaattgttcgcggtggtatcgaagctgttccagcagggcaaatggaagctagtcgaagtcttggtttgtcttacggaaccacgatgagaaaagtaattctcccacaagctgtgaaactaatgttacctaactttatcaatcagtttgttatttcattgaaggatacaacaatcgtctcagcaattggtttagtggaactcttccaaacaggtaaaatcattattgctagaaattaccagtcgttccgtatgtatgctattttagcaattatttaccttatcatgattatactcttaacaagacttgcaaaacgtttagaaaagaggcttaac

SEQ ID NO: 1198 - protein, 724 aa, Streptococcus pyogenes
MTHKIKVLLLAIMSIFLTCNIASAETIAIVSDTAYAPFEFKDSDQIYKGIDVDIINEVAKRQSWDFSMSFPGFDAAVNAVQSGQASALMAGTTITNARKKVFHFSEPYYDTKIVIATRKANAIKKYSDLKGKTVGVKNGTAAQAFLNNYKKKYDYTVKTFDTGDLMYNSLSAGSIAAVMDDEAVIQYAISQNQDIAINMKGEPIGSFGFAVKKGSGYDYLVNDFNTALKAMKADGTYQAIMTKWLGTDDKATTSQATGNPSAKATPTKDSYKIVSDSSFAPFEFQNGKGKYVGIDIELIKAIAKQQGFKIEIANPGFDAALNAVQSSQADGVIAGATITDARKAIFDFSDPYYTSNIILAVKAGKNIKNYEDLDRKTVGAKNGTSSYSWLKENAPKYGYNVKAFDDGSSMYDSLNSGSVDAIMDDEAVLKYAISQGRRFETPLEGISTGEVGFAVKKGTNPELIEMFNNGLAALKKSGQYDDIIDKYLDSKKAATPSEKGADESTISGLLSNNYKQLLAGLGTTLSLTLISFAIAIIIGIIFGMMAVSPTKSLRLISTVFVDVVRGIPLMIVAAFIFWGVPNLIESMTGHQSPINDFLAATIALSLNGGAYIAEIVRGGIEAVPAGQMEASRSLGLSYGTTMRKVILPQAVKLMLPNFINQFVISLKDTTIVSAIGLVELFQTGKIIIARNYQSFRMYAILAIIYLIMIILLTRLAKRLEKRLN

SEQ ID NO: 1199 - DNA, 564 bp, Streptococcus agalactiae
atgattaagaaaaataaagtttttttaggagttcttttagtccttgttgttatccttggaggtggtgtattattttaccaatcacaattccaaaagacaactaatcaagcgttagctattgcttataaagatgctaaagtggctaagaaggatgtcatacatcaaaaaattgacaaagaatttgaaaactttagagggagctacgaaattgaattcaataccaaaagcgcagaatacagctatcatgtagatgttaagactggacaaatccttgagcgggacatggataataatggcttttcaaaatcgacttctcagtcaagttcatcgtcaagtcaaaaatctcataaaataagtcaagaagaagccaaaaagattgcatttaaagatgctaatatagaggaatcagaagtcagtaatcttaagatcaaagaagaaattgaaaatggaaaatcagtttatgatattgactttgtggacctgaaaaataaaaatgaagttgattatcaaattgatgcagaaactggaaaaatcattgaacgttctagagatcatatgaatgat

SEQ ID NO: 1200 - protein, 188 aa, Streptococcus agalactiae
MIKKNKVFLGVLLVLVVILGGGVLFYQSQFQKTTNQALAIAYKDAKVAKKDVIHQKIDKEFENFRGSYEIEFNTKSAEYSYHVDVKTGQILERDMDNNGFSKSTSQSSSSSSQKSHKISQEEAKKIAFKDANIEESEVSNLKIKEEIENGKSVYDIDFVDLKNKNEVDYQIDAETGKIIERSRDHMND

SEQ ID NO: 1201 - DNA, 450 bp, Streptococcus pyogenes
atgatacttcaaagtgaccacacgtttttatattgtatagtcaaaatattgggaaaaaccatgtgtttgagttataatagaagaaatcaaagaaagaaggtagtacttatgacaattaaaaaattctctctactagccatagccagcctctctttactcagtcttgcagcctgtgatatggatgataaagacgatcatatggataatcaaccaaagacaagtcaaactagcaagaaagttaaactctcagaagacaaagccaaatcaattgcgttaaaagatgcttctgttacggaagctgatgctcaaatgctatcagttacacaagataatgaagatggcaaagccgtgtatgaaatcgagtttcaaaacaaagatcaagaatacagctataccattgacgccaactcaggggatattgtggaaaaatcttctgaaccaatcaatgac

SEQ ID NO: 1202 - protein, 150 aa, Streptococcus pyogenes
MILQSDHTFLYCIVKILGKTMCLSYNRRNQRKKVVLMTIKKFSLLAIASLSLLSLAACDMDDKDDHMDNQPKTSQTSKKVKLSEDKAKSIALKDASVTEADAQMLSVTQDNEDGKAVYEIEFQNKDQEYSYTIDANSGDIVEKSSEPIND

SEQ ID NO: 1203 - DNA, 1032 bp, Streptococcus agalactiae
ttggaggggagagatatggcaaagaccgctcttaatattccttttacagttgaagggatagaaaattattatcaaaatataaaaatgatactgtctttagcagataaatggagcatacctaaagatgatctattactttttttaaagggcctcaaggctattgatgatataaaagttggctctcctatttttaagtatttttggacttctttaagtttacaagcacccctcaaagctttagaattcgtgttagagcaggctaaaatgccaactgaattgtcaggagaattatcagaaacacaatacttggtcgcacagttttcagatgagttagctccacatgatgatttctggatagccttatcacaagttatttatgattcttttcctgggaatagtctagccgaagatactgtattaaataggaaactccatcaattccgctatttgatttctagtcagcaagcacagtatgttcgacgatactttaaagatgttggtatgactgatagagatgctttagtaaactacctatcatgtttaagagaaccagatagtatcgcctactatgaatctgctcgcttgcataataaacgtcggagaaatggtgaaatctttggtttcccagatgatgagccggttattaatagtaagcttttaatttcattccatacggaatttattattgatgacaaaggaaactttttaaacgagattgacgcagaagtaataacacgtaatggtattatcaatggagctagctttaattatgcttttaaaaataatacacgtcataaagaattagatgttgatcctgtaaagttagacccaaaatttcgaaacgatatgactagaggttatagatcgccaaatctatctagaaggaaatggtttttctttaaagaagaggattacgattgtagttatttcaataaaaaaggatattacgcatttggaaggcgtagtgctaagcaatcggttgataaacaagtcaaatacttgaagaaggctgtgcagaaaatgcgcatcaac

SEQ ID NO: 1204 - protein, 344 aa, Streptococcus agalactiae
MEGRDMAKTALNIPFTVEGIENYYQNIKMILSLADKWSIPKDDLLLFLKGLKAIDDIKVGSPIFKYFWTSLSLQAPLKALEFVLEQAKMPTELSGELSETQYLVAQFSDELAPHDDFWIALSQVIYDSFPGNSLAEDTVLNRKLHQFRYLISSQQAQYVRRYFKDVGMTDRDALVNYLSCLREPDSIAYYESARLHNKRRRNGEIFGFPDDEPVINSKLLISFHTEFIIDDKGNFLNEIDAEVITRNGIINGASFNYAFKNNTRHKELDVDPVKLDPKFRNDMTRGYRSPNLSRRKWFFFKEEDYDCSYFNKKGYYAFGRRSAKQSVDKQVKYLKKAVQKMRIN

SEQ ID NO: 1205 - DNA, 1032 bp, Streptococcus pyogenes
atgtgttataatatggtcaaaaaagatgaggagaaggccatgaaacaagctatcttagatcgctatcaggccttgaaatgctatcaaaacgcaggtttatcaaaccaagcatttcgtgctatagctaaagagcctatcattgataatcgacttggttctccaactttctgggtaatatggcctattgaaaaagaaaaccaatcagctaagcagttactaacgtttcttcttgatttggtagagatgccatttgagctaagtggtcagttgcatgaaactcaaacgctactcacccgattccatccatctctattgccagatcatatgttttggaaagagttggctagcttagttgatcaagcttttcctggcaaaacactaagccaagcaggtgagcttgaaaagcgtttgcatcaatttcgttatgtcatctctagtcaacaagctcaatctatcagaaaccattataaaatgattgagatgacagacgcccaagctctggccctttttttgaggtctaaaaaagggccttgtttgtggcggcaagcaccagattataccttgatggattctgccaggttacataataaactaagatttgaagataataaagtcatttttccaagtcaagaagtttcctataatataaaagtacttctttggtttcataccgaatttactctagatagcacaggcttttttcttaatgaagttgatgcagaagtagtgaccgaaaaaggaattgtcaatggtgcatcttttaactatggcacagatggtcctagacattgggatttagatgttgatccgattagccatcacgatcctcagtttagaagagacacccttaaaggatttcgatcgccaaaaagagtatttcgccagtggtttagagctcaaaaagatgactttatgttctcttattttaatgccaaaggactttttgcttaccacaacaagagtagttttgccagagtcaaaaaatcagctaagcaattcaaacgtcaaattcatcctataaagggttggttt

SEQ ID NO: 1206 - protein, 344 aa, Streptococcus pyogenes
MCYNMVKKDEEKAMKQAILDRYQALKCYQNAGLSNQAFRAIAKEPIIDNRLGSPTFWVIWPIEKENQSAKQLLTFLLDLVEMPFELSGQLHETQTLLTRFHPSLLPDHMFWKELASLVDQAFPGKTLSQAGELEKRLHQFRYVISSQQAQSIRNHYKMIEMTDAQALALFLRSKKGPCLWRQAPDYTLMDSARLHNKLRFEDNKVIFPSQEVSYNIKVLLWFHTEFTLDSTGFFLNEVDAEVVTEKGIVNGASFNYGTDGPRHWDLDVDPISHHDPQFRRDTLKGFRSPKRVFRQWFRAQKDDFMFSYFNAKGLFAYHNKSSFARVKKSAKQFKRQIHPIKGWF

SEQ ID NO: 1207 - DNA, 702 bp, Streptococcus agalactiae
ttgcgaacagtattagtagtgcaaggtgatgacgaaacaatagagttattaaggtcgtatttagagggagctctttataaggttgtgatggctagtgatggtgaggaggctttttctttatttcagcaacatcagattgatttagcaatcatagatattacgctacctaaaatagatggatatgagttgacgcgactcattcgtcaagatagtcagattcctattattatgctagcagctaagacaacagatatggacagaatattaggattgaatattggagcagatgattttatcacgaaaccgtttaattctttggaggttttagctcgaattaattcgcaactgcgtcgttactatgaattcaatagtcttgccaaacctaaaaatcaatttataaagataggggaattggaattagatgaggaacatgttgaactaactaaaaatggtaaacatatcaagttgactgctacagaatttaagattcttcatatcttaatgtcatcaccaggaaggatttatactaaaacacaactctatgagaagattaatggtaggtatttagaaggtgatgagacaacgattatggtgcatatttctaatatccgtgacaaaatcgaagatgatagtaaatatcctaaatatataaaaacacttagaggagtaggatataaaatcgaaaaaccgcagtatcttgtt

SEQ ID NO: 1208 - protein, 234 aa, Streptococcus agalactiae
MRTVLVVQGDDETIELLRSYLEGALYKVVMASDGEEAFSLFQQHQIDLAIIDITLPKIDGYELTRLIRQDSQIPIIMLAAKTTDMDRILGLNIGADDFITKPFNSLEVLARINSQLRRYYEFNSLAKPKNQFIKIGELELDEEHVELTKNGKHIKLTATEFKILHILMSSPGRIYTKTQLYEKINGRYLEGDETTIMVHISNIRDKIEDDSKYPKYIKTLRGVGYKIEKPQYLV

SEQ ID NO: 1209 - DNA, 1941 bp, Streptococcus agalactiae
atgattaaaatcactttcccagatggtgcaattcgtgaatttgaatctggcatcacaacatttgaaattgcacaatcaatttctaactctttagctaaaaaagctttagctggtaaatttaatggtcaacttattgatacaacacgtgctatcgaagaagatggtagtattgagattgtaacacctgaccacgaagatgctttaggagttcttcgtcactcagcagcgcatttatttgctcaagctgcaaaacgcctttttccagacttatgtttaggtgtaggtccagctattcaagatggtttttactacgatactgataataaatcaggtcaaatttcaaatgatgatcttcctcgtattgaagaagaaatgaaaaaaattgttaaggaaaatcacccttgtattcgtgaagaaatcagtaaagaagaagcgttagaactttttaaagatgacccttataaagttgaattaattagtgaacatgctgaagatggtttaactgtttatcgtcaaggtgaatttgtagacctttgtcgtggacctcatgtcccatcaacaggacgtattcaagtctttcatcttctaaatgtcgctggtgcttactggcgtggtaacagtgataatgctatgatgcagcgtgtctatggtactgcttggtttgataaaaaagatttgaaagcatatcttaaacgccgtgaagaagctaaggaacgtgaccatcgcaaattaggtaaagaacttgatttatttatggttaatcctgaagtaggtcaaggattgccattctggttgccaaatggagcaactattcgccgcgaattggaacgttacattgttgataaggagattgcttcaggttatcaacacgtttacacacctccgatggcatctgttgaattttacaagacttctgggcactgggaccactatcgtgaagatatgttcccaacaatggatatgggagatggagaggaattcgttcttcgtccaatgaactgcccacaccatattgaagtttataaacatcatgttcattcatatcgtgaattgccaattcgtatcgctgaacttggtatgatgcaccgttatgaaaaatcaggggccctcacaggattgcaacgtgtacgcgaaatgacactcaacgatgcccatattttcgttacacctgagcaaattaaagatgaatttcttaaagctcttaatcttatagcagaaatttatgaagattttaacttaacagattaccgtttccgcttatcttatcgtgacccagaagataaacataagtattatgataacgatgagatgtgggaaaatgcacaagctatgctaaaagaggctatggatgattttggattagattattttgaagcagaaggcgaagcagccttttacggtcctaaattggatatccaggtgaaaactgctcttggtaatgaagaaacactatctactatccaactagatttccttcttccagaacgctttgatctcaaatacatcggtgcagatggtgaagaacatcgtccaattatgattcaccgcggtggtatttcaacaatggagcgctttacagctattttaattgaaacttacaaaggtgcctttccaacttggcttgctccacaacaagtttctgttattccaatttcaaatgaagcccacattgattatgcttgggaagtggctcgtgtccttaaagatcgtggtattcgtgctgaagtagatgaccgtaacgaaaagatgcaatataagattcgtgcggctcaaacccaaaaaattccatatcaattgattgttggtgataaggaaatggaagaaaaagccgtaaatgtgcgccgctatggaagcaaagcgactgaaacaaaatctatagaggaatttgtagaaagtattttagctgatattgcaagaaaatctagacctgacgaagttaaa

SEQ ID NO: 1210 - protein, 647 aa, Streptococcus agalactiae
MIKITFPDGAIREFESGITTFEIAQSISNSLAKKALAGKFNGQLIDTTRAIEEDGSIEIVTPDHEDALGVLRHSAAHLFAQAAKRLFPDLCLGVGPAIQDGFYYDTDNKSGQISNDDLPRIEEEMKKIVKENHPCIREEISKEEALELFKDDPYKVELISEHAEDGLTVYRQGEFVDLCRGPHVPSTGRIQVFHLLNVAGAYWRGNSDNAMMQRVYGTAWFDKKDLKAYLKRREEAKERDHRKLGKELDLFMVNPEVGQGLPFWLPNGATIRRELERYIVDKEIASGYQHVYTPPMASVEFYKTSGHWDHYREDMFPTMDMGDGEEFVLRPMNCPHHIEVYKHHVHSYRELPIRIAELGMMHRYEKSGALTGLQRVREMTLNDAHIFVTPEQIKDEFLKALNLIAEIYEDFNLTDYRFRLSYRDPEDKHKYYDNDEMWENAQAMLKEAMDDFGLDYFEAEGEAAFYGPKLDIQVKTALGNEETLSTIQLDFLLPERFDLKYIGADGEEHRPIMIHRGGISTMERFTAILIETYKGAFPTWLAPQQVSVIPISNEAHIDYAWEVARVLKDRGIRAEVDDRNEKMQYKIRAAQTQKIPYQLIVGDKEMEEKAVNVRRYGSKATETKSIEEFVESILADIARKSRPDEVK

SEQ ID NO: 1211 - DNA, 1941 bp, Streptococcus pyogenes
atgattaagattacttttccagatggcgccgtgcgtgaatttgaatctggcgtaacaacgtttgacattgctgagtccatcagcaaatcattggctaaaaaagctttagctggtaagttcaatgatcaactcattgacaccactcgtgccattgaagaagatggcagtattgaaatcgtgacacctgaccacaaagatgcttatgaggtgcttcgccactctgcagcccatttatttgcccaagctgcaaaacgcttgttcccaaatcttcatttgggtgtgggccctgccattgcagaaggcttttactatgatacagataatgctgaaggccaaatttcaaacgaagatttgccacgtatcgaagctgaaatgcaaaaaatcgtgacagaaaattacccatgtatccgtgaagaagtgaccaaagaagaagctttggaattgttcaaagatgatccttacaaggtagaattgattaatgagcatgctggtgctggcttgacggtttaccgtcaaggtgaatttgtggatctttgccgtggccctcatgtgccatcaacaggccgtatccaagtcttccacttgctcaatgtggcgggtgcttactggcgtggtaacagcgacaataacatgatgcaacgtatctatggaacagcttggtttgataaaaaagacctcaaagcttacttgactcgtctagaagaagctaaagaacgtgatcaccgtaagcttggtaaagagcttgacttgttcatgattagccaagaagttggccaaggcttgccattttggttaccagatggagcgactattcgtcgtacacttgagcgctacatcacagataaagaattagcatcaggctaccaacacgtttacacaccaccacttgcttctgtagaattgtacaagacatcaggtcattgggatcattatcaagaagatatgttccctgtaatggatatgggagatggtgaggagtttgttcttcgtccaatgaactgcccacaccacattcaagtgtataaaaatcatgtgcgttcttatcgtgaattgcctattcgtattgccgagcttggcatgatgcaccgttacgaaaaatcaggtgccctatcaggacttcaacgggtacgtgaaatgaccttgaatgatggtcacattttcgtaacaccagagcaaatccaggaagaatttcaacgtgcccttcaattaatcattgatgtttatgctgacttcaacttgactgattatcgttttcgtttgtcataccgagaccctaacgatactcataaatattatgacaatgatgagatgtgggaaaatgctcaaagtatgcttaaagctgcacttgatgagatgggtgtagattactttgaagcagaaggtgaagcagctttttatgggcctaagcttgatattcaggtgaaaacagctcttggtaacgaagaaaccctatcaaccattcagttggacttcttgttgccagaacgctttgatctcaaatacattggtgctgatggcgaagaacaccgcccagtcatgattcaccgtggtgttatctcaactatggaacgtttcactgctatccttattgaaacttacaagggtgctttcccaacttggttggcacctcaccaagtaaccgtgattccaatttcaaatgaagcccacattgactatgcttgggaagtagcaaaaacccttcgtgaccgtggtgttcgtgcagatgtcgatgaccgcaatgaaaaaatgcagtacaagattcgtgcgtctcaaaccagcaaaattccttaccaattaattgttggggacaaagaaatggaagacaaatcagtcaatgttcgccgctatggtagcaagacgactcacaccgaatctgtggaagaatttgtggaaaacatcttggcagacattgctcgcaagtcacgtccagatgcacaagct

SEQ ID NO: 1212 - protein, 647 aa, Streptococcus pyogenes
MIKITFPDGAVREFESGVTTFDIAESISKSLAKKALAGKFNDQLIDTTRAIEEDGSIEIVTPDHKDAYEVLRHSAAHLFAQAAKRLFPNLHLGVGPAIAEGFYYDTDNAEGQISNEDLPRIEAEMQKIVTENYPCIREEVTKEEALELFKDDPYKVELINEHAGAGLTVYRQGEFVDLCRGPHVPSTGRIQVFHLLNVAGAYWRGNSDNNMMQRIYGTAWFDKKDLKAYLTRLEEAKERDHRKLGKELDLFMISQEVGQGLPFWLPDGATIRRTLERYITDKELASGYQHVYTPPLASVELYKTSGHWDHYQEDMFPVMDMGDGEEFVLRPMNCPHHIQVYKNHVRSYRELPIRIAELGMMHRYEKSGALSGLQRVREMTLNDGHIFVTPEQIQEEFQRALQLIIDVYADFNLTDYRFRLSYRDPNDTHKYYDNDEMWENAQSMLKAALDEMGVDYFEAEGEAAFYGPKLDIQVKTALGNEETLSTIQLDFLLPERFDLKYIGADGEEHRPVMIHRGVISTMERFTAILIETYKGAFPTWLAPHQVTVIPISNEAHIDYAWEVAKTLRDRGVRADVDDRNEKMQYKIRASQTSKIPYQLIVGDKEMEDKSVNVRRYGSKTTHTESVEEFVENILADIARKSRPDAQA

SEQ ID NO: 1213 - DNA, 1332 bp, Streptococcus agalactiae
atgcgtataggtctatttacagatacatacttcccccaagtttcgggagtttcaacaagtatccgcactttaaaggaagggttggagaaggaaggacacgaagtttatattttcacaactaccgaccgtaatgtcaaacgttttgaagaccctacaattattcgtttaccaagtgtcccttttatttcttttacggatcgtcgagtagtttatagaggtttaatttctgcttataggatagctaaagactacgaacttgatattattcatactcaaacagaattcagcttagggcttttaggaaaattagttgcaaaagctttaagaatacctgttgtgcatacttatcatactcaatatgaggattacgttggttatatcgcaaaaggcaaattgattaagccaagtatggtcaaatatatcatgcgtacctacctaagtgatttggatggtgtcatatgtccttctcgaattgttctcaatcttctagatggttacggtgtcaaaattccaaaacaagttattccgacaggtattcctgttgagaactatcgtcgagaggatatctctgaagaaacaatcaagaatctacgaacggagcttggacttgcggataatgatacaatgctattgagtttatcacgggtatcttttgaaaaaaatattcaagcaatcttgatgcatttatcagctgtcgttgatgaaaatcctcacgtaaaattagtgatagttggagatggtccttatctttcagatctaaaagaacttgttcactctttagaacttgaaaattcagttatttttacaggtatggttgagcatagccaagtggctatctactataaagcatgtgatttctttattagtgcttcaacaagtgaaacgcaaggattaacttacattgagagtctggcgagtggacgtccaatcattgcgcaaagtaatccttatctagatgatgttatttcagataaaatgtttggaactctgtacaagaaggaaagtgatttggcagatgctatcctagatgcaatagcagagacacccaaaatgactcaagaagcttatgaacagaaattatatgagatttctgctgagaatttcagcaagtctgtatatgctttttacctagactttctgatttcacaaaaagctagtgtgaaagaaaaagtctctctgacaataggaaataaggatagccattctactcttcgttttgtcagaaaagcggtatatttacctaagaaagtttttacctttacaggaagagcctctaaaaaagtggtaaaagcacctaaacgtcgtatttcatctattcgagattttttagat

SEQ ID NO: 1214 - protein, 444 aa, Streptococcus agalactiae
MRIGLFTDTYFPQVSGVSTSIRTLKEGLEKEGHEVYIFTTTDRNVKRFEDPTIIRLPSVPFISFTDRRVVYRGLISAYRIAKDYELDIIHTQTEFSLGLLGKLVAKALRIPVVHTYHTQYEDYVGYIAKGKLIKPSMVKYIMRTYLSDLDGVICPSRIVLNLLDGYGVKIPKQVIPTGIPVENYRREDISEETIKNLRTELGLADNDTMLLSLSRVSFEKNIQAILMHLSAVVDENPHVKLVIVGDGPYLSDLKELVHSLELENSVIFTGMVEHSQVAIYYKACDFFISASTSETQGLTYIESLASGRPIIAQSNPYLDDVISDKMFGTLYKKESDLADAILDAIAETPKMTQEAYEQKLYEISAENFSKSVYAFYLDFLISQKASVKEKVSLTIGNKDSHSTLRFVRKAVYLPKKVFTFTGRASKKVVKAPKRRISSIRDFLD

SEQ ID NO: 1215 - DNA, 1332 bp, Streptococcus pyogenes
atgcgtataggtctattcacagatacctattttccacaagtttcaggagtcgctactagtattcgtacgttaaaagaagagctagaaaaagaaggtcacgaagtttatattttcaccactactgatagagatgtcaaacgctttgaagacccgaccattattcgactgccaagtgttccttttgtgtcatttacggatagacgtgtggtttatcgtggcctcatttcgtcatacaaaattgcaaaacactataatcttgatattattcatacgcaaactgagtttagcttaggcttattagggaaaatgataggcaaagctttgcgaattcctgttgtccatacttaccatacccaatatgaggactacgtgagttatattgccaacggaaaaatcattcgaccaagtatggtcaaacctcttcttaggggctatttgaaggatttggatggggttatctgcccaagtaggattgtcctcaatcttctagaaggttacgaagttactatccctaagcgggttatcccaacaggcattcctttggaaaaatatattcgtgatgacatcacagcagaagaagtaaccaacttaaaagcagaattgggcattgctggtgatgaaaccatgttattgagtttgtcacggatttcttatgaaaaaaatattcaagctatcatcaatcagatgccagctattttggctgaaaatgccaagataaagcttattattgtaggaaatggcccctatttgcaagatttgaaacacttggcgatgcagttagaggttgacaaacacgtgacctttacaggcatggtgcctcatgataaggttgctctgtactataaggcttgtgatttctttatctcagcatcaactagtgagactcagggcttgacctatattgaaagtttggctagtggcactcctattattgctcatggcaatccttatttagatgatgtggtgactgataaaatgtttggcactctttattacgctgaaacagatttaactgatgctattattgatgccatactaaaaacaccagttatggataaacggttattagcaaaaaaacgttatgaaatctcagcacagcactttggaaaatctatttacacgttctatttagatacgttaattgctagaaatagcaaagaagctcaaaagctgagtctttatcttaatcattctggtaaaagtagttctctaaaattagtgcaaggtgctattcacttgcctaaacgtgctgctaaggtcacagctatcacctcagtaaaagtagtcaaggctcctatcaagctggtccatgctatcaaagattttctggat

SEQ ID NO: 1216 - protein, 444 aa, Streptococcus pyogenes
MRIGLFTDTYFPQVSGVATSIRTLKEELEKEGHEVYIFTTTDRDVKRFEDPTIIRLPSVPFVSFTDRRVVYRGLISSYKIAKHYNLDIIHTQTEFSLGLLGKMIGKALRIPVVHTYHTQYEDYVSYIANGKIIRPSMVKPLLRGYLKDLDGVICPSRIVLNLLEGYEVTIPKRVIPTGIPLEKYIRDDITAEEVTNLKAELGIAGDETMLLSLSRISYEKNIQAIINQMPAILAENAKIKLIIVGNGPYLQDLKHLAMQLEVDKHVTFTGMVPHDKVALYYKACDFFISASTSETQGLTYIESLASGTPIIAHGNPYLDDVVTDKMFGTLYYAETDLTDAIIDAILKTPVMDKRLLAKKRYEISAQHFGKSIYTFYLDTLIARNSKEAQKLSLYLNHSGKSSSLKLVQGAIHLPKRAAKVTAITSVKVVKAPIKLVHAIKDFLD

SEQ ID NO: 1217 - DNA, 996 bp, Streptococcus agalactiae
atgaaagttttactgtatttagaggctgaagaatacttgaaaaagtcaggtatcggtcgtgctatcaaacatcaagagaaagctcttcaaattgctgggatagattataccactaatcctacagatgactttgaccttgttcatatgaatacctatggtattagaagttggcttttgatgagtaaagctaaaaaaactgggaaaaaagtaattatgcatggccattccactgaagaggactttagaaattcttttattggctcaaatttagtatccccgctttttaaatggtacctttgccgtttttatcaaaaagcagatgccattataaccccaactgattattctaaacaactaataaaagcatatggcatcaagaaaccaatttttgttttatctaacgggattgatctaagtcgctatcagaggtcagaaaagaaagaatctgcatttcgtcactattttcacttaagtaaggatgataaagttgttatgggggccggtctttatttcatgcgtaagggaattgaccaatttgttgaagtagctgcaaaaatgcctgatattcgttttatttggtttggagaaacaaataaatgggttattcctcgaaaggttaggcaaatcgttaccaagcaacatccctcaaatgttacttttgctggttacataaaaggtgatgtttatgaaggtgccatgagtgctagcgatgctttcttctttccgagtcgtgaagagacagaagggatagtagttttagaggctttagctagtcatcagcatgtggttttaagagatatccctgtgtatcacggttgggtgaccgaagacagtgttgaattagcgactgatgttgatggttttgttgaaaagttggataaagtcttatctggtaagagtgataagattaaagaaggttatcatgtggctgagagtcgaagtatcgaacgaattgcccatgaattggcaagtgtttatcaaaaagtaatggagttg

SEQ ID NO: 1218 - protein, 332 aa, Streptococcus agalactiae
MKVLLYLEAEEYLKKSGIGRAIKHQEKALQIAGIDYTTNPTDDFDLVHMNTYGIRSWLLMSKAKKTGKKVIMHGHSTEEDFRNSFIGSNLVSPLFKWYLCRFYQKADAIITPTDYSKQLIKAYGIKKPIFVLSNGIDLSRYQRSEKKESAFRHYFHLSKDDKVVMGAGLYFMRKGIDQFVEVAAKMPDIRFIWFGETNKWVIPRKVRQIVTKQHPSNVTFAGYIKGDVYEGAMSASDAFFFPSREETEGIVVLEALASHQHVVLRDIPVYHGWVTEDSVELATDVDGFVEKLDKVLSGKSDKIKEGYHVAESRSIERIAHELASVYQKVMEL

SEQ ID NO: 1219 - DNA, 996 bp, Streptococcus pyogenes
atgaaagtcttattgtatttagaagcagaaaattatctaagaaaatcaggaattggtcgagcgattaagcatcaggctaaagccttgtcacttgttggtcaacattttacgactaatccaagagaaacttatgatttggttcatctcaatacctatggtttaaaaagttggctgctgatgataaaagcacaaaaagctggtaagaaggttatcatgcatgggcattctacagaagaagattttagaaattcttttattttttcaaatctattatctccttggtttaaaaaatacctttgtcacttttacaataaggcagatgctatcattacccctaccctatattctaagtctttgattgagagttatggagtgaagtcacctatttttgcagtgtcaaatgggattgatttggagcagtacggagcagatcctaaaaaggaagcagcttttcgtcgctactttgacattaaagagggtgaaaaagtggttatgggagcaggattattttttctgaggaaaggaattgatgactttgtcaaagttgcccaagctatgccagatgttcgttttatctggtttggcgagaccaacaaatgggtcattcctgctcaagttcgccaaatggtcaatggtaaccacccgaaaaatcttattttcccaggatacattaaaggggatgtttatgaaggtgccatgactggtgcagatgcctttttctttccaagtcgtgaagaaacagaaggcattgttgtcttagaagccttggccagtcgccagcaccttgttttacgtgatataccagtttactacggatgggttgatcaaagtagtgcggaattagcaaccgatataccaggttttatagaagctctgaaaaaagtcttttctggtgccagcaacaaagttgaagctggttacaaggttgcccagagtcgtcgcctagaaacggttggccatgccttagtagatgtctataaaaaagtaatggagtta

SEQ ID NO: 1220 - protein, 332 aa, Streptococcus pyogenes
MKVLLYLEAENYLRKSGIGRAIKHQAKALSLVGQHFTTNPRETYDLVHLNTYGLKSWLLMIKAQKAGKKVIMHGHSTEEDFRNSFIFSNLLSPWFKKYLCHFYNKADAIITPTLYSKSLIESYGVKSPIFAVSNGIDLEQYGADPKKEAAFRRYFDIKEGEKVVMGAGLFFLRKGIDDFVKVAQAMPDVRFIWFGETNKWVIPAQVRQMVNGNHPKNLIFPGYIKGDVYEGAMTGADAFFFPSREETEGIVVLEALASRQHLVLRDIPVYYGWVDQSSAELATDIPGFIEALKKVFSGASNKVEAGYKVAQSRRLETVGHALVDVYKKVMEL

SEQ ID NO: 1221 - DNA, 1464 bp, Streptococcus agalactiae
atgacaaatgaattgataatgcaagcttttgagtggtatttacctagtgatgggaatcactggaagaaattagaggagtctatatcagaccttaaaaaacttggaattagtaaaatctggttaccaccagcatttaagggaactagcagtgatgatgtaggatatggtgtttatgatctctttgatttaggagaatttgaccagaatggaacaattagaacaaaatatggtaggaaagaagagtatctaaagcttattaagtcgttaaaggcaaatggcattaaaccgtttgcagatatcgttcttaaccataaagccaatggtgatcataaagaaaaatttcaagtcatcaaagtcaatcctgaaaatcgtcaagaagcattaagtgaaccctatgagattgaaggatggacgggatttgatttcccaggtagacagggtgagtacaatgattttaaatggcactggtaccactttactggtttagattacgatgctaaaaataatgaaacagacatctttatgattgtaggcgataataaaggttgggcagacgatgatttgattgatgatgaaaatggtaatttcgattatctcatgtacaatgacattgattttaagcatcctgaagttataaaaaacttacaagattgggctaagtggtttattgaaactacaggcattgaaggttttcgtttggatgctgtgaaacatatcgattcttactttattcaaactttcattaatgatattcgtacaaaaataaaacccgatttagaggtctttggcgaatattggaaatctgaccaaacatcaatgaaggactatttagaggcaacacaatttcaattttctcttgttgatgttaccttacatatgaatttttttgatgccagtcaccaaaaccgtgattttgatatgcgaacaatttttgatgatagtcttgttattgataatcctgagtatgctgttacattcgtagaaaatcatgatacgcaaagtggacaagctctagaaagtagagtggaagattggtttaaacctttagcttatggcttgatacttttacgccaacaagggactccatgtcttttttatggtgattactatggcattcaaggagaatttggtcaaccatcctttaaagaggttattgataaaatggctgagctacgccaaaactatgtatttggcaaacaagtcgattattttacgcattcaaattgtattggttggacttgtcttggggatgaggaacataattcttgtttagctgtggtcctaacaaatggtgatcagggatggaaacatatggaagtaggggaaatttatgcaggcaaaacgtttgttgattatttaggtaattgtgaacaagaggttgttataggagatgatggttggggtgattttttagttgaatctgcgtctatctcggcttgggttcctaaaatagaggaagctaac

SEQ ID NO: 1222 - protein, 488 aa, Streptococcus agalactiae
MTNELIMQAFEWYLPSDGNHWKKLEESISDLKKLGISKIWLPPAFKGTSSDDVGYGVYDLFDLGEFDQNGTIRTKYGRKEEYLKLIKSLKANGIKPFADIVLNHKANGDHKEKFQVIKVNPENRQEALSEPYEIEGWTGFDFPGRQGEYNDFKWHWYHFTGLDYDAKNNETDIFMIVGDNKGWADDDLIDDENGNFDYLMYNDIDFKHPEVIKNLQDWAKWFIETTGIEGFRLDAVKHIDSYFIQTFINDIRTKIKPDLEVFGEYWKSDQTSMKDYLEATQFQFSLVDVTLHMNFFDASHQNRDFDMRTIFDDSLVIDNPEYAVTFVENHDTQSGQALESRVEDWFKPLAYGLILLRQQGTPCLFYGDYYGIQGEFGQPSFKEVIDKMAELRQNYVFGKQVDYFTHSNCIGWTCLGDEEHNSCLAVVLTNGDQGWKHMEVGEIYAGKTFVDYLGNCEQEVVIGDDGWGDFLVESASISAWVPKIEEAN

SEQ ID NO: 1223 - DNA, 2133 bp, Streptococcus pyogenes
atgagagaattacatatcaaaacttataagttattaacgaaaagtgctgttttacttggcttaatttcatttccactaactgtttctgctgccgataatgcttctgtcaccaacaaagcagatttttcaacagatacgatttatcagattgtaacagatcgttttaacgatggtaatacctctaataatggtaagactgatgtttttgataaaaatgaccttaaaaaataccatggaggtgattggcaaggaatcatcgccaagattaaggatggttacctgacagatatggggatttctgccatttggatttcttctcctgttgaaaatatcgacagtattgatccttctaatggaagtgctgcatatcatgggtattgggctaaggacttctttaaaacaaaccagcattttggcactgaagcagactttcaacaactagtcaaagtagctcatcaacaccatattaaggtagttattgattttgctcctaatcatacgtctacagccgaaaaagaaggcacaactttcaaagaagatggcgctttatataaaaacggtaaattagttggtaaattttcagatgataaagacaagatttttaatcatgaatcttggaccgattttagtacttatgaaaattctatttatcattcaatgtacggactagctgatttaaataacattaatccgaaagttgaccagtacatgaaagaagctattgataaatggttagacctgggtgttgatggtatccgagttgacgctgttaaacatatgtcacaaggttggcaaaaaaattggttgagtcatatctatgaaaaacataatgtctttgttttcggggaatggttctcgggacataccgacgatgattatgatatgacgacatttgctaacaatagtgggatggggcttttagattttagatttgccaatgctattagacagttgtatacaggtttttcaacgtttaccatgcgagatttttacaaggttcttgaaaatagagatcaggtgactaatgaagtgacagaccaggtgacctttattgataatcatgatatggaacgcttcgcaacaaaagtggctaataatcaaactgctgttaatcaagcctatgctttgcttttaacatctagaggtgtgcctaatatttattatggtacagagcagtatgcaacaggtgataaagatcctaataatcgtggtgatatgccaagttttaataaagagtcacaagcctataaagtgattagtaagctagctcctttaagaaaacaaaatcaagctttagcttatggaacaactgaacaacgttggattagtgatcatgttttggtatttgagcgtaaatttggtaatcatgtcgcactagtggctattaatagagatcaaacgaatggttatacaattactaatgctaaaacagccttgccccaaaatagctacaaggacaaattagaaggtcttcttggcggtcaagaattaatagttggagcagatggcactattagtagctttgaacttggagcggggcaagtcgctgtatggacttatgaaggagaggacaagacaccacaacttggagatgtcgatgcttcagtgggtattgctggaaataagattactatttcaggtcaaggttttggtaattctaaaggtcaagtgacttttggagaaatctctgctgagatcctttcttggtcagatacccttatcaccttaaaagtaccgacggttccagcaaattattataacatttcagtgacaactgccgataagcaaaccagcaatagttaccaagcctttgaagtattgactgataaacaaattcctgttcgtttactcatcaatgattttaagacagtaccaggggaacaactatatctcatgggtgatgtttttgagatgggggcaaatgacgctaagaatgctgttggtcctctatttaataacactcagaccattgccaagtacccaaactggttctttgatactcatctaccaatcaataaagaaatagcagtcaaacttgttaaaaaagatagtattgggaatgttttatggacaagtcctgagacttatagtataaagacaggtcatgaagcacaaaccattactataaaaaaa

SEQ ID NO: 1224 - protein, 711 aa, Streptococcus pyogenes
MRELHIKTYKLLTKSAVLLGLISFPLTVSAADNASVTNKADFSTDTIYQIVTDRFNDGNTSNNGKTDVFDKNDLKKYHGGDWQGIIAKIKDGYLTDMGISAIWISSPVENIDSIDPSNGSAAYHGYWAKDFFKTNQHFGTEADFQQLVKVAHQHHIKVVIDFAPNHTSTAEKEGTTFKEDGALYKNGKLVGKFSDDKDKIFNHESWTDFSTYENSIYHSMYGLADLNNINPKVDQYMKEAIDKWLDLGVDGIRVDAVKHMSQGWQKNWLSHIYEKHNVFVFGEWFSGHTDDDYDMTTFANNSGMGLLDFRFANAIRQLYTGFSTFTMRDFYKVLENRDQVTNEVTDQVTFIDNHDMERFATKVANNQTAVNQAYALLLTSRGVPNIYYGTEQYATGDKDPNNRGDMPSFNKESQAYKVISKLAPLRKQNQALAYGTTEQRWISDHVLVFERKFGNHVALVAINRDQTNGYTITNAKTALPQNSYKDKLEGLLGGQELIVGADGTISSFELGAGQVAVWTYEGEDKTPQLGDVDASVGIAGNKITISGQGFGNSKGQVTFGEISAEILSWSDTLITLKVPTVPANYYNISVTTADKQTSNSYQAFEVLTDKQIPVRLLINDFKTVPGEQLYLMGDVFEMGANDAKNAVGPLFNNTQTIAKYPNWFFDTHLPINKEIAVKLVKKDSIGNVLWTSPETYSIKTGHEAQTITIKK

SEQ ID NO: 1225 - DNA, 1002 bp, Streptococcus agalactiae
atgaatacagatgatacgattacgatttatgatgttgcccgtgaagcaggtgtttcgatggcaactgttagtcgtgtggtaaatggaaataaaaatgtcaaggaaaatacacgtaagaaagtccttgaagttattgatcgtcttgactatcgtccaaatgctgtggcgcgtggtttagcaagtaaaaaaacgacaactgttggtgttgtcattcctaatatcgcaaatagctacttttcaattttagcgcgtggtattgatgatattgcagcaatgtacaaatataacattgtccttgcttcaagtgatgaagacgatgataaagaggttaatgttgttaatactttgtttgctaagcaagtagacggtattatttttatgggacaccacttaactgaaaagattcgtgcagagttctctcgttcacgcacaccgattgttttagcaggtactgtggaccttgagcatcaattaccaagtgttaatatcgattacaaagcagcagcagttgatgttattgatattttagctggcaatcataaagacattgcttttgtatcaggaccacttattgacgatattaatggcaaggttcgtttggcaggatacaaagaaggtctcaagaaaaatggcttaaactttaaagaggggttggtttttgaagccaactaccgttatgctgaaggctttgcattagctcaacgcgtgattaatgctggagcaacagcagcatatgttgctgaggatgagttagcggcaggtttgttaaatggtctttttgaggcaggtaaacgtgttcctgaagattttgaaattatcacaagcaatgactcgccaatcgcacaatatacacgtcctaacttaacttctatcagtcaaccggtctatgatttgggtgctgttagcatgcgtatgctaacaaaaattatgcacaaagaagagttggaagaaaaagaaatagtgcttaatcacgggattgttaaacgtggcacaacaaataat

SEQ ID NO: 1226 - protein, 334 aa, Streptococcus agalactiae
MNTDDTITIYDVAREAGVSMATVSRVVNGNKNVKENTRKKVLEVIDRLDYRPNAVARGLASKKTTTVGVVIPNIANSYFSILARGIDDIAAMYKYNIVLASSDEDDDKEVNVVNTLFAKQVDGIIFMGHHLTEKIRAEFSRSRTPIVLAGTVDLEHQLPSVNIDYKAAAVDVIDILAGNHKDIAFVSGPLIDDINGKVRLAGYKEGLKKNGLNFKEGLVFEANYRYAEGFALAQRVINAGATAAYVAEDELAAGLLNGLFEAGKRVPEDFEIITSNDSPIAQYTRPNLTSISQPVYDLGAVSMRMLTKIMHKEELEEKEIVLNHGIVKRGTTNN

SEQ ID NO: 1227 - DNA, 999 bp, Streptococcus pyogenes
atgaatacagatgatccccttacaatttatgatgttgcccgtgaagctggtgtttcaatggcaaccgttagtcgtgttgttaatggcaataaaaatgttaaggaaaatacacgtaagaaagttttagaagttattgatcgccttgactatcgtcccaatgctgtcgcgcgtggtctcgccagcaaaaagacaacaaccgttggcgttgtgattccaaatattgcaaatagttatttttctatcttagctaagggtattgacgatatcgccgctatgtacaaatataatattgtgcttgcctccagtgatgaagatgatgacaaggaggttaatgttgtcaataccctttttgccaagcaagtggatggtattatttttatggggcatcacttgacagaaaaaatccgggccgagttttcacgctctcgtactccagttgttttggcaggaactgtagatcttgatcatcaattaccaagcgtcaacattgactatagagctgcggtgtcaaacgttgttgatattttagctgaaaatcataagtgtatcgcttttgtgtcaggaccactcattgatgatatcaatggtaaagtgcgcttagcaggttacaaagaagggttgaagcacaataagcttgacttcaaagaaggccttgtttttgaagcgaactattcttataaagaaggatttgaattggcgcagcgcgtcattaactcaggagcaacagcggcttatgtggctgaagatgaattggcagcgggccttttaaacggcttgtttgaagcaggtaaacgcgtaccagaggactttgaaatcatcaccagcaacgattcaccagtggttcaatacactcgtcccaatttgagttctatcagtcaacctgtttatgacttaggtgctgttagcatgcggatgttgactaaaatcatgaacaaagaagagttggaagaaaaagaaattcttttgaatcatggtattaaaaaacgtgggacaactaag

SEQ ID NO: 1228 - protein, 333 aa, Streptococcus pyogenes
MNTDDPLTIYDVAREAGVSMATVSRVVNGNKNVKENTRKKVLEVIDRLDYRPNAVARGLASKKTTTVGVVIPNIANSYFSILAKGIDDIAAMYKYNIVLASSDEDDDKEVNVVNTLFAKQVDGIIFMGHHLTEKIRAEFSRSRTPVVLAGTVDLDHQLPSVNIDYRAAVSNVVDILAENHKCIAFVSGPLIDDINGKVRLAGYKEGLKHNKLDFKEGLVFEANYSYKEGFELAQRVINSGATAAYVAEDELAAGLLNGLFEAGKRVPEDFEIITSNDSPVVQYTRPNLSSISQPVYDLGAVSMRMLTKIMNKEELEEKEILLNHGIKKRGTTK

SEQ ID NO: 1229 - DNA, 1083 bp, Streptococcus agalactiae
atgtcaaaacttaatcgtatacgccatcacttacattcagtccaagctgaacttgctgtcttttctgatcctgtgacagtcaactatttaacaggtttcttttgcgatccccatgaaagacaaatgtttttatttgtctatgaagatcgcgatcctattttatttgtaccagcactagaagtatcgcgtgcaaaacaaagtgtaccatttcccgtctttggttacatagattcagaaaatccttggcaaaaaatagctagcaacttaccatccttttctgtttctaaagttctagccgaatttgataatcttaatgttactaaattccaaggtctccaaaccgtttttgatggtcattttgaaaacctaacaccttatattcaaaacatgcgcctaattaaatcacgagatgaaattgagaaaatgttagtcgctggagaatttgctgataaagctgttcaagttggatttgacaatatctcgctaaacaacactgaaaccgatattatcgctcaaatcgaatttgaaatgaaaaaacaaggtatcaataaaatgagtttcgacactatggttttgactggcaataatgcagcaaatccacatggtatcccaggaactaataaaatcgaaaataatgctttgttattatttgatttaggtgtagaaacactaggttatacgtcagatatgacccgtacagtagcagtggggaaacctgatcaattcaaaaaagatatttaccatttatgtcttgaagcacatcaagcggctattgattttattaagccaggagtccttgcttctgaagttgacgcagcagcaagaaatgttattgaaaaggctggttatggacaatactttaaccaccgccttggtcatggattaggtatggatgtccatgaatttccatctattatggctggtaacgatatggagattcaagaaggcatgtgcttctctgttgaaccaggtatttatataccagataaagttggtgtgcgaattgaagactgcggttatgtgactaaaaccggctttgaagtatttaccaaaacacccaaggaactactctattttgaagga

SEQ ID NO: 1230 - protein, 361 aa, Streptococcus agalactiae
MSKLNRIRHHLHSVQAELAVFSDPVTVNYLTGFFCDPHERQMFLFVYEDRDPILFVPALEVSRAKQSVPFPVFGYIDSENPWQKIASNLPSFSVSKVLAEFDNLNVTKFQGLQTVFDGHFENLTPYIQNMRLIKSRDEIEKMLVAGEFADKAVQVGFDNISLNNTETDIIAQIEFEMKKQGINKMSFDTMVLTGNNAANPHGIPGTNKIENNALLLFDLGVETLGYTSDMTRTVAVGKPDQFKKDIYHLCLEAHQAAIDFIKPGVLASEVDAAARNVIEKAGYGQYFNHRLGHGLGMDVHEFPSIMAGNDMEIQEGMCFSVEPGIYIPDKVGVRIEDCGYVTKTGFEVFTKTPKELLYFEG

SEQ ID NO: 1231 - DNA, 1083 bp, Streptococcus pyogenes
atgacaaaattagaccaaatacgtttgtatcttgaccaaaagggagctgaattggcgattttctcagatcctgttacgattaactatttaaccggattcttctgtgacccacatgaaagacaactgttcttgtttgtctaccatgatttagctcctgtgctttttgtacctgcccttgaggtggccagagctagccaggccatatcatttcctgtgtttggttatgttgactctgaaaatccttgggaaaagatcaaggccgttttaccaaatacagcagccaaaaccatttatgctgaatttgaccaccttaacgtcaataagttccatggcttgcagactatcttttcaggacaatttaacaatctaaccccttatgtccaaggcatgcgcctcgtcaaatcagctgatgaaatcaataaaatgatgattgccgggcagttcgctgataaggctgttcaagttggttttgacaatatttccttagatgctaccgaaacagacgtcatcgctcaaattgagtttgaaatgaaaaaacaaggcattcataaaatgagctttgacactatggtcttaactggaaataatgcagccaatccccatggcattcctggaacaaataacattgaaaacaatgccctacttctctttgacttaggtgttgagaccttaggctacaccagtgatatgaccagaactgtggctgttggtcagccagaccaatttaaaatcgatatctacaatctctgcctagaggcacaactagcggctattgactttatcaaaccaggtgtaacagctgctcaagtagatgctgctgctcgtcaagtgattgaaaaggctggatatggtgagtacttcaaccaccgcttgggacatggtatcggcatggatgtccacgaatttccctccattatggctggcaatgacttggtccttgaagaaggtatgtgcttctctgttgaacctggtatttacattccaggaaaggtcggtgtgcgcatcgaagactgtggccatgtcactaaaaatggctttgaagtctttacccatactccaaaagagttgctttattttgaaggc

SEQ ID NO: 1232 - protein, 361 aa, Streptococcus agalactiae
MTKLDQIRLYLDQKGAELAIFSDPVTINYLTGFFCDPHERQLFLFVYHDLAPVLFVPALEVARASQAISFPVFGYVDSENPWEKIKAVLPNTAAKTIYAEFDHLNVNKFHGLQTIFSGQFNNLTPYVQGMRLVKSADEINKMMIAGQFADKAVQVGFDNISLDATETDVIAQIEFEMKKQGIHKMSFDTMVLTGNNAANPHGIPGTNNIENNALLLFDLGVETLGYTSDMTRTVAVGQPDQFKIDIYNLCLEAQLAAIDFIKPGVTAAQVDAAARQVIEKAGYGEYFNHRLGHGIGMDVHEFPSIMAGNDLVLEEGMCFSVEPGIYIPGKVGVRIEDCGHVTKNGFEVFTHTPKELLYFEG

SEQ ID NO: 1233 - DNA, 102 bp, Streptococcus agalactiae
atgataggattacgccaattacgtgtcaaatctacaattggagaaaatgaagcattacaacccacagcagatgcctccatccctgcgattcttcccatttca

SEQ ID NO: 1234 - protein, 34 aa, Streptococcus agalactiae
MIGLRQLRVKSTIGENEALQPTADASIPAILPIS

SEQ ID NO: 1235 - DNA, 1788 bp, Streptococcus agalactiae
atgacacatttagttgacttaacaaagaaacccttcaatctaaatcaagaagcaattgagtggattgaaaaaacaattaatgagatgacattggatgagaaaattgggcaactttttttcaatatgggagctagtcgttcagaagaatatttaacagatgttttggatcggtatcatattgctgctgttcgctataatagaggtagttcaagtgaaatctatgatcagaatttaattttacagacaaagtcgaaattgccgatgttgattgctgcaaatacagaagctggtggagacggtgctgtcacggatggaactaaagttggcgatgaaataaaagtggctgctacaaatgatccgaaatatgcttatgaaatgggaagaatcgcagggatggaggcatctgctgtgggttgtaatgcttcattttctccaattgtagatttgacacgtaattggcgtaatcctatcatagctagtcgaaattggggtgctaacgttgatcaaattatttcactttcaaaagagtatatgaaaggaatcatgcaatataatattgtacctttcgctaaacattttccaggggatggcattgatgagcgtgatcatcatttgtcatttgcttccaatcctatgagtaaagaggagtggatgtcgacatttggccgcatttatggtgaattggctgacgcaggtttaccaggagtcatggcaggtcacatacatttaccaaacgttgaaaaagaaatgcatccagagcgagaccttgatgatatgttaccagcttcattgaataaaacacttttagatgagttattgagaggagagttaggttataatggagctattgtaacggacgcttctcatatggttggaatgactgcttcaatggcaaggagagatttgttgccaacggcgattgaagcaggttgtgatttattcttattctttaatgaccctgatgaagacattcaatggatgaaagaaggttacgaaaaaggtattctaacagaggaacgtctccatgacgctttacgtcgtactctcggtctaaaagcgaaattaggcttgcataactatgagggacgtcgccaagaactctttatgcctaaagataaggctatggctttaatcaacacattagagtcgcaaaaaatagctgatgaagttgctgataaagcagtaactctggtaaaagataaacaaaaagatatctttccagtaaatccagaacgttatcgtcatatcttacttgttaacgttgaaggatataagggaggttttggtgcgatgattgctggaaacaagcaacgtgcatcggattacatgaaagagttacttgaggcacgtggccatgaagtaactgtctgggagtctaccgaagagcgtattatgaaattgccacaagaggagcgggcagcagctatcgctaatgtttacgcacaaaaacagccaatcgcaaatctaacagaacactatgacttgattattaacttggtagatgtcaatgctggaggaacaacacaacgtattatttggccagcagctaaaggcacccctgatcagcctttttacgttcatgaaataccatctattgtgatttcagtacaacatgcatttgctttagcagatatgccacaggtagggacttatattaatgcttatgatgggcttcctagcacgataagtgcagtagttgcgaaattggctggagaatcagaatttacaggagtttcaccagtagatgcttactgtggtttaattgatacacatttatggcgccaatgc

SEQ ID NO: 1236 - protein, 596 aa, Streptococcus agalactiae
MTHLVDLTKKPFNLNQEAIEWIEKTINEMTLDEKIGQLFFNMGASRSEEYLTDVLDRYHIAAVRYNRGSSSEIYDQNLILQTKSKLPMLIAANTEAGGDGAVTDGTKVGDEIKVAATNDPKYAYEMGRIAGMEASAVGCNASFSPIVDLTRNWRNPIIASRNWGANVDQIISLSKEYMKGIMQYNIVPFAKHFPGDGIDERDHHLSFASNPMSKEEWMSTFGRIYGELADAGLPGVMAGHIHLPNVEKEMHPERDLDDMLPASLNKTLLDELLRGELGYNGAIVTDASHMVGMTASMARRDLLPTAIEAGCDLFLFFNDPDEDIQWMKEGYEKGILTEERLHDALRRTLGLKAKLGLHNYEGRRQELFMPKDKAMALINTLESQKIADEVADKAVTLVKDKQKDIFPVNPERYRHILLVNVEGYKGGFGAMIAGNKQRASDYMKELLEARGHEVTVWESTEERIMKLPQEERAAAIANVYAQKQPIANLTEHYDLIINLVDVNAGGTTQRIIWPAAKGTPDQPFYVHEIPSIVISVQHAFALADMPQVGTYINAYDGLPSTISAVVAKLAGESEFTGVSPVDAYCGLIDTHLWRQC

SEQ ID NO: 1237 - DNA, 810 bp, Streptococcus agalactiae
atggtagatacaaatcacaaaatcgctttttgcatagattctgatggttgcgcaatggatacaatgacatataagcatcaactcttttttggtccaattgctgcagatatatttgggatatcagaacaagaaagaacaagttttttaaaagagtgggatagagtcaatctttattcaagaactcgtggagttaatcggtttgtgggattggttatgggccttgagtttgccggagtagaacatattgataaattaaaagaatgggtcgaaacaacagactcattgtccaataattccttagagttagcgcttgccaacgattttagtagagatttagagaaggctttagaatggtccaatgaagtgaatcgccaaatcaaaaattatgagggagattctttagcgttttcaggtgtgttagaaagtttagaacgattaagtcaatttggtaatgtttatgtcgtgagttctgctaacaaggaagctgtttggcaagagtgggaagaacagggattgctaaagtatgttgatgatatctattgtcaagatagaggtaaaaaagaagatgttatcgccactttaattgcaagtggttactgccgtgaaactattttgatggtaggagattccctgggtgatctggctgcagcagaacaaaatggtattgcattttacccagtacttgttggtaaggaagtcaaatcatgggaaattcttagagaagatattggtgaagcttttgcaaaaggtcaattcgaacagcaaaggcaaaaagaatctattaataccttttgggctaatttagataac

SEQ ID NO: 1238 - protein, 270 aa, Streptococcus agalactiae
MVDTNHKIAFCIDSDGCAMDTMTYKHQLFFGPIAADIFGISEQERTSFLKEWDRVNLYSRTRGVNRFVGLVMGLEFAGVEHIDKLKEWVETTDSLSNNSLELALANDFSRDLEKALEWSNEVNRQIKNYEGDSLAFSGVLESLERLSQFGNVYVVSSANKEAVWQEWEEQGLLKYVDDIYCQDRGKKEDVIATLIASGYCRETILMVGDSLGDLAAAEQNGIAFYPVLVGKEVKSWEILREDIGEAFAKGQFEQQRQKESINTFWANLDN

SEQ ID NO: 1239 - DNA, 888 bp, Streptococcus agalactiae
ttgtacttagctaagagtagaatacttatagaagttaatgagaggaataagatgtcaaaaacaattacatttaccaataaagttgtcgtcataacaggtgcaggcggtgttctctgtggttatatggctaaagaatttgcgaaagcaggcgctaaagtggcattattagatttgaatcaagaagctgctcaaacatttgctgatgaaattgtagaagaaggtggtatcgctaaggcttataaagctaacgttttgtctaaagaaaaccttgaagaagtgcatcaagccgttttagaggatcttggaccaactgatattttagttaatggtgcaggaggcaacaatcctaaagctacaactgataatgaatttcacgaattagacttaccttcagaaacaaaaaccttctttgagttagatgaagctggtattagctttgtttttaacttaaattatttaggaacattattgccaacgcaagtatttgcccaagatatggttggacgtgaaggagcgaatattattaatatctcttcaatgaatgcttttacccctctgaccaaaataccagcttattctggagctaaagcagctattagtaacttcacacaatggctagctgttcatttctcaaaagttggtatccgttgtaatgctattgcacctggtttcttggtaacaaatcagaaccgaagcttgttatttactgaggacggtcagccaactgcgcgtgctgagaaaattcttaataatacaccaatgggaagatttggagaagcaagtgagctgattggcggattgttctttttagcagatgaaaaatcatcaagttttgttaatggcgttgtccttccgattgatggtggatttgctgcttactctggtgtt

SEQ ID NO: 1240 - protein, 296 aa, Streptococcus agalactiae
MYLAKSRILIEVNERNKMSKTITFTNKVVVITGAGGVLCGYMAKEFAKAGAKVALLDLNQEAAQTFADEIVEEGGIAKAYKANVLSKENLEEVHQAVLEDLGPTDILVNGAGGNNPKATTDNEFHELDLPSETKTFFELDEAGISFVFNLNYLGTLLPTQVFAQDMVGREGANIINISSMNAFTPLTKIPAYSGAKAAISNFTQWLAVHFSKVGIRCNAIAPGFLVTNQNRSLLFTEDGQPTARAEKILNNTPMGRFGEASELIGGLFFLADEKSSSFVNGVVLPIDGGFAAYSGV

SEQ ID NO: 1241 - DNA, 792 bp, Streptococcus pyogenes
atggaaaatatgttttcgttacaaggtaagattgccttgattaccggagcatcttacggtattggttttgaaattgccaaagcctatgctcaagcgggtgcaactattgtgtttaatgacatcaaacaagagttagttgataaggggttggctgcctatcgagagttagggatagaagcgcatggctatgtttgtgacgtgactgatgaagctggtatccaacagatggttagtcaaattgaagatgaagtaggtgctattgatattttggtcaacaatgcaggtattattaggcgtacgccgatgcttgaaatggccgcagaagattttcgtcaagttattgatattgatttaaatgctccttttattgtgtcaaaagctgtattaccatcaatgattgcaaagggacatggtaaaattataaatatctgttctatgatgagcgaattggggcgtgaaacagttagtgcctacgcggcggctaaaggtggcttgaaaatgttaaccaaaaatatagcctctgagtttggagaagccaacattcaatgtaatgggattggtcctggctacattgcgacgccccaaacagctccgttgagagagcgacaagcagatggtagtcgtcatccttttgatcaatttatcattgctaaaacaccagcagcacgttgggggacaacagaagacttagctggtccagctgtttttctagctagcgatgccagtaattttgtcaacggccatattctttatgtcgacggtggcattttagcttatattggaaaacaacct

SEQ ID NO: 1242 - protein, 264 aa, Streptococcus pyogenes
MENMFSLQGKIALITGASYGIGFEIAKAYAQAGATIVFNDIKQELVDKGLAAYRELGIEAHGYVCDVTDEAGIQQMVSQIEDEVGAIDILVNNAGIIRRTPMLEMAAEDFRQVIDIDLNAPFIVSKAVLPSMIAKGHGKIINICSMMSELGRETVSAYAAAKGGLKMLTKNIASEFGEANIQCNGIGPGYIATPQTAPLRERQADGSRHPFDQFIIAKTPAARWGTTEDLAGPAVFLASDASNFVNGHILYVDGGILAYIGKQP

SEQ ID NO: 1243 - DNA, 1044 bp, Streptococcus agalactiae
atggaaatgtcatttaggtggtatggtgaagacgaccccgttactttagaaaatattggtcaaattccaacaatgaaagggattgttacagcgatatacgatgtaccagtaggagaagtttggtcacgtgagcgcattcaacagctgaaagaaaaggtagaggcagcagggcttaaaatttcggttatcgaatcagtacctgttcatgaagatatcaaattgggacgtccaacacgtgatctcttgattgataattatattcaaaccgtcaaaaatttggctgcggaaggtattgatactatttgttataattttatgccagtatttgactggacacgcactgatttagcatatcaatatccagatggttccacagctttgatatttgatgagacggtttctaaaaaaatggatccagtaaacggtgaattatctttgccaggatgggatgccagctatagtaaagaagaaatgaaggctatcatggatgcctatgctgaaattgatgaggaaaaactttgggaaaatctcacttattttattaaacgtattattcctgaagcggaagccgtaggcgttaaaatggccattcatccggatgacccaccatattctatttttggtttacctcgcattattactgggttagaggctattgagcgttttgtgaaattgtacgatagtaaaagtaatggcatcactttatgtgtgggttcttacgcttctgatccccagaatgatgttttagagatttcgcgacgtgcttttgagttagatcgtgtaaactttgttcatgctcgcaatattaaattaggtgatggaaagtcatttaaagaatcggctcatccatcagaatacgggtcaatagacatgtatgaagttattaagttatgccatgaatttgggtttgagggtgctattcgacctgaccacgggcgtatgatttggggagaaacaggtcgtccaggatatggcctatacgatagagctttaggagccacttacgtttctggtttatacgaagctgtgattaaaggttcaaaa

SEQ ID NO: 1244 - protein, 348 aa, Streptococcus agalactiae
MEMSFRWYGEDDPVTLENIGQIPTMKGIVTAIYDVPVGEVWSRERIQQLKEKVEAAGLKISVIESVPVHEDIKLGRPTRDLLIDNYIQTVKNLAAEGIDTICYNFMPVFDWTRTDLAYQYPDGSTALIFDETVSKKMDPVNGELSLPGWDASYSKEEMKAIMDAYAEIDEEKLWENLTYFIKRIIPEAEAVGVKMAIHPDDPPYSIFGLPRIITGLEAIERFVKLYDSKSNGITLCVGSYASDPQNDVLEISRRAFELDRVNFVHARNIKLGDGKSFKESAHPSEYGSIDMYEVIKLCHEFGFEGAIRPDHGRMIWGETGRPGYGLYDRALGATYVSGLYEAVIKGSK

SEQ ID NO: 1245 - DNA, 93 bp, Streptococcus agalactiae
gtgaaggctatatcccaaatcaatcagaaatcagcaaatggcaaacagctgtttttatggaactttgccgattatataaaaaatatggttttg

SEQ ID NO: 1246 - protein, 31 aa, Streptococcus agalactiae
MKAISQINQKSANGKQLFLWNFADYIKNMVL

SEQ ID NO: 1247 - DNA, 1398 bp, Streptococcus agalactiae
atggcgtttaatactgaaacatttatgttaaaaaatcaagcagctatacagctgtatgaagaggtcaagagacaacctatttttgattatcattgccacttagatccaaaggacatttttgaagatcatatttttgataatattgtggatttgtggcttggtggtgaccactataaatggcgtcttatgagggctaatggtatttctgaagcagaaattacaggtccagcatccaaccttgagaaatttaaagcatttgctagaacactagaaagagcatacggtaatcctgtttatcattggtctgctatggaattgaaaaatgtctttggtgttaatgagattttgacagaatcaaatgctgaggaaatttatcatcgtttaaatcatttcttgaaagagcataaaataagtcctagacgtttaattgcagatagcaaagttatgtttattggtactacagaccaccctcttgatactctcgagtggcataaaaagttggctgctgatgagagttttaaaacagttgttgctccgacatttaggccagatgaagcttttattgaacatcgacattttgttgattttattactaaactgggtgacattactcaaaaagagattacagatttttcaacatttatagcagcaatggaagaacgcattgcgtattttgctcaaaatggttgtagggctagcgatatcagttttacggaaatcgtctttgaacaaactgatgaattggagttgaacgatttatttaataaagtttgtgaaggctatatcccaaatcaatcagaaatcagcaaatggcaaacagctgtttttatggaactttgccgattatataaaaaatatggttttgtaacacaggtgcattttggagctttgagaaataatcattctactatttttgaaaaattgggagctgacgtgggtgtggattcacttggtgaccaagtggctttaactgttaatatgaaccgtttattggattccttggttaaaaaagatagtctgcctaaaatgatttggtataatctcaatccagcttacaatatagcagtagctaacactttggcaaattttcaagctaacgaacttggagtgagatcttaccttcaatttggtgcaggttggtggtttgcagatactaaattagggatgattagtcaaatgaatgccttagcagagcaaggcatgttggcgaattttattggtatgttaacagattctagaagttttctatcttatcaacgtcatgactattttcgacgtattttatgtacctacttaggagaatggattgaagaaggagaagttccagaagattatcaagctttaggaagtatggctaaagacatcgcttatcaaaatgcagttaattattttaagaac

SEQ ID NO: 1248 - protein, 466 aa, Streptococcus agalactiae
MAFNTETFMLKNQAAIQLYEEVKRQPIFDYHCHLDPKDIFEDHIFDNIVDLWLGGDHYKWRLMRANGISEAEITGPASNLEKFKAFARTLERAYGNPVYHWSAMELKNVFGVNEILTESNAEEIYHRLNHFLKEHKISPRRLIADSKVMFIGTTDHPLDTLEWHKKLAADESFKTVVAPTFRPDEAFIEHRHFVDFITKLGDITQKEITDFSTFIAAMEERIAYFAQNGCRASDISFTEIVFEQTDELELNDLFNKVCEGYIPNQSEISKWQTAVFMELCRLYKKYGFVTQVHFGALRNNHSTIFEKLGADVGVDSLGDQVALTVNMNRLLDSLVKKDSLPKMIWYNLNPAYNIAVANTLANFQANELGVRSYLQFGAGWWFADTKLGMISQMNALAEQGMLANFIGMLTDSRSFLSYQRHDYFRRILCTYLGEWIEEGEVPEDYQALGSMAKDIAYQNAVNYFKN

SEQ ID NO: 1249 - DNA, 708 bp, Streptococcus agalactiae
ttgaatagctatttttttagtattcttcttgacaattcatcagatgacttatataatatagttaaagataacggttacattttgggaggtattatgttaaatcaattgaaaaacaactatttctttgctgttattcgagggaaatcatctgaggatgcgctcgaaatcgcaaagcatgctattttgggtggtattcggaatattgaagtaactttttcgactcctgaagcaagcaaagtcatcaaacaattatcagatgactttaaaaataataaagaaattattgtgggggccggaacggtcatgacaactgaacttgctaaagaggctattgatgctggagctaaatttttggttagcccacactttgattcagatattgctaatttagctaatgaaaacaaggtttattatttcccaggctgtgcaacggcaacagaaatcgtggtagctagaaagtataaatgtcagattataaagctttttccaggtggagttgtgggtccaggttttatcaaagatattcatggtcctattccagatgttgatttaatgccatcaggtggcgtctctgtttcaaatgtagttgaatggagaaaagcaggagcagttgcggttggtgttggctcagcattatctagtaaagtagccacagaaggctatgatagtgttactaaaatagctaaacagtttgtttctgcacttgat

SEQ ID NO: 1250 - protein, 236 aa, Streptococcus agalactiae
MNSYFFSILLDNSSDDLYNIVKDNGYILGGIMLNQLKNNYFFAVIRGKSSEDALEIAKHAILGGIRNIEVTFSTPEASKVIKQLSDDFKNNKEIIVGAGTVMTTELAKEAIDAGAKFLVSPHFDSDIANLANENKVYYFPGCATATEIVVARKYKCQIIKLFPGGVVGPGFIKDIHGPIPDVDLMPSGGVSVSNVVEWRKAGAVAVGVGSALSSKVATEGYDSVTKIAKQFVSALD

SEQ ID NO: 1251 - DNA, 633 bp, Streptococcus pyogenes
atgggaaaaatagaaatcttaaccaaacttaaggctaatcggcttgtcctagttgtacgaggagagtctagtgaggaagctttagcttgcagcctggccagtattgaaggtggcattaagacaattgaagtcacctatactaacccctttgctagtgaggttatcggtcaattagctgaacgcttcaaagaagatcctgaggtattgataggtgctgggacagttttggatgatgtcactgcccgccaagctattttagcaggagcacagtttattgttggtcctaatttcaatcgagcagtggctttgatttgtcatcgttatagcataccttatttaccaggttgtatgacggttaatgaagtggttacagcattagaatcaggggttgatatggtcaaaatttttcctggttctactgtagggatatcctttattcgggcaatcaaatctcctttgccacaagtagaggttatggttacaggcggagtttcttcagataatctcaaagactggctagctgctggagtagatgttctaggcataggaggcgagtttaatcagttagcgagccaaaaacaatataacctaatcactaagaaagccgctcattatatcaaaagtttgcgacaa

SEQ ID NO: 1252 - protein, 211 aa, Streptococcus pyogenes
MGKIEILTKLKANRLVLVVRGESSEEALACSLASIEGGIKTIEVTYTNPFASEVIGQLAERFKEDPEVLIGAGTVLDDVTARQAILAGAQFIVGPNFNRAVALICHRYSIPYLPGCMTVNEVVTALESGVDMVKIFPGSTVGISFIRAIKSPLPQVEVMVTGGVSSDNLKDWLAAGVDVLGIGGEFNQLASQKQYNLITKKAAHYIKSLRQ

SEQ ID NO: 1253 - DNA, 669 bp, Streptococcus agalactiae
atggctagacccttagtagaacaaacagcagatcgtctattgcatttaattttagaaagagaataccctgttggtgctaagctccccaatgaatatgaattagcagaagatctagatgttggtcgcagcacaatccgagaagcagtcagaagtttagcaacgcgtaatattttagaagtcagacagggctctggaacatatattagttctaaaaagggtgtttctgaggatccattagggttctctctaataaaggacacagataggttgacatcagatctctttgaactacgccttttattggaacctcgaatagcagagctggtagcttatagaattacagatgatcagttacaattactcgaaaagcttgttggagatattgaagatgctgttcacgcaggcgatccgaaacatttacttttagacgtggaatttcattccatgctagctaaatacagtggtaatattgcaatggatagccttttgccagtcatcaaccagtcaattcatctgataaatgcgaattatacaaatcgtcagatgaagtcggatagtttagaagcacatagagaaattatcaaagcaatccgagaaaaaaatccagtagctgcacatgatgctatgcttatgcatatcatgagtgttagacgttcagcattgaaagct

SEQ ID NO: 1254 - protein, 223 aa, Streptococcus agalactiae
MARPLVEQTADRLLHLILEREYPVGAKLPNEYELAEDLDVGRSTIREAVRSLATRNILEVRQGSGTYISSKKGVSEDPLGFSLIKDTDRLTSDLFELRLLLEPRIAELVAYRITDDQLQLLEKLVGDIEDAVHAGDPKHLLLDVEFHSMLAKYSGNIAMDSLLPVINQSIHLINANYTNRQMKSDSLEAHREIIKAIREKNPVAAHDAMLMHIMSVRRSALKA

SEQ ID NO: 1255 - DNA, 723 bp, Streptococcus pyogenes
atgaataaccgacttgaggagtgtggcatgttaccagcttatataaaaattcatgatgcaattaaaaaagacattgatctgggcatctggccaattggtagtcgcttaccaagtgaacgacatttagcggaacatttcaccgttagtcgaatgactctacggcaggctattacattactagtagaagaagggattcttgaaaggcggataggaagtggtacttatgttgccagtcatcgtgttcaagaaaaaatgcgaggaacaacaagtttcacagaaattatacgctcccaaggacgacaaccctcctctaaattattatcctatcaaaagcaattagctagtgataccgaagttaaagaattgaacttagacaaaacagacttggtcattcgaatggaacgtatccgctatgcagacagtgtccctttggtgtacgaaattgcttcaatcccagaaaaatttataaaaacggttaaacgagctgatattacagaacacttttttcactcattgatagcaaatggttacgagattggtaaaagtaaacagacaatctacgctaagctagcaagtgagcgtgtagcctcctacttggaagttgctaaaggacatgccattttggctctaactcaggtgtcttactttacagacggcaaaccttttgagtatgtccgcagtcagtatatcggtgaccgttttgaattttacttagaaaataat

SEQ ID NO: 1256 - protein, 241 aa, Streptococcus pyogenes
MNNRLEECGMLPAYIKIHDAIKKDIDLGIWPIGSRLPSERHLAEHFTVSRMTLRQAITLLVEEGILERRIGSGTYVASHRVQEKMRGTTSFTEIIRSQGRQPSSKLLSYQKQLASDTEVKELNLDKTDLVIRMERIRYADSVPLVYEIASIPEKFIKTVKRADITEHFFHSLIANGYEIGKSKQTIYAKLASERVASYLEVAKGHAILALTQVSYFTDGKPFEYVRSQYIGDRFEFYLENN

SEQ ID NO: 1257 - DNA, 1863 bp, Streptococcus agalactiae
atgatattgcttacctcattgaaaaagaaacaaatgatattaaacgatagtgtaaaaggagagtgtatgttatatccattattgacaaaaacaagaaatacttatgatttaggcggtatttggaactttaaattaggagaacataatccaaatgaattactaccttcagatgaagtcatggttatcccgacttcatttaatgatttgatggtaagtaaagaaaaacgtgattatataggtgatttttggtatgaaaaagtcattgaagtacctaaagtatcagaggatgaagagatggtgctgcgttttggctcagtgacacatcaagctaaaatttatgttgacggtgtattggtaggagagcataagggaggttttactccttttgaagttcttgttcctgaatgtaagtataataatgagaaaattaaggtatcaatttgtgctaataacgttttagactataccacgcttccggtcggaaattatagtgaaatcattcaagaagatggtagcattaagaagaaagtacgtgagaattttgatttcttcaattatgcaggtgtgcatcgtcctcttaagttgatgatacgtcctaaaaatcatatttttgatattacaattacaagtcgtctatcagatgatttacagtcagcagatttacattttttagtggagactaatcaaaaggttgacgaagttagaattagcgtttttgatgaagataacaaactagtgggtgaaacgaaggatagcagattatttcttagtgatgtccatctttgggaagttttaaatgcctatctgtacacagcgcgtgttgaaatttttgttgataatcaactccaagatgtctatgaggaaaattttggtcttagagaaatagaagtgacaaatggtcaattcctattgaatcgcaaacctatttattttaaaggatttggtaaacatgaagatacgttcattaatggcagaggtttgaatgaagctgctaacttaatggatttgaatcttttgaaggatatgggggcaaactcttttagaacatcccattatccttattctgaagaaatgatgcgtttagcagatcgaatgggagtgttagtgatagatgaggttccagcagtagggttatttcaaaattttaacgcttccttagatttgtcaccaaaagataatggtacgtggaatttgatgcaaacaaaagcggcgcatgaacaagctatccaagaattagtgaagcgtgataaaaatcatcctagcgtcgtgatgtgggtagtcgctaacgaaccggctagtcatgaagcgggagcacatgattattttgagccattagtaaaactttataaagatttagaccctcaaaaacgtcctgtcaccttggttaatattttaatggcaaccccagatagagaccaagtgatggacctggttgatgttgtctgccttaatcgttactatggttggtacgttgaccacggtgatttaacaaatgcagaagtaggtataagaaaagagttattagaatggcaagataaatttcctgacaaaccaattatcataacggagtatggcgctgatacgttaccgggattacattctacttggaatattccatatacagaagaatttcaatgtgatttttatgaaatgagtcatcgtgtttttgatggtattcctaatttagttggtgagcaagtctggaattttgcagactttgaaactaatctgatgatacttcgtgtacaggggaatcacaaaggtctcttttcaaggaatcgccagccgaaacaagtcgtcaaagaatttaaaaaacgctggatgactattcctcattaccataataaaaaaaatagtgtaaaa

SEQ ID NO: 1258 - protein, 621 aa, Streptococcus agalactiae
MILLTSLKKKQMILNDSVKGECMLYPLLTKTRNTYDLGGIWNFKLGEHNPNELLPSDEVMVIPTSFNDLMVSKEKRDYIGDFWYEKVIEVPKVSEDEEMVLRFGSVTHQAKIYVDGVLVGEHKGGFTPFEVLVPECKYNNEKIKVSICANNVLDYTTLPVGNYSEIIQEDGSIKKKVRENFDFFNYAGVHRPLKLMIRPKNHIFDITITSRLSDDLQSADLHFLVETNQKVDEVRISVFDEDNKLVGETKDSRLFLSDVHLWEVLNAYLYTARVEIFVDNQLQDVYEENFGLREIEVTNGQFLLNRKPIYFKGFGKHEDTFINGRGLNEAANLMDLNLLKDMGANSFRTSHYPYSEEMMRLADRMGVLVIDEVPAVGLFQNFNASLDLSPKDNGTWNLMQTKAAHEQAIQELVKRDKNHPSVVMWVVANEPASHEAGAHDYFEPLVKLYKDLDPQKRPVTLVNILMATPDRDQVMDLVDVVCLNRYYGWYVDHGDLTNAEVGIRKELLEWQDKFPDKPIIITEYGADTLPGLHSTWNIPYTEEFQCDFYEMSHRVFDGIPNLVGEQVWNFADFETNLMILRVQGNHKGLFSRNRQPKQVVKEFKKRWMTIPHYHNKKNSVK

SEQ ID NO: 1259 - DNA, 3504 bp, Streptococcus pyogenes
atggtttatcgccaaaagagttcagagatcgttacaaggacaattaccaagccatcaagggcgaccagtaacgtcaaacaggagattgatatgacaccagatagcaaggagcagacagtgactggctaccaataccactatattgatcaagaaggaagaaagcagccctttaatcaaggctggcgttttcttatggcagatgtggcgtgtgctcaggacccttcttttgatgattcgaactggcaggtgattcatttaccacatgatttcagtcttacgcagccttacacaagaaatggtgaagctgaaagtgcttataaattaggtggtgtcggttggtatcggcattatctcgtgttagatgaggttttagctggttgtcatgttgccattacttttgagggttcctatatggaaacggaaatttatgttaacgggcaattcattggcaaacacttaaatggctatcaggaatttacttatgatatctctgatgttgtgacttttggagctgaaaatcttctggctgtccgggttgaaaacaaggttcccagttctcgttggtattcaggcagtggtctttatcgtgaagtgagtttgtctgttcttccccagcttcattttgtggcagaccaggtagcaatgaccttggctgatactgctgtgcaggagaaagggcaacagaaagttgatttacgctttgccctcaatcagtctattcagacttgccactaccaattgagcctctgtttatgggaacaatcacattgctcaaaagacaagaaactcctttatcaagaaacagaagtgcctctagctgatttggctttccaaagacagtatggtcttacactgtctttggaagaactccaattgtggtcaccagataatcctcacctctacgatttagaactcactctttactatcaaggtcaggtcattgattgcttttgccttgaaactggttttcgtcagctgacttttatggccaatcaggggctttttgtgaatggcagagctgtcaaattaaagggagtttgtttgcatcatgaccaaggaggcctaggagcttgtgcttacgaagatgccctagccagacaattagtcctgttgaaagacatgggggctaataccattcgtagcacccataacccaagtagtcccaaacttaggcaactagccaatcgtctcggcttttttgtgattgaagaagcctttgacacctggacctatgccaaaaatggaaacgttaatgacttttcaaactatttccatcagactatcggaactgaaaatgcaaactatcttcaaagagtgaggtcacctgaaacgagctgggcccagtatagtattgaggccatggtctggtctgccaagaatgacccgtcagtgttgatgtggtcgattggtaatgaattgatggagggtttttcagccgatgtcagtcattacccagagctgacaagacaaatgtgccaatggattactgctattgacacctcacgtcccattacctttggggacaataaattaaaagaagctgacttttgctggcatgaggaagtgtcgcaaatggcaactcttcttagtcaattagaccatcctcagggactcattgggttaaactatgctgatggaaaagactatgataggcttcatgaggagcactctgattggctgttgtatggttctgaaacagtctcagccattaccagcagggcttattataaagagacaaaaaaagttcttgactccggttatcacctaacctcttatgatcatgctaaggttgattggggtgccttcgctagccaggcttggtatgataccattacccgtgattttgttgctggcgaatgcgtttggacaggctttgattatttaggagaacctaccccctggaacaagatcgacagcggtgttgtaggcctttggccttctcctaaaaatgcctactttggcattttagacacggcaggctttccaaaagatagctattatttttaccaaagtcagtgggcgcaggggcagaccaccttgcacctgttaccagtctggcagaaggaccagctttgtttcgatgagcagggattggtggaggttgtggtttatagcaatgctgccagtgtgcaactgatgtttgaagatgagcagggcaacttaacagattatggaaggaaggcatttcatacttatagcacgccaacgggacacacttatcagctttaccaaggagctgacgctgctaagaatcctcacgagaacctttacctgacttggcgagtgccctatcaaaaagggttgctaagggcagtggcctacgacatttctggtaaaagcattccaaaaaccagtggacgttctcaggttagaacctatggttcagtggcaaagctatcttggaaagcctttgaagcacctattgacgctccttgggaattgctttatctggatttatcactcttggatagccgaggtgaattggtcagccatgctcaagattggttgcaggttcaagtagaaggaccagcccgtttgttggctcttgataatgggaatccgactgaccacaccccttatcaggagcctctgcgccaggcatatgggggaaaattattagccattttagccctcactggagaggcgggacacattaaggtcacggcaaaagcctcgcagcaacttagcagtgtttttcagacacaagtagcctgccgtgcccccaaagaacacttagtgacactacctttagagaaatatcagtttaaaaagagccgactgacaagtcaacaagaaattggtcaatcttgtctaaagaccacacaattcctttctgttttggagaacaaagacacccagcaaaaagcaggtaaggctagcacacctcacattcttatcactagttaccagcactatttatctctgcccttgcaggtttgttctcaggcatttgattttaaaaaaggcgacgatatcttcttgcctcagtggctccaagtcaaagatgcccaaggttctcttgtgaaaaaagctttttcaatgacgtggtacctaaaagagaaaatctttgccaagcctattcttgtcacaggctatgtttcttgttttgggcaatcaataccggttgaggcaaggcttaacctagcacaagctagcaaaagacggcaccaggatctcagtttagtcgccaagcaatccctggccgcaagtcaaaaaaggctaacttattgctaccaatatgatacggtgcaagccataggagccattagcttgcaaaatcacacaggcacatctcttagtgtttctgtggcaatcagttatggtagtcagagctctattaagcaagaaaccttgatgctagctgatagccacttgagccagttagaagaggttattttcttcgatgatattttgactgttttgtatctggcagtgacccttgaagtcattgaaggacctgacctaactgaagacagtattcaaattggcctttgggatttagca

SEQ ID NO: 1260 - protein, 1168 aa, Streptococcus pyogenes
MVYRQKSSEIVTRTITKPSRATSNVKQEIDMTPDSKEQTVTGYQYHYIDQEGRKQPFNQGWRFLMADVACAQDPSFDDSNWQVIHLPHDFSLTQPYTRNGEAESAYKLGGVGWYRHYLVLDEVLAGCHVAITFEGSYMETEIYVNGQFIGKHLNGYQEFTYDISDVVTFGAENLLAVRVENKVPSSRWYSGSGLYREVSLSVLPQLHFVADQVAMTLADTAVQEKGQQKVDLRFALNQSIQTCHYQLSLCLWEQSHCSKDKKLLYQETEVPLADLAFQRQYGLTLSLEELQLWSPDNPHLYDLELTLYYQGQVIDCFCLETGFRQLTFMANQGLFVNGRAVKLKGVCLHHDQGGLGACAYEDALARQLVLLKDMGANTIRSTHNPSSPKLRQLANRLGFFVIEEAFDTWTYAKNGNVNDFSNYFHQTIGTENANYLQRVRSPETSWAQYSIEAMVWSAKNDPSVLMWSIGNELMEGFSADVSHYPELTRQMCQWITAIDTSRPITFGDNKLKEADFCWHEEVSQMATLLSQLDHPQGLIGLNYADGKDYDRLHEEHSDWLLYGSETVSAITSRAYYKETKKVLDSGYHLTSYDHAKVDWGAFASQAWYDTITRDFVAGECVWTGFDYLGEPTPWNKIDSGVVGLWPSPKNAYFGILDTAGFPKDSYYFYQSQWAQGQTTLHLLPVWQKDQLCFDEQGLVEVVVYSNAASVQLMFEDEQGNLTDYGRKAFHTYSTPTGHTYQLYQGADAAKNPHENLYLTWRVPYQKGLLRAVAYDISGKSIPKTSGRSQVRTYGSVAKLSWKAFEAPIDAPWELLYLDLSLLDSRGELVSHAQDWLQVQVEGPARLLALDNGNPTDHTPYQEPLRQAYGGKLLAILALTGEAGHIKVTAKASQQLSSVFQTQVACRAPKEHLVTLPLEKYQFKKSRLTSQQEIGQSCLKTTQFLSVLENKDTQQKAGKASTPHILITSYQHYLSLPLQVCSQAFDFKKGDDIFLPQWLQVKDAQGSLVKKAFSMTWYLKEKIFAKPILVTGYVSCFGQSIPVEARLNLAQASKRRHQDLSLVAKQSLAASQKRLTYCYQYDTVQAIGAISLQNHTGTSLSVSVAISYGSQSSIKQETLMLADSHLSQLEEVIFFDDILTVLYLAVTLEVIEGPDLTEDSIQIGLWDLA

SEQ ID NO: 1261 - DNA, 1056 bp, Streptococcus agalactiae
ttgttaaataagagctaccattggaggattcttatggcaaaaattatttcattaggtgaggttcttttgcgattatctccacctcaatatcacacactgatgcaggctaatcacctaaaatgccaattcggtggttcagaacttaatgtcttagcaagccttgctcaactaggttaccatgtaggattggtctcagctttgcctgataatgatttgggcaagatggcaagtcaatttatattgtcacagcaaattagtccagctgctataattaaaaaagaaggacgactaggaatttattactatgaacaaggattttcggtaagaacaaataaggttatctacgatcgtaactattcatctttttgggaaagtaccttgagtgattatgattttacttctatttttaagggagtggattggtttcatgtttctggaattactccagcactaaccaaggacttatatgaggtgactcggttccttatgacaaaagctaaagaaggaggtgtaaaagtatcgattgatctcaattttcgtgagagtttatggtcatcttttcaagaggcacgtgagcaattatcgccactattaggattattagatgtttgctttggcttagagccgatttatttagctggcgaaagtgaagatttaaaagatgagttgggcttatccagaccttaccttgatattgaattacttgaaaagataacccaaaagattgtccaagaatatgggttagactatattgcctttactcaaagggaaatggaatatactaatcagtatatgttaaaatcatatttgtatcataataatatgttatatcaaactgataaaactggcgttgaagtattagatcgtgtggggacaggagatgcctttgctgcaggtttaattcatgcgcttctggaaaaagaaactcctcaaagggccttagaaatagctatggctacatttaaatacaaacataccattcaaggagatatcaatatcatgacacgagatgatattgcttacctcattgaaaaagaaacaaatgatattaaacga

SEQ ID NO: 1262 - protein, 352 aa, Streptococcus agalactiae
MLNKSYHWRILMAKIISLGEVLLRLSPPQYHTLMQANHLKCQFGGSELNVLASLAQLGYHVGLVSALPDNDLGKMASQFILSQQISPAAIIKKEGRLGIYYYEQGFSVRTNKVIYDRNYSSFWESTLSDYDFTSIFKGVDWFHVSGITPALTKDLYEVTRFLMTKAKEGGVKVSIDLNFRESLWSSFQEAREQLSPLLGLLDVCFGLEPIYLAGESEDLKDELGLSRPYLDIELLEKITQKIVQEYGLDYIAFTQREMEYTNQYMLKSYLYHNNMLYQTDKTGVEVLDRVGTGDAFAAGLIHALLEKETPQRALEIAMATFKYKHTIQGDINIMTRDDIAYLIEKETNDIKR

SEQ ID NO: 1263 - DNA, 1038 bp, Streptococcus pyogenes
ttgaacagtaattccattttgacgaggaaaggaggtcacatgtctaagttattattggttggtgaaccgctgattcgcgttagccccaatcagtttcagcctttgaccaatgcctgcgaggctcagctttttttcggcggttcagaagttaatattgcaagaactctaggcggttttggcttagaagcaaggctatttacggccctaccagataatcctgttggtcacgcttttcatcagtttttgaagcaaagcggcgtggatatgtccttgacggcttggcaaggtcatcgcgttgggctatattaccttgaaaatggctttggctgtcgggctagtcaggtttattatgaccgctgtggctctagcttttcggccttagataaggatagtcttgatttagctgccatttttgaaggcattagtcactttcattttagtgggatcagtttggcgttgggcaaaaaaactcaggacctgattgaggtacttgtgagagaagctaagaaaagggatatttgtatttcctttgaccttaactttagatctagtatgattgccgtagctgatgctaaacgactcttttctcactttgctcaatacgcggatattatttttggcatggaacctttgctgttagacagtgacgattttgacatgtttgatagaaaaaaggcagatactacgacgattagagaacgtctggcaggactttatcagcgctatcagttacaagctatttaccatacggagcgttcaaatgatgcccaaggcagtaatcatttcaaagcttatgcctatgataggcagttttacgaatcctgtgaagtgacgaccccagtcttgcaacgggttggaagtggagatgcttttgtggcgggtttactttatcagttgttagaaggtaacgaaaagcagcgcaaccttgattttgctgtggcaacagctagcctaaaatgtacagtagctgaagatcagctctatcacagtgtccaacaagtagaagcagtcttagctaatcaacgagatatccagagg

SEQ ID NO: 1264 - protein, 346 aa, Streptococcus pyogenes
LNSNSILTRKGGHMSKLLLVGEPLIRVSPNQFQPLTNACEAQLFFGGSEVNIARTLGGFGLEARLFTALPDNPVGHAFHQFLKQSGVDMSLTAWQGHRVGLYYLENGFGCRASQVYYDRCGSSFSALDKDSLDLAAIFEGISHFHFSGISLALGKKTQDLIEVLVREAKKRDICISFDLNFRSSMIAVADAKRLFSHFAQYADIIFGMEPLLLDSDDFDMFDRKKADTTTIRERLAGLYQRYQLQAIYHTERSNDAQGSNHFKAYAYDRQFYESCEVTTPVLQRVGSGDAFVAGLLYQLLEGNEKQRNLDFAVATASLKCTVAEDQLYHSVQQVEAVLANQRDIQR

SEQ ID NO: 1265 - DNA, 177 bp, Streptococcus agalactiae
atggccacaaggatactaatagctgccatttttaaatcagggggcagtggtgtttcgatagttggaaatgattttgaaaatccaattcctgctaacacaaaacctactaccataggagcaaatgaagaagcaatcgaatctgttaaggagaagatagttccaatcattcctgataca

SEQ ID NO: 1266 - protein, 59 aa, Streptococcus agalactiae
MATRILIAAIFKSGGSGVSIVGNDFENPIPANTKPTTIGANEEAIESVKEKIVPIIPDT

SEQ ID NO: 1267 - DNA, 1548 bp, Streptococcus agalactiae
atggagaaaacaatggatatggaacaacgtgaagaagttgtatcttataaccgagcgaaagtatggcagttagttatgtttgccatgaacaatgcttctacaaatatatacttatttacgtttatgtttgttacctatttctcaactggcgttcttggctcggcagccatttttgtcagtcaaattatgggttatatccgtatttttgatggttttattgatccagctattggtattatgattgataaaactgatacaaaatttggtaagtatcgtcctattttgattattgggaacgttattacggctttgtcattgatttttcttcttgcattgagaggtgtcgatgaaaatattcgtttcccattatttatccttgttctaattatccataaaattggatactcaatgcaacagacaataactaaagcagggcaaacagcactgacaaatgaccctaagcaacgtcctatttttaatatcgttgatgcagttatgacaacatcattaatgacaggcggtcagtttgtcgtttcagttttcttagtaccaaaatttggtaattttacacctcaattcttcaatgtccttatttttggaacaattcttatttcagctattttagcaatcgttgcaattattgggatttgggcaaaagacagaaaagaattctttggtttaggagagaatacccaaaagactgctctaaaagattactggaaggtgttgaaaggaaataaaccgcttcagatattatccattgctgcagctttggtaaaatttgccatccaattctttggcgattccgttgttatggtgctattgtttggtattttatttggtaattatgctttatcaggacaattctcacttcttttcattgttcctggtgttattattaatattttgttctcaacaattgctcgtaaaaaaggtcttcgtttttcatatgtcagagcaattcagatcggtatgattggtttacttgcttttggtgcagttctttacgttggtaagcctggtgaccttagtttaacaagcctaaatctttatactattttatttatcgttactaatattattgcgagatacgcttcacaagcacctgctagtttagtattgactatgggagcagatatttctgactatgaaacttctgaatccggtcgttatgtatcaggaatgattggaactatcttctccttaacagattcgattgcttcttcatttgctcctatggtagtaggttttgtgttagcaggaattggattttcaaaatcatttccaactatcgaaacaccactgccccctgatttaaaaatggcagctattagtatccttgtggccattccatttatagctttgtctatagctcttcttttaatgaaattttacaaactagataaagaagaaatggttcgtattcaagagaagattcaagttatgaaagcagcaactactaaggaacgtgctaaagatattgctcgtaatgttcctttgacagatatggattatgttgatgtaacaaaatatcctattgataaagat

SEQ ID NO: 1268 - protein, 516 aa, Streptococcus agalactiae
MEKTMDMEQREEVVSYNRAKVWQLVMFAMNNASTNIYLFTFMFVTYFSTGVLGSAAIFVSQIMGYIRIFDGFIDPAIGIMIDKTDTKFGKYRPILIIGNVITALSLIFLLALRGVDENIRFPLFILVLIIHKIGYSMQQTITKAGQTALTNDPKQRPIFNIVDAVMTTSLMTGGQFVVSVFLVPKFGNFTPQFFNVLIFGTILISAILAIVAIIGIWAKDRKEFFGLGENTQKTALKDYWKVLKGNKPLQILSIAAALVKFAIQFFGDSVVMVLLFGILFGNYALSGQFSLLFIVPGVIINILFSTIARKKGLRFSYVRAIQIGMIGLLAFGAVLYVGKPGDLSLTSLNLYTILFIVTNIIARYASQAPASLVLTMGADISDYETSESGRYVSGMIGTIFSLTDSIASSFAPMVVGFVLAGIGFSKSFPTIETPLPPDLKMAAISILVAIPFIALSIALLLMKFYKLDKEEMVRIQEKIQVMKAATTKERAKDIARNVPLTDMDYVDVTKYPIDKD

SEQ ID NO: 1269 - DNA, 993 bp, Streptococcus agalactiae
gtgatgaaactcaaagtatttaatgttagagaagaagaagcaacattagcacaagattgggcaaaccgaaatcatgtggaactttctatgagtgaaggacctttgacattggaaactgttaatgaggtagaaggttttgatgggattgctaatgcacagattgagcctttagatgatgctatttatcctcttctcaaagaaatgggaattaagcaaatcgctcagcgcagtgctggtgttgatatgtataatcttgagttagctaagcaacatggtattatcattagcaatgtgccaagttactcaccggagtctattgcagaatttacagtgacaatcgctcttaaccttattcgaaaagttgagcttattagagctaatgttcgtgaacagaatttttcatggaccttgccaattcgaggacgagtcctaggtaacatgactgtggctataataggaactggtcgcattggtctagcgactgctaaaatttttaaagggttcggatgtcgtgttattggttatgatatttaccataatccaatggcagatggtatccttgagtatgtcaattcggtagaagaagctgttgaagaagctgatcttgtgtccttacatatgccaccaactgctgaaaatacgcatctatttaatttagatatgtttaaacagtttaaaaaaggtgctattttaatgaatatggcacgtggagcattggtggaaaccaaagatcttcttgaggctttagatcaagggcttttggagggagctggtattgatacttatgaatttgaggggccatatatacctaaaaattgtcaaggtcaagacatttcagacaaggatttcctaagactgattaaccatccgaaagtaatatacactcctcatgcggcttattatacagatgaagcggtcaaaaatctagtagagggtgccttaaatgcttgtgtagaagtgattgaaacgggaacaactactacgaaagtcaac

SEQ ID NO: 1270 - protein, 331 aa, Streptococcus agalactiae
MMKLKVFNVREEEATLAQDWANRNHVELSMSEGPLTLETVNEVEGFDGIANAQIEPLDDAIYPLLKEMGIKQIAQRSAGVDMYNLELAKQHGIIISNVPSYSPESIAEFTVTIALNLIRKVELIRANVREQNFSWTLPIRGRVLGNMTVAIIGTGRIGLATAKIFKGFGCRVIGYDIYHNPMADGILEYVNSVEEAVEEADLVSLHMPPTAENTHLFNLDMFKQFKKGAILMNMARGALVETKDLLEALDQGLLEGAGIDTYEFEGPYIPKNCQGQDISDKDFLRLINHPKVIYTPHAAYYTDEAVKNLVEGALNACVEVIETGTTTTKVN

SEQ ID NO: 1271 - DNA, 252 bp, Streptococcus agalactiae
ttgactgaccacccagccatacaaagcccaaaactagcagcacagatacctaaattagcagcaccagaaccaattccggacaaactaattgccaaagcaatcccaactgttgtgattggagatacgatcaagaaacagaaaatcatcgcaattaaaattgacatcaaaacaggttgtaaaccaagtaatgaagcaatcccttgtccacgccaaacgcatgaagaaacttttgttttcagaaaactagattca

SEQ ID NO: 1272 - protein, 84 aa, Streptococcus agalactiae
MTDHPAIQSPKLAAQIPKLAAPEPIPDKLIAKAIPTVVIGDTIKKQKIIAIKIDIKTGCKPSNEAIPCPRQTHEETFVFRKLDS

SEQ ID NO: 1273 - DNA, 303 bp, Streptococcus agalactiae
atggctaatgtattagcaaaaccgaagattatgctacctatgatatcttcagcagcaatactaggaattctcggagctctctttaatattcaaggaacaccagctagtgcaggttttggtatcagtggtttgattggaccgattaatgctcttaatttagcaaaaggtggatggtcagttatgaatatgttattgataattataatatttgttgctgcaccaattatattgaattttatttttaattacctctttataaaagtacttaaaattattgatccaatggactataaattagatatt

SEQ ID NO: 1274 - protein, 101 aa, Streptococcus agalactiae
MANVLAKPKIMLPMISSAAILGILGALFNIQGTPASAGFGISGLIGPINALNLAKGGWSVMNMLLIIIIFVAAPIILNFIFNYLFIKVLKIIDPMDYKLDI

SEQ ID NO: 1275 - DNA, 543 bp, Streptococcus pyogenes
atgattggtcaaggaatagcgtctctacttggtttacaacctattttgatgtctctccttattgccatgattttctgcttccttattgtttctccaattacaacggtaggaattgctcttgcgattaacttatctggtattggttcaggtgccgcaagctttggactttgcttagcaggttgggctgttaattcaaaaggaacttcacttgctcacgtcttgagatcaccgaaaatttcaatggccaacgttttatcaaaaccaaaaatcatgttgccaatgttatgttctgcagctgtacttggtgttattggtgctatctttaatattcaaggaacacctgctagtgcaggctttggaattagtggtttgatcggacctatcaatgcccttaatttagctaaaggcggatggtgtccagtaaatattctacttatcattatcatttttgtaggggcaccaattgttctcaatatgatctttaactacctttttatcaaggtgcttaaagtgattgatccaatggattacaaacttgatatc

SEQ ID NO: 1276 - protein, 181 aa, Streptococcus pyogenes
MIGQGIASLLGLQPILMSLLIAMIFCFLIVSPITTVGIALAINLSGIGSGAASFGLCLAGWAVNSKGTSLAHVLRSPKISMANVLSKPKIMLPMLCSAAVLGVIGAIFNIQGTPASAGFGISGLIGPINALNLAKGGWCPVNILLIIIIFVGAPIVLNMIFNYLFIKVLKVIDPMDYKLDI

SEQ ID NO: 1277 - DNA, 618 bp, Streptococcus agalactiae
gtgaaatcacaaacaatcattattagtaggaggcatcttatgtcggatgttgtcgaaaaacaaacaactaaatcgtttataatgaacgtattaaatggtttagctttagggactgttattgtcttgataccaggagcaatccttggagaattaatgaaagctttactgccaatgtggagcggctttgcaactttaatcgctgcaacagcagttgcaacaagtatgatggggcttgttattggtattatggttggtctcaattttaaatttaatcccattcaatcagcatcactaggattagcggttatgtttgcaggtggagctgcaaccttccttaaaggcgctattatgctaaaaggaacaggcgatatcattaacatgggaattactgctgccttaggtgtccttttgatccaatttttatctgacaagacgaaatcattcactttgattgtcattccaacagtaacactcttactagttggaggagtaggtcatgtgttattaccttatgtcaaaatgattaccaccatgattggacaagggacacgccgtacgcatgaaaactttctcttcatccttttgtgcccggacatcaattttgaaaagattcctttt

SEQ ID NO: 1278 - protein, 206 aa, Streptococcus agalactiae
MKSQTIIISRRHLMSDVVEKQTTKSFIMNVLNGLALGTVIVLIPGAILGELMKALLPMWSGFATLIAATAVATSMMGLVIGIMVGLNFKFNPIQSASLGLAVMFAGGAATFLKGAIMLKGTGDIINMGITAALGVLLIQFLSDKTKSFTLIVIPTVTLLLVGGVGHVLLPYVKMITTMIGQGTRRTHENFLFILLCPDINFEKIPF

SEQ ID NO: 1279 - DNA, 1056 bp, Streptococcus pyogenes
atgacaacaacagataaagagacatttagttcttttatgaataaggtcttggctggtacagcgattgctatcgttgtggcactcattccaaatgctattttagcgactttcttaaaaccgcttttgccaaatatggcagctgctgaatttttacacattgtgcaagtcttccaattcttcacgccgattatggctggtttcttgattgggcaacaatttaagtttaatcctatgcaacagttggctgttggtggagctgcttatatcggttctggagcctgggcttatacagaagtcattcaaaaaggtgtggcgacaggaacattccaacttagaggtattggggacttaatcaatatgatgattacagctagccttgcggttttagctgtgaaatattttgggaataaatttggctctttaaccattatcttgttacctatcactataggaactggcgtaggttatattggttggaaatttttgccttatgtgtcttacgtgacaaccctgatcggacaagggattaattcttttacaaccttacaacctattttaatgtctattttaattgcagttgctttctcgcttatcattgttagtccgatttcaactgttgcaatcggtttagctattgggcttaatggaatggctgcgggagcagcttctatgggaattgcatcgacagcagcagtcttagtgtgggcgacgcttaaagttaataaatctggtgtaccaattgctatcgcacttggggctatgaaaatgatgatgccaaacttcttgaaacatcctatcatggctattccgatggtgttcactgcagcaattagctcattaacagtaccattgtttaatcttgttggaacaccagcttcatctggttttggcttagttggtgcagtaggtccgattgcttctttagcaggtggtagctcaatacttattattatccttgcttggatcattgttccgtttgcggttgcttttgcggcgcataaggtttctaaagatattctaaaactgtataaagaagacattttcgtctttgaaggc

SEQ ID NO: 1280 - protein, 352 aa, Streptococcus pyogenes
MTTTDKETFSSFMNKVLAGTAIAIVVALIPNAILATFLKPLLPNMAAAEFLHIVQVFQFFTPIMAGFLIGQQFKFNPMQQLAVGGAAYIGSGAWAYTEVIQKGVATGTFQLRGIGDLINMMITASLAVLAVKYFGNKFGSLTIILLPITIGTGVGYIGWKFLPYVSYVTTLIGQGINSFTTLQPILMSILIAVAFSLIIVSPISTVAIGLAIGLNGMAAGAASMGIASTAAVLVWATLKVNKSGVPIAIALGAMKMMMPNFLKHPIMAIPMVFTAAISSLTVPLFNLVGTPASSGFGLVGAVGPIASLAGGSSILIIILAWIIVPFAVAFAAHKVSKDILKLYKEDIFVFEG

SEQ ID NO: 1281 - DNA, 882 bp, Streptococcus agalactiae
atggatattagacaacttacttactttattgctgttgcagaagcaaaaaattattcacgcgctgcaaaaagtctttttgtgacccaacctacactttcacaatccattaaaaaattagaagcagaattaaatactattttattcttacaaaatggtcgtcaactcgctttaactgaagcaggagaaattctctatgagaaaggacaattgttgatgactaatgttaatcaaatggttacggagatccagcaattaaatcaagaaaaaaaggaaggtatccgtgtagggcttacttctctttttgctattcaatttatgaaacagatttcaacttttatggctacacattcaaatgttgaagtatctttgattcaagatggttcccgtaaattacaagaattgttagcaaaaggaaagatcgatattggcttattgtcctttccaagtacccgcaatgatatcactatcgaaccactgcaaacctcaactaaaggatataaagtaagcattgtcatgccaaaatcgcatcctcttgcaacacttcctgaaattgaacttaatgatttaagagattataaagttgcctcactcaacgaacattatatgctaggagagatgttgcctcgtaaatgtcgtgctttaggatttgacccccatatcgtctttaaacacaatgactgggaagttcttattcatagtttacaagacctcaatgcagtcactattttaccaagtgaatttgaaagcattagccaagttcaagatttatgctgggtcccacttaaggataaaaataatttttatccgattggtattgcttaccgaaatgatacttcttttagtcctatgattgaagaatttttaagtcttttaaagaccaat

SEQ ID NO: 1282 - protein, 294 aa, Streptococcus agalactiae
MDIRQLTYFIAVAEAKNYSRAAKSLFVTQPTLSQSIKKLEAELNTILFLQNGRQLALTEAGEILYEKGQLLMTNVNQMVTEIQQLNQEKKEGIRVGLTSLFAIQFMKQISTFMATHSNVEVSLIQDGSRKLQELLAKGKIDIGLLSFPSTRNDITIEPLQTSTKGYKVSIVMPKSHPLATLPEIELNDLRDYKVASLNEHYMLGEMLPRKCRALGFDPHIVFKHNDWEVLIHSLQDLNAVTILPSEFESISQVQDLCWVPLKDKNNFYPIGIAYRNDTSFSPMIEEFLSLLKTN

SEQ ID NO: 1283 - DNA, 480 bp, Streptococcus pyogenes
ttgtcccaaggaaaaatcgatattggtctcctctcctttctaagtattcgaaaggatattaccattgagctattacaaacgtccacaaaaggctataaggtcagtatcgttctcctcaaacagcaccctttggcgcaacatcctcagttaaaacttaaagatttaaaaggctataagattgcttctttaaacgatcactacatgttaggcgaaatgcttcctagaaaatgccgagctctcggttttgaaccagatattgtctttaaacacaatgattgggaagttcttattcatagtttgcacgatttaaataccttgactatcctcccgagtgattttgagagtcttaatcaggtagataacttagtttggattcctttgcaagataaaaataatttttaccctattgggattgcttaccgagatgatgcgagtttcagtccagttattgaggaatttttaagccttttaaaaacgaac

SEQ ID NO: 1284 - protein, 160 aa, Streptococcus pyogenes
LSQGKIDIGLLSFLSIRKDITIELLQTSTKGYKVSIVLLKQHPLAQHPQLKLKDLKGYKIASLNDHYMLGEMLPRKCRALGFEPDIVFKHNDWEVLIHSLHDLNTLTILPSDFESLNQVDNLVWIPLQDKNNFYPIGIAYRDDASFSPVIEEFLSLLKTN

SEQ ID NO: 1285 - DNA, 867 bp, Streptococcus agalactiae
atgctactatttaatagaaattgttgtagggattatcaaaaggaggaagaaatgattttaaaaatttgtcgtgcagcatatagtttacaatggggaggtgtttaccaattagctttgctggattatcctcgaattaaggcgtttgaattggaaaggataggagctttcatagcttacgagaaacaatataaaagaaaaactgagatacaatgtgacgataaacatctcctcgcaaaaattgttcattttttaaaatacaatagttttacttttccctatattcccaaatatagagaagcggcagctacttttaatgaggatggtattagtttaacttctgattttttaagccatacatgtacgattgaaactgcaaaactaatttttaaagaaggtaaaatcttatcagcagttaaagcctttaataagcctgctgaagtactggtaaaagataagaggaatgctgctggagaccctaaagattactttgactatgtgatgttgaactggtcaaataccaattctggttatcgtttagtaatggaaagattgttaggcaaagcaccatctgaacaggagttaacagtaggttttaagccaggggtcagttttcattttacttatcaagatatcatcaatcatcctgattctatttttgatggttatcatcctgctaaaattaaaaatcagctttctttagcagaacatttagttgcatgtgttatcccaaaacattatcaagaagattatcaaagccttgtgcccaatgacttgaaacacagggtttattatttagattactgtaacgaaacactttatgagtggaatcaaaaagtttatgattttctttgtcatttggaaaataaa

SEQ ID NO: 1286 - protein, 289 aa, Streptococcus agalactiae
MLLFNRNCCRDYQKEEEMILKICRAAYSLQWGGVYQLALLDYPRIKAFELERIGAFIAYEKQYKRKTEIQCDDKHLLAKIVHFLKYNSFTFPYIPKYREAAATFNEDGISLTSDFLSHTCTIETAKLIFKEGKILSAVKAFNKPAEVLVKDKRNAAGDPKDYFDYVMLNWSNTNSGYRLVMERLLGKAPSEQELTVGFKPGVSFHFTYQDIINHPDSIFDGYHPAKIKNQLSLAEHLVACVIPKHYQEDYQSLVPNDLKHRVYYLDYCNETLYEWNQKVYDFLCHLENK

SEQ ID NO: 1287 - DNA, 771 bp, Streptococcus agalactiae
atgagcggtgaaaattctatttctttaatgtcattactaatggcatcgtcattagttttgattactttatttttttcttactggcaaaagttaaacctagaaaaagaagtgattattagcgctatccgagcagtgattcaattattagcagtgggttttttgctagactatatatttggttatcaaaatcctattttcacagctcttttaatgctattcatgattattaatgcttcttataacgcagctaagcgtggtaaagggattaataaagggtttgttatttcatttatagctattgggtcagggactataatcactttatctgtcttgattttttcaggaattttaaaatttgttccgaatcaaatgattcctgtaggtggtatgattattagtaattctatggtagcaatcggtttgtgctataaacaattattgtccgaatttagaagtaaacaagaggaagtggagacaaaattagctttaggagcagatattttgccagcttcgattgatattattcgtgatgttatcaaaactggtatggtacctacaattgattcagctaaaacacttgggattgtatctttgccagggatgatgacagggttaattcttgctggaacttcacctatccaagcggttaaataccaaatgatggtgacgtttatgctattagcaacgacttcgatagcttcttttgtagctacttatttggcttataaaattttctttaataatcgtaagcaattagtagtaacaaaagat

SEQ ID NO: 1288 - protein, 257 aa, Streptococcus agalactiae
MSGENSISLMSLLMASSLVLITLFFSYWQKLNLEKEVIISAIRAVIQLLAVGFLLDYIFGYQNPIFTALLMLFMIINASYNAAKRGKGINKGFVISFIAIGSGTIITLSVLIFSGILKFVPNQMIPVGGMIISNSMVAIGLCYKQLLSEFRSKQEEVETKLALGADILPASIDIIRDVIKTGMVPTIDSAKTLGIVSLPGMMTGLILAGTSPIQAVKYQMMVTFMLLATTSIASFVATYLAYKIFFNNRKQLVVTKD

SEQ ID NO: 1289 - DNA, 654 bp, Streptococcus agalactiae
atgtcctatttaacctttaaacacgttgattttaaaacggatgataagttggttttaaatgatatcaactttgcaattgatgaaggtgattttgtttctattgtagggccatctggaagtggtaagagtactgtattaaaattagccagtggtttaatgagtcctactgcaggtcatattttctttgatggaaaagatttgaaccaattagaaccgattgaaagtcgaaaaatgatttcttactgttttcaaacgccacatttatttggtaatacagtggaagacaatattagttttccttaccacattcgacacgaaaaagtagattatagacgcgttgatgatttatttcaacgttttgaaatggaccagtcttacctgaaacaggatgtcaaaaaactatcaggaggagaaaagcaacgtattgctctgattaggcaattattgtttgaacctaaagttttactcttagatgaagttacttcggctttagacaatcataataaagctattgttgaaaaggttattaaatcattacatgacaaaggaataacgattttgtggattacgcatgatgaggaacagagtcgtcgatttgccaataaagtcttaaaagttgtcaatggtagtattgaagcaatggaggttataaaa

SEQ ID NO: 1290 - protein, 218 aa, Streptococcus agalactiae
MSYLTFKHVDFKTDDKLVLNDINFAIDEGDFVSIVGPSGSGKSTVLKLASGLMSPTAGHIFFDGKDLNQLEPIESRKMISYCFQTPHLFGNTVEDNISFPYHIRHEKVDYRRVDDLFQRFEMDQSYLKQDVKKLSGGEKQRIALIRQLLFEPKVLLLDEVTSALDNHNKAIVEKVIKSLHDKGITILWITHDEEQSRRFANKVLKVVNGSIEAMEVIK

SEQ ID NO: 1291 - DNA, 1152 bp, Streptococcus pyogenes
ttgactaagccaattatcacatttaacaatgtttcaaaaacatttgaggacagtggaacacaggttctaaagaacattaactttgaccttgaagaaggaaaattttacaccctgcttggagcttctggctctggaaaatcaactattttaaatattatggcgggcctactagatgccagcagcggagacatttatttagatggggaacgtattaatgatttgccgattaataaacgtgacattcataccgttttccaaaattatgccctcttccctcatatgactgtttttgagaatgttgcctttgctttgaagctgaagaaagtggacaagaaagagattgctaagcgcgtgaaagaaaccttgaaaatggttcaattagaagggtttgaaaatcgttctatccagaagttgtctggtggtcaacgtcaacgtgttgccattgcgcgtgcgattatcaatcaaccgcgtgtggtcttacttgacgaaccactctcagcccttgatttgaaattaagaacagagatgcaatatgaattacgtgaattgcaacaacgtctaggcattacctttgtttttgttactcacgatcaagaagaagccttggccatgagtgattggatttttgtcatgaatgaaggtgaaattgttcagtcgggaacaccagtggatatttacgatgagccaattaatcattttgttgctaattttattggagaatctaatattattaacggtaccatgattgaagactatcttgtctcctttaacgggaaagaatttgaatctgtggacggtggaatgcgccctaatgagcctgttgaagtggttattcgtcctgaagatcttcaaattactttgccagaagaagggaaattacaagttaaggttgatacccaattattccgcggggttcactacgaaattattgcctatgatgaattgggtaatgaatggatgattcattctacccgcaaagctatcgaaggagaagttatcggattagattttacccctgaagatcttcatatcatgcgtcttaatgagactgaagaggaatttgatgcccgtattgaagaatatgtggaaatggatgagcctgaagatggattgattaatgccattgaggaggagcgtaatgaagaaaacctc

SEQ ID NO: 1292 - protein, 384 aa, Streptococcus pyogenes
LTKPIITFNNVSKTFEDSGTQVLKNINFDLEEGKFYTLLGASGSGKSTILNIMAGLLDASSGDIYLDGERINDLPINKRDIHTVFQNYALFPHMTVFENVAFALKLKKVDKKEIAKRVKETLKMVQLEGFENRSIQKLSGGQRQRVAIARAIINQPRVVLLDEPLSALDLKLRTEMQYELRELQQRLGITFVFVTHDQEEALAMSDWIFVMNEGEIVQSGTPVDIYDEPINHFVANFIGESNIINGTMIEDYLVSFNGKEFESVDGGMRPNEPVEVVIRPEDLQITLPEEGKLQVKVDTQLFRGVHYEIIAYDELGNEWMIHSTRKAIEGEVIGLDFTPEDLHIMRLNETEEEFDARIEEYVEMDEPEDGLINAIEEERNEENL

SEQ ID NO: 1293 - DNA, 177 bp, Streptococcus agalactiae
ttgcaactatcaccaataaatgctgcaataaagaaaataataagaaaagttacaatattgaaggacatttttggatttgcagcaagggctccagcagcaaataataaactatcacctggtaaaaatggaaagatgacagccccagtttcaacgaaaataacgaggaagagcaataga

SEQ ID NO: 1294 - protein, 59 aa, Streptococcus agalactiae
MQLSPINAAIKKIIRKVTILKDIFGFAARAPAANNKLSPGKNGKMTAPVSTKITRKSNR

SEQ ID NO: 1295 - DNA, 636 bp, Streptococcus agalactiae
atgtttttaatcgattttattttacatattgatactcatatctatgctatggctaacactgttggtaattggacctatctattgctcttcctcgttattttcgttgaaactggggctgtcatctttccatttttaccaggtgatagtttattatttgctgctggagcccttgctgcaaatccaaaaatgtccttcaatattgtaacttttcttattattttctttattgcagcatttattggtgatagttgcaacttcttgattggtcgtacatttggttaccgttttatcaaacatcctttctttcgtcgtttcattaaagaaaaaaatatccgagatgctgagctttattttgagaaaaaaggtactgctgccatcattttagggcgctatatccctattatcagaacctttgttccttttgtagcaggtattagtcagctccctccaaaagtatttatcaaacgcgccttcattgcagcattatcttggtcagttattgcaacaggttctggttttctctttggtaatattccttttgtgaagcagcacttctcgcttattatcttgggaattgtatttgttaccttaattcctgtccttatttctggtgtcaaatcatatcggaacactaag

SEQ ID NO: 1296 - protein, 212 aa, Streptococcus agalactiae
MFLIDFILHIDTHIYAMANTVGNWTYLLLFLVIFVETGAVIFPFLPGDSLLFAAGALAANPKMSFNIVTFLIIFFIAAFIGDSCNFLIGRTFGYRFIKHPFFRRFIKEKNIRDAELYFEKKGTAAIILGRYIPIIRTFVPFVAGISQLPPKVFIKRAFIAALSWSVIATGSGFLFGNIPFVKQHFSLIILGIVFVTLIPVLISGVKSYRNTK

SEQ ID NO: 1297 - DNA, 225 bp, Streptococcus agalactiae
gtgttaaatagaaatttttggatacattacttagtgttccgatatgatttgacaccagaaataaggacaggaattaaggtaacaaatacaattcccaagataataagcgagaagtgctgcttcacaaaaggaatattaccaaagagaaaaccagaacctgttgcaataactgaccaagataatgctgcaatgaaggcgcgtttgataaatacttttggagggagc

SEQ ID NO: 1298 - protein, 75 aa, Streptococcus agalactiae
MLNRNFWIHYLVFRYDLTPEIRTGIKVTNTIPKIISEKCCFTKGILPKRKPEPVAITDQDNAAMKARLINTFGGS

SEQ ID NO: 1299 - DNA, 471 bp, Streptococcus agalactiae
atgcttgatagaaccattcgtcaatatcaaaatcgcagagataccactcttcccgatgcaaattggaaaccattaggttggcatcaagtagctactaatgaccattatggacatgcagtcgacaaggggcatttaattgcctatgctttagctggaaatttcaaaggttgggatgcttccgtgtcaaatcctcaaaatgttgtcacacaaacagctcattccaaccaatcaaatcaaaaaatcaatcgtggacaaaattattatgaaagcttagttcgtaaggcggttgaccaaaacaaacgtgttcgttaccgtgtaactccattgtaccgtaatgatactgatttagttccatttgcaatgcacctagaagctaaatcacaagatggcacattagaatttaatgttgctattccaaacacacaagcatcatacactatggattatgcaacaggagaaataacactaaat

SEQ ID NO: 1300 - protein, 157 aa, Streptococcus agalactiae
MLDRTIRQYQNRRDTTLPDANWKPLGWHQVATNDHYGHAVDKGHLIAYALAGNFKGWDASVSNPQNVVTQTAHSNQSNQKINRGQNYYESLVRKAVDQNKRVRYRVTPLYRNDTDLVPFAMHLEAKSQDGTLEFNVAIPNTQASYTMDYATGEITLN

SEQ ID NO: 1301 - DNA, 480 bp, Streptococcus pyogenes
atgccttacttactaagtcgacacgacagtatcgaaatcgctatcaaacggataatgcttatcgtaactttaagcccagcaggttggcaccgattgcaccacttaaaaggaagttatgatcacgcggttgatagagggcatttgctaggttatgctttagttggtggactgaaaggttttgatgcttctactggtaatcctgataatattgccactcaactaagttgggctaatcaagcaaataaaccctacttgacaggtcagaattactatgaaggtttagtacgtcgtgctttagataaggggcatcgcgtccgctaccgtgtcaccctactttatgatggtgataatctactagccagcggtagccatttggaggctaaatcctctgatgacagcttgacttttaacgtgtttgttccaaatgtccaagcaggattgaccgctgactatcggacgggacaaatagctatcaatctc

SEQ ID NO: 1302 - protein, 160 aa, Streptococcus pyogenes
MPYLLSRHDSIEIAIKRIMLIVTLSPAGWHRLHHLKGSYDHAVDRGHLLGYALVGGLKGFDASTGNPDNIATQLSWANQANKPYLTGQNYYEGLVRRALDKGHRVRYRVTLLYDGDNLLASGSHLEAKSSDDSLTFNVFVPNVQAGLTADYRTGQIAINL

SEQ ID NO: 1303 - DNA, 216 bp, Streptococcus agalactiae
atgttctacatgaagttagctaaccgtctatcactagctgctacgattgttaatgaagcaaatgccaattctccatttggtattattatacatagtgataaggctgaaaacgttgaatggaacgattttgagacacaattccctgatttattcaattcaccaaaaaaagaggagtctcctaaaaaaagtctatggcaacatttctttagtcaaaaa

SEQ ID NO: 1304 - protein, 72 aa, Streptococcus agalactiae
MFYMKLANRLSLAATIVNEANANSPFGIIIHSDKAENVEWNDFETQFPDLFNSPKKEESPKKSLWQHFFSQK

SEQ ID NO: 1305 - DNA, 456 bp, Streptococcus pyogenes
atgactaatttagaagataagctattaaaaggagcctggggagaaagaagattaaatcctgagcagcaacgctactatctaggaacgtatgctgaacgagtcgttttaagtgctttattagacgaagctcaaactaaaacagtaaaagactatttgaaaagagaattaccgagccttcaattagtctatcaacctttacacttaaaaatctcttccaagctggcacctcaacttcaaatactctatatgaaattagcaaaagaaaaccatttacctgttactattattacagaaacgcatatgacttcaccttttgcgtttatccttcataccgaccacgcaataaatctgaaggaaacacgtttagaagtcatcttaaagcagacaaaaaacgatcaacttagcaaacaaactcctgaaaaaaccaaatccttttggaaaagatttttgaaaaaa

SEQ ID NO: 1306 - protein, 152 aa, Streptococcus pyogenes
MTNLEDKLLKGAWGERRLNPEQQRYYLGTYAERVVLSALLDEAQTKTVKDYLKRELPSLQLVYQPLHLKISSKLAPQLQILYMKLAKENHLPVTIITETHMTSPFAFILHTDHAINLKETRLEVILKQTKNDQLSKQTPEKTKSFWKRFLKK

SEQ ID NO: 1307 - DNA, 483 bp, Streptococcus agalactiae
atggaaatttgggatgcttatgaccaatatgggttcattacaggtcttacacttaatagggatcaaaatatcccacaaggcttattccacttagttgttgatgttatcctttttcatgaggatggtgacgtattgatgatgaaacggcaccctaaaaagaaagcttttcctgcttatttcgaagccaccgctggcggatctgcccttaaaggagaaaatgctaagcaagctattctaagggaactcaaagaagaaactggtatcgttcctcaatgtctaacctttcttaatagagagtggttctctgagcgttcttactttgtagaccattttatcgcaaaatacaatggtgcaaaagatataattacattgcaagaaggagagaccgttgactatatctggttaaaaccagaatatattgatttatttttatctaaaaacaaattaataccctctcaaataaaactcttaaaatccttaatc

SEQ ID NO: 1308 - protein, 161 aa, Streptococcus agalactiae
MEIWDAYDQYGFITGLTLNRDQNIPQGLFHLVVDVILFHEDGDVLMMKRHPKKKAFPAYFEATAGGSALKGENAKQAILRELKEETGIVPQCLTFLNREWFSERSYFVDHFIAKYNGAKDIITLQEGETVDYIWLKPEYIDLFLSKNKLIPSQIKLLKSLI

SEQ ID NO: 1309 - DNA, 639 bp, Streptococcus agalactiae
atgattaaaggtttgttagtcatggacgttgattcaaccttaataatggaagaagctattgatttattagctattgaagcaggggtggggaaacaggttgctgcactgactgacgctgcaatgcgtggcgagttagattttgaagaagctttgaagaaaagagtagcgctacttaaaggtttgcctgttactattttgacagatatattatcctcaatacattttactccaggggcttatgaattgattaaagagtgtcacaagcgtcagatgaaagttggtcttgtatcaggaggttttcacgagacgattgatatcttagctaagcaattacaagttgattatgtcaaagcgaatcgtcttggtgtcaaaggtggttttctcactggcgaagttgagggagagattgtcactaaagaagtgaaaaaaataaagttaaaagagtgggcttctgaaaatcacttagacctttcacaaaccatcgcaatgggagatggtgccaatgatttaccaatgatcaaatccgctggggtaggaattgctttttgtgcaaaaccaattgtcagagaagaagctgcgtatcagattaatgaaaaaaatttgcttaaggtatttgatattattgatgcaaatgaaaac

SEQ ID NO: 1310 - protein, 213 aa, Streptococcus agalactiae
MIKGLLVMDVDSTLIMEEAIDLLAIEAGVGKQVAALTDAAMRGELDFEEALKKRVALLKGLPVTILTDILSSIHFTPGAYELIKECHKRQMKVGLVSGGFHETIDILAKQLQVDYVKANRLGVKGGFLTGEVEGEIVTKEVKKIKLKEWASENHLDLSQTIAMGDGANDLPMIKSAGVGIAFCAKPIVREEAAYQINEKNLLKVFDIIDANEN

SEQ ID NO: 1311 - DNA, 1722 bp, Streptococcus agalactiae
atgtcgagcggaatcatattgctgcttgtggctatagtcctgcttgtgattattgcctacgtagtcggcgtcgtaataagaaaacgtaatgatacattaattgcaaacttagaaactagaaaacaagagttagttgaccttcctgtgcaagaggagattgagcaagtcaaattgcttcatttgattggccaaagtcaatcaacttttagagaatggaaccaaaaatggactgatttatcaactaattcatttaaagatattgattttcatttagttgaagctgaaaatcttaatgattcatttaattttgtgcgtgctaagcacgagattgataatgttgatagtcagctaactattatagaagaagatattgtttcgattcgtgaagctttagaagttttaaaagagcaagaagagaaaaatagtgcccgtgtaacacatgctttggacctatacgaaacacttcaaaaatcaatttctgaaaaagaagataattacgggacaaccatgccagaaattgaaaagcagttgaaaaatatcgaggctgaattttcacattttgtgaccttaaactcaactggtgacccgattgaagcttctgaagttttgaataaagcagaggagcatacgattgctttagggcaaattacagaacaaattccagctattgttgctaaattagaagacgattttccagatcagttagatgatttggagacaggatatcgtcgtcttttagaggaaaactaccatttccctgaaaaggatattgaacaacgttttcaagaagttcgtgaggctattcgttcgaattcagatggtttagttagtttggatctagatcgtgctcgcgatgaaaatgaacatattcaagaaaaaattgataaactttatgatatttttgaacgtgagattgctgcttataaagtagctcataaggatagtaaaattattcctcaattccttgctcatgcaaaatctaacaatgaacaactggggcatgaaatcaaacgattatctgctaaatatatcttaaatgaaaatgaaagcttaagtttacgttccttcacaaatgatttggaagaaattgaaacaaaggttttaccttctgtagaaaattttggtcaagaagcttcaccttatactcatctacaaattttatttgagcgtacgttgaaaacattgactactgttgaagaaaatcaaatggaagtttttgaagccgttaaaactattgaaagcgttgagacacgagcacgccaaaatatggataagtatgttaacaagctccatatgattaaacgtttcatggaaaaacgcaatcttccaggaatcccgcaagacttcttaagcactttctttacaacaagttctcaaattgaggcacttattaatgaactcagtcgcggtcgtattgatattgaggctgtttcacgtttaaatgatgtgactacaaatgctatcgctaatttagagcaagctacatatctagttgttcaagatgcgactctcacagagcagttactacagtattcaaaccgttatcgtagttttgaacaaaatgtgcaaaagagctttgaacaagctttgtacttatttgaagttgaacataactataaagcatctttcgatgaaatttcatacgcacttgagactgtggaaccaggtgtaactgaccgttttgtgacgtcttatgaaaagacacaagaacgtattcgtttc

SEQ ID NO: 1312 - protein, 574 aa, Streptococcus agalactiae
MSSGIILLLVAIVLLVIIAYVVGVVIRKRNDTLIANLETRKQELVDLPVQEEIEQVKLLHLIGQSQSTFREWNQKWTDLSTNSFKDIDFHLVEAENLNDSFNFVRAKHEIDNVDSQLTIIEEDIVSIREALEVLKEQEEKNSARVTHALDLYETLQKSISEKEDNYGTTMPEIEKQLKNIEAEFSHFVTLNSTGDPIEASEVLNKAEEHTIALGQITEQIPAIVAKLEDDFPDQLDDLETGYRRLLEENYHFPEKDIEQRFQEVREAIRSNSDGLVSLDLDRARDENEHIQEKIDKLYDIFEREIAAYKVAHKDSKIIPQFLAHAKSNNEQLGHEIKRLSAKYILNENESLSLRSFTNDLEEIETKVLPSVENFGQEASPYTHLQILFERTLKTLTTVEENQMEVFEAVKTIESVETRARQNMDKYVNKLHMIKRFMEKRNLPGIPQDFLSTFFTTSSQIEALINELSRGRIDIEAVSRLNDVTTNAIANLEQATYLVVQDATLTEQLLQYSNRYRSFEQNVQKSFEQALYLFEVEHNYKASFDEISYALETVEPGVTDRFVTSYEKTQERIRF

SEQ ID NO: 1313 - DNA, 1722 bp, Streptococcus pyogenes
atgtcaagcggaattatcttgctgattgtggctatagtcctactagtgattatcgcctatctagtgggtgtcatcatacgaaagcgtaatgattccctaattaccagtctagaagaacgaaaacaggccttgtttgctttgcctgttaatgatgaaattgaagaagtaaagtcacttcatttgataggacagagccaaacctcttttcgggaatggaatcagaaatgggtagacttaactgtgaattcgtttgcagatattgaaaatcatatttttgaagctgaaaatttgaatgatacgtttaattttattcgcgccaagcatgagattaatagcgttgaaagtcagcttaatcttgttgaagaagatatcgcttctattcgtgaagcacttaatatcttaaaagagcaagaagaaaaaaatagtgctcgtgtcacccatgctcttgatttatatgaaaagctccaagcttctatttctgagaatgaagataattttggttcaactatgcctgaaattgacaaacagatgaaaaacattgaaactgaattttcacagtttgtcgcactcaactcatcaggtgatcctgtagaagcttctgaagttctggatagagcagaagagcatactattgctctagggcagattacagagcagattccagctattgtggccaagttggaagatgattttccagatcagttagatgatttggaaacaggatatcgccgtttacttgaagaaaactatcattttccagaaaaaaacattgaggcacgttttcaggagattcgtgagtctattcgtgccaattcatcagagttagttacacttgacttggatcgtgctagagaagaaaacacgcatattcaagaacgcattgattctctttatgaagtctttgagcgcgaaattgccgcttataaggtagctgctaaaaatagtaagatgctacctcgttacctagaacatgtgaaacgtaataatgaacaactcaaagatgaaattgcacgtttatcacgtaaatatattctaagtgaaacggaaagtctgactgttaaggcatttgagaaggatattaaagagatagaagacagtacacttgctgttgcagaacaatttggtttacaagaaaaaccattttcagaactgcaagtgacttttgaacgcagtataaagacgcttactaatgtcgagtcaggtcaaatggatgtttttgcagcagttaaagatattgaaaaaattgaatcacaggcacgccataaccttgatgtttatgttactcagcttcatatgattaaacgttatatggaaaaacgtcacttgcctggaattccacaagactttcttagtgctttctttacaacgagttcacaattggaagctttgatggatgagcttagtagaggacggatcaatattgaggcagtgtcacgtttgtcggaagttgcgacggttgctattgctaatctagaagatttaacctatcaagtggttcaaaatgctaccttgactgaacaattactacaatattctaatcgctatcgttcttttgaagcaggagttcaaagtagttttgaacatgctttgagacttttcgaagtagaaaatgattatcaggcttcttttgatgaaatttcttatgctcttgaaacagttgaacctggggtaacagatcggtttgttaactcttatgaaaaaacacgagagcacattcgtttt

SEQ ID NO: 1314 - protein, 574 aa, Streptococcus pyogenes
MSSGIILLIVAIVLLVIIAYLVGVIIRKRNDSLITSLEERKQALFALPVNDEIEEVKSLHLIGQSQTSFREWNQKWVDLTVNSFADIENHIFEAENLNDTFNFIRAKHEINSVESQLNLVEEDIASIREALNILKEQEEKNSARVTHALDLYEKLQASISENEDNFGSTMPEIDKQMKNIETEFSQFVALNSSGDPVEASEVLDRAEEHTIALGQITEQIPAIVAKLEDDFPDQLDDLETGYRRLLEENYHFPEKNIEARFQEIRESIRANSSELVTLDLDRAREENTHIQERIDSLYEVFEREIAAYKVAAKNSKMLPRYLEHVKRNNEQLKDEIARLSRKYILSETESLTVKAFEKDIKEIEDSTLAVAEQFGLQEKPFSELQVTFERSIKTLTNVESGQMDVFAAVKDIEKIESQARHNLDVYVTQLHMIKRYMEKRHLPGIPQDFLSAFFTTSSQLEALMDELSRGRINIEAVSRLSEVATVAIANLEDLTYQVVQNATLTEQLLQYSNRYRSFEAGVQSSFEHALRLFEVENDYQASFDEISYALETVEPGVTDRFVNSYEKTREHIRF

SEQ ID NO: 1315 - DNA, 1950 bp, Streptococcus agalactiae
atgacagaagaaacaaagaatatggaacaacgtgctcaagaatatgacgcaagtcagattcaagtattagaaggtttagaagctgttcgcatgcgtccaggcatgtatatcggttcgacttcgaaagaagggcttcatcaccttgtatgggaaattgttgataactcaattgatgaagccttagctggatttgcaggacatattaaagtttacattgaaccagataactctattacagttgttgatgatggtcgcggtattccggtagatatccaagaaaaaactggaagaccagctgtagagacagtttttacagttctccatgccggtggtaaatttggtggtggcggatacaaggtttctggtggcttacatggtgtagggtcatctgttgttaatgcattgtcaacacaattagatgtcaaggtttataaaaatggcaaggttcattatcaagaataccaacgcggtgttgttgttaatgatcttgaaattatcggtgatactgacttatcaggaacaacagttcactttacgcctgacccagaaattttcactgaaaccactgtatttgattttgataaattagccaaacgtattcaggaattagcttttttaaatcgtggactaagaatctccatttcagacaagcgagaaggtcaagaagttgaaaaagaatatcactatgaaggtggtataggttcatacgttgagtttatcaatgagaacaaagaagtgatttttgaaaatcctatttatactgacggtgaattagatggtatttcagttgaagtagcaatgcagtatactactggatatcaagagactgttatgagttttgcaaataacatccacactcatgaaggaggaacgcacgaacaaggatttcgtactgccttgacacgtgtgattaatgattacgctaaaaagaataagattctcaaagaaaatgaagataatttaactggagaagatgttcgtgaaggtttaacagcagttatatctgttaaacatccaaatccacaatttgaaggacaaactaaaacaaaacttggaaattctgaagttgttaaaattacaaatcgtctctttagcgaagctttcaatcgattcctattagaaaatccacaagtagctaagaagattgttgaaaaaggaattttggcatctaaagcccgtattgcagcaaaacgggcgcgtgaagtaacacgtaaaaagtcaggcttagagatttcaaacttacctgggaaactggctgattgctcatctaataatgctgagatgaatgaactttttatagtggagggagattctgcgggagggtctgcaaaatcaggacgtaatcgtgagtttcaagcaattttaccgattaggggtaagattctaaacgttgaaaaagctacaatggataaaattttagcaaacgaagaaatccgaagtctcttcacagctatgggaactggatttggtgcagattttgatgtatcaaaagtcagatatcaaaaattagtcattatgactgatgccgatgttgatggagctcacatcagaactttacttttaactctgatttatcgttttatgcgacctgttttggaagcaggatatgtttatatcgctcaaccaccaatctatggtgtcaaagtaggaagtgagattaaagcttatattcagccaggggtcaatcaagaagaggaattacgtcaagctctagatacctatagttcaggacgttcaaaacctactgtacaacgttacaaaggtctaggtgagatggatgaccatcaactttgggaaacaacaatggatcctgaaaaccgcttgatggcacgtgtctcagttgatgatgcagcagaagcagataagattttcgatatgctaatgggagatcgagtagaaccacgacgtgaattcattgaagctaatgctgtttatagtaacttagatatc

SEQ ID NO: 1316 - protein, 650 aa, Streptococcus agalactiae
MTEETKNMEQRAQEYDASQIQVLEGLEAVRMRPGMYIGSTSKEGLHHLVWEIVDNSIDEALAGFAGHIKVYIEPDNSITVVDDGRGIPVDIQEKTGRPAVETVFTVLHAGGKFGGGGYKVSGGLHGVGSSVVNALSTQLDVKVYKNGKVHYQEYQRGVVVNDLEIIGDTDLSGTTVHFTPDPEIFTETTVFDFDKLAKRIQELAFLNRGLRISISDKREGQEVEKEYHYEGGIGSYVEFINENKEVIFENPIYTDGELDGISVEVAMQYTTGYQETVMSFANNIHTHEGGTHEQGFRTALTRVINDYAKKNKILKENEDNLTGEDVREGLTAVISVKHPNPQFEGQTKTKLGNSEVVKITNRLFSEAFNRFLLENPQVAKKIVEKGILASKARIAAKRAREVTRKKSGLEISNLPGKLADCSSNNAEMNELFIVEGDSAGGSAKSGRNREFQAILPIRGKILNVEKATMDKILANEEIRSLFTAMGTGFGADFDVSKVRYQKLVIMTDADVDGAHIRTLLLTLIYRFMRPVLEAGYVYIAQPPIYGVKVGSEIKAYIQPGVNQEEELRQALDTYSSGRSKPTVQRYKGLGEMDDHQLWETTMDPENRLMARVSVDDAAEADKIFDMLMGDRVEPRREFIEANAVYSNLDI

SEQ ID NO: 1317 - DNA, 1950 bp, Streptococcus pyogenes
atgattgaagaaaataaacattttgaaaaaaaaatgcaagaatacgatgccagtcaaattcaggttctagaagggctggaggctgtccgcatgcgtccagggatgtatattggctcgacagctaaagagggtttgcatcatttagtctgggaaattgttgacaactcaattgacgaagcattagcaggttttgcctctcatattaaagtctttattgaagcagataattccattacagtagtagatgatggccgtggaattccagttgatatccaagccaagacaggacgtcccgccgttgaaacagtttttacagtcttacacgcaggtggtaaatttggtggaggcggctataaggtttctggaggattacatggtgtagggtcatctgttgttaatgctttatcaacacaattagatgtacgtgtttataaaaacggccaaattcattaccaagaatttaaacgcggggctgttgtagcagatcttgaggtcattggaaccactgatgtgactggcacgaccgtacactttacacccgatccagaaatttttaccgaaacgactcagtttgattacagtgttttagcaaaacgtattcaagagttagcctttttgaatcgtggtttaaaaatttccattacagataagcgctcaggtatggaacaagaagaacatttcctttatgaaggtggaattggttcttatgttgaatttttaaatgataaaaaagatgttatctttgaaacgcccatctatacagatggtgaattagaaggtattgcagttgaagtagccatgcaatacacgactagctatcaagaaacagtcatgagttttgctaataatattcatactcatgaaggtggaacgcatgaacaaggctttagagcggctcttactcgggtcatcaatgactacgctaagaaaaataaaattcttaaagaaaatgaggacaatttgacaggagaagatgttcgtgaaggtttgacggcggtaatttctgttaagcatccaaatcctcaatttgaaggtcaaaccaaaacaaaattgggcaactcagaagtggttaagatcactaatcgtctctttagtgaggcctttcaacgttttcttttggaaaacccacaagttgctcgtaagattgtggaaaaagggattttggcttctaaagctagaattgcagctaagcgagcccgcgaagtcacccgcaaaaaatcaggcttagaaatttcaaacttacctggaaaattagcagactgttcgtcaaatgacgctaaccaaaacgaacttttcatcgtcgaaggagattcagcgggtgggtcggccaaatcaggtcgtaaccgagagtttcaagctatcttgcctattcgcggtaaaattttgaacgtggaaaaagcaactatggataagattcttgccaacgaagaaattagaagtctctttaccgctatgggtacaggttttggtgcagattttgacgtgtcaaaagctcgctaccaaaagctggttatcatgaccgatgccgatgtggatggcgctcatattagaaccttacttttaaccttgatttaccgctttatgagacctgttctagaagctggctatgtttacatcgcccagccacctatttatggtgttaaggtcggtagtgagattaaagagtatattcagccaggtattgatcaagaagaccaattaaaaacagctcttgaaaaatatagtattggtcgttcaaaaccaactgttcaacgttataaaggtcttggggaaatggatgaccatcaactttgggaaactactatggatcctgaaaatcgtttgatggcgcgtgtgacagttgatgatgccgcagaagcagataaagtatttgatatgttaatgggagatcgtgttgaaccaagacgtgatttcattgaggaaaatgcggtttatagtacactggatatt

SEQ ID NO: 1318 - protein, 650 aa, Streptococcus pyogenes
MIEENKHFEKKMQEYDASQIQVLEGLEAVRMRPGMYIGSTAKEGLHHLVWEIVDNSIDEALAGFASHIKVFIEADNSITVVDDGRGIPVDIQAKTGRPAVETVFTVLHAGGKFGGGGYKVSGGLHGVGSSVVNALSTQLDVRVYKNGQIHYQEFKRGAVVADLEVIGTTDVTGTTVHFTPDPEIFTETTQFDYSVLAKRIQELAFLNRGLKISITDKRSGMEQEEHFLYEGGIGSYVEFLNDKKDVIFETPIYTDGELEGIAVEVAMQYTTSYQETVMSFANNIHTHEGGTHEQGFRAALTRVINDYAKKNKILKENEDNLTGEDVREGLTAVISVKHPNPQFEGQTKTKLGNSEVVKITNRLFSEAFQRFLLENPQVARKIVEKGILASKARIAAKRAREVTRKKSGLEISNLPGKLADCSSNDANQNELFIVEGDSAGGSAKSGRNREFQAILPIRGKILNVEKATMDKILANEEIRSLFTAMGTGFGADFDVSKARYQKLVIMTDADVDGAHIRTLLLTLIYRFMRPVLEAGYVYIAQPPIYGVKVGSEIKEYIQPGIDQEDQLKTALEKYSIGRSKPTVQRYKGLGEMDDHQLWETTMDPENRLMARVTVDDAAEADKVFDMLMGDRVEPRRDFIEENAVYSTLDI

SEQ ID NO: 1319 - DNA, 558 bp, Streptococcus agalactiae
atgaattatcatgattatatttgggatttgggtggtacactacttgataattacgaaagttccacacgtgcttttgtagagactttgaaagaatttggatatcaagcagaccacgatagtgtgtatcaaaaattaaaagagtcaacagcagatgcaattgcatattttatccctgaagaagctgattttttaaaagagtataaggctaatgaagctaaggttttggaaacaccaattctattccaaggggcaaaagaacttttagcgaaaattcaaagacaaggtagtcgtaattttttggtgtctcatcgtgataatcaagttatagttattctggaaaaaacagaaattattgactattttacagaagtagtgactgctgataacggcttttcaaggaaacctagtcccgagagtatgctttatttgaaagaaaaataccaaattgataattgtttagtaataggcgatcgtgatatagataagcaagcaggagaatcggctggttttgataccttattagtcgatgggtcaaaatcattgatggagataatagag

SEQ ID NO: 1320 - protein, 186 aa, Streptococcus agalactiae
MNYHDYIWDLGGTLLDNYESSTRAFVETLKEFGYQADHDSVYQKLKESTADAIAYFIPEEADFLKEYKANEAKVLETPILFQGAKELLAKIQRQGSRNFLVSHRDNQVIVILEKTEIIDYFTEVVTADNGFSRKPSPESMLYLKEKYQIDNCLVIGDRDIDKQAGESAGFDTLLVDGSKSLMEIIE

SEQ ID NO: 1321 - DNA, 567 bp, Streptococcus pyogenes
atgaaaggtatgaattatcaagattatatatgggatttgggaggtaccttactcgataattacgagctttcaacccaagcttttgtccaaacgctagcttttttcagccttccaggagatcacgatgctgtttaccaaaaattaaaagaatcaaccgctatcgctgtggcaatgtttgctcctaatgagccagaatttttgcatgtgtataggctaagagaagcagacaaattggcacaacccatttggtgtttgggagctaaagaaattttgggaaagatagcgacttcaggttcgcgaaattttttaatttctcatcgagattgtcaggtgaaccaacttttagagcaagctgggttgctaatctattttacagaagtcgtgacagcttcaaatggctttgctcggaaaccaaatcctgaaagtttgttttatttaaaagaaaagtatgatattaatagtggattagtaattggagatcggctaattgataaacaagcaggacaagcagcgggttttaataccttgcttgttgacggtagaaaaaacctattggagatagtaacg

SEQ ID NO: 1322 - protein, 189 aa, Streptococcus pyogenes
MKGMNYQDYIWDLGGTLLDNYELSTQAFVQTLAFFSLPGDHDAVYQKLKESTAIAVAMFAPNEPEFLHVYRLREADKLAQPIWCLGAKEILGKIATSGSRNFLISHRDCQVNQLLEQAGLLIYFTEVVTASNGFARKPNPESLFYLKEKYDINSGLVIGDRLIDKQAGQAAGFNTLLVDGRKNLLEIVT

SEQ ID NO: 1323 - DNA, 1224 bp, Streptococcus agalactiae
atgaataaaaaaggaagtcctatgtcacaaaaatcaaactattttaaagggcaaattgattatgctgttgtgataccagtattttttttattaatgattggtttagcctcaatttatgttgcaacgatgaatgattatccttctaatatctatatcgcgatgtttcagcaggtgtcttggattattatggggtgtattattgcatttgtcgttatgcttttcagtactgaatttttatggaaagccacgccctatctgtatgctttaggactaaccctaatggttcttcccttaattttttatagtccacagctttttgcggcaacaggtgctaaaaattgggtgaccattggctcggtaactttgtttcaaccgtcagagtttatgaagatttcctatattttaatgttatctcgaataactgttagttttcatcagaaaaatcgcaaaacttttcaagatgattggaagttgctaggattgtttggtttggttacattgccagtgatgattcttctaatgttacaaaaagatttaggaacagcattagttttccttgccattttgtcaggtttaatccttttatcgggcatatcttggtggataatcttgccaattttatctactatcgttctttttatagctagctttttgatgatttttatctcaccaaacggcaaggaatggttttataatttggggatggatacatatcaaatcaaccgtttatctgcttggattgatccatttagttttgcagactcaattgcttatcaacaaacacagggtatggtatcaattggaagtggcggggtaacaggtaaaggttttaatattttagagctctcggttcctgttcgtgaaagtgacatgatttttactgtcattgctgagaattttggcttcattggttcggcgattgttttagggttatatctcattatcatttaccgtatgttaaggatcaccattgaatctaataatcaattttatacttttatatcaactggttttatcatgatgattgttttccatgtttttgaaaatattggtgcagcagttggtatattacctctaacaggaatcccacttccgtttatttcgcaaggtggaagttcattactaagtaatcttattggaattggattggtcttatccatgtcttatcaaaatacagttcgtcaggccaaggctaatggatcacatttgaagtatcgtagtata

SEQ ID NO: 1324 - protein, 408 aa, Streptococcus agalactiae
MNKKGSPMSQKSNYFKGQIDYAVVIPVFFLLMIGLASIYVATMNDYPSNIYIAMFQQVSWIIMGCIIAFVVMLFSTEFLWKATPYLYALGLTLMVLPLIFYSPQLFAATGAKNWVTIGSVTLFQPSEFMKISYILMLSRITVSFHQKNRKTFQDDWKLLGLFGLVTLPVMILLMLQKDLGTALVFLAILSGLILLSGISWWIILPILSTIVLFIASFLMIFISPNGKEWFYNLGMDTYQINRLSAWIDPFSFADSIAYQQTQGMVSIGSGGVTGKGFNILELSVPVRESDMIFTVIAENFGFIGSAIVLGLYLIIIYRMLRITIESNNQFYTFISTGFIMMIVFHVFENIGAAVGILPLTGIPLPFISQGGSSLLSNLIGIGLVLSMSYQNTVRQAKANGSHLKYRSI

SEQ ID NO: 1325 - DNA, 186 bp, Streptococcus agalactiae
ttgtctatcagaacagatatagatgagtttaaagaagcgattgataaaggctatatttcagggaacacagtagcgatagtgcgtaaaaacggaaagatatttgattatgtgttactacacgaagaagtgagagaagaagaggttgttacagttgagagagtgcttgatgtactgaggaagttatca

SEQ ID NO: 1326 - protein, 62 aa, Streptococcus agalactiae
MSIRTDIDEFKEAIDKGYISGNTVAIVRKNGKIFDYVLLHEEVREEEVVTVERVLDVLRKLS

SEQ ID NO: 1327 - DNA, 180 bp, Streptococcus pyogenes
atgctaacatacgacgagtttaagcaagcgattgacaatggatatatcgcaggcgatacagtagcgatcgtgcgtaaagacggacagatttttgattatgtgttgccacatgagaaagtaaagaatggagaagttgtgactaaggaaaaagtggaagaggtgctggtggagctttcgaga

SEQ ID NO: 1328 - protein, 60 aa, Streptococcus pyogenes
MLTYDEFKQAIDNGYIAGDTVAIVRKDGQIFDYVLPHEKVKNGEVVTKEKVEEVLVELSR

SEQ ID NO: 1329 - DNA, 198 bp, Streptococcus agalactiae
atgtcacaagaaaaactaaaatcaaaattagatcaagcaaaaggtggtgctaaagaaggctttggcaaaataaccggtgataaagagttagaagcaaaaggatttatcgaaaaaacaattgctaaaggcaaagaactagcagatgatgctaaagatgctgttgaaggggcagtagatgctgtcaaagaaaaactgaag

SEQ ID NO: 1330 - protein, 66 aa, Streptococcus agalactiae
MSQEKLKSKLDQAKGGAKEGFGKITGDKELEAKGFIEKTIAKGKELADDAKDAVEGAVDAVKEKLK

SEQ ID NO: 1331 - DNA, 198 bp, Streptococcus pyogenes
atgtcagaagaaaaattaaaatcaaaaattgagcaagcatctggtggcctaaaagaaggtgctggtaagttgacaggtgataaagagctagaagcaaaaggatttgttgaaaaaacaattgctaaaggcaaagaacttgcagacgatgcaaaggaagcggttgaaggtgctgtagatgccgttaaggaaaaattaaaa

SEQ ID NO: 1332 - protein, 66 aa, Streptococcus pyogenes
MSEEKLKSKIEQASGGLKEGAGKLTGDKELEAKGFVEKTIAKGKELADDAKEAVEGAVDAVKEKLK

SEQ ID NO: 1333 - DNA, 609 bp, Streptococcus agalactiae
atgaagaatatggcgctccctaaaatggctaccgttaagacaaaaacagctcttaaaaagactcaaaaaacgtatcctcaaaacttactcaaccagaaatttaatcctgataaacctaatcaagtatggtctactgacttcacctatatttctattggatataagaaatatgtctatctctgcgcaataattgatctctattctagaaaatatattgcttggaaattgagtcatcgtatggatgcaaagttagcatgtgacactctagaattagctcttaataaaagaaagattgaaggaacacttctctttcattccgaccaagggtcacaatttaaggccagggaatttagaaaaataattgatgacaacaatatcatgcattctttttctaaacctagatatccttatgataatgccgtaactgaagcatttttcaagtatttaaagcatagacaaatcaaccaaaaaaattatcaaaatatcaaacaggttcaattagactgctttgaatacattgagaatttttataacaattacatcccacatacggctaatctaggactaacccctaatcagaaagaagaaaattattttaacgcaataaaa

SEQ ID NO: 1334 - protein, 203 aa, Streptococcus agalactiae
MKNMALPKMATVKTKTALKKTQKTYPQNLLNQKFNPDKPNQVWSTDFTYISIGYKKYVYLCAIIDLYSRKYIAWKLSHRMDAKLACDTLELALNKRKIEGTLLFHSDQGSQFKAREFRKIIDDNNIMHSFSKPRYPYDNAVTEAFFKYLKHRQINQKNYQNIKQVQLDCFEYIENFYNNYIPHTANLGLTPNQKEENYFNAIK

SEQ ID NO: 1335 - DNA, 1080 bp, Streptococcus pyogenes
gtgttacaatctgttttaaaagacacaaaaacgaaaggacagcctatgtcaacagttaaacgctatgatgaagaattcaaacaatctcttgttaacctttatcaaactggaaaaactcggtctgaactctgtaaagactatggggtatccgcttctgcgcttgcaaaatggatcaaacagtattcccaagtcaaactcgaagataattctgtacttactgccaagcaaatacaagagctacaaaaacgtaatgcgcagcttgaagaggagaaccttatcctaaaaaaaagcaagtgccatattcatgcaaaacttaaagtaagactcctcgctgtttatcggttacgctttgaacacgtcacaacaaccttgtatcgtgttttacgtgtcaatcgctccacttactataaatttctaaaacataagccctcaaaaagagaattggataatcaaatttatagaaaacaaatacttgagatttataccaaagcaaacaaaagacttggtgtgaagtctatcaaagtcattcttcaaagagactacgacacaaaaatctctgaaggaagaatttaccgtctaatgaagaatatggcgctccctaaaatggctaccgttaagccaaaaacagctcttaaaaggactcaaaaaacgtatcctcaaaacttactcaaccagaaatttaatcctgacaaacctaatcaagtatggtctactgacttcacctatatttctattggatataagaaatatgtctatctctgcgcaatacttgatctctattctagaaaatgtattgcttggaaactgagtcaccgtatggatgcaaagttagcatgtgacactctagaattagctcttaataaaagaaagattgaaggaacacttctctttcattccgaccaagggtcacaatttaaggccagggaattgagaaaaataattgatgacaacactatcatgcattctttttctaaacctggatatccttatgataatgccgtaactgaagcatttttcaagtatttaaagcatagacaaatcaaccaaaaaaagtatcaaacaggttcaattagactgctt

SEQ ID NO: 1336 - protein, 360 aa, Streptococcus pyogenes
VLQSVLKDTKTKGQPMSTVKRYDEEFKQSLVNLYQTGKTRSELCKDYGVSASALAKWIKQYSQVKLEDNSVLTAKQIQELQKRNAQLEEENLILKKSKCHIHAKLKVRLLAVYRLRFEHVTTTLYRVLRVNRSTYYKFLKHKPSKRELDNQIYRKQILEIYTKANKRLGVKSIKVILQRDYDTKISEGRIYRLMKNMALPKMATVKPKTALKRTQKTYPQNLLNQKFNPDKPNQVWSTDFTYISIGYKKYVYLCAILDLYSRKCIAWKLSHRMDAKLACDTLELALNKRKIEGTLLFHSDQGSQFKARELRKIIDDNTIMHSFSKPGYPYDNAVTEAFFKYLKHRQINQKKYQTGSIRLL

SEQ ID NO: 1337 - DNA, 93 bp, Streptococcus agalactiae
atggaaaaaagaaatgatatcgataaagaatatggtaaaaacttaaggctcaagtctttcgcgtctttttgcatatcagctgttgaaacaaat

SEQ ID NO: 1338 - protein, 31 aa, Streptococcus agalactiae
MEKRNDIDKEYGKNLRLKSFASFCISAVETN

SEQ ID NO: 1339 - DNA, 1317 bp, Streptococcus agalactiae
atgaagaaattaaaaatattcccaaaaatgttcatacaaatattttctattcttggaatactaattatattagttcattcattattcttttttatctttcctaaaacatatttggagacgaggaaagtaaaaatccacattatggcagatgaaatttctaaaaatatgaatggaaaagagttaaaatatttagaccaaactttggagctttattctaaaagtagtgacataaaggtatttataaaaaaaaataataacaaaaatgaattacaaataaatgataatataaatgttaatgtaaaaagtgatagtaattctttaataattgaagaaagggaaattaaacttcatgatggcaaaaaaatacatcttcaatttgtttcaacagctgatatgcaaaaagacgcgaaagacttgagccttaagtttttaccatattctttatcgatatcatttcttttttccattgttatttctttaatttatgctaaatctataaaaaacaatatacaagaaataactatggttactgataaaatgataaaacttgacaaagaaacaagattgaaaattagttctaatgatgaaattggacaactaaaacagcaaatcaatgacttatattgtgctttattgaatacaattaatgatttggaatttaaaaataaggaaattttaaagttagaaaaattgaaatatgatttttttaagggggcgtcccacgaacttaaaactcctctttccagcctaaagatattacttgagaatatgaaatataatatcggaaaatataaagatagagacttttatatcagtgagtgtattaatattgtagataacttaacaaagaatgtctcgcaaatattatctttttattctataaaagacttgaataatgatgaagaatatttaaatgttggtgatacattagatgaagtattagaaaaatactctatcttagtaaatcaaaaaaaaataaatattaataaggaattattagactataatatttatataggaaaaacggcactaaatattgtattttctaatttgattagcaatgcagtaaaatatactaatcgaaatggaataattaatatcaaaatagctaatgattggttacttatagaaaactcatatgataaaaataaaatttcgaaaataaataaaattttagatgctagttttgatctaaaattggataatagtaatggattaggattaaatatagtaaagaatatacttaataagtataatataaagtatgaaatattacatggtgaaaattattttatatttaaaataaaaataatctct

SEQ ID NO: 1340 - protein, 439 aa, Streptococcus agalactiae
MKKLKIFPKMFIQIFSILGILIILVHSLFFFIFPKTYLETRKVKIHIMADEISKNMNGKELKYLDQTLELYSKSSDIKVFIKKNNNKNELQINDNINVNVKSDSNSLIIEEREIKLHDGKKIHLQFVSTADMQKDAKDLSLKFLPYSLSISFLFSIVISLIYAKSIKNNIQEITMVTDKMIKLDKETRLKISSNDEIGQLKQQINDLYCALLNTINDLEFKNKEILKLEKLKYDFFKGASHELKTPLSSLKILLENMKYNIGKYKDRDFYISECINIVDNLTKNVSQILSFYSIKDLNNDEEYLNVGDTLDEVLEKYSILVNQKKININKELLDYNIYIGKTALNIVFSNLISNAVKYTNRNGIINIKIANDWLLIENSYDKNKISKINKILDASFDLKLDNSNGLGLNIVKNILNKYNIKYEILHGENYFIFKIKIIS

SEQ ID NO: 1341 - DNA, 1386 bp, Streptococcus pyogenes
gtgagactaatcaaaaaaacctttttggtcatcaatggcttaattattgtagtggttacctctattttgttagtgctttattttgcaatgccaatttattacaccaaagtcaaagacaaagaagttaagtgtgaatttgaccaaacaagcaagcaaatcaaaggcaaaacggtaaccgagattagagatatcctaacaaaaaaaatcaacaaagataatatttggtacagcttagtagacagtgataaccaactgctctatccttccttgcagctcctagacggcgtcagtgaaagcaaagacagtcaaaatgttaatatcgtcaccacctttgacaactcttattctaatgttaaggtgatgagtcaaaaagtaaccctacgcgatggaaaaaaaatgacattgcttgggcaatcttcacttcaacccgtaacagatgctagcaaagttctccttgacctctacccgtcactattgattttttcagtgaccgtagggagtattgtcgcctacttatatagtaggacttctagccggcgtatccttagcatgtcacaaaccgccaaaaaaatggtcaacctagaaccaaacttaacgtgtaccattcacggcaaagatgaaatagcaatgttggctagtgatattaaccgtttgtatgcgagtctttcaacgagcatcaaatccttgcaaaaagagtatgaaaaagcttctgattcagaaagagagaaatctgagtttttacgcatgacatcgcacgagctaaagacaccaatcactagtgttatcggaatgattgatggaatgctctataatgttggtgactttgcagatcgtgacaaatatttgcgaaagtgccgagacgtccttgaagggcaagcccaactggttcaatccattttatctttatctaagattgaaaccctagcttctcaaaatcaagaactgttttcactaaaaagcagcctagaagaagaaatggaagtctttctcgtcttatcagaactaaaacacctcaaagtgactatcaatctcgaagaacaattcgtcaaagccaataaagtatatctactaaaggcgattaaaaatattattgacaatgcctttcactataccaaatcaggcggccaagtgatgattcaactaaaagacaaccaactagtgattaaaaatgaagcagagacattattgacacaacagcagatgaaacagttattccaaccgttttatcgaccagattatagtcgtaacaggaaagacggtggtacaggattggggctgtttatcacccaccagattcttgatcagcatcatctggcttatcgctttgttgttcttgatcaaagatggatggtatttacgattgattttccatcccatcatgacgat

SEQ ID NO: 1342 - protein, 462 aa, Streptococcus pyogenes
VRLIKKTFLVINGLIIVVVTSILLVLYFAMPIYYTKVKDKEVKCEFDQTSKQIKGKTVTEIRDILTKKINKDNIWYSLVDSDNQLLYPSLQLLDGVSESKDSQNVNIVTTFDNSYSNVKVMSQKVTLRDGKKMTLLGQSSLQPVTDASKVLLDLYPSLLIFSVTVGSIVAYLYSRTSSRRILSMSQTAKKMVNLEPNLTCTIHGKDEIAMLASDINRLYASLSTSIKSLQKEYEKASDSEREKSEFLRMTSHELKTPITSVIGMIDGMLYNVGDFADRDKYLRKCRDVLEGQAQLVQSILSLSKIETLASQNQELFSLKSSLEEEMEVFLVLSELKHLKVTINLEEQFVKANKVYLLKAIKNIIDNAFHYTKSGGQVMIQLKDNQLVIKNEAETLLTQQQMKQLFQPFYRPDYSRNRKDGGTGLGLFITHQILDQHHLAYRFVVLDQRWMVFTIDFPSHHDD

SEQ ID NO: 1343 - DNA, 663 bp, Streptococcus agalactiae
atggaggtatctatgaaaatattaactgttgaagatgataagttgataagagagggaataagtgaatacctttcagaatttggatatactgttattcaggctaaagatggaagggaagccttgtcaaaatttaatagtgatataaacttggttatcttagacattcagataccttttataaatggtttagaagtgttgaaagaaattagaaagaaaagcaatttaccaattctaattttgactgcatttagtgatgaagaatataaaattgatgcatttactaatttagtagatggatatgtagaaaaaccattttcattgcctgttttaaaggctagaatagattctttaattaagaagaattttggacatttagagaagtttgaatataagaatctttcggtaaattttaatagttatacagctaaaataaatgatgaaaaaatagatgtaaatgcaaaagaactcgaaatactaaaatgtttattggataatgatggacaagttttaacaagaatgcaaattattgattatgtctggaaggatagcgaagagatcccttatgatcgagtagtagatgtatatataaaagaacttagaaaaaaattacaattagactgtataactactataagaaatgtaggatataaattggagagaaaa

SEQ ID NO: 1344 - protein, 221 aa, Streptococcus agalactiae
MEVSMKILTVEDDKLIREGISEYLSEFGYTVIQAKDGREALSKFNSDINLVILDIQIPFINGLEVLKEIRKKSNLPILILTAFSDEEYKIDAFTNLVDGYVEKPFSLPVLKARIDSLIKKNFGHLEKFEYKNLSVNFNSYTAKINDEKIDVNAKELEILKCLLDNDGQVLTRMQIIDYVWKDSEEIPYDRVVDVYIKELRKKLQLDCITTIRNVGYKLERK

SEQ ID NO: 1345 - DNA, 651 bp, Streptococcus pyogenes
atgtttaaaatattagtagttgaagatgatgataccatcagtcaagtgatttgtgagtttttaaaagcgaataactatgatccagattgtgtatttgatggccaagctgccttagacaagtggcagacaacgtcttatgatctgattattttagacatcatgctcccttccttaagtggcttagaagtgctaaaaacaattcgaaagacatcagatgtccctattattatgctaacggcattagatgacgagtacacacagcttgtaagcttcaaccatttgattagtgattatgtgaccaaaccattttcaccactcattttaatcaaacgtatcgaaaatgtattacgcgtctctactccagatgaaaagcgccaaatcggagacttacttgttgatgagaccgaacatagcgtctattggcaaggaacattggtcaaactaaccaaaaaagaatatgacattattgattatttagcaaaacgtcaccaaaaaattgtcaccagagaccaattgatggatgacatatggggctattctgaactggacacgcgtgtccttgacaaccacatcaagaaccttcgtaaaaaaatgacgggtattcccctcaagacaattacaggcatgggctatttattgggagagcgtgag

SEQ ID NO: 1346 - protein, 217 aa, Streptococcus pyogenes
MFKILVVEDDDTISQVICEFLKANNYDPDCVFDGQAALDKWQTTSYDLIILDIMLPSLSGLEVLKTIRKTSDVPIIMLTALDDEYTQLVSFNHLISDYVTKPFSPLILIKRIENVLRVSTPDEKRQIGDLLVDETEHSVYWQGTLVKLTKKEYDIIDYLAKRHQKIVTRDQLMDDIWGYSELDTRVLDNHIKNLRKKMTGIPLKTITGMGYLLGERE

SEQ ID NO: 1347 - DNA, 1374 bp, Streptococcus agalactiae
atgataaaaaatgcatttgcttatgtaactagaaaaagcttaaaatcattaattattatattagttattctatcaatggcaactttaagcatcattagtttatctattaaagatgccacagatagagcttctaaggaaacatttgctaatataacaaacagtttttctatggaaataaatagacaagtaaatccaggaacacctaggggtggaggaaatgtaaaaggtgaagatattaaaaagatatctcaaacaaacagtatagactcctatgtaaaaagaataaacagcgtcgcagacctagttgatcatgatataattgaaactcaagatacacttgcaaatcaatcacctgaaagagcaaagaattttaagagaacagttatgttaacaggggttaatgactcagcaaaagaaacaaaatttgtatcagaagcatataagttagtagaaggaaagcatttagaaaataaagataaaaataaaattttaatgcataaagatttggcaaaaaaaaacaatctcaaagttggagataaaataaaaataaaatctaatttgtttgatgctgacaatgaaaaagttgcaaatgaaactgtagaagtagaaattaaaggtttatttgatggtcataatagcggtggggtaagtgcagcacaagaactatacgaaaatacactaatcactgacgttcattcagctgctaaagtttatggtaatacagaagatacagccgtataccaagatgcaacattctttgtaaaaggtgataagaatcttgatagtgtaataaaagatcttgggaaactagatataaattggagagaatataatttgattaaaagttcatcaaattatcctgcgctgcaacaatctatatccggtatctattctatttcaaacaaattatttgttggctcattaatatttgcaggagttgtagtttcattattacttttcttatggatgaatgccagaaagaaagaaatagcagtattactatcattaggtatatctaaattagaaatttttggtcaatttataatcgagatggtatttatatccattcccgcacttcttggatcttatttcttagctcaatatacagctgataagctagggaataatatattgaataaagttactggcgatatagctaaacaaatagctagacaatctgcatctagtcaattaggcgggggggcagaagctgaaggattcaacaagactctttcaggtttagatataaatgtattacctaaattcataatttatgtagttatatttatgagttttgtacttcttgtatcattgattctttcttcaatttatacattaagaaagaatccaaaagagttattaattgataataat

SEQ ID NO: 1348 - protein, 458 aa, Streptococcus agalactiae
MIKNAFAYVTRKSLKSLIIILVILSMATLSIISLSIKDATDRASKETFANITNSFSMEINRQVNPGTPRGGGNVKGEDIKKISQTNSIDSYVKRINSVADLVDHDIIETQDTLANQSPERAKNFKRTVMLTGVNDSAKETKFVSEAYKLVEGKHLENKDKNKILMHKDLAKKNNLKVGDKIKIKSNLFDADNEKVANETVEVEIKGLFDGHNSGGVSAAQELYENTLITDVHSAAKVYGNTEDTAVYQDATFFVKGDKNLDSVIKDLGKLDINWREYNLIKSSSNYPALQQSISGIYSISNKLFVGSLIFAGVVVSLLLFLWMNARKKEIAVLLSLGISKLEIFGQFIIEMVFISIPALLGSYFLAQYTADKLGNNILNKVTGDIAKQIARQSASSQLGGGAEAEGFNKTLSGLDINVLPKFIIYVVIFMSFVLLVSLILSSIYTLRKNPKELLIDNN

SEQ ID NO: 1349 - DNA, 1218 bp, Streptococcus pyogenes
atggaaaattggaaattcgctcttagctcaatttgggggcataagatgcgctcaatcctgacaatgttgggaattatcatcggtgtagcagcagttgtgattattatggggttgggaaatgctatgaaaaatagtgtaacaagcacattttctagcaagcaaaaagatattcaactctattttcaagaaaaaggagaagaagaagacctgtatgccggattgcacacgcatgaaaataatcacgaagtgaagccagagtggttagaacaaattgttaaagatatcgatggtattgattcttattactttaccaattctgctacttctactatttcgtatgaaaaaaagaaagtagacaatgcttcgatcataggggtaagtaaagattattttaatataaaaaactatgatatcgtagctggtcgtacactaacagataatgattattctaatttttcgcgtatcattcttttagatacagtattagccgatgacctatttggcaaaggtaattataagtcagctttaaataaagtggtaagtttatctgataaagattatttagttattggtgtttataaaactgatcagacgccagtttcttttgatggattatcaggcggcgctgtcatggcgaatactcaggtagcttcagagtttggcaccaaagaaataggatctatctacattcatgtgaacgatattcaaaacagtatgaacttaggaaatcaagcagctgatatgctaaccaacatatcgcatattaaagatggacagtacgctgtccctgataatagcaaaatcgttgaagaaatcaatagtcagttcagtatcatgacaacagtcataggttcaattgcagcgatctctcttttagtgggaggaattggtgttatgaatattatgttggtatctgtcacagagcgaactagagaaattggtttacgtaaagcacttggtgcaacacgcctgaaaattttatcacaatttttgattgaatccgttgttctaacagttcttggaggcttgataggattattattagctcaattaagtgtaggggctttaggaaatgcgatgacattaaaaggagcttgtatttctcttgatgtggccttaatagcagttttattttctgcctcaataggtgtcttttttggaatgttgccagctaataaagctagtaagttagatccaattgaggcattacgttatgaa

SEQ ID NO: 1350 - protein, 406 aa, Streptococcus pyogenes
MENWKFALSSIWGHKMRSILTMLGIIIGVAAVVIIMGLGNAMKNSVTSTFSSKQKDIQLYFQEKGEEEDLYAGLHTHENNHEVKPEWLEQIVKDIDGIDSYYFTNSATSTISYEKKKVDNASIIGVSKDYFNIKNYDIVAGRTLTDNDYSNFSRIILLDTVLADDLFGKGNYKSALNKVVSLSDKDYLVIGVYKTDQTPVSFDGLSGGAVMANTQVASEFGTKEIGSIYIHVNDIQNSMNLGNQAADMLTNISHIKDGQYAVPDNSKIVEEINSQFSIMTTVIGSIAAISLLVGGIGVMNIMLVSVTERTREIGLRKALGATRLKILSQFLIESVVLTVLGGLIGLLLAQLSVGALGNAMTLKGACISLDVALIAVLFSASIGVFFGMLPANKASKLDPIEALRYE

SEQ ID NO: 1351 - DNA, 654 bp, Streptococcus agalactiae
atggatatattagaaataaagaatgtaaattacagttacgcaaattctaaagaaaaagttttgtcaggagtaaatcaaaaatttgaacttggaaagttttatgcgatagtagggaagtcaggaacaggaaaatccacacttctttccttacttgcaggacttgataaagttcaaacaggaaaaatcttgtttaagaatgaagatatagaaaagaaaggatatagtaatcacagaaaaaataatatatctttggtatttcaaaattataatttaatagattatttatcgccgattgaaaatattagactagtaaataaatcagtagatgagagtatcttgttcgaattaggtttagataaaaaacaaataaaaagaaatgttatgaaattatctggtggtcagcaacaaagggtagctattgctagggcactggtatcagatgccccaataatactagctgatgagcctaccggtaacctagacagtgttactgctggagaaataattaatatattaaaggaattagctcaagatagaaataaatgtgtaatagttgtaacacatagtaaggaagtagcagattctgcggatatcattttagaactaagtggtaaaaagttgaaaaaagtaaataaaatgaatttggaggttgaa

SEQ ID NO: 1352 - protein, 218 aa, Streptococcus agalactiae
MDILEIKNVNYSYANSKEKVLSGVNQKFELGKFYAIVGKSGTGKSTLLSLLAGLDKVQTGKILFKNEDIEKKGYSNHRKNNISLVFQNYNLIDYLSPIENIRLVNKSVDESILFELGLDKKQIKRNVMKLSGGQQQRVAIARALVSDAPIILADEPTGNLDSVTAGEIINILKELAQDRNKCVIVVTHSKEVADSADIILELSGKKLKKVNKMNLEVE

SEQ ID NO: 1353 - DNA, 711 bp, Streptococcus pyogenes
atggaggggcagatggcttttattgaattaaaacaggtttcaaaatcttatcagataggagagacgactgtttttgccaaccacgaagtgtcttttgagattaataaaggagaactagtggttattttgggagcatccggagctggtaaatcgacagtcctcaatattttggggggcatggacacagtagatgcaggtcaagtaattattgatggcaaagacattgctcattacacgtctaaggccttaactcagtatcgtcggaatgctattggtttcgtttttcaattttataatttggttcctaatttgacagctaaagaaaatgttgaattagcagttgaaattgtagcagatgctttagatcctgtgaccattttaaaggaagtaggactcagtcatcgtctggatcattttcctgctcagctctcaggtggtgaacagcaacgggtttcgatagcacgtgccttagctaaaaaccctaaattgcttctttgtgatgaacctacaggtgcccttgactaccaaacaggaaagcaaattctaaccctcttacaggatatggcacaaactaaggggaccacggtagttattgtaacccacaatgctgctattgctccgatagctgatcgtgtcatttttatgcatgatgcacaggttaccaagacagtcattaataaggaacctgcaagcattgagacaattgattat

SEQ ID NO: 1354 - protein, 237 aa, Streptococcus pyogenes
MEGQMAFIELKQVSKSYQIGETTVFANHEVSFEINKGELVVILGASGAGKSTVLNILGGMDTVDAGQVIIDGKDIAHYTSKALTQYRRNAIGFVFQFYNLVPNLTAKENVELAVEIVADALDPVTILKEVGLSHRLDHFPAQLSGGEQQRVSIARALAKNPKLLLCDEPTGALDYQTGKQILTLLQDMAQTKGTTVVIVTHNAAIAPIADRVIFMHDAQVTKTVINKEPASIETIDY

SEQ ID NO: 1355 - DNA, 105 bp, Streptococcus agalactiae
ttgtttaaggcaagctctgtagattctaaactaccagaatacattaaaattttatttgcaattctattattctctgatttatttaatatttcttggctagttgaa

SEQ ID NO: 1356 - protein, 35 aa, Streptococcus agalactiae
MFKASSVDSKLPEYIKILFAILLFSDLFNISWLVE

SEQ ID NO: 1357 - DNA, 1275 bp, Streptococcus agalactiae
gtgataaaaaatgctatagcatatattaccagaaaaaaaaatagaacacttattatatttgctattttaacaattgttctttcttgcttgtattcatgtttaacaataatgaaatcaagtaatgaaatagaaaaggctttatatgaaagttctaattcttcaatatcaattacaaaaaaagatggtaaatattttaatattaatcaatttaagaatattgaaaaaataaaagaggttgaagaaaaaatatttcaatatgatggattagcaaaattgaaagatcttaaagtagttagtggtgagcaaagtataaatagagaagatttatctgacgaatttaaaaatgttgtttcactagaagctacaagtaatactaaaagaaatcttttatttagtagtggagtatttagttttaaagaaggaaaaaatatagaagaaaatgataagaattcaattcttgttcatgaagaatttgctaaacaaaacaaactaaaattgggtgatgaaattgatcttgaattactagatacggaaaaaagtggaaaaataaaaagtcataaatttaaaattataggaatcttttctggtaaaaaacaggaaacatatacaggattatcatctgattttagcgaaaatatggtttttgtagattattcaactagccaagaaatattaaataaatcagagaataatagaattgcaaataaaattttaatgtattctggtagtttagaatctacagagcttgccttaaacaaattgaaagactttaaaattgataagtcaaagtattctattaagaaagataataaagcattcgaagagtctttagagtcagtgagtggaataaaacatataattaaaataatgacttattcgattatgttaggtggaatagttgttctttcattaatcttgattctatggttaagagaaagaatttatgaaataggtatatttttatctattggaacaactaagatacaaattataaggcaatttatatttgagttaatattcatatcaataccaagtataatatcctccttatttttagggaatctactattaaaagtaattgtagaaggatttattaactcagagaactcaatgattttcggtggaagtttaataaataaaagcagttttatgttaaacataacaacacttgcagaaagttatttaatattaataagtattattgttttatcagttgtaatggcctcttcattaatattatttaagaaaccaaaagaaatattatcaaaaataagt

SEQ ID NO: 1358 - protein, 425 aa, Streptococcus agalactiae
MIKNAIAYITRKKNRTLIIFAILTIVLSCLYSCLTIMKSSNEIEKALYESSNSSISITKKDGKYFNINQFKNIEKIKEVEEKIFQYDGLAKLKDLKVVSGEQSINREDLSDEFKNVVSLEATSNTKRNLLFSSGVFSFKEGKNIEENDKNSILVHEEFAKQNKLKLGDEIDLELLDTEKSGKIKSHKFKIIGIFSGKKQETYTGLSSDFSENMVFVDYSTSQEILNKSENNRIANKILMYSGSLESTELALNKLKDFKIDKSKYSIKKDNKAFEESLESVSGIKHIIKIMTYSIMLGGIVVLSLILILWLRERIYEIGIFLSIGTTKIQIIRQFIFELIFISIPSIISSLFLGNLLLKVIVEGFINSENSMIFGGSLINKSSFMLNITTLAESYLILISIIVLSVVMASSLILFKKPKEILSKIS

SEQ ID NO: 1359 - DNA, 1215 bp, Streptococcus pyogenes
atggaagatattattgcagctttaagctctatattatcacacaagatgcggtcaattttgacaatgctagggattattatcggtattggtgccattatcgcaatcttttcaatcatcgaaggtaataccgaaaataccaaaagacagttgattggtggcagcaataacactattaacattgtgtttaacaaaaaaagtagtattgaccctaaatttccagacaagtcaaatgctaaaaaaccagactatcttccttttatggctgaagaagagcttagcaaaatacagcaagtcaaaggcgtcaaaaatgccctgatctcatatggtattgatgacaaagtctaccatctaggccaaaaatcatctgcaaagatttctgccatcacaaaaaacgtagctgaagtgagacgcatgacatttattaaaggcagtgacttttcagacaaagactttattgaccaaaaacaggtgatttaccttgaaaaaagcttgtatgagtcactatttccaaaagacgatggccttggaaaatttgtcgaagtgatgggaaatcccttcagggtcattggggtgtttgaatcaaaagaacaaagtggcctcacaagtgggactgagaaaattgcttatatcccgctacatcagtggtataatattaatggtgtagtggatgcgacacctgagatcacgatccagacctatcgcgcagatgacctcaaacctgtagcaaagcgtgtcagtgatatgctcaatcaaacgatccctaaatcagattatatgtttggtgtcatgaaccttaaagaatttgaacgccaactagacaacctaaacaaatctaattttgtgttattagctggtattgctagtatctctcttattgtaggtggtattggtgtgatgaacattatgctagtatcagttaccgaaagaacgagagaaattgggatcaaaaaagcgcttggcgctagacgtaagcttattttaaaacaatttttaattgaagcggtcattctaaccttgctaggtggtgtgataggggttatttcagggatggtatcaggattgatcatcacaagatcactcgaatatccctatatcctatccttgttctcagttgtcttgagtttagcgttttgttgtattatagggattgtctttggactattaccagccattaaagcgtctaagctagacccaattgaagcattgcgatttgaa

SEQ ID NO: 1360 - protein, 405 aa, Streptococcus agalactiae
MEDIIAALSSILSHKMRSILTMLGIIIGIGAIIAIFSIIEGNTENTKRQLIGGSNNTINIVFNKKSSIDPKFPDKSNAKKPDYLPFMAEEELSKIQQVKGVKNALISYGIDDKVYHLGQKSSAKISAITKNVAEVRRMTFIKGSDFSDKDFIDQKQVIYLEKSLYESLFPKDDGLGKFVEVMGNPFRVIGVFESKEQSGLTSGTEKIAYIPLHQWYNINGVVDATPEITIQTYRADDLKPVAKRVSDMLNQTIPKSDYMFGVMNLKEFERQLDNLNKSNFVLLAGIASISLIVGGIGVMNIMLVSVTERTREIGIKKALGARRKLILKQFLIEAVILTLLGGVIGVISGMVSGLIITRSLEYPYILSLFSVVLSLAFCCIIGIVFGLLPAIKASKLDPIEALRFE

SEQ ID NO: 1361 - DNA, 159 bp, Streptococcus agalactiae
ttgggcggcattggagcgcataaattttacgcaggaaaaataggccaggtttttttatatattatttttagtattacctttattcctggaattatcgaccttatcgaagctttgatggctctcggaaaacaaactgatgaatatggaaatatcatcgtt

SEQ ID NO: 1362 - protein, 53 aa, Streptococcus agalactiae
MGGIGAHKFYAGKIGQVFLYIIFSITFIPGIIDLIEALMALGKQTDEYGNIIV

SEQ ID NO: 1363 - DNA, 93 bp, Streptococcus agalactiae
ttgaaaaacccaaagaaactttcagttggtgcattatcaatacatttgccaatccgggacatggataaggtcagaccagcttgttgtatgata

SEQ ID NO: 1364 - protein, 31 aa, Streptococcus agalactiae
MKNPKKLSVGALSIHLPIRDMDKVRPACCMI

SEQ ID NO: 1365 - DNA, 258 bp, Streptococcus agalactiae
ttgatgaacattctggggattagttcagtcattcgtcgtgttagccatgcttgtacaaaagctggtgacagattttacgaagaaaatattcttaatcgtgaatttacagccacagctcataaccagaaatggtgcacagatgtcacctatcttcaatacggtctgggagctaaagcttatctcagtgcgattaaagacctgtataacggttctattatcgcttatgagattagtcacaacaatgaaatccacttgtta

SEQ ID NO: 1366 - protein, 86 aa, Streptococcus agalactiae
MMNILGISSVIRRVSHACTKAGDRFYEENILNREFTATAHNQKWCTDVTYLQYGLGAKAYLSAIKDLYNGSIIAYEISHNNEIHLL

SEQ ID NO: 1367 - DNA, 90 bp, Streptococcus agalactiae
gtgttcaaggctaccttgatggaaaaggctctcttagagatatttgtaaatggtatgatatctcaagtcgctctgttctccaaaagtgga

SEQ ID NO: 1368 - protein, 30 aa, Streptococcus agalactiae
MFKATLMEKALLEIFVNGMISQVALFSKSG

SEQ ID NO: 1369 - DNA, 402 bp, Streptococcus agalactiae
ttgatatactccacattagctaaagaacagggtgttcaaggctaccttgatggaaaaggctctcttagagatatttgtaaatggtatgatatctcaagtcgctctgttctccaaaagtggataaaacggtatactagtggtgaagacttgaaagccactagtagaggatatagccgtatgaaacaaggaaggcaagccacatttgaagaacgtgtagagattgttaactacaccattgcccatgggaaagactatcaagcagctattgagaagtttggtgtttcctaccaacaaatttattcttgggtgcgtaagcttgagaagaatggctcacaaggtttggttgatagacgtgtgaaagggttggagagtaggcctgatttaaccgagattgagcaactt

SEQ ID NO: 1370 - protein, 134 aa, Streptococcus agalactiae
MIYSTLAKEQGVQGYLDGKGSLRDICKWYDISSRSVLQKWIKRYTSGEDLKATSRGYSRMKQGRQATFEERVEIVNYTIAHGKDYQAAIEKFGVSYQQIYSWVRKLEKNGSQGLVDRRVKGLESRPDLTEIEQL

SEQ ID NO: 1371 - DNA, 216 bp, Streptococcus agalactiae
atgatattgattacactaacaaatatttatcaattaataaaacttgggattatcatttcaaccaaagatacctgccaacaaaaaacaaaagtagtatcagaaatataccaattgacaatgatacattattttttttgcatgaatttacaaaaaataaaaacgacagattattcgacaaactttcaaataatgcagtcaataaaactatccgaaaaa

SEQ ID NO: 1372 - protein, 72 aa, Streptococcus agalactiae
MILITLTNIYQLIKLGIIISTKDTCQQKTKVVSEIYQLTMIHYFFCMNLQKIKTTDYSTNFQIMQSIKLSEK

SEQ ID NO: 1373 - DNA, 579 bp, Streptococcus agalactiae
ttgataaaaatttgtaaagaaaaatcacaacatcaatcgtatgcagcgttatacctcatcgctaaaactggcatgcgcttcgctgaatgtttaggtttaacagttaatgatattgattacactaacaaatatttatcaattaataaaacttgggattatcatttcaaccaaagatacctgccaacaaaaaacaaaagtagtatcagaaatataccaattgacaatgatacattattttttttgcatgaatttacaaaaaataaaaacgacagattattcgacaaactttcaaataatgcagtcaataaaactatccgaaaaataactggtcgcgaggtacgagtgcactctctcaggcatacatttgcaagctatctaatttccatctctcaagttttagatcacgagaatttaaatatcactttagaagtttacgcacatcaattacaagaacaaaaagataggaacgataaacttaatcagagaaatttggggcggatttggggcaaaatagctctaaaccgctatttacatgcaatgaatatgtcccctgccggaatctactactattgtacacaa

SEQ ID NO: 1374 - protein, 193 aa, Streptococcus agalactiae
MIKICKEKSQHQSYAALYLIAKTGMRFAECLGLTVNDIDYTNKYLSINKTWDYHFNQRYLPTKNKSSIRNIPIDNDTLFFLHEFTKNKNDRLFDKLSNNAVNKTIRKITGREVRVHSLRHTFASYLISISQVLDHENLNITLEVYAHQLQEQKDRNDKLNQRNLGRIWGKIALNRYLHAMNMSPAGIYYYCTQ

SEQ ID NO: 1375 - DNA, 177 bp, Streptococcus agalactiae
atgttatatatagatgagtttaaagaagcgattgataaaggctatatttcagggaacacagtagcgatagtgcgtaaaaacggaaagatatttgattatgtgttgccgcacgaggaagtgagagatgatgaagttgtgacagttgagagtgtagaagaggtgttgagggaattgaag

SEQ ID NO: 1376 - protein, 59 aa, Streptococcus agalactiae
MLYIDEFKEAIDKGYISGNTVAIVRKNGKIFDYVLPHEEVRDDEVVTVESVEEVLRELK

SEQ ID NO: 1377 - DNA, 201 bp, Streptococcus agalactiae
ttgtattttactttattaacaaggatgattgaaatggataaagaattaacacctcaagaaaaagcaaataaaaagtgggcagaaaacaatagagaacatagaacctatctatcaaaacgatctactgctcgtagttttattaacaaaaatgctacaaaagaagacttattagaattaaaacaattaattgaaagcaaactc

SEQ ID NO: 1378 - protein, 67 aa, Streptococcus agalactiae
MYFTLLTRMIEMDKELTPQEKANKKWAENNREHRTYLSKRSTARSFINKNATKEDLLELKQLIESKL

SEQ ID NO: 1379 - DNA, 198 bp, Streptococcus agalactiae
atgtcacaagaaaaactaaaatcaaaagttgaacaagcatcaggtagcctaaaagaaggagctggtaagctaactggcgataaagagttagaggcaaaaggttttgtcgaaaaaacaattgctaaaggtaaagaactagcagatgatgctaaagatgctgttgaagaggcagtagatgttgtcaaagaaaaactgaaa

SEQ ID NO: 1380 - protein, 66 aa, Streptococcus agalactiae
MSQEKLKSKVEQASGSLKEGAGKLTGDKELEAKGFVEKTIAKGKELADDAKDAVEEAVDVVKEKLK

SEQ ID NO: 1381 - DNA, 108 bp, Streptococcus agalactiae
gtgtactacttttacaaattcaaaaaaatagaaatttttagcaagaatcgcctgatactagctgttcttgcttttttatttgctaaagaaagatatagatgttataat

SEQ ID NO: 1382 - protein, 36 aa, Streptococcus agalactiae
MYYFYKFKKIEIFSKNRLILAVLAFLFAKERYRCYN

SEQ ID NO: 1383 - DNA, 1086 bp, Streptococcus agalactiae
ttgtggcttgacattatttttaaaaaaagtataattatcttaacaagacaaaccccccattcctttataggcagatacgttctgatatggggctttttttatatcgttaggagagttatgaaacaacctttagctttgacatgggaagatcaaattagactacttgaaaaacgtggattaattgttaaagctgatgatgtagagaaaatcaaacatatcagttattatagaattaaagaatttgcaaaaccacttgaaataaagcaacaagatggtgaggagcaggatattttatatgataatattgagtttgcagaagttttggcaagatattatcaggataaaaacttaagaatctatctactgcacgctattgaaaaaattgaagtgtctattaaaacaaaaatttcttttgttttgggggatagatatggggcgttcggatatttaaatttctcttcatgggctaataggaataagtttacaaaatatgatattgaaaaaagacaatttaggattaaaaagaatttattgaatactgtaagaaaatctcaactaactgagttacaaaaatcaattaaccttgatctagatggattcccaacagtgtggcttgctattgatttattgatgtttggtgacatcgtttcaatcttaacaatcatgagtgagaagaacattaaacagatttgtcaatattacagttgtacaccagaagaacttgtttcgtggcttaaatgtttgaatttcataagaaatgtatgtgctcataattcaaatgtactggatattcaaatcacaacaaagcctaaacttcgttcagaatggagaaattatattgatacagtaataattaaacataacgtgactaaaccttctaataagttatccgttattattgctattgtagtctatcttgtaaatactattaattccaaatatcaatggagaaatatacagtctagtttgaaggctctttgtaaagaagatgacagtagggcaaagcttttaggttttaaagattatgattctgttaaagcaatgattaatgggataaagtgtactacttttacaaattcaaaaaaa

SEQ ID NO: 1384 - protein, 362 aa, Streptococcus agalactiae
MWLDIIFKKSIIILTRQTPHSFIGRYVLIWGFFYIVRRVMKQPLALTWEDQIRLLEKRGLIVKADDVEKIKHISYYRIKEFAKPLEIKQQDGEEQDILYDNIEFAEVLARYYQDKNLRIYLLHAIEKIEVSIKTKISFVLGDRYGAFGYLNFSSWANRNKFTKYDIEKRQFRIKKNLLNTVRKSQLTELQKSINLDLDGFPTVWLAIDLLMFGDIVSILTIMSEKNIKQICQYYSCTPEELVSWLKCLNFIRNVCAHNSNVLDIQITTKPKLRSEWRNYIDTVIIKHNVTKPSNKLSVIIAIVVYLVNTINSKYQWRNIQSSLKALCKEDDSRAKLLGFKDYDSVKAMINGIKCTTFTNSKK

SEQ ID NO: 1385 - DNA, 744 bp, Streptococcus agalactiae
atgatgagtggaagaaaggtcaataatatggtaattaatattgagcaagctatcgcatggatggcatctagaaaaggtaaagttacttactcgatggactatcgaaatggtccttcatcttacgattgctctagctctgtctattttgctctacgctcagcaggcgcatcagataatggctgggcagtaaatacagaatatgagcacgattggttgataaaaaacggttatgttcttattgcagaaaatactaattggaatgcgcaaagaggtgatatttttatttggggtaaacgtggggcttcggctggagcttttggacatactggtatgtttgttgatccagacaatattattcactgtaattatggttataactcaattacagtgaataaccatgatgaaatctggggatataatggtcaaccttatgtttacgcttatcgttacgctaggaaacagtcaaatgctaaggttgataatcaatcagttgtatctaaatttgaaaaagagttagacgttaacacaccgctaagtaattcaaatatgccatattacgaagcaacaatttcagaagattattacgttgagtccaagcctgacgtcaatagcactgataaggagttgcttgttgctggtactagagttcgagtttacgaaaaagtaaaaggctgggcaaggataggcgctccacagtctaatcagtgggtagaagatgcttacttaattgatgcaacagatatg

SEQ ID NO: 1386 - protein, 248 aa, Streptococcus agalactiae
MMSGRKVNNMVINIEQAIAWMASRKGKVTYSMDYRNGPSSYDCSSSVYFALRSAGASDNGWAVNTEYEHDWLIKNGYVLIAENTNWNAQRGDIFIWGKRGASAGAFGHTGMFVDPDNIIHCNYGYNSITVNNHDEIWGYNGQPYVYAYRYARKQSNAKVDNQSVVSKFEKELDVNTPLSNSNMPYYEATISEDYYVESKPDVNSTDKELLVAGTRVRVYEKVKGWARIGAPQSNQWVEDAYLIDATDM

SEQ ID NO: 1387 - DNA, 1332 bp, Streptococcus pyogenes
atggctacatatcaggaatataaaagtcgttcaaatggcaatgcttacgatattgatggatcgcttggtgcgcaatgttgggatggctacgcagactactgtaagtatctaggactgccatacgcaaactgtacaaatacaggatatgcaaaggatatatgggaacaacgtcacaaaaatggtattttaaactactttgacgaagtagagactatgcaagctggagatgtcgcaatttttatggtagttgcaggtgttacaccgtatagccatgtggctatttttgatagtgatgcaggtagtggatacggatggtttttaggtcaaaaccagggtggagcaaacggagcatataatttagtaaaaataccatattcaacgacttatcctactgcatttagaccaaaagtttttaaaaatgcagttactgttataggtaatataggactaaataaaggcgattattttattgatgtatcagcttatcaacaagcagacttaaccgctacttgtcagcaagctggcactactaaaacgattatcaaagtatccgagtcactcgcttggctgtctgataggcatcagcaacaagctaatactagtgaccctattggttattatcactttggacgatttggaggagatagcaacttagcgcaacgagaagcagatttatttctgtccaatttaccaaccaaaaaagtctcttacttagtcattgattatgaagactctgcaagtgccgacaaagaagctaacactaatgcagttattgcgtttatggataaaattgcaaacgctggatataagcctgtttattacagctataaaccatttacgcttaataatattgattatcagcaaattatcgctaagtacccaaacagcatttggatagctggttatccagactacgaagtacgaacagagccactttgggagttcttcccttcaatggatggtgtgcgctggtggcagttcacaagtgtaggagtagcaggtggtttagataaaaatattgtattattagcagatgatagtagcaaagtggatatacctaagattgacaaaccacaaagccagcttacttttaatcaaaagctagatactaacactaaattagacaactcgaatgtaccttactacgaagcaacccttagaacagactattatgtagagtctaagccaaacgcaagtagcgctgataaagaatttatcaaggcaggaactcgtgtaagagtctatgaaaaagtgaatggatggtcacgtattaacgcttctcagtctgaccagtgggtcgaagataagtatttatctaatgcaacacaagta

SEQ ID NO: 1388 - protein, 444 aa, Streptococcus pyogenes
MATYQEYKSRSNGNAYDIDGSLGAQCWDGYADYCKYLGLPYANCTNTGYAKDIWEQRHKNGILNYFDEVETMQAGDVAIFMVVAGVTPYSHVAIFDSDAGSGYGWFLGQNQGGANGAYNLVKIPYSTTYPTAFRPKVFKNAVTVIGNIGLNKGDYFIDVSAYQQADLTATCQQAGTTKTIIKVSESLAWLSDRHQQQANTSDPIGYYHFGRFGGDSNLAQREADLFLSNLPTKKVSYLVIDYEDSASADKEANTNAVIAFMDKIANAGYKPVYYSYKPFTLNNIDYQQIIAKYPNSIWIAGYPDYEVRTEPLWEFFPSMDGVRWWQFTSVGVAGGLDKNIVLLADDSSKVDIPKIDKPQSQLTFNQKLDTNTKLDNSNVPYYEATLRTDYYVESKPNASSADKEFIKAGTRVRVYEKVNGWSRINASQSDQWVEDKYLSNATQV

SEQ ID NO: 1389 - DNA, 333 bp, Streptococcus agalactiae
atgaacgaatttataacacaaatcattacagtatcagtaccaatttttggtatcatcgcaggtattctcacgcacaaagtaaaaaaattacttataaaaaaaggtggagaaaaagctgttaaaattgcagaaattgtcgctcgtaatgctgttgaggcagttgaacaaatatctgtggaagttggtattaagggacaagataagctaacagaagctaaaacagctgttattgatggtttatcgcaatataatatcagtttaacagagactcagttagaaacatttatcgaagctgcggttaaacgcatgaatgatgagtggaagaaaggtcaa

SEQ ID NO: 1390 - protein, 111 aa, Streptococcus agalactiae
MNEFITQIITVSVPIFGIIAGILTHKVKKLLIKKGGEKAVKIAEIVARNAVEAVEQISVEVGIKGQDKLTEAKTAVIDGLSQYNISLTETQLETFIEAAVKRMNDEWKKGQ

SEQ ID NO: 1391 - DNA, 300 bp, Streptococcus agalactiae
atgacagtagaacaagcagaaagaatcgctcaatcacaatttgtgtgggctattctctttatcttgctttttatgattgtggttggttatctggtgcgaacgtctgataagcgtgagaaaaagctaatggatttccatgaccaatcaaaatcagaatctaacaaacgtgaagagtggctcaaaggtcacttagataaaaatacagaacagttacaggacatttctcagaccattggtgttgtccaaaaggagatgtcttatatgagtgaccgcattggtcgtctagaaaaagaggagaaa

SEQ ID NO: 1392 - protein, 100 aa, Streptococcus agalactiae
MTVEQAERIAQSQFVWAILFILLFMIVVGYLVRTSDKREKKLMDFHDQSKSESNKREEWLKGHLDKNTEQLQDISQTIGVVQKEMSYMSDRIGRLEKEEK

SEQ ID NO: 1393 - DNA, 210 bp, Streptococcus agalactiae
atgaagatcttattgctattggttagaatttttttacaggaagaagggatagatatgatgattaaattatttgcgattgacttatattatggacgtatggcttggtcaagttttgttaaaaagggattttcagagtttattaataacaaaacaaaagagcaacttgcaattatgtgcgatgaagaattacttgctgaaattttagcaagt

SEQ ID NO: 1394 - protein, 70 aa, Streptococcus agalactiae
MKILLLLVRIFLQEEGIDMMIKLFAIDLYYGRMAWSSFVKKGFSEFINNKTKEQLAIMCDEELLAEILAS

SEQ ID NO: 1395 - DNA, 375 bp, Streptococcus agalactiae
gtgtcgtgcactggtcaatataacagtcaatataacaaaggagacgatatgtttacaattaacacaaaattcccacaagttcttgaggataaaagtattatgggagtgactgcaattgtgtcagttgatttaccacacgtgaaaggtaacttaacttttgatttaccacctgagtctgaaaataaatcttttgcagaaacgcttgaaaagtgtgagcagatattttacgacgaaaagtataaagataaagctcagtctgaaaaaatgactgaactaagtacatcaacatcaacaggcacacaaacacttatcaatctgataagtacgctttacgcaaaagaggttttaaaagatgaagatcttattgctattggt

SEQ ID NO: 1396 - protein, 125 aa, Streptococcus agalactiae
MSCTGQYNSQYNKGDDMFTINTKFPQVLEDKSIMGVTAIVSVDLPHVKGNLTFDLPPESENKSFAETLEKCEQIFYDEKYKDKAQSEKMTELSTSTSTGTQTLINLISTLYAKEVLKDEDLIAIG

SEQ ID NO: 1397 - DNA, 2004 bp, Streptococcus agalactiae
atgggaactgctacatatagtaggtcgtgggggaataacctgacacttgaaatattgtctgcttggaataagccaaatatcgcaagtaatacaagcacagtcaatgtacaagtttttttaaaaatgtctagttatggctatatttcaataggtgaaactagacctttaaaaataacagttgatggtagagctgagaccatcaatgttaatccatcgataaattacggacagagaaaactattatttgctaaagattacattgttaatcataattcagatggaaataaaccactattcaatatttcagcatattatccaataaactttagcaattatggtgaagcgactgcaaatcagtctatctcgctacctaaaattaatagacttagtgtatcaagtgctattagtggtgtgctaggtaatgcagtaactatcacaatcaatagatattcaacgtcatttactcacaatttgaaatatgattttaagggtagtacaggtactatcgcaactggcgttggtactagctatttgtggactataccgccaacgtttgctaatttactgcctaatgaattaactggtacaggtaatctgattgttgagacgatggatggatcagcaaagattggtgagacaaaatatactttatcaataacaatacctaatacagctacttataagccaaaattgtcaagtatcactctatctgatacaaatactttaactagtagcattgttagtggaaacaattttgttaggattataagtaaagttaaagttgattttggctcagctattggaaacaacggttcaacaataacaagttataatgctgaaattgtcgggaaaagtaactcaattatcggtaatggtagcgtatttgataaattggacttttttggttcagcaacaatcagagcaacggtaactgatagcagaggtctaacatcagaaccagttgacacaaaaattaatgtcattgattattttttaccaattgttacaagtgcaaaagtagtcaggtctcagcaaaatcctgacattttacaagtcttgccatttgttaagattgcaccaattatagttggtggaatacaaaaaaaccaactcaaaatgtcggtatctgttgcaccatacaatactggtatctatgcagttgatagtggcgcagctacaaatacctggtcaacaatttcccaaatgtcaggcgcccctttaaatcttggcggcacttatgacaagtcaaaatcatggcttgttaagatttcggtgagtgataacctaatgtcagcaacaccaataatacaaccagttgcaagtgagtttgtacttgtaactaaagcaccttctggtgttgcatttgggaaaatttgggaacatggcattattgatgccaaaggcgatgtttatgttgacggtactatttattgtggcgataaggcgatacagcaaaaaccacttgctttaaataatggtggctcttttagacatgacgacaccgacctaaatagcttgcaagacacaggtttttattgtgtatttagaggtgctaatagaccggctggggcaggtcctgggtacgtaacagttgtaagacatgagacagcaaactatgcttatcaacaattttacgaccgcacaaataaaactatatttacgcgcttgctggaaaacggtgtttggagcggttggagtgagtatgttaaaaaagatagcttacaaacgactggctggataacaattggcaacggttttaaatataagcggaaaggtgatgacatagacttgatgtataattttgcttctaatggattacagagatggtctgttggtaatatgccatctggtttaatacctcaagagttgatgtttgcgataactggatggacacttgctccagacaaatcaatccacttacaaatcaatgcatcgggattgattgagtgtataaatcctggcgcttactcaaatacttacagaggtgtcgtgcactggtcaata

SEQ ID NO: 1398 - protein, 668 aa, Streptococcus agalactiae
MGTATYSRSWGNNLTLEILSAWNKPNIASNTSTVNVQVFLKMSSYGYISIGETRPLKITVDGRAETINVNPSINYGQRKLLFAKDYIVNHNSDGNKPLFNISAYYPINFSNYGEATANQSISLPKINRLSVSSAISGVLGNAVTITINRYSTSFTHNLKYDFKGSTGTIATGVGTSYLWTIPPTFANLLPNELTGTGNLIVETMDGSAKIGETKYTLSITIPNTATYKPKLSSITLSDTNTLTSSIVSGNNFVRIISKVKVDFGSAIGNNGSTITSYNAEIVGKSNSIIGNGSVFDKLDFFGSATIRATVTDSRGLTSEPVDTKINVIDYFLPIVTSAKVVRSQQNPDILQVLPFVKIAPIIVGGIQKNQLKMSVSVAPYNTGIYAVDSGAATNTWSTISQMSGAPLNLGGTYDKSKSWLVKISVSDNLMSATPIIQPVASEFVLVTKAPSGVAFGKIWEHGIIDAKGDVYVDGTIYCGDKAIQQKPLALNNGGSFRHDDTDLNSLQDTGFYCVFRGANRPAGAGPGYVTVVRHETANYAYQQFYDRTNKTIFTRLLENGVWSGWSEYVKKDSLQTTGWITIGNGFKYKRKGDDIDLMYNFASNGLQRWSVGNMPSGLIPQELMFAITGWTLAPDKSIHLQINASGLIECINPGAYSNTYRGVVHWSI

SEQ ID NO: 1399 - DNA, 4122 bp, Streptococcus agalactiae
atgttaacaattcatggaccggatttaaaacctgtcctttttttggataatgataaacaaggagctttgaactactttaaccacaagtggtatagaaagcaaaagactggctcgtctgtactagaattctccgtttacaaaaaagatttgcttggcgatagcccacttagtcataaatatcacgtactaaacgatcaagcatttgtctcttttgtgcacaaaggtaaagtacaattgttaaacatcatgaaaattgatgaagatgaaaaacaaattgattgttattgcgaaaaccttaatttagagttgctaaacgagtattgtaacgcatataaagcaactaaagcgatgtcgtttgaagagtatctcgtgcagtttgacattttgagctggggggctttgacagttggcacaaacgaagttaaggacaaaaaacttacattggaatggactagtcaagaaactaagttagctcgtcttttgtcaattgctaataatttcgatgcagaaattgagtttgagacaaagcttaatttcaatcacacgtttaagcaactcatcattaatatttacaaagaatacgaggagggcaaatcttatggtgtagatcgtgataagaccgacgtgatattacgctatcaaaaaaatatttctgggataaggaaaacagttgacaagcgccagatttataacgctattagaccatacggcaaaaaaactgttagaggcgagcgcgttatttctaatcctgtaactcgtaaagtcactaaaacggttggttcaaatcgcacgtacttaggcggagaccttaaatattatggtcatacaatcaaaaaagctaacgtacaagctattattaactacgcagtgcaatataatattttgccaagtggaatcatcacgcaactttatttagagagtttttggggtgattcgacagttggtaaacgtgacaacaactgggcaggtatgagcggtggagcacagacgcgtccaagtggagtaaaagtcactactgggatggctcgtcctgcaaacgagggtggaacatacatgcactatgcaagtgtagatgactttttaaaagattacacttatcttttagcaaaacaagggatttataatgtcgtcggcaaaaagaatatagcagactatacaaaagggctttttagagctggtggagctaaatatgactatgcagcagcaggatatcaaagctacacaaatttgatgactaatatccgaaatggtatcaataaagtaactggaaatatcctcaatacgattgataagctgtggcagactcctgtaaagcccataaccgccgtaaacgtcgctagaagagccactaaaacaatacaagctattaatgaggctactaagctgaaagggcgcagaatcggttctggacagtgttatgcgctatctgggtggtatgcaaaaaaattggatggcgcttggattgacagctcgattggtggtattagaggtcgtatcggaggcggtatggctgctgccttaatcggcactgattataactggggtgcatatgggtggaaggtagataaatcacctaacgctggaaacttaaaagctggtggtatttataatgtacgagcaaatcgaggcgctcctttttataccacaggctgggggcatacaggtattatcaagagtgtctccaagaccagagttactgttttggagcaaaactttgttggtcgcatgtatgttgtcgaaaactcatatgacattaactctttcgcatctggattacaaacagtatgttaccctcgtgaaatagcgcaaggtatgtctgttaacggcgcaacaacacagcaagtaagtggtgggacacagatatcgtacgaagaagtcgtacaagaggctcagacagaatcatacgaagaagaacaaatcatctatattgacaactctatctacaaagagtggaaagatgaaaacggtaaagtagagtactatctcaaaaatggatttttgtacgcaccactttcaagagaccgctatccatctgttttaaccggtaatgagacacgagacaactggatacgaaaagacatggaagtcgagactgatagtcaagaagtcttgatgtcaacaggtctaaaagacttaaaagcacacgcatatccagcaattacatacgaagttgatggctatgttgacttagaacttggtgatgttgtgcggatacaggacgacggatacgagccaccgctgattttgacagcacgagtagttgagcaagaaatatccataacaaatcccagctctaacaaaactaaattcagcaattttgtcgaaaaagaaagtcagttagcttctgatttaatcagtgatatgttgcgtctatacgatgagtcaattccatacgaaatcaaactagctacttcgaatggtgtcgcttttaaaaatggcactggtgaatctgtcctaactcctagcttgcaaaagaacgggaaagactatgaagcagtttatttttataaaaatggtgactcgctaattgatatcggaccatcgctaatcgttaaagcaagcgactttaaccacgttttaaatataacagttgaggcatatttaaatgaggaacttgtagcaagcacacaaatatcatttacagacactgaagacggtgctgacgggaaagatggcgcaccgggaccacaaggacctcccggtgtaaacggactgcaaggtccaaaaggtgaccaaggcattcaaggtccagctggtgctgacggtaaagcgacttatacgcatatagcatacgcccttgacgagaacggatcaactggctttagtgtatctgataacgttggcaaaacgtacataggtatgtatgttgatgataatatcatagactcaaacgaccctaaaaagtacaagtggaatttgataaaaggcgcagatggtgctagaggtatccaaggtccagctggtgctgacggtaagacaccttactggcatgtagcgtatgcaaacagctcagatgggacagttgactttagcgtgtctgatagtgcaaacaagcgctacattgggcaatatactgactacgatgcaatagattcaagtgaccctaaaaaataccgctggactgacatggttgggacggttgtcgtcgggacaaacaatctgattgatggtacaaaatcattttttgggactgattggtttacttctgcaacgctagaagacgagaacctctctaattgtcctttcacgcttaaaaaatggattagtgggcaaaaagtgtcgcatgcaaaagatatcatggtcgagcaaggtgtaacgtacacttttagtgcttatgttaaacgtgaggtagctgggaatttatatttttatctttatgatatagcagatggttttattactagcgataccccacgagagacaattataaaaaacgttgactctagtctcagacgttttgaaatcacttttacaccaactaagacaggtaggattagaccaaggttcgcgatggtgtcatcggagcaaggtagtttcagctctggtgggtttatgctcgttaggggaaataaaacaggcgactggcaggaatcagaagctgataaagcaagtaatcttgattcaaaagctgatcaagaattaacccaagcacaaattctagctcttgaagaaagaactgctatagcaagagaaaatgcaattgctgaggctatgcagaatacactcagtgaagttgaaactaagtggaagctttggtatgacttaaatacgatagacgaaaagcaaaaagttgcaaacgacatcgctcaattgtttgatcgtacaactgagtttaaacaactattaggtgaggcaagtgcaagatttagctttatcaacaatgaaacgttgattggtgaagagggcgttgctatcggtgacaaaggcggaaaagcaaagttatttctatcaaatgacagcatttcatttgtgacaaatggtgttgctcagatgacattgacaggtgataccttaacaataaaaaatggactgtttacagagcgtatacaaattggaaattttgttgaagaagtctatgacagaaatccattatttaatgttatcagagcaattagaaatagt

SEQ ID NO: 1400 - protein, 1374 aa, Streptococcus agalactiae
MLTIHGPDLKPVLFLDNDKQGALNYFNHKWYRKQKTGSSVLEFSVYKKDLLGDSPLSHKYHVLNDQAFVSFVHKGKVQLLNIMKIDEDEKQIDCYCENLNLELLNEYCNAYKATKAMSFEEYLVQFDILSWGALTVGTNEVKDKKLTLEWTSQETKLARLLSIANNFDAEIEFETKLNFNHTFKQLIINIYKEYEEGKSYGVDRDKTDVILRYQKNISGIRKTVDKRQIYNAIRPYGKKTVRGERVISNPVTRKVTKTVGSNRTYLGGDLKYYGHTIKKANVQAIINYAVQYNILPSGIITQLYLESFWGDSTVGKRDNNWAGMSGGAQTRPSGVKVTTGMARPANEGGTYMHYASVDDFLKDYTYLLAKQGIYNVVGKKNIADYTKGLFRAGGAKYDYAAAGYQSYTNLMTNIRNGINKVTGNILNTIDKLWQTPVKPITAVNVARRATKTIQAINEATKLKGRRIGSGQCYALSGWYAKKLDGAWIDSSIGGIRGRIGGGMAAALIGTDYNWGAYGWKVDKSPNAGNLKAGGIYNVRANRGAPFYTTGWGHTGIIKSVSKTRVTVLEQNFVGRMYVVENSYDINSFASGLQTVCYPREIAQGMSVNGATTQQVSGGTQISYEEVVQEAQTESYEEEQIIYIDNSIYKEWKDENGKVEYYLKNGFLYAPLSRDRYPSVLTGNETRDNWIRKDMEVETDSQEVLMSTGLKDLKAHAYPAITYEVDGYVDLELGDVVRIQDDGYEPPLILTARVVEQEISITNPSSNKTKFSNFVEKESQLASDLISDMLRLYDESIPYEIKLATSNGVAFKNGTGESVLTPSLQKNGKDYEAVYFYKNGDSLIDIGPSLIVKASDFNHVLNITVEAYLNEELVASTQISFTDTEDGADGKDGAPGPQGPPGVNGLQGPKGDQGIQGPAGADGKATYTHIAYALDENGSTGFSVSDNVGKTYIGMYVDDNIIDSNDPKKYKWNLIKGADGARGIQGPAGADGKTPYWHVAYANSSDGTVDFSVSDSANKRYIGQYTDYDAIDSSDPKKYRWTDMVGTVVVGTNNLIDGTKSFFGTDWFTSATLEDENLSNCPFTLKKWISGQKVSHAKDIMVEQGVTYTFSAYVKREVAGNLYFYLYDIADGFITSDTPRETIIKNVDSSLRRFEITFTPTKTGRIRPRFAMVSSEQGSFSSGGFMLVRGNKTGDWQESEADKASNLDSKADQELTQAQILALEERTAIARENAIAEAMQNTLSEVETKWKLWYDLNTIDEKQKVANDIAQLFDRTTEFKQLLGEASARFSFINNETLIGEEGVAIGDKGGKAKLFLSNDSISFVTNGVAQMTLTGDTLTIKNGLFTERIQIGNFVEEVYDRNPLFNVIRAIRNS

SEQ ID NO: 1401 - DNA, 1044 bp, Streptococcus pyogenes
atgttgacatcaaagcaccataatctcaacaaactagtctggcgctacgggctaacctcagccgctgccgtccttctagcctttggaggcggggcaagcagcgttaaggctgaggtttcttctacgactatgacgtcgagtcaaagagagtcaaaaataaaagagatcgaagaaagtcttaaaaaatatccagaagtgtccaatgagaaattttgggaaagaaagtggtatggaacctattttaaagaagaagattttcaaaaggagctaaaagattttactgagaagaggcttaaggagattctagatttaattggtaaatctggaatcaagggagaccgtggtgagactggtcctgctggcccagccggaccacaaggtaaaactggtgagaggggcgcccaaggtcctaaaggtgaccgcggtgagcaaggaatccaaggtaaagctggtgaaaaaggtgagcgcggtgaaaaaggcgacaaaggtgaaaccggtgaacgcggtgaaaaaggcgaagctggaatccaaggcccacaaggtgaagctggtaaagatggcgctccaggtaaagatggagctccaggcgaaaagggtgaaaaaggtgaccgcggtgaaaccggagctcagggtccagtaggcccacaaggtgaaaaaggtgaaacgggcgcccaaggcccagcaggcccacaaggtgaggcaggcaaaccaggtgagcaaggcccagcaggcccacaaggtgaagcaggccaaccaggcgaaaaagctccagaaaagagcccagaaggcgaagcaggccaaccaggcgaaaaagctccagaaaagagcaaagaggtaactccagctgcagaaaaacctgctgacaaagaagctaaccaaacgccagaacgccgcaatggcaatatggctaagacacctgtagccaacaaccacagacgtctaccagcaactggtgagcaagccaacccattctttacagcagcagcagtagcagtgatgacaacagctggtgtcctagccgttacaaaacgcaaagaaaacaac

SEQ ID NO: 1402 - protein, 348 aa, Streptococcus pyogenes
MLTSKHHNLNKLVWRYGLTSAAAVLLAFGGGASSVKAEVSSTTMTSSQRESKIKEIEESLKKYPEVSNEKFWERKWYGTYFKEEDFQKELKDFTEKRLKEILDLIGKSGIKGDRGETGPAGPAGPQGKTGERGAQGPKGDRGEQGIQGKAGEKGERGEKGDKGETGERGEKGEAGIQGPQGEAGKDGAPGKDGAPGEKGEKGDRGETGAQGPVGPQGEKGETGAQGPAGPQGEAGKPGEQGPAGPQGEAGQPGEKAPEKSPEGEAGQPGEKAPEKSKEVTPAAEKPADKEANQTPERRNGNMAKTPVANNHRRLPATGEQANPFFTAAAVAVMTTAGVLAVTKRKENN

SEQ ID NO: 1403 - DNA, 1518 bp, Streptococcus agalactiae
gtggtagattacaaaactgtaagatgtcattttggcgatgtcgaattgactaagtggattactattacagacggctttactgtctttagtggcgcagactacgacccggagctaaaagaaattggtggcaaagatggtagcatttttattggaacgaaaactaagcataaagtaataaaagtcccattctgggtaaaatacaatacaatagaagattacgatgccctacaattggctttatcttctaaaaagcctaagatgttgatgtttagccacatacctggacgctattatttagctgtccaggttggggatttgaactttaaagaaatcaagatgaacggctttggtgagataacgtttatagttgcagatgcatatgctcattcaacgtcatacagacgcattaaagactatactcaagacggaaataaaatgaccttcaagattaaaaataacgggacagcccctgcgtttccgatatttagaattaagcacttgggtgaaaatggctatattggaattacaaatgagactggagcatttgcggttggttctcctgaagaagaagacgggactatcgttcatcgtaacgaaaccctttttgattactcaaaagcgattgcacaagctttagaaggtgcgcccaacgtcgcaaaactcaactatatgccaccaacatttgactcggaattaaagcgcatgcgccttgataatattttaggctctggcaaaggtggagagtatgtagctattggtgctagaggaactacaccgggttacggcgagcatgttggaacacggacatttattattaatcctgactcaaacggcgaatatactctcaatgaacacttgtggtggaaacagatttttattgctaccgcgcaggatcaaaaaggatttttaaagctttgcgtgacaggtgaaaatgatgaattcctctatgggattgaaacttacaaacgcaaaaacggctttgaaacagagtataacttttttgctcttgatgatgatggcgttggatggcgcttttataagcagtttgaattccaagcggatagaaattatcacaatcctttttcgatgaatagaagcagggcggttgagatttttagagaagaagataagtttcgtatttactttaacggtgcgcatcatcatgtaactgttccgtcccttaaaggaaaaaaatctcgcaagatacatcttgcgatggggacatgcagtgatagctctaaatatatcaactacaacctgtttgaaaaagtcaattttgaaaaaatgggagtgtctcattacaacaatattgtcaataagtaccaaccaggggatgaggttatcattaactttgaaaatgacactgtaagtacaaaagatatcgattcaatacaagatgtggtgttaggttctaagatgatttcgattccgccaggagagtcagaactagtcgtacacttgtctagctgggtcgcagcgctacctgatatatcaattgattttgaagagaggtacaaa

SEQ ID NO: 1404 - protein, 506 aa, Streptococcus agalactiae
MVDYKTVRCHFGDVELTKWITITDGFTVFSGADYDPELKEIGGKDGSIFIGTKTKHKVIKVPFWVKYNTIEDYDALQLALSSKKPKMLMFSHIPGRYYLAVQVGDLNFKEIKMNGFGEITFIVADAYAHSTSYRRIKDYTQDGNKMTFKIKNNGTAPAFPIFRIKHLGENGYIGITNETGAFAVGSPEEEDGTIVHRNETLFDYSKAIAQALEGAPNVAKLNYMPPTFDSELKRMRLDNILGSGKGGEYVAIGARGTTPGYGEHVGTRTFIINPDSNGEYTLNEHLWWKQIFIATAQDQKGFLKLCVTGENDEFLYGIETYKRKNGFETEYNFFALDDDGVGWRFYKQFEFQADRNYHNPFSMNRSRAVEIFREEDKFRIYFNGAHHHVTVPSLKGKKSRKIHLAMGTCSDSSKYINYNLFEKVNFEKMGVSHYNNIVNKYQPGDEVIINFENDTVSTKDIDSIQDVVLGSKMISIPPGESELVVHLSSWVAALPDISIDFEERYK

SEQ ID NO: 1405 - DNA, 2010 bp, Streptococcus agalactiae
atggctactaacttaggacaagcttacgtgcagattatgccgtcggctaaaggaatctctggatctataagtaagacgttagacccagaagcgtcaagcgcaggtagctctgcaggtagcctattaggaggtaaattgattgggatattggggagtgtcattgcagctgctaaaataggcgaaatggtcacaaaagcaatatcgtcatcaatttcagaaggagcggcgcttcagcagtcacttggaggagtagaaacccttttcaaaagcaacgcaaatttagtaaaaaaatatgcagacgaagcctataaaacaactggcttatcagcgaatgcgtatatggaaagtgtcaccggctttagtgctagtttgcttcagtcgctcggaggggatacggccaaagcggcaaaagtcgcaaatatggctatgatagacatggctgataactctaacaagatgggtacatctatggaaagtattcagtacgcttatcaaggttttgcgaagcaaaattacacgatgttggacaatttgaaactcgggtatggcggtacgcaagaagaaatgaaacgtttgctttcagatgcccaaaagctaactggaaaaaaatatgatatttcaaatctctcagatgtatatgaagctattcacgctattcaagggaaaatagggataaccggaacaaccgctaaagaggcagcaacaacgttcacaggttcttttgaagctatgaaagcagcttcgaaaaacttgttggggaaaatggctttaggtgaggatatcaaaccatcgctaaaagcgctgtttgatacaacaagcaactttgtattgaataactttataccaatgctaacaaatgtttttaaaggatttggttcggttatttcgttaactttctcagagctaatacctaaaattgttggttttatgcaaacaagcggtccgtcgctaatgcaatctggcattagctttattattagctttgttaacggatttctaacagcctatcctgcatttttaacagtggcaggaaaaatatttacagatttcgtatcttttgtaatgcaaagtatacctggactcttgcaagctggggctactctcgtcctgaatctaatagatggaatattagctaacttacctcaaatagcaacttcggcagtatctgtgatatcaagctttatatcaatgttgcaagcaaattacccggcaattttaaaaaaaggttttgaaattttaagttacttagtgcaagggattatagcaagattacctgatatcgttattactgttggaaaactcatagcgattttagcaggagcgatagcaagtaatctacctaaagtgctagctcttggagttcagttactcatcacttttgttaaagggattctgagtgtcataggtaaaataaacgaaacagctaacaatattggtgaaaagcttatcaatgcaatcaaatcgattgatttgttgagtgcaggtagagctataatgcgaggtttcttacgaggtttagaggatgtttggggagatattcaaaattttgtcggagatattgcagggtggattaaagatcacaaaggaccaataagttacgatagacgtttacttattccagccggcaacgcaatcatgcaaggtctgcatcaaggacttgttgataaatttaaaccagttaaaaacttagttaacggaatggccgaagaaattcagtcttcattcggaaatcctcaactagcttttgatatggatactaacgtaaacaatggctttgagcgaataggtactttaaataaaaatttatctagtcaagtgactagtacagataattacactagcggcaatgctgctttgttatctgccatcaaaaatttagccgatagacctattgttgtgtctgcgcaatttgataaaaatgaatttgccagagtcgttgctaagccaatagcagcgagacaaaaatttgacgaacagacagaagaaagactgagaggtataaacaggtgg

SEQ ID NO: 1406 - protein, 670 aa, Streptococcus agalactiae
MATNLGQAYVQIMPSAKGISGSISKTLDPEASSAGSSAGSLLGGKLIGILGSVIAAAKIGEMVTKAISSSISEGAALQQSLGGVETLFKSNANLVKKYADEAYKTTGLSANAYMESVTGFSASLLQSLGGDTAKAAKVANMAMIDMADNSNKMGTSMESIQYAYQGFAKQNYTMLDNLKLGYGGTQEEMKRLLSDAQKLTGKKYDISNLSDVYEAIHAIQGKIGITGTTAKEAATTFTGSFEAMKAASKNLLGKMALGEDIKPSLKALFDTTSNFVLNNFIPMLTNVFKGFGSVISLTFSELIPKIVGFMQTSGPSLMQSGISFIISFVNGFLTAYPAFLTVAGKIFTDFVSFVMQSIPGLLQAGATLVLNLIDGILANLPQIATSAVSVISSFISMLQANYPAILKKGFEILSYLVQGIIARLPDIVITVGKLIAILAGAIASNLPKVLALGVQLLITFVKGILSVIGKINETANNIGEKLINAIKSIDLLSAGRAIMRGFLRGLEDVWGDIQNFVGDIAGWIKDHKGPISYDRRLLIPAGNAIMQGLHQGLVDKFKPVKNLVNGMAEEIQSSFGNPQLAFDMDTNVNNGFERIGTLNKNLSSQVTSTDNYTSGNAALLSAIKNLADRPIVVSAQFDKNEFARVVAKPIAARQKFDEQTEERLRGINRW

SEQ ID NO: 1407 - DNA, 2355 bp, Streptococcus pyogenes
atggcaacagaacttggtcaagcgtatgtgcaaattatgccatccgctcgtggaataagtggagcaatctcgaagcaacttgatcccgaagcaaggtcggctggattgagcgctggttcgctcattggtggtaatctcgttaaaatgattggtggtgccattgcagctgctggaatcggtaagatgatttcgtctgccttgtccgctggtgctgatttgcagcaatcttttggtggtattgacacattgtataagggcgctgagactgctgtcaaagggtttgctaaagaggcatacaaagctggaatatcagcaaatacttatgcagagcaagcagtttcaatgggtgcatctctaaagcaatcacttggaggtgatgctgtcgcggctgccaaggctgctaacatggcaatcatggatatggccgacaactcggctaagatgggtactgatatcacatcaatccaaatggcttaccagggatttgctaagcaaaactatacaatgcttgataacctaagacttgggtacggcggcacaaaagaagagatgaagcgtcttttatcagacgctgaaaagttacctgccgctatgggcaagaagtttgatttgagtaattatgctgatgtggttgaggctatacacttggtacaggataacatgggtatcgctggagttgctgctgaagaagcaaaaactacattttcaggctcactagctgctatgaagtcctcttttacaaatgtaatggcaggtttatcactaggagatgatatcagaccggctttacgaggactggctgagacaacttctaatttcttatttggtaactttattccgatggtggcaaatatctttaaaggattaccatcggcaattggtacttttattggagccgcagctcctattatcacaagtcaattccaaggtctaatgagtagccttggaattagtattgatttaagtcctattactgctaaatttgcacagattggccaaaatttacaacctgtttttaacggtttaaaaacggcttttagtcagttgccatcattttttactagcattggtagtgcagttgcaccagtaatagacactattattagcggattagccagattagatttcagtggttttgaggctttaatttcagcaattttaccagccctacaggcaggtttttctaacttcgctgcgattgttggaccagctatctcaggagttgttgactcgtttgttggcatgtggaatgcagcacaacctttaatttcgatactaagtgatgccttgatgccagtatttcaaattttagggtctttcttaggtggtgttgtaaaaggtgcgcttatgggagttagctttgcctttgatgcagttaaagtggctatacaactagtcacaccaattattgacttgctggttcaaggtcttaattttgtacaacctgttctcagtgtcattgcagaatggattggagttgctatcggtatgtttggtaatttaggcacagccggccaaggcttgagcgcttttattaagagcgcttggactaacattcagactgcaatttcaactgctggaacaatcatatctacggttattgactacataaaattagcgttcagtggtgccggttctgcagttggcgtcctaaaaaacattttctcacttgcttggatggcaatgggagacgcaataaatgtggctaagggtatcataagctctgttataaatggcataaaatcagccttcagtagttttagtagcttagtgtctagtgttggttcagcagtaaatggagttatcgattcaatctcaagcacaattagaggtttggcaaacattgatatttctggagctggtgccgcaattatgaatggtttcttaaacggtttgaaatcagcttggggagccgtcaaaagttttgtgagcggtatcgccaactggattgcagaacataaaggacctatctcttatgatagagttctactaaaacctgctggtaaagcaattatgggtggacttaatacaagcttgattgacggctttaaagaggttaaatcaaatgtctctggcatggctgacgaccttgcaagcaccatgacaggtaaaagtctatctctcggtatcgatgctaaaccaagcgtcacagctgatgacttactatcaagcaatattagtactaaaactacagtcggttctgctacaagtgacttgtcattattctttgttaaggtgcttgctctgttgcaagatatccttgataaaaatacggatgtctatctagacaaagaaaaagtcagcgctattttatacgaagaatttgccaaaattatggctagagaggggattgta

SEQ ID NO: 1408 - protein, 785 aa, Streptococcus pyogenes
MATELGQAYVQIMPSARGISGAISKQLDPEARSAGLSAGSLIGGNLVKMIGGAIAAAGIGKMISSALSAGADLQQSFGGIDTLYKGAETAVKGFAKEAYKAGISANTYAEQAVSMGASLKQSLGGDAVAAAKAANMAIMDMADNSAKMGTDITSIQMAYQGFAKQNYTMLDNLRLGYGGTKEEMKRLLSDAEKLPAAMGKKFDLSNYADVVEAIHLVQDNMGIAGVAAEEAKTTFSGSLAAMKSSFTNVMAGLSLGDDIRPALRGLAETTSNFLFGNFIPMVANIFKGLPSAIGTFIGAAAPIITSQFQGLMSSLGISIDLSPITAKFAQIGQNLQPVFNGLKTAFSQLPSFFTSIGSAVAPVIDTIISGLARLDFSGFEALISAILPALQAGFSNFAAIVGPAISGVVDSFVGMWNAAQPLISILSDALMPVFQILGSFLGGVVKGALMGVSFAFDAVKVAIQLVTPIIDLLVQGLNFVQPVLSVIAEWIGVAIGMFGNLGTAGQGLSAFIKSAWTNIQTAISTAGTIISTVIDYIKLAFSGAGSAVGVLKNIFSLAWMAMGDAINVAKGIISSVINGIKSAFSSFSSLVSSVGSAVNGVIDSISSTIRGLANIDISGAGAAIMNGFLNGLKSAWGAVKSFVSGIANWIAEHKGPISYDRVLLKPAGKAIMGGLNTSLIDGFKEVKSNVSGMADDLASTMTGKSLSLGIDAKPSVTADDLLSSNISTKTTVGSATSDLSLFFVKVLALLQDILDKNTDVYLDKEKVSAILYEEFAKIMAREGIV

SEQ ID NO: 1409 - DNA, 369 bp, Streptococcus agalactiae
atgctaaaaatggacgaagatgctcttgtctgtgatttagctgaaacttatcacatatatgattacaaacagctaccacctctaaaagtagctgttttttctttaggcttgagagaagaatcaagaatcaatcgagttatttcaggtaatagagtctcatttgaaagacgaatactagctgggatgtttgacagacttggaatgctcatttggatgaaaacgacagatggccaaaaaggtaaaaatagaccagaaatggtttcaacaatgtttgataatcaacagaaagatagtgaagttgtttcattcggcagtggcaaggatttcgaagaaactagaaataacattcttgggtttggaggtgatagc

SEQ ID NO: 1410 - protein, 123 aa, Streptococcus agalactiae
MLKMDEDALVCDLAETYHIYDYKQLPPLKVAVFSLGLREESRINRVISGNRVSFERRILAGMFDRLGMLIWMKTTDGQKGKNRPEMVSTMFDNQQKDSEVVSFGSGKDFEETRNNILGFGGDS

SEQ ID NO: 1411 - DNA, 369 bp, Streptococcus pyogenes
atgatagcaaaagatgatgatgcattgacttgtgatttagctgaaacatacggcatatatgattacagacagctacctgcttatcaggtggctgtttttgctgtcggtttgagatctaactctaggataaaaatggcattatctggagagactgaggctttggatactgttttgttagctggtatttatgataatactaatttgctgttttggtctaaaactaaggatggtcaatctggtcaaaacaaacctaaatccgtggtggaagctatatctggatctaaatcacaaaaagctaatgatgtcatttcttttgtgtctggcgaggattttgaaaatgcacgtaaacaattactaggaggtgatggc

SEQ ID NO: 1412 - protein, 123 aa, Streptococcus pyogenes
MIAKDDDALTCDLAETYGIYDYRQLPAYQVAVFAVGLRSNSRIKMALSGETEALDTVLLAGIYDNTNLLFWSKTKDGQSGQNKPKSVVEAISGSKSQKANDVISFVSGEDFENARKQLLGGDG

SEQ ID NO: 1413 - DNA, 243 bp, Streptococcus agalactiae
atgaaaacatcgtcaggttttgaatataagattgaagaatcgcgtttaaaaaattatgaattagtagaggcactagcggatttagaaagcaatccgctgtctttaccgaaagttctacgtttgttgctaggtgaccaagtagaaagtttaaaaaatcatttacgcgctagcgacgggactgtttcgacggaggcgttgatggaagaagtgaaagaaatttttgaaagtggtcaattaaaaaaa

SEQ ID NO: 1414 - protein, 81 aa, Streptococcus agalactiae
MKTSSGFEYKIEESRLKNYELVEALADLESNPLSLPKVLRLLLGDQVESLKNHLRASDGTVSTEALMEEVKEIFESGQLKK

SEQ ID NO: 1415 - DNA, 261 bp, Streptococcus pyogenes
atggaaatcttaaaaggaaaaacaacatcaggatttgaatacgaaattcctaaaaaacgattaaaaaactttgaacttgttgaagctattgcagaagaggaaactgatccaacagcggtagttaaaatcgttaatttgttacttggtgatgctgctaagtctctaaaagaacatgtacgagatgcagaaggtatcgtagacgttgaagctatcggagtagaaatcaaagaaatttttgaaagtcaaaaagatttaaaaaac

SEQ ID NO: 1416 - protein, 87 aa, Streptococcus pyogenes
MEILKGKTTSGFEYEIPKKRLKNFELVEAIAEEETDPTAVVKIVNLLLGDAAKSLKEHVRDAEGIVDVEAIGVEIKEIFESQKDLKN

SEQ ID NO: 1417 - DNA, 555 bp, Streptococcus agalactiae
atggtagcaaattcatcaaacgttactacggctaaacctaaaattggtggtgctatttatactgcgccgctaggaacagaattacccaaagacacagcatcagagttaaatgaagcttttaagtcattagggtacatttccgaagacggcttatcaaacgaagataaacgagaatcagaagagatccaagcgtggggtggcgatgttgtagaatctgcccaaaaaagtaaagcagataaatttacatatacattgattgaagcattgaatattgaagtactcaaagaaatctatggcaaagataatgtaactggagaccttaaaaccgggattactgttaaatcaaattcaaaaccactagaggaacattgtttggttatcgagatgattttgaaaaacaatacagttaaacgtattgtaataccaaaagggaaagtatccgaagttggtgaaattaagtatgtcgacaacgaagcggctggttatgagacaacgttacaagcgtttcctgatgcggaaggaaacactcactatgaatatataaaaggagctggt

SEQ ID NO: 1418 - protein, 185 aa, Streptococcus agalactiae
MVANSSNVTTAKPKIGGAIYTAPLGTELPKDTASELNEAFKSLGYISEDGLSNEDKRESEEIQAWGGDVVESAQKSKADKFTYTLIEALNIEVLKEIYGKDNVTGDLKTGITVKSNSKPLEEHCLVIEMILKNNTVKRIVIPKGKVSEVGEIKYVDNEAAGYETTLQAFPDAEGNTHYEYIKGAG

SEQ ID NO: 1419 - DNA, 594 bp, Streptococcus pyogenes
ttgatgaataagaatgatactaaaaatgtaacatctgcaaagcccaagaccggtggggcgatttattcggcaccgcttggtactgaattgcccaaggatgcaaaatcagaattaaatactaaatttaagaatttgggttatgtatccgaggatggtgtggtcaatgaagatacacgttcatccgaaaatattaaagcgtggggtggagatattgtcggggctgtacagacagaaaaagaggataaatttacttataagctgattgagtcactaaatgtagaagtcttaaaagaagtttatggcgctgtcaatgttactggagatttaagtgggggaatccagattaaatcaaattcaaaagagttagaagctcacgtaattgttgttgacatgatcatgaatggcggcattcttaaacgaattgtcttaccaaatgcaaaagtcgatgaggtaggtgaaattaagtatgttgacggcgaagtcgttggttatgaaacaacactaaaatgtttcccggacaaggatggtgatacacaccgtgagtatattgtaaaacctggagaagctaataaaaaagaaaacagctttgaaatg

SEQ ID NO: 1420 - protein, 198 aa, Streptococcus pyogenes
LMNKNDTKNVTSAKPKTGGAIYSAPLGTELPKDAKSELNTKFKNLGYVSEDGVVNEDTRSSENIKAWGGDIVGAVQTEKEDKFTYKLIESLNVEVLKEVYGAVNVTGDLSGGIQIKSNSKELEAHVIVVDMIMNGGILKRIVLPNAKVDEVGEIKYVDGEVVGYETTLKCFPDKDGDTHREYIVKPGEANKKENSFEM

SEQ ID NO: 1421 - DNA, 234 bp, Streptococcus agalactiae
atgagtaagtttaaattcaagctcaataaagctggtgttgctgaattgatgaaatcatcagaaatgcagcaggtattaaccactaaggccacagccatcagagaacgttgtggcgatggttacgcccaagatatccatgtcgggaaaaatagggctaatgctatggtcagcgctaaaaccataaaggccaagaaagataactcaaaaaacaacacattgttgaaggcggtgcga

SEQ ID NO: 1422 - protein, 78 aa, Streptococcus agalactiae
MSKFKFKLNKAGVAELMKSSEMQQVLTTKATAIRERCGDGYAQDIHVGKNRANAMVSAKTIKAKKDNSKNNTLLKAVR

SEQ ID NO: 1423 - DNA, 234 bp, Streptococcus pyogenes
atgagtaagtttaaattcaagcttaatagagctggtgttgccgaattgatgaaatcatcagaaatgcagcaggtattaaccactaaggccacagccatcagagaacgttgtggtgatggttatgtccaagatatccatgttgggaaaaatagggctaatgctatggtcagtactaaaaccataaaggccaagaaagataactcaaaaaataacacactgttgaaggcggtgcga

SEQ ID NO: 1424 - protein, 78 aa, Streptococcus pyogenes
MSKFKFKLNRAGVAELMKSSEMQQVLTTKATAIRERCGDGYVQDIHVGKNRANAMVSTKTIKAKKDNSKNNTLLKAVR

SEQ ID NO: 1425 - DNA, 180 bp, Streptococcus agalactiae
ttgaccggaaaaaaagttgaatatatcttggcaattccaaaaggagataagcatgattgggaggataaagaggtttgcttttttgacaaaaagtggcgcactgtcggcctagctcttgaaggtattgaagagcttattccgcttgaatggaataagaaagttatggtggaaagatatgag

SEQ ID NO: 1426 - protein, 60 aa, Streptococcus agalactiae
MTGKKVEYILAIPKGDKHDWEDKEVCFFDKKWRTVGLALEGIEELIPLEWNKKVMVERYE

SEQ ID NO: 1427 - DNA, 327 bp, Streptococcus pyogenes
ttgaaagggataacagttgctttagccgataagtcgattagcggaaaagacccttttggaaatcctgtaacagttgattttgatatcaaaattgagaatgtgcttgttgcaccagcaactaccgaagatatcactaatcagttatctttgaccggaaaaaaggttgaatatgtcttggctataccaaaaggagacgaacacgattgggaaaataaggaagttagatttttcggcaaaaaatggcgcacagtaggaattccactagaaggtattgaagagcttataccactagactggaataagaaagttatggtggaaagatatgag

SEQ ID NO: 1428 - protein, 109 aa, Streptococcus agalactiae
LKGITVALADKSISGKDPFGNPVTVDFDIKIENVLVAPATTEDITNQLSLTGKKVEYVLAIPKGDEHDWENKEVRFFGKKWRTVGIPLEGIEELIPLDWNKKVMVERYE

SEQ ID NO: 1429 - DNA, 429 bp, Streptococcus agalactiae
atgacaaattttgcgacaacagatgacgtcattttattatggcgtcaattatccgttgacgaaatcaagcgtgctgaggctttgttagagactgtctctgacacgttgaggttagaagcaagtaaagtgggtaagaatctagatgaaatgattttggaaactccttactttgctactgtattgaaatcggtaactgtagatattgtagcgagaacgctgatgactgctacacaaggtgaaccgatgtcgcaagaaagtcaatcggcacttggctacacttggtctggaacttatttggttccaggaggtggtctttttattaaggatagtgagttgaagcgtctcggactaaaaaaacagcgatatggaggaattgagctttatggggaaattgaaaggaataacagttactttagtcgacaagacgat

SEQ ID NO: 1430 - protein, 143 aa, Streptococcus agalactiae
MTNFATTDDVILLWRQLSVDEIKRAEALLETVSDTLRLEASKVGKNLDEMILETPYFATVLKSVTVDIVARTLMTATQGEPMSQESQSALGYTWSGTYLVPGGGLFIKDSELKRLGLKKQRYGGIELYGEIERNNSYFSRQDD

SEQ ID NO: 1431 - DNA, 420 bp, Streptococcus pyogenes
gtgggcaatttcgcaacaacagatgacgtcattttgttatggcgtcccttatctgttgacgaattgaaacgtgcaaatgcactcttgaaagtcgtatcagatacattaagaatggaagctgacaaagttggcaaagacttagataaaacgatggttgataagccttattttgttaatgttattaaatcggttacggttgacattgtagcgagaacgctgatgacatctactcgaggcgaaccaatggcccaagagagccaatcagctttaggatacacatggtcaggcacttatttagttccaggcggcggtctttttattaaggacagtgagttgaagcgtcttggactaaaaaaacaacgatatggaggaattgaactttatggcgaaattgaaagggataacagttgctttagccga

SEQ ID NO: 1432 - protein, 140 aa, Streptococcus pyogenes
VGNFATTDDVILLWRPLSVDELKRANALLKVVSDTLRMEADKVGKDLDKTMVDKPYFVNVIKSVTVDIVARTLMTSTRGEPMAQESQSALGYTWSGTYLVPGGGLFIKDSELKRLGLKKQRYGGIELYGEIERDNSCFSR

SEQ ID NO: 1433 - DNA, 900 bp, Streptococcus agalactiae
atggcagaatcaattaaagcaggaacgttatttaaaccagaactagtaacagaaattatgagtaaagtgaaaggtcactctacgcttgcgaaattatctggtcaaacaccaatcccgttcaacggagtagaacaatttgttttcaacttggatggtaatgctcagattgttggtgaaggtgagcaaaaattagggaataccgcaaaggtcacttctaaaattattaaaccgctgaagtttgtttatcaggcacgtatgactgacgaatttaagtacgcctcagaagaaaaacgattgaatttcttaaaacattatgctgacggttttgctaaaaaaatggcggaggcttttgatattgcagctattcatggccttgaacctcgcacaatgacagatgcctcattcaaagctacaaactcatttgatggggtcgtgactggtaatgtcatcaaatacgaagcagataaaattgacgacaatattgatgcagctgttacaacgattgtagcaaatggaaatgatgtgacaggtatcgctttgtcaccacaggcaggacaagatatgtctaaacgaaaagataaatttgataatgtgatgtatcctgaatttcgattcgggcaacgtccaagcaacttctttaatatgactttagacatcaacaagacacttactatgaaaggtggcacagctaaagatgaccatgctattgtcggagatttccagaatatgttcaagtggggttatgctgaaaatatcccaatggaaatcattgagtatggagacccagatggctctggacgtgatctaaaggcttataatgaaatcctgctccgtacagaagcattcataggatggggaattttagatgagaaagcattctctcgcgttgaggtacaagga

SEQ ID NO: 1434 - protein, 300 aa, Streptococcus agalactiae
MAESIKAGTLFKPELVTEIMSKVKGHSTLAKLSGQTPIPFNGVEQFVFNLDGNAQIVGEGEQKLGNTAKVTSKIIKPLKFVYQARMTDEFKYASEEKRLNFLKHYADGFAKKMAEAFDIAAIHGLEPRTMTDASFKATNSFDGVVTGNVIKYEADKIDDNIDAAVTTIVANGNDVTGIALSPQAGQDMSKRKDKFDNVMYPEFRFGQRPSNFFNMTLDINKTLTMKGGTAKDDHAIVGDFQNMFKWGYAENIPMEIIEYGDPDGSGRDLKAYNEILLRTEAFIGWGILDEKAFSRVEVQG

SEQ ID NO: 1435 - DNA, 909 bp, Streptococcus pyogenes
atgggaacagaaacatcaaaagcgagcttatttgacaaacatttagtatcagatcttatcaataaagttaaggggcatagctcactagctaaactatctagccaaaaacctattccgtttaacggatctaaagaatttacgtttacattagattctgatattgatgtggttgctgaaaacggtaaaaaaacacacggtggcttatcgctagagcctgttactatcgtaccaatcaaggttgagtatggtgctcgtctttctgatgaatttttatatgcaacagaagaggaaaagattgatattttgaaagcttttaacgaagggtttgcgaaaaaactcgctcgtggtattgacctaatggcgatgcatggtatcaatccacgtacaaaaaaagcgtctgacgttatcggcacgaatcactttgatagtaaagtgacgcaagtggttaaatttacagagagcgaagacgctgatgcaaatatcgaagcagctgttaatctaattcaggggtctgaaggtgtagtgacagggcttgcgatggatacagagttttcaacagcactggcgaaagttaccaatggggagatggggcctaaaatgtaccctgaacttgcttggggagcgaatccagatagcatcaatggcttgaaatcgtccgtcaatactactgttggtgctggagctgatgaagcagaatccaaagatttagtaattattggcgattttgaaagcatgtttaagtggggttatgcaaaacaaattccaatggaaatcattaaatacggtgatcctgataattcggggaaagaccttaaagggtataaccaaatttacttacgtgctgaggcgtatatcggctggggtattttggacgctaagagctttgctcgtgtcactaaaggagaagta

SEQ ID NO: 1436 - protein, 303 aa, Streptococcus pyogenes
MGTETSKASLFDKHLVSDLINKVKGHSSLAKLSSQKPIPFNGSKEFTFTLDSDIDVVAENGKKTHGGLSLEPVTIVPIKVEYGARLSDEFLYATEEEKIDILKAFNEGFAKKLARGIDLMAMHGINPRTKKASDVIGTNHFDSKVTQVVKFTESEDADANIEAAVNLIQGSEGVVTGLAMDTEFSTALAKVTNGEMGPKMYPELAWGANPDSINGLKSSVNTTVGAGADEAESKDLVIIGDFESMFKWGYAKQIPMEIIKYGDPDNSGKDLKGYNQIYLRAEAYIGWGILDAKSFARVTKGEV

SEQ ID NO: 1437 - DNA, 588 bp, Streptococcus agalactiae
ttgttacacaacgaagccaaaaagaaagcaaagaaccagctgttaaaaaacgacatccggaagggtgtttttttactgctaaaaaatctaccgaactgccgggaaagcaggagaaaggacgttaatatgtcagaatttaaagttattgaaacacaagaagagttggacacgattgtgaaagctcgcattgctcgagaacgtgagaagtatcaagattacgaccaactgaaaactcgtgttgaagaactagaaaccgaaaacagcagcttacaaactgctttgaatgatgctaaatcaaacactgatagctatacagagaaaattaccactttggaaaatcaaatcgctggttatgaggcagcaaatttacggacaaaggtagcgttacagtatggcttaccaatcgatttagctaatcgtttgcaaggcgatgatgaagacgggctcaaggtggatgcagaacgcttagcatcttttatcaagccgtctcaaccacaaccgccaacaaagtcaaatgaaccgattattaccgaccaaaaagaagcaggttggattgaaatggcacgtaatttagttaacaaaggagaa

SEQ ID NO: 1438 - protein, 196 aa, Streptococcus agalactiae
MLHNEAKKKAKNQLLKNDIRKGVFLLLKNLPNCRESRRKDVNMSEFKVIETQEELDTIVKARIAREREKYQDYDQLKTRVEELETENSSLQTALNDAKSNTDSYTEKITTLENQIAGYEAANLRTKVALQYGLPIDLANRLQGDDEDGLKVDAERLASFIKPSQPQPPTKSNEPIITDQKEAGWIEMARNLVNKGE

SEQ ID NO: 1439 - DNA, 459 bp, Streptococcus pyogenes
atgtcagaatttaaagttattgaaacacaagaagagttggacacgattgtgaaagctcgcattgctcgagaacgtgagaaatatcaagattacgaccaactgaaaactcgtgttgaagaactagaaaccgaaaacagcagcttacaaactgctttgaatgatgctaaatcaaacactgatagctatacggaagagattagcaccctgaagaatcaaattgccgattatgagacggcaaatttacggacaaaggtagcgttacagtatggcttaccgattgatttagctgatcgtttgcaaggagatgatgaagatggactcaaagtagatgcagaacgcttagcatcctttattaagccatcccaaccacaaccgccagcaaaatcaaacgaaccaaatatcgatagtaatgcagacgcaaattacagagcgttagtgcaaggattaagtacagaagat

SEQ ID NO: 1440 - protein, 153 aa, Streptococcus pyogenes
MSEFKVIETQEELDTIVKARIAREREKYQDYDQLKTRVEELETENSSLQTALNDAKSNTDSYTEEISTLKNQIADYETANLRTKVALQYGLPIDLADRLQGDDEDGLKVDAERLASFIKPSQPQPPAKSNEPNIDSNADANYRALVQGLSTED

SEQ ID NO: 1441 - DNA, 1413 bp, Streptococcus agalactiae
atggttactaagacgaaagcaaagcttggcaatcagcgacctactcaatcggtaaatttacattttgctaaaactctagctcatgaagccatcaattactacaaaaaaacaggtctaagttgctacttgtggcaagagaatatgctcatacctatgatggctatcaacgaagataacctgtgggtgcatcaaaaatacggctacgctattcctcgacgaaacggaaaaacagaagtcgtttacatacttgagctgtgggctttgcataaaggattgaaaatcttgcatactgctcacagaattagcacttctcactcttcgtttgaaaaagtaaaaaaatatcttgaaatgtcaggatatgttgacggagaagattttatatcaaacaaagccaaagggcaggagcgtattgagtttaaatctagcggttctgttatccagtttaggactaggacatcaaatggaggtcttggtgagggatttgacctactaattattgatgaggcgcaagaatacactgccgagcaagaatcagcgttgaaatacacggtaactgatagcgataacccaatgactattatgtgtggaacgccaccgaccatggtatctactggtacagtctttgaatcttatcgtaaagagtgtttaaaaggtgacagacgctactctggatgggcagaatggtctgttgacgaaatgcaaccaatacatgacgtaaaaagttggtatgttgccaacccgtccatgggataccacttaaatgagcgtaaaattgaagctgaattaggtgaggatgaaattgatcacaatatccagcgcttaggatattggccgtcatttaaccagaaatcagttatatctgaaaaggagtgggctaaactaaaagttgagcaagtaccagaactcaaaagtaagttatttgttgggattaagtttggccaagacggtaacaacgtatcattgtcaattgcagcaagagcatcagaaaataaagtatttgttgaggctattgactgtttatccgttagaaatggaactcaatggattattaactttttgaaatcggctgacattgctaaagttgttgttgatggcgcaagcggtcaagaattacttgctcaagagatgagagagcatggtttaaagaaaccagaattgcctaaagttgctgaaattatcacagctaacacgatgtgggaacaaggtatcatgcaagagactatctgccacaacgaccagccatctttgacagcggtagttacaaactgcgaaaaaaggcaaattggctcgaatggtggttttgggtataaatcgctttatgatgatagagacattagcttaatggacagtgcattgcttgcgcactggatttgttacacaacgaagccaaaaagaaagcaaagaaccagctgt

SEQ ID NO: 1442 - protein, 471 aa, Streptococcus agalactiae
MVTKTKAKLGNQRPTQSVNLHFAKTLAHEAINYYKKTGLSCYLWQENMLIPMMAINEDNLWVHQKYGYAIPRRNGKTEVVYILELWALHKGLKILHTAHRISTSHSSFEKVKKYLEMSGYVDGEDFISNKAKGQERIEFKSSGSVIQFRTRTSNGGLGEGFDLLIIDEAQEYTAEQESALKYTVTDSDNPMTIMCGTPPTMVSTGTVFESYRKECLKGDRRYSGWAEWSVDEMQPIHDVKSWYVANPSMGYHLNERKIEAELGEDEIDHNIQRLGYWPSFNQKSVISEKEWAKLKVEQVPELKSKLFVGIKFGQDGNNVSLSIAARASENKVFVEAIDCLSVRNGTQWIINFLKSADIAKVVVDGASGQELLAQEMREHGLKKPELPKVAEIITANTMWEQGIMQETICHNDQPSLTAVVTNCEKRQIGSNGGFGYKSLYDDRDISLMDSALLAHWICYTTKPKRKQRTSC

SEQ ID NO: 1443 - DNA, 1428 bp, Streptococcus pyogenes
ttgaaaggaataagtatggttactaagacgaaaacaaagcttggcaatcagcgacctactcaatcggtaaatttacattttgctaaatctctagcgcatgaagctattaattactacaaaaaaacagggctaagctgctatccatggcaagtaaatatgcttatcccaattatggccatagatgaaaatggtctgtgggttcatcaaaagtatgggtatgctatcccacggcgtaacggtaagacggaagtagtctatattgttcagctgtgggctttgcataaaggtttaaaaatcttgcatacagctcatcgaattagcacatctcatgcatcattcgaaaaggtaaaaaaataccttgagatgtcaggttatgttgatggagaagactttatatcaaataaagccaagggtcaagagcgtatagagttcaaagccagcggcgctgttatccagttccgaactaggacatcaaacggtggacttggtgagggatttgacttacttatcattgacgaggcacaagaatacacatctgagcaagaatcagcattgaagtacacagttactgatagtgataatccaatgactattatgtgtggaacgccgccaacgatggtatctactggtacagtatttgaagcatatcggaaagattgcttaaaaggcaataagcgttattctggttgggctgaatggtcagttcctgagatggttaagattaacgatgtatcttcctggtatatttccaacccatctatgggattccacctcaacgagaggaaaatcgaagctgaattaggtgaagatgagattgatcacaacatccaacgcttaggttattggccatcctttaaccaaaaatcagttatatccgaaaaagaatgggcaaaactcaaagttgagcaagtgccagaactcaaaagcaagctttttgtcggtatcaagtttggtcaagatggcaacaacgtatcactatcaattgcagcaagaacatcagaaaataaggtatttgttgagactattgactgtttatcggtcagaaatggaactcaatggattattaattttttgaaatcggctgatatcgctaaggttgtcattgatggtgcaagtggtcaagaattacttgctcaggagatgaaagatcaaggtctaaagaaaccagaattgcctaaagttgctgaaattatcacagctaacatgatgtgggagcaggggatcatgcaggaaaccatttgtcatagtgatcagccatctttgacagcagtagtcacaaactgtgaaaagaggcaaattggctctaatggtggttttgggtataaatcgctttatgatgatagagacattagcttaatggacagtgcattgcttgcgcactggatttgttacacaacgaagccaaaaagaaagcaaagaaccagctgt

SEQ ID NO: 1444 - protein, 476 aa, Streptococcus pyogenes
LKGISMVTKTKTKLGNQRPTQSVNLHFAKSLAHEAINYYKKTGLSCYPWQVNMLIPIMAIDENGLWVHQKYGYAIPRRNGKTEVVYIVQLWALHKGLKILHTAHRISTSHASFEKVKKYLEMSGYVDGEDFISNKAKGQERIEFKASGAVIQFRTRTSNGGLGEGFDLLIIDEAQEYTSEQESALKYTVTDSDNPMTIMCGTPPTMVSTGTVFEAYRKDCLKGNKRYSGWAEWSVPEMVKINDVSSWYISNPSMGFHLNERKIEAELGEDEIDHNIQRLGYWPSFNQKSVISEKEWAKLKVEQVPELKSKLFVGIKFGQDGNNVSLSIAARTSENKVFVETIDCLSVRNGTQWIINFLKSADIAKVVIDGASGQELLAQEMKDQGLKKPELPKVAEIITANMMWEQGIMQETICHSDQPSLTAVVTNCEKRQIGSNGGFGYKSLYDDRDISLMDSALLAHWICYTTKPKRKQRTSC

SEQ ID NO: 1445 - DNA, 186 bp, Streptococcus agalactiae
atggaattattgcagtacaataataagaaaatttcacttgttgacattgatgatgagatatggactggaacagcatactattgcgatgctgatacaaatgagacccccgaggacgtcttagtcgtaaaaaacgagagaggatatacagaaatttctgaatcagaaatcaaatcaattgaaatcatt

SEQ ID NO: 1446 - protein, 62 aa, Streptococcus agalactiae
MELLQYNNKKISLVDIDDEIWTGTAYYCDADTNETPEDVLVVKNERGYTEISESEIKSIEII

SEQ ID NO: 1447 - DNA, 1218 bp, Streptococcus agalactiae
atggttgatgatgtcttacctaagctactaaaatctgttcaacaggattttgaaaagcattttggcaaaagtgaggtcgttgctaaggcttttgcagaattgcaagctaaaaaagcgacttataagacagtcaacgagtttgctgtagaggttggacggcttttgtcgttggctctggcaaactctgttatttctgatgagttaccagatggtaaaatgtattataatattgctaatcgtctcgtgaatgatacactgagacataattataagttaatttctgattatgcaggcgatgtccagcaaaatttaaacaaacaggctaaaattagtttaaaaattcaacgtccaccgcttaatcaagataaaattgacgggttagtcaatcgtttggcgagtgaacctgtatttgacgatgtcaagtggcttctcgatgagccaattgttaattttagtcaatctatcgttgatgattgtatcagagctaatgctgatttccactttaaaacgggactgaaaccaactatagaacgtatatcaacaggtaagtgctgcgattggtgtgaccgattagctggtcgctacgtttaccacgaagaaccaaaagatttttacaagaggcatcaacattgtcagtgtgttatcgactatcatcctaaaaacggcaagcgtcagaattcatggtcgaaaaagtggacaaaagaaactactgatatactagaacgacgcaaacagatgaatattgacatcagagacaataaccgtaagtctgatatcaaagaatataaggaaatagtatccattttaggtacaaaagcccctatttctctagctaaattccaagacttgaagtataatgatggtataagatatgagcgattaaaagaccaagcacacatccaaggaaactttaaaaacggaagttggctagataaggtaaatcctgaaaaacaagctcggcatatcaaatcaaccgctggagaaggtaagagttatttcttcgatgatgtggataccgatgttttataccaaaagtataaacagactggtgaattaatcaagaatagaaggggacggactcataaggaacttattgatttaccagaagatatttcgataggtattgatatttactcaggaaatttagtaaatggcctgactattcattacggaaagaccggatcgcacattgttccaacttatcatgaaaggagagag

SEQ ID NO: 1448 - protein, 406 aa, Streptococcus agalactiae
MVDDVLPKLLKSVQQDFEKHFGKSEVVAKAFAELQAKKATYKTVNEFAVEVGRLLSLALANSVISDELPDGKMYYNIANRLVNDTLRHNYKLISDYAGDVQQNLNKQAKISLKIQRPPLNQDKIDGLVNRLASEPVFDDVKWLLDEPIVNFSQSIVDDCIRANADFHFKTGLKPTIERISTGKCCDWCDRLAGRYVYHEEPKDFYKRHQHCQCVIDYHPKNGKRQNSWSKKWTKETTDILERRKQMNIDIRDNNRKSDIKEYKEIVSILGTKAPISLAKFQDLKYNDGIRYERLKDQAHIQGNFKNGSWLDKVNPEKQARHIKSTAGEGKSYFFDDVDTDVLYQKYKQTGELIKNRRGRTHKELIDLPEDISIGIDIYSGNLVNGLTIHYGKTGSHIVPTYHERRE

SEQ ID NO: 1449 - DNA, 1491 bp, Streptococcus pyogenes
atggttgatgatgtcttacctaagctactaaaatctgttcgacaagattttgaaaagtattttggcgaaagtgatgttgtaaccaaggcttttgcagaattgcaagctaaaaaagtgacctataaaacagtcaatgagtttgctattgaagtcggaagacttttatctttggctctgacaggttctgttagctcggataaattaccagacggtaaaatgtattacaatatcgctaagcgtctcttagatgagactatgggacggaattacaaattgatttcaggttatgctggtgatgttcagcggattttaaatgagaatgctcagattggtctaaaggtgcaacgtccaccgctaaatcgagacaagattaacgggatggtaaatcgtttggatagcgagaatacatttgatgatgtaaaatggctgtttggtgaaccgattgttaatttttcgcagtccattgtggatgataccatcaaggcaaatgcggatttacaatataaaacaggtatgacgccacaggttgtcagaacagaaagtggcaactgttgtgaatggtgtcgtgaggttgttggcacttatagttatccaaaagtccctaaggacgtatggagaagacatcagcggtgtcgatgtacgcttgactatgacccgaagaatggaaaagttcagagtgcttggagtaaaatctggcgaaagaaagaaaaaactcaagaatctatagaaagggttgaaaaatttaaggaaagtgctctagtagaatctatcaaaaatgatatcgctaagttagatatgacaaaggttggtccgagtgatataattgatatagggaaacgtatcaattatcactttagagtttcagaacatataggagataaagagaaattaaaagaaattttctcaaattttcgtgaaatcggtggagaaatacctaaaaatacttgggcaaaaggttcatctaaacttgttaaagaccagctacaagaggcttttcaaaattatccaactgagtgggcagctgttccggacggtattggtaaaaaactaaaagctataaaaaggaagcgcggttacttcgatggatatgatgaagatttagttattgctacaaatggaacaagaaaaacaacaccttaccatgagataggacatatgattgaactggttaatcctgatttagtaagattagagaaagcctgggtagataaaagaactgctaatgaagctgaggttcgcttgaaagatatttttccaagttcaaattatggtattggggaagttactaagaaagatgactttatatcaccatatattggtaaatactacagcgatgcagctgaagttttcactatgggattacaaggtatttttgttcctgaagaacgatttgctaagtcctttgacaaaaaaacatggaaatatgactacaagacaatcaatgacgaccctgaatttttgaattttattattggattatttgtgaaagtg

SEQ ID NO: 1450 - protein, 497 aa, Streptococcus pyogenes
MVDDVLPKLLKSVRQDFEKYFGESDVVTKAFAELQAKKVTYKTVNEFAIEVGRLLSLALTGSVSSDKLPDGKMYYNIAKRLLDETMGRNYKLISGYAGDVQRILNENAQIGLKVQRPPLNRDKINGMVNRLDSENTFDDVKWLFGEPIVNFSQSIVDDTIKANADLQYKTGMTPQVVRTESGNCCEWCREVVGTYSYPKVPKDVWRRHQRCRCTLDYDPKNGKVQSAWSKIWRKKEKTQESIERVEKFKESALVESIKNDIAKLDMTKVGPSDIIDIGKRINYHFRVSEHIGDKEKLKEIFSNFREIGGEIPKNTWAKGSSKLVKDQLQEAFQNYPTEWAAVPDGIGKKLKAIKRKRGYFDGYDEDLVIATNGTRKTTPYHEIGHMIELVNPDLVRLEKAWVDKRTANEAEVRLKDIFPSSNYGIGEVTKKDDFISPYIGKYYSDAAEVFTMGLQGIFVPEERFAKSFDKKTWKYDYKTINDDPEFLNFIIGLFVKV

SEQ ID NO: 1451 - DNA, 1266 bp, Streptococcus agalactiae
atgaactatatgggtatgggctatcttcagaggaagttagctctttttaagactggtgtagataaaagatatcgctattatgctatggacgacagagacaacacacgaagtattgtcatgcctgacaatgtgcgtgagatgtacaggtctgtgattgaatggaccgctaaaggagttgatagtctggcagatcgcattatttttagggaattcgctaatgatgattttaatgcttgggaaatttttaaagctaataacccggatatcttttttgatacggctattcaatcggcgctaattgcatcttgttgctttgtgtatattatgccagggaaggaagatagcctgcccaaaatgcaagttattgaagcgagtaaagcaacaggcattcttgacccgactacatttttgctgacagaaggttatgcagtcttagagtcggattcaaatgagaaccctacattagaagcttattttacaggcgaaaaaacctggtactatcccaaagatgagaaaccatatagcattgataactcgacaggacaccctttgcttgtccctgtaattcataggccagatgctgtacgtcccttcggacgtagtcgtataaccaaagctgggatgtatcaccaaaaggccgccaaacgtactttagagcgtgcggaagttactgcagagttttatagtttccctcaaaagtatgttctcggaatggatcctgatgcagaacctatggaaaaatggcgtgctactgtttcgacgttattagagatatcaaaagatgaagatggagacaaaccaacagttgggcaatttacaacagcaagcatggcccctttcatggatcatttaaaaatgtacgcttcattattcgcgggtggctctggacttactcttgatgaccttggtttcccttctgacaatccatcatcagtggaagccattaaagcagcgcatgagaatttaagagcggcaggacgcaaagctcaacgctctttctcttctggttttttaaatgtggcttatattgctgtttgtttgagagatgatttcccttatcttcgtaatcagttcatggatactgaaattaaatgggaacctctttttgaagctgatgcaaatatgctaactttggtcggtgatggtgctattaagcttaatcaagctattcctggtttcatggatgcagacgttattcgggacttaactggtgtaaaaggttctgacaatccaattccaaaagctacggaggtgacaactgatggt

SEQ ID NO: 1452 - protein, 422 aa, Streptococcus agalactiae
MNYMGMGYLQRKLALFKTGVDKRYRYYAMDDRDNTRSIVMPDNVREMYRSVIEWTAKGVDSLADRIIFREFANDDFNAWEIFKANNPDIFFDTAIQSALIASCCFVYIMPGKEDSLPKMQVIEASKATGILDPTTFLLTEGYAVLESDSNENPTLEAYFTGEKTWYYPKDEKPYSIDNSTGHPLLVPVIHRPDAVRPFGRSRITKAGMYHQKAAKRTLERAEVTAEFYSFPQKYVLGMDPDAEPMEKWRATVSTLLEISKDEDGDKPTVGQFTTASMAPFMDHLKMYASLFAGGSGLTLDDLGFPSDNPSSVEAIKAAHENLRAAGRKAQRSFSSGFLNVAYIAVCLRDDFPYLRNQFMDTEIKWEPLFEADANMLTLVGDGAIKLNQAIPGFMDADVIRDLTGVKGSDNPIPKATEVTTDG

SEQ ID NO: 1453 - DNA, 1266 bp, Streptococcus pyogenes
atgaattatatgggtatgggctatcttcgtaggaagttagctctttttaaaactggagttgataaaagatatcgttattatgccatggatgacagagacgacacacgaagtattgtcatgccaaataatgtgcgtgaaatgtacaggtctgtgttagaatggaccgctaaaggggttgatagccttgcggaccgtattattttcagggagtttaccaacgatgattttaatgcttgggaaatttttaaagcgaataaccctgatatcttttttgatacagccatacagtcagcattaattgcatcttgttgctttgtgtacatcatgccaggagcggaagacggcttacctaaaatgcaagttatcgaagctagtaaagcgacggggatacttgacccaactacatttttattaacagagggttatgcaattttagagtctgactcaaacggtaatcctacgttagaggcctatttcacagacaaagacatctggtattatccaaaaaaagggaaaccatataatattaaaaatccaacaggtcaccccttgcttgtacctatcattcacagaccagacgcagttagaccatttggtcgcagtcgcattaccaaggctggaatgtatcatcaaaaggcagcgaagagaacgcttgagagagcagaggttacggctgagttttactcattcccacaaaaatatgttttgggaatggatccagacgctgaaccgatggaaaagtggcgtgctacggtgtcaacgttactcgaaatctcaaaagacgaggatggcgacaagccaacagttgggcaattcacaacagcaagcatggcccctttcatggaacacttgaaaatgtatgcttcgctatttgctggtggttccggtctcactcttgatgaccttggttttccatctgacaacccatcgtctgttgagtcaataaaagcggcacatgagaatttgagagcagcaggacgcaaagctcaacgttctttttcttctggatttctaaatgtggcgtatattgctgtttgtttaagagatgaatttccttatcttcgtaatcaattcatggatacagtaattaaatgggagcctctctttgaagctgatgcaaatatgctaactttagtaggggatggagctatcaaacttaatcaagctatccctggtttcatggatgcagatgttatccgtgatttaacgggagtaaaaggggctgataaacctatacctgctatcacggaggtaacaactgatggt

SEQ ID NO: 1454 - protein, 422 aa, Streptococcus pyogenes
MNYMGMGYLRRKLALFKTGVDKRYRYYAMDDRDDTRSIVMPNNVREMYRSVLEWTAKGVDSLADRIIFREFTNDDFNAWEIFKANNPDIFFDTAIQSALIASCCFVYIMPGAEDGLPKMQVIEASKATGILDPTTFLLTEGYAILESDSNGNPTLEAYFTDKDIWYYPKKGKPYNIKNPTGHPLLVPIIHRPDAVRPFGRSRITKAGMYHQKAAKRTLERAEVTAEFYSFPQKYVLGMDPDAEPMEKWRATVSTLLEISKDEDGDKPTVGQFTTASMAPFMEHLKMYASLFAGGSGLTLDDLGFPSDNPSSVESIKAAHENLRAAGRKAQRSFSSGFLNVAYIAVCLRDEFPYLRNQFMDTVIKWEPLFEADANMLTLVGDGAIKLNQAIPGFMDADVIRDLTGVKGADKPIPAITEVTTDG

SEQ ID NO: 1455 - DNA, 354 bp, Streptococcus agalactiae
ttgaaaaagaaatgtttaatttgtaaaaagactttccaagctaaaaccaacagaagtttatattgttcagaagaatgccgcaaaaagggcattcgtgagaaacaacgcaaattgatgaagcaaaaacgagccgataaaaagaaagagaaaattaaggttctaaatactaacgcagatgtgacagaaaagcctaaaaaaatacgtaatttggtacaacactataaaaaactaaagagggaaattttagacaatgagtctgaatttggttttacaggaatcgcgcttgttgagggtatagatattcacgaagaaaactttgtagatttagttatgcaaaaaataaaggagcaacaa

SEQ ID NO: 1456 - protein, 118 aa, Streptococcus agalactiae
MKKKCLICKKTFQAKTNRSLYCSEECRKKGIREKQRKLMKQKRADKKKEKIKVLNTNADVTEKPKKIRNLVQHYKKLKREILDNESEFGFTGIALVEGIDIHEENFVDLVMQKIKEQQ

SEQ ID NO: 1457 - DNA, 354 bp, Streptococcus pyogenes
ttgaaaaagaaatgcttaatttgcaaaaaaaacttccaagcaaaaaccaatagaactttatattgctctgaagaatgccgtaagaaaggcaatcgtgagaaacaacgtaaattgatgaaacaaaaacgggctgaacagaggaaagaaaaaaagaaagtcctaaatcctaacacagatgtgacagaaaagcctaaaaaaatacgtaatttagcgcagcactataaaaaactaaaaaaggaaattttggcaaatgaatctgaatttggttttactggaataacacttattgaaggaatagatgtacatgaagaaaactttgtagatttagtcatgcaaaaaataaaggagcagaaa

SEQ ID NO: 1458 - protein, 118 aa, Streptococcus pyogenes
LKKKCLICKKNFQAKTNRTLYCSEECRKKGNREKQRKLMKQKRAEQRKEKKKVLNPNTDVTEKPKKIRNLAQHYKKLKKEILANESEFGFTGITLIEGIDVHEENFVDLVMQKIKEQK

SEQ ID NO: 1459 - DNA, 417 bp, Streptococcus agalactiae
gtggttcgaatccactcacacgctttactcagtcatcacattgtggtggctttttattacaattgtaagaggggatgttgcaaactgcgtgcagataaaaaaggtacccaccgggtcgcgttcgaaaaaaataaacgccggctgctaaaaaccgcccacctatgcggtatctgtggccggccagtagataagtcattgaagtatccacatccgctaagtgcagcaattgatcatattgttcctattgcaaaaggtggtcatccgtcatcaatagataacttacagttaacacattggcaatgtaataggcaaaagtctgacaagttatttatcaatcagacagccgtacgggctactgttgtaggaaatagaaacttacctcaaagccgagactggtcgtcctacgcatctaaagaa

SEQ ID NO: 1460 - protein, 139 aa, Streptococcus agalactiae
MVRIHSHALLSHHIVVAFYYNCKRGCCKLRADKKGTHRVAFEKNKRRLLKTAHLCGICGRPVDKSLKYPHPLSAAIDHIVPIAKGGHPSSIDNLQLTHWQCNRQKSDKLFINQTAVRATVVGNRNLPQSRDWSSYASKE

SEQ ID NO: 1461 - DNA, 342 bp, Streptococcus pyogenes
atgtctcagttaagggcagataaaaaaggtacccaccgggtagcatttgacagaaataaaaagaagttactaaaggcagccactgtctgtggtatctgtggcaagccagtggacaagtctcttaagtatccacatccattaagcgcagcaatagatcatatagttcctatcgcaaaaggtggtcatccatcagcgcttgagaacttacagttaactcactggcagtgcaacaggcagaagtctgataagttgtttgctaaccaagcaagcaacgagccaaagacaattggcaacagaaaccttcctcaaagtcgagactggtcatcttttgcatttaaaaag

SEQ ID NO: 1462 - protein, 114 aa, Streptococcus pyogenes
MSQLRADKKGTHRVAFDRNKKKLLKAATVCGICGKPVDKSLKYPHPLSAAIDHIVPIAKGGHPSALENLQLTHWQCNRQKSDKLFANQASNEPKTIGNRNLPQSRDWSSFAFKK

SEQ ID NO: 1463 - DNA, 264 bp, Streptococcus agalactiae
atgaaagaaaaaacaatttttatatcaaaaaaatatgcaaatgactttaacaatgacaaatataatttgtcctctggctattattttagaagtggtgaaaaacatgatattgctattgttaaatatggtgaaaaagattatttaaaaaatactgatttagcatatgttgtatgcgataagatcgttgacgcagactctataagcttcgtttatcatggtgaatatgaaacttggcattttaaactattaaacacagaagcaaat

SEQ ID NO: 1464 - protein, 88 aa, Streptococcus agalactiae
MKEKTIFISKKYANDFNNDKYNLSSGYYFRSGEKHDIAIVKYGEKDYLKNTDLAYVVCDKIVDADSISFVYHGEYETWHFKLLNTEAN

SEQ ID NO: 1465 - DNA, 531 bp, Streptococcus agalactiae
atgaatattgaagaagcgaagaaattgatagacaaacagtctattggtaaaggtggtgtcggcgacattccagtagtgaaaacacatattgtaaaagtattactcgaccagattgaccaacctcaaccagaagtgccacggtttgtggctgattggtacgagaagcataaagatagcttagagtgcgatttatatttatatcacatgtcgatatacgatgaagaagtcgaaaaagatgacttctattactggatgcaaacatcaaaaaatccagtctacacacttattaatatgcaccaattcggctacaccatccaaaaagagaagctgtatacggttgagatacctaatccgaatgaaagacagttaagttttgtgctgatgagacaacttagcggaaatgtaagtatcaaagttatgcatagagataacttagacttactaaagacagataatgatttacaactaacagaatccgaaatccgcaaagatttcgactgggcgtggcagtttagagaagaggtggtggaa

SEQ ID NO: 1466 - protein, 177 aa, Streptococcus agalactiae
MNIEEAKKLIDKQSIGKGGVGDIPVVKTHIVKVLLDQIDQPQPEVPRFVADWYEKHKDSLECDLYLYHMSIYDEEVEKDDFYYWMQTSKNPVYTLINMHQFGYTIQKEKLYTVEIPNPNERQLSFVLMRQLSGNVSIKVMHRDNLDLLKTDNDLQLTESEIRKDFDWAWQFREEVVE

SEQ ID NO: 1467 - DNA, 459 bp, Streptococcus pyogenes
atgaatatagaagaagcgaaagaattagtagataattcaaaattttatggaaagactagcagtgttataaaagccgaggttcgcgacattatagaccagttaaaccaaccaaaaccagaagtaccgcagtgtgtggcggattggatagaagagtgcaaagaagaagatttaactttaaaaggcttgttttctaacagcgatatgcctgcaaaaatttttgattggatttttggtagtgacgaaaattgtaggttaatggctgaagcatggattaacggctacacagtagaaaaagaaaagctctacactgtcgacttaccaaacggtcaacctttagtgcgcggcataaacactttgtattttagtcaaaatctagcaaccgaaaatgtaaaactcaccgaatccgaaatccgcaaagattttgaatgggcgtggcagtttgctgaagaggtgactgaa

SEQ ID NO: 1468 - protein, 153 aa, Streptococcus pyogenes
MNIEEAKELVDNSKFYGKTSSVIKAEVRDIIDQLNQPKPEVPQCVADWIEECKEEDLTLKGLFSNSDMPAKIFDWIFGSDENCRLMAEAWINGYTVEKEKLYTVDLPNGQPLVRGINTLYFSQNLATENVKLTESEIRKDFEWAWQFAEEVTE

SEQ ID NO: 1469 - DNA, 330 bp, Streptococcus agalactiae
ttgtcattaattgatgaagtaaaagaatgcggttcagaatctcacaaaaaatggtttgataggtactttgatggtttaaaaatcgaggagaaacttaaacagtctgcgatgaaaggattctctggttataaaatctctattccaaaaaatgatgaatacttagctagacgacttgatagccaaaaaacaatagatttactaaaataccgacttggtgacggttttgatgtcgaaataaaaaatcttgaatcatcatataaaatctttggtaaaccagttgtactaagtagagatttatttattttttggaggacaggagataagaatgga

SEQ ID NO: 1470 - protein, 110 aa, Streptococcus agalactiae
MSLIDEVKECGSESHKKWFDRYFDGLKIEEKLKQSAMKGFSGYKISIPKNDEYLARRLDSQKTIDLLKYRLGDGFDVEIKNLESSYKIFGKPVVLSRDLFIFWRTGDKNG

SEQ ID NO: 1471 - DNA, 288 bp, Streptococcus agalactiae
gtggatagaggagatgacgaaatgactgaacaacagatgattgattgcttgctttatgagttagcaaaaaaagacaaattgaacattagacgaaacaatatcataacgtttttatcgattgtgctgatggctatatctattttaaacgtcgcactgcaagaccactacaagtcgcaaattacagaattacggacacagttaagcaggacacaaaagcagcttaaacgtgctagtgatgatagagctagacagacaaaacggattgctgagctgactggaaatggggga

SEQ ID NO: 1472 - protein, 96 aa, Streptococcus agalactiae
MDRGDDEMTEQQMIDCLLYELAKKDKLNIRRNNIITFLSIVLMAISILNVALQDHYKSQITELRTQLSRTQKQLKRASDDRARQTKRIAELTGNGG

SEQ ID NO: 1473 - DNA, 267 bp, Streptococcus pyogenes
atgactgaagaacagatgattgattgcttgctttatgagttagtaaaaaaagacaaagcaatcaaaaagaaaagcatcattatcgctgcactaacagttatgctgattgtcgtatcagggctttgcgtatcgcttaaaagctattatgaaccgcaaatatacggactacgtacacagctaagcaggacacaaaagcagcttaaacgtgcgagtgagcaaaatcagagacagacaaagcggattgctgatttaacgaataacggaggg

SEQ ID NO: 1474 - protein, 89 aa, Streptococcus pyogenes
MTEEQMIDCLLYELVKKDKAIKKKSIIIAALTVMLIVVSGLCVSLKSYYEPQIYGLRTQLSRTQKQLKRASEQNQRQTKRIADLTNNGG

SEQ ID NO: 1475 - DNA, 162 bp, Streptococcus agalactiae
atgacaaaagaagaagtaattgcatttctgacagaacagcgtgatttgcggcttgttggatatgagtggggaaaagacaatctgtccgtttttgcgagatggcaattagaacaagcaaatatgtatttagatgtcattgagtggatagaggagatgacgaaa

SEQ ID NO: 1476 - protein, 54 aa, Streptococcus agalactiae
MTKEEVIAFLTEQRDLRLVGYEWGKDNLSVFARWQLEQANMYLDVIEWIEEMTK

SEQ ID NO: 1477 - DNA, 414 bp, Streptococcus agalactiae
atgataccgaattttagagcgtttaataaagagaccaaaaagatgtatggtgttgacggctttgaattaagtgtgcgcaaaatatatagatgcagcttagcagatgatgagtttcgttgtggtcgcttagagacgtttcattttgtcgaggataactttgacgattatatcctcatgcaatcaacaggaatgtttgacaaaaacggtgttgagatttttgatggtgatatagttttaacaacacgtctcatagattacacatataaaaattttaaaggtgtagtaaaaatgttagaaggtcgctggttaattgacacaggtaaagatgcggttggtttgtggactgaagttgatgagaacgaagcaatcggaaacatatatcaaaacagcgaattactagaaagcgtggaagaa

SEQ ID NO: 1478 - protein, 138 aa, Streptococcus agalactiae
MIPNFRAFNKETKKMYGVDGFELSVRKIYRCSLADDEFRCGRLETFHFVEDNFDDYILMQSTGMFDKNGVEIFDGDIVLTTRLIDYTYKNFKGVVKMLEGRWLIDTGKDAVGLWTEVDENEAIGNIYQNSELLESVEE

SEQ ID NO: 1479 - DNA, 243 bp, Streptococcus pyogenes
atgataccaaattttagagggtttaacaaaaaaactaaaaaaatgtatagcattgatggctttaaatcaagtgaacgcaaaatatacagatgcagcttagcagatgatgagtttcgctctggtcgcttagagacattccattttgtagaggataatcttgtggaaaagtgcaacagaccacctgaacgattttatcgacaaaaacaagtacgcaaaagtgacaggcgacttatggcaaggcag

SEQ ID NO: 1480 - protein, 81 aa, Streptococcus pyogenes
MIPNFRGFNKKTKKMYSIDGFKSSERKIYRCSLADDEFRSGRLETFHFVEDNLVEKCNRPPERFYRQKQVRKSDRRLMARQ

SEQ ID NO: 1481 - DNA, 354 bp, Streptococcus agalactiae
ttgaagagattgacagatgaattaataaatcaattttacaaaatttttgacaatgggattgtaaggcaaattaaaaagctagatgtagattgtaaaaaagccgagcaaataagatgtagcgttacaaataacagacgtcgaaaaaccctgccaagaccgtacgttatcgaagcgtttaaagattattttgacgaagatacctatgcacagatgtatatcaaatcatatcgtgagtatcacaacccaaatgaccacgagacggaactttttgtaaaactaaaaagagcgcacaaagatactaagttagagcattacaaggaagttaagcgattgatgtacgcagcaatgaccttt

SEQ ID NO: 1482 - protein, 118 aa, Streptococcus agalactiae
MKRLTDELINQFYKIFDNGIVRQIKKLDVDCKKAEQIRCSVTNNRRRKTLPRPYVIEAFKDYFDEDTYAQMYIKSYREYHNPNDHETELFVKLKRAHKDTKLEHYKEVKRLMYAAMTF

SEQ ID NO: 1483 - DNA, 486 bp, Streptococcus agalactiae
ttgaagaggaatatgacttttaagacagaatttgaaataccaatcgaaccaaaacctcaaactagacctaagttcagcaaatttggtacgtacgaagatccaaagatgaagagatggcgaaaagaggtttctggatggatagaaaaaaattatgatggaccgtttttcgatgattgcataaaggtagaggtaaccttttacatgaaagcccccaaaacgctatcaaaagagcctacacaacgttctaaaggtaaaacaatacaaatatatcagaacttcgtgcgtgagcttatatggcacgctaagaagcctgatattgataatctgattaaagctgtttttgatagtatttccgatgcaggttacgacagaatacagaaatcaggtatcgtttggtcagatgacaatatcgtatgcgatttaagagcaaagaaaaaatacagtcagaatccaagaataaaagtgaggattgaagagattgacaga

SEQ ID NO: 1484 - protein, 162 aa, Streptococcus agalactiae
MKRNMTFKTEFEIPIEPKPQTRPKFSKFGTYEDPKMKRWRKEVSGWIEKNYDGPFFDDCIKVEVTFYMKAPKTLSKEPTQRSKGKTIQIYQNFVRELIWHAKKPDIDNLIKAVFDSISDAGYDRIQKSGIVWSDDNIVCDLRAKKKYSQNPRIKVRIEEIDR

SEQ ID NO: 1485 - DNA, 291 bp, Streptococcus agalactiae
ttgggaaagccgtgtaagggaaaaccttacgcacggtttgacgaggggtttctgaggagatggctcaaatcagcgacctactctacaaaaatgacgaagccgaggaaacaaaggatatatgcaatatatgatgacgacaaatttgtcgacgttggcacaaaagaagagttatcggcacggcttggaattaaaaaagcaacaatagaacagtacatgactaaatcatatcaagcgttagctagctcaaaacgaattgcattgttggtagggattgaagaggaatatgacttt

SEQ ID NO: 1486 - protein, 97 aa, Streptococcus agalactiae
MGKPCKGKPYARFDEGFLRRWLKSATYSTKMTKPRKQRIYAIYDDDKFVDVGTKEELSARLGIKKATIEQYMTKSYQALASSKRIALLVGIEEEYDF

SEQ ID NO: 1487 - DNA, 1317 bp, Streptococcus agalactiae
atgattgctcagaaagctataaacatctttgaaaaggttcaagtatttcaacggaagatatatctatcgaccaaggcagataataagcgaaagtttggtgttttatacgacaaagtatatcgtaaagatatcctgaaagttgcgtggttctatgtaaaaaggaataaaggttcggcaggcattgatgacttcacgattgaagaaattgaagcctacggtgtacagaaatttcttgatgaaatagaagaccagttgagaaacaagaaatatcaacctaaggcagtaaagcgagtttatattccaaaagcgaatggtaaaaagagaccgttgggaattccgacagtccgagatagagttgttcaaacagctgtgaaaatagttatagaaccgatattcgaagcggactttcaagaattttcttatggttttagacctaagcgaagtgctaaccaagctataagagagatatataaatatctcaattatggttgtgagtgggttattgatgccgacttaaaaggttactttgacacgatacctcatgataagttactacttttagttaaggaacgagtaactgataagtctattatcaagttacttagtttatggctagaagcaggtatcatggaagacaatcaagtgagaagtaatattttaggtactccacaaggaggtgtcatatcaccgttgttagcgaatatctacctaaatgctttagacagatattggaagaacaatcggttagaaggaagagggcatgatgcccacttgatacgttatgcggatgactttgttattctatgctcaaataatccgaagaaatattatcagtatgcgaaacagcgtattgataagctaggattaacattgaacgaagaaaagacaagaattgtgcatgcgacagagggatttgattttctaggctatacgcttaggaaatcaaaatctcacaaaagtggtaagtataaaacctactactatccttcaagaaaatctatgaaatcaataaaaggcaaagtaaaagatgttatccaaacaggacaacacctgaaccttcctgatgtcatggaaagattgaatccaatgttgagaggatgggctaattatttcaaagctgggaactctaagcaacacttcaagagtatagataactatgtcatatataatctaacaattatgcttagaaagaagcacaagaagtctggaaagggatggagggaacatccgccgtcatggtactataactactttggactggtttgtttaaggaagttgagtaccaatatcaatgatgatagtcagagatatggtaga

SEQ ID NO: 1488 - protein, 439 aa, Streptococcus agalactiae
MIAQKAINIFEKVQVFQRKIYLSTKADNKRKFGVLYDKVYRKDILKVAWFYVKRNKGSAGIDDFTIEEIEAYGVQKFLDEIEDQLRNKKYQPKAVKRVYIPKANGKKRPLGIPTVRDRVVQTAVKIVIEPIFEADFQEFSYGFRPKRSANQAIREIYKYLNYGCEWVIDADLKGYFDTIPHDKLLLLVKERVTDKSIIKLLSLWLEAGIMEDNQVRSNILGTPQGGVISPLLANIYLNALDRYWKNNRLEGRGHDAHLIRYADDFVILCSNNPKKYYQYAKQRIDKLGLTLNEEKTRIVHATEGFDFLGYTLRKSKSHKSGKYKTYYYPSRKSMKSIKGKVKDVIQTGQHLNLPDVMERLNPMLRGWANYFKAGNSKQHFKSIDNYVIYNLTIMLRKKHKKSGKGWREHPPSWYYNYFGLVCLRKLSTNINDDSQRYGR

SEQ ID NO: 1489 - DNA, 414 bp, Streptococcus agalactiae
atgattaacaacattgtactagtaggtcgcatgaccaaggatgccgaacttcgttatacaccaagtaatcaagcggtagctactttttcacttgcagttaatcgtaattttaaaaatcaatctggcgaacgtgaggctgattttattaactgtgttatttggcgccaacaagctgaaaacttggctaactgggcaaaaaaaggtgctttggttggaattacaggtcgtatccaaacgcgtaattatgaaaaccaacaaggtcaacgtatctatgtaacagaagttgttgcggaaaatttccaattattagaaagtcgcaatagccaacaacagactaatcaaagcggcaatagttctaattcttattttggcaatgccaacaaaatggatatttcagatgatgacttaccattc

SEQ ID NO: 1490 - protein, 138 aa, Streptococcus agalactiae
MINNIVLVGRMTKDAELRYTPSNQAVATFSLAVNRNFKNQSGEREADFINCVIWRQQAENLANWAKKGALVGITGRIQTRNYENQQGQRIYVTEVVAENFQLLESRNSQQQTNQSGNSSNSYFGNANKMDISDDDLPF

SEQ ID NO: 1491 - DNA, 489 bp, Streptococcus pyogenes
atgattaataatgtagtactagttggtcgtatgaccaaggatgcagaacttcgttacacaccaagtcaagtagctgtggctaccttcacacttgctgttaaccgtacctttaaaagccaaaatggtgaacgcgaggcagatttcattaactgtgtgatctggcgtcaaccggctgaaaatttagcgaactgggctaaaaaaggtgctttgatcggagttacgggtcgtattcagacacgtaactacgaaaaccaacaaggacaacgtgtctatgtaacagaagttgttgcagataatttccaaatgttggaaagtcgtgctacacgtgaaggtggctcaactggctcatttaatggtggttttaacaataacacttcatcatcaaacagttactcagcgcctgcacaacaaacgcctaactttggaagagatgatagcccatttgggaactcaaacccgatggatatctcagatgacgatcttccattc

SEQ ID NO: 1492 - protein, 163 aa, Streptococcus pyogenes
MINNVVLVGRMTKDAELRYTPSQVAVATFTLAVNRTFKSQNGEREADFINCVIWRQPAENLANWAKKGALIGVTGRIQTRNYENQQGQRVYVTEVVADNFQMLESRATREGGSTGSFNGGFNNNTSSSNSYSAPAQQTPNFGRDDSPFGNSNPMDISDDDLPF

SEQ ID NO: 1493 - DNA, 144 bp, Streptococcus agalactiae
gtgtttgttgtcgggtcctgcgaaaaagatatcccgttattggcaaaagctgttgtgattgcttctgtaacattttcaagcggcacgtatttgcttttgaaaaatgggttatccttatcttttagtggttgttttacctctagc

SEQ ID NO: 1494 - protein, 48 aa, Streptococcus agalactiae
MFVVGSCEKDIPLLAKAVVIASVTFSSGTYLLLKNGLSLSFSGCFTSS

SEQ ID NO: 1495 - DNA, 672 bp, Streptococcus agalactiae
atgaggaaatcagaaagtataacagaatatgctaaagccttttgtaaagctcagctagaggtaaaacaaccactaaaagataaggataacccatttttcaaaagcaaatacgtgccgcttgaaaatgttacagaagcaatcacaacagcttttgccaataacgggatatctttttcgcaggacccgacaacaaacacagaaaacggttatatcgatgttgcaacgcttgtcatgcacacgagcggcgaatgggttgagtacgggcctttaagtgttaaacctacaaaaaatgatgtacaaggcgctggttcggctatcacttacgcaaaacgctatgcactatcggcaatttttgggataacaagcgatcaagatgatgacggcaacgaagatagtaaaccaaacaattccaggcaatcgccaaaagctacaactaaaaaaacacaaaagacaggatatcaaacaccaaaaatcagcaatatccaaatcgagacttacaagtctgatttaaatgatattgcgaaagccacaaaccaaaacgttgaagagttaacaaaatggctaaccgatactttaaaagtgggggaactagaaaatttgcatacggaacacattgtttcagcagacgaattaatcaataaactcaaaaagaaagcaggactaaaaaatgat

SEQ ID NO: 1496 - protein, 224 aa, Streptococcus agalactiae
MRKSESITEYAKAFCKAQLEVKQPLKDKDNPFFKSKYVPLENVTEAITTAFANNGISFSQDPTTNTENGYIDVATLVMHTSGEWVEYGPLSVKPTKNDVQGAGSAITYAKRYALSAIFGITSDQDDDGNEDSKPNNSRQSPKATTKKTQKTGYQTPKISNIQIETYKSDLNDIAKATNQNVEELTKWLTDTLKVGELENLHTEHIVSADELINKLKKKAGLKND

SEQ ID NO: 1497 - DNA, 480 bp, Streptococcus agalactiae
atggcttatttatacgaattagaaggtatttacgcacaattacagtcaatggatttagacgaagaaacattccaagatacacttgacagcattgattttcagtcagacttagaaaataacattgagtattttgtcaaaatgttaaaaaatgtgcaggctgatgctgaaaagtataaagccgaaaaagaagctttttataaaaagcaaaaacaagcggaagccaaagcggaaaaatacaaagagacgatcaggcttgcaatggaattgagtcaaaagaaaaaagttgacgctggaatgtttaaggtgtctttgcgaagaagtaaaaaagttgagattttggacgaaacaaaaattcctcttgattacatgcaagaaaaaattgaatacaaaccaatgaaagctgaaatctcaaaagctttgaaatctggaattgatatatctggagttgaactaatcgaaacagaaagtttgcaggtaaag

SEQ ID NO: 1498 - protein, 160 aa, Streptococcus agalactiae
MAYLYELEGIYAQLQSMDLDEETFQDTLDSIDFQSDLENNIEYFVKMLKNVQADAEKYKAEKEAFYKKQKQAEAKAEKYKETIRLAMELSQKKKVDAGMFKVSLRRSKKVEILDETKIPLDYMQEKIEYKPMKAEISKALKSGIDISGVELIETESLQVK

SEQ ID NO: 1499 - DNA, 159 bp, Streptococcus agalactiae
gtgaacgaagaaatatatgagtctagtcgttactggcaaagtagatacagcgacttgatgtctgattatcttaaagaagctgaagaaaatatagagttaaagaaacagttgaagagattaaaagccgaaaattggcagctgaaacacagaaagaggaaa

SEQ ID NO: 1500 - protein, 53 aa, Streptococcus agalactiae
MNEEIYESSRYWQSRYSDLMSDYLKEAEENIELKKQLKRLKAENWQLKHRKRK

SEQ ID NO: 1501 - DNA, 273 bp, Streptococcus agalactiae
atgcgatttaggaagggatatatggttgaaatcagaattaacggtgagtcaatcacatttgatagcaattttagggatgcgcttatatttacggtagatcacctaaaaaattatgacgatccttctttgaggcagacttacaacgagtttaaagattatacagacgaggacttgatgggatatatcagcacagaatttgatgtagacccggaaatgtttgttgatactaattcagacagcagatggaaaattaaacaacgaattttagaggac

SEQ ID NO: 1502 - protein, 91 aa, Streptococcus agalactiae
MRFRKGYMVEIRINGESITFDSNFRDALIFTVDHLKNYDDPSLRQTYNEFKDYTDEDLMGYISTEFDVDPEMFVDTNSDSRWKIKQRILED

SEQ ID NO: 1503 - DNA, 138 bp, Streptococcus agalactiae
atgacaaaacaacatagagaaacgcttatctggtaccgagcaagtcatcaagagcgtgagaagctgcttgattttgggctagttgataaatcacagtacgtgacactattgcggcaattgcgcaagaaatatgcgatt

SEQ ID NO: 1504 - protein, 46 aa, Streptococcus agalactiae
MTKQHRETLIWYRASHQEREKLLDFGLVDKSQYVTLLRQLRKKYAI

SEQ ID NO: 1505 - DNA, 138 bp, Streptococcus pyogenes
atgacaaaacaacatagagaaacacttatctggtaccgagcaagtcatcaagagcgtgagagattgcttgattttggactagttgataaagcacggtacgtgacactattgcggcaattgcgtaagaaatatgcgatt

SEQ ID NO: 1506 - protein, 46 aa, Streptococcus pyogenes
MTKQHRETLIWYRASHQERERLLDFGLVDKARYVTLLRQLRKKYAI

SEQ ID NO: 1507 - DNA, 231 bp, Streptococcus agalactiae
atggatcaggagatttttaatttttttaacaaacaaatcaaaaaagattttggtaaaacggcgagtaaagagacttttgctaagtttgctagttactgcgccgaaggaatcgaaaaaaatggagttaagccaatttttaattggataaacctatacgcttttggaaccggtatgacaacagcagaagcagaccgattaagaatagagcgatataaacaggagaatacgtta

SEQ ID NO: 1508 - protein, 77 aa, Streptococcus agalactiae
MDQEIFNFFNKQIKKDFGKTASKETFAKFASYCAEGIEKNGVKPIFNWINLYAFGTGMTTAEADRLRIERYKQENTL

SEQ ID NO: 1509 - DNA, 231 bp, Streptococcus pyogenes
atggatcaggagatttttaatttttttaacaaacaaatcaaaaaagattttggtaaaacggcgagtaaagagacttttgctaagtttgctagttactgcgccgaaggaatcgaaaaaaatggagttaagccaatttttaattggataaacctatacgcttttggaactggtatgacaacagcagaagcagaccggttgagaatagagcgatataaacaggagaatgcgtta

SEQ ID NO: 1510 - protein, 77 aa, Streptococcus pyogenes
MDQEIFNFFNKQIKKDFGKTASKETFAKFASYCAEGIEKNGVKPIFNWINLYAFGTGMTTAEADRLRIERYKQENAL

SEQ ID NO: 1511 - DNA, 858 bp, Streptococcus agalactiae
atggcagataacaaaaagtattactatctaaaattaaaagaaaatttttttgaaagtgatgaagcaatcattttagaaagtatgcctgacggctatatctatagcaatattttgctcaagctatacctaagaagtttaaaaaatgacggtttattaatgtttaacaaccttatcccttacaacgcacaaatgcttgcaacgattacaagacatcaggttggcactgtcgaaaaggctattcaaatttttagagacctacaactaattgaaattcttgataatggtgctatatatatgacaaatattcaaaattttgtcggaaaatcaagcactgaggctgacaggatacgaaaactaagagcaaaaaataacagtggtgtacaaatgttgtacaaatgtacaccagagatagagatagagaaagataaaaagatagatataaatatagataaagagttagaactagaacaagataaagaagataggtttgttgatgttgttgaagcaaatcttggtagaggtcttgtaaagtttgagttcgacatgattaatgactatctcattggacaaaatgtctcaaaggatttgtttttggaagctgttaaagtagcagttgctaataatgtccgcaaatttaattacatcgctcgcattttggataattggattaatgatgggataaagactcctgaacaagcatatcaggctcaaagagactttaaagctaaaaaagctaacaaaacaatgcaatcacaatccaacgttcctagctggtctaatccagactacaaaggaccagatttaaaagaatttgcactaggaagcatagacgatatagaagatggatcaggagatttt

SEQ ID NO: 1512 - protein, 286 aa, Streptococcus agalactiae
MADNKKYYYLKLKENFFESDEAIILESMPDGYIYSNILLKLYLRSLKNDGLLMFNNLIPYNAQMLATITRHQVGTVEKAIQIFRDLQLIEILDNGAIYMTNIQNFVGKSSTEADRIRKLRAKNNSGVQMLYKCTPEIEIEKDKKIDINIDKELELEQDKEDRFVDVVEANLGRGLVKFEFDMINDYLIGQNVSKDLFLEAVKVAVANNVRKFNYIARILDNWINDGIKTPEQAYQAQRDFKAKKANKTMQSQSNVPSWSNPDYKGPDLKEFALGSIDDIEDGSGDF

SEQ ID NO: 1513 - DNA, 384 bp, Streptococcus pyogenes
atggacgaaaaaaagctttttgaaaatttccaattaacttttggacggatgatatcgccatttgaaatcgaagatattcaaaagtggattcacgaagataacatgccaattgaagttgtcaaccttgccttaagagaagcggtagaaaacaacaaaatcagttggaagtatatcaataaaatcttagttgattggtataaatctggagatacgacagtagaaaaggtcagagacaggttgcaacggtttgacgatagtaaaaaacaacgaagtgtaactacctcaaacgtcccaagctggtcgaatccagactacaaagaaccagatttagaagaatttgctctaggaagcatggacggtatagaagatggatcaggagatttt

SEQ ID NO: 1514 - protein, 128 aa, Streptococcus pyogenes
MDEKKLFENFQLTFGRMISPFEIEDIQKWIHEDNMPIEVVNLALREAVENNKISWKYINKILVDWYKSGDTTVEKVRDRLQRFDDSKKQRSVTTSNVPSWSNPDYKEPDLEEFALGSMDGIEDGSGDF

SEQ ID NO: 1515 - DNA, 246 bp, Streptococcus agalactiae
gtggatcgagaaaaggagtatgatatggaaaatccaatgacaggagtagcaatactagcatttatcgctttacttgcatatctcggcaatcgtaatagcaatcaaaagacaattactaagactgttgagacggtgttagataactaccaagttgtgcgaaaggttgagagaccaaaacgcacggattttatagagttacctaccccaggatcatgcgggaaagtttggggcaaggatagacctttt

SEQ ID NO: 1516 - protein, 82 aa, Streptococcus agalactiae
MDREKEYDMENPMTGVAILAFIALLAYLGNRNSNQKTITKTVETVLDNYQVVRKVERPKRTDFIELPTPGSCGKVWGKDRPF

SEQ ID NO: 1517 - DNA, 126 bp, Streptococcus agalactiae
ttgacaaggttggcggtcgttcaacaaaagttaaaaaatttgaagaatggagaaaattacaaaatgaaaaaattatttaactttattttcgcaaaacaaaaaagaagaaagaccaaaatggacaat

SEQ ID NO: 1518 - protein, 42 aa, Streptococcus agalactiae
MTRLAVVQQKLKNLKNGENYKMKKLFNFIFAKQKRRKTKMDN

SEQ ID NO: 1519 - DNA, 228 bp, Streptococcus agalactiae
atgctagcaaaacttaaaagcggtatcgaagtaccttacgaagagctttggcttaatgataacgacttatccgaatttattggaaagtcatttgaccaaacgcagcgattactaagaaagatgtacaaagacagaaattatcgcaaatacattgacaaggttggcggtcgttcaacaaaagttaaaaaatttgaagaatggagaaaattacaaaatgaaaaaattatt

SEQ ID NO: 1520 - protein, 76 aa, Streptococcus agalactiae
MLAKLKSGIEVPYEELWLNDNDLSEFIGKSFDQTQRLLRKMYKDRNYRKYIDKVGGRSTKVKKFEEWRKLQNEKII

SEQ ID NO: 1521 - DNA, 801 bp, Streptococcus agalactiae
atgatagacaaaatatttgttaataaaactaacaaaccgctagaaaggaactatatgaatcaactaataaacatcaccctaaacgaaaatcaagaaccagttgtcagtggtagagatttacacaatgtacttaatataaaaactcaatatactaaatggcttgaaaggatgtcggaatatggttttgaagaaaacgttgactatatagctattagtcaaaaaagactaacagctcaaggtaaccgtacagaatatatagaccacgttctcaagctagacatggcaaaagagattgctatgttacagcgaaacgagaaatcaaaacaggtacgcaaatacttcatccaggttgaaaaagacttcaatagtcctgagaaaatcatggcgagagccttgctcatggcagataagaaaatcactaacttaacgatggaaaataatcaattgcagttagatttaaaagaagctcaaaagcaagcgcgttatcttgatctaatcattgagagcaagggagctttgcgagtaacacagattgctgctgattatggtatgtctgtcaataaattcaataaaacactattagaatttggtgtgcagcacaaagtgaatggacaatggattctctataaacgacatatgggcaaaggttacacagacagtcacacatttgactatcaagacaaaaacggccatacaagagccaatgtgacgacgacgtggacacaaaaggggcgtctattcctgtacgagttgttgaaagacaacaatattttgccactaattgaacaggaagacattgta

SEQ ID NO: 1522 - protein, 267 aa, Streptococcus agalactiae
MIDKIFVNKTNKPLERNYMNQLINITLNENQEPVVSGRDLHNVLNIKTQYTKWLERMSEYGFEENVDYIAISQKRLTAQGNRTEYIDHVLKLDMAKEIAMLQRNEKSKQVRKYFIQVEKDFNSPEKIMARALLMADKKITNLTMENNQLQLDLKEAQKQARYLDLIIESKGALRVTQIAADYGMSVNKFNKTLLEFGVQHKVNGQWILYKRHMGKGYTDSHTFDYQDKNGHTRANVTTTWTQKGRLFLYELLKDNNILPLIEQEDIV

SEQ ID NO: 1523 - DNA, 726 bp, Streptococcus pyogenes
atgaatcaactaattaacgtaacactaaacgaaaatcaagaaccagttgtcagtggtcgtgatttgcacaaagtacttgaaattaaaacacaatatacaaaatggcttgagcgaatgagcgaatatggtttcgttgaaaacgaagacttcatggctattagtcaaaaaagactaacagctcagggcaatcaaacagaatatacagaccacgttctaaaactagacatggcaaaagaaatagctatgcttcaacgcaatgaaaaatctaaagaagtccgtaaatacttcatccaggttgaaaaagatttcaacagtcctgagaaaatcatggcaagggcgttgctgatggcggacaagaaagtgcataaattagaggctcagattgaggcagaccgtccaaaggtgctatttgctgatgccgtaagtgctagccatacctctatattggtcggagaacttgcaaagttactcaagcagaatggggtaaatattggagcgactcgtctcttcacttggcttcgtaaacacggctatcttatcaagcgtaatggccgagattggaatatgcctactcagaaaagcgtagagcttggacttataagggtcaaggaaactagcatcacccattctgatggccatattacagtaagcaagacacctctggtaaccggaaaaggtcagcaatactttatcaacaaatttcttaatcaggaatatctaccagtt

SEQ ID NO: 1524 - protein, 242 aa, Streptococcus pyogenes
MNQLINVTLNENQEPVVSGRDLHKVLEIKTQYTKWLERMSEYGFVENEDFMAISQKRLTAQGNQTEYTDHVLKLDMAKEIAMLQRNEKSKEVRKYFIQVEKDFNSPEKIMARALLMADKKVHKLEAQIEADRPKVLFADAVSASHTSILVGELAKLLKQNGVNIGATRLFTWLRKHGYLIKRNGRDWNMPTQKSVELGLIRVKETSITHSDGHITVSKTPLVTGKGQQYFINKFLNQEYLPV

SEQ ID NO: 1525 - DNA, 189 bp, Streptococcus agalactiae
atgcaacaatttaatctaaaacaactacgagagaaaaaaggatttactcaaaatgaattagctgataaagctaacgttagtcgttcgctcgtggttggtttagaaacaggttcatattcagagacatctacagcatctctgaagaaattggcgaaagctttggacgtaaagattaaggatttatttttt

SEQ ID NO: 1526 - protein, 63 aa, Streptococcus agalactiae
MQQFNLKQLREKKGFTQNELADKANVSRSLVVGLETGSYSETSTASLKKLAKALDVKIKDLFF

SEQ ID NO: 1527 - DNA, 204 bp, Streptococcus pyogenes
atgaagaacctcaaattaaaagcagcgcgtgcaggcaaagatttgtctcaacaagctctagcagatttggtaggcgtctccagacaaaccattgcggctgttgaaaaaggtgattacaacccaacgattaatctttgcattgccatttgtcgagtgcttgataagactttagatgaccttttttgggaagctgatgattctcgt

SEQ ID NO: 1528 - protein, 68 aa, Streptococcus pyogenes
MKNLKLKAARAGKDLSQQALADLVGVSRQTIAAVEKGDYNPTINLCIAICRVLDKTLDDLFWEADDSR

SEQ ID NO: 1529 - DNA, 804 bp, Streptococcus agalactiae
atgattgaaagtcttgatataaagacgattttgcttggttctgctactctcttaggaactactgccataaagaaagctgaaaatcctgcaagagctattgatgatttaatgacattaattggttttgaaaaattacatgaaatagctgaaaatcgaagaaataagtacattactaacagaaacgattttattcaaaaattagctaaagaaatacaagatgttgttagtaaaaatattgaaaatctacaagaacctagtctttcgatagctggaccggctttagaagcatctaaattttatttagaagaagaagaacttagaaatttatttacaaaattgattgcttcatctatggataaatcaaaaaatgaattcaaccatccatcttttattgagataataaaacagtttgataaaattgatgcacaaaatttcaaaattatctcagatttatactttaaaaaaggtttcgttgcaactggtacctactatacgacaataattggtcaagataagccgttagagcatattgctagtcatgtattcgtagataatttagaacaaaatgatatagctattcaaagttcatcattaactaatttagaaagactaggactaattcaaattaattacaaagcacacgtagatgagaaagaatattacaacattcttaataatagctttataactaaaaagaacagtgaattaaaagaacaaaacaaaagagtactaacaaatctaggaatgataactcttactttatttggtgttagattttcaaaaacttgtttacctgacgtttcg

SEQ ID NO: 1530 - protein, 268 aa, Streptococcus agalactiae
MIESLDIKTILLGSATLLGTTAIKKAENPARAIDDLMTLIGFEKLHEIAENRRNKYITNRNDFIQKLAKEIQDVVSKNIENLQEPSLSIAGPALEASKFYLEEEELRNLFTKLIASSMDKSKNEFNHPSFIEIIKQFDKIDAQNFKIISDLYFKKGFVATGTYYTTIIGQDKPLEHIASHVFVDNLEQNDIAIQSSSLTNLERLGLIQINYKAHVDEKEYYNILNNSFITKKNSELKEQNKRVLTNLGMITLTLFGVRFSKTCLPDVS

SEQ ID NO: 1531 - DNA, 837 bp, Streptococcus pyogenes
atgattgattttagtaatatcgaaacatattggccaatgacttctagtgcttttggtttgtttattacccaaggtggtctgaaacctatctttacatcgctaaaccacatgtggtattcaaaatatggatacctaactgagcgaaaagcaaaattaaaagagattgaaaatgaatacatctatgagattgaaaaaagaaaattagaaaatcaagaaaaattcaaaaatgagattgattgcgaattttctaaaataccgcaaactagtttaaaagaacccgttgagtatatcttatatcctgcgataaatgagtcagagcaatatttaagtaacgaaacacttagaaatatgttcgctagaacgatagcttcaacatttaatcaggacaaagaaaaggatcttcactcagcttttgttcaaatcatcaaacaaatgacaccacttgatgcacaaaatctattattgataaatcaagagggaaataatctcattgcaaatctacaaataggagtacactacagtaaagaaaacctttcaggaaccgttaacaaggcaaataatatatacttatcaaagttagattactcaccagatattattgcttcttctattgataatttaaccagattagggctaatcaaagttgattatcttcattatccattggattcaaattatgaatcaattaaacaaacaacaatttacaaatctcttgaaagtgaaattaacactcttaatttattcaaaacatcaaacacaaaatatgatattaagattgaaaaaggaaaggtctccttaacagatttcggaaaaaaatttatttcagtttgtctagaa

SEQ ID NO: 1532 - protein, 279 aa, Streptococcus pyogenes
MIDFSNIETYWPMTSSAFGLFITQGGLKPIFTSLNHMWYSKYGYLTERKAKLKEIENEYIYEIEKRKLENQEKFKNEIDCEFSKIPQTSLKEPVEYILYPAINESEQYLSNETLRNMFARTIASTFNQDKEKDLHSAFVQIIKQMTPLDAQNLLLINQEGNNLIANLQIGVHYSKENLSGTVNKANNIYLSKLDYSPDIIASSIDNLTRLGLIKVDYLHYPLDSNYESIKQTTIYKSLESEINTLNLFKTSNTKYDIKIEKGKVSLTDFGKKFISVCLE

SEQ ID NO: 1533 - DNA, 186 bp, Streptococcus agalactiae
atggagtttatttatttactaattataccatcaatagtttcatttgttgtatctatcttttggtcaaaactagtcttcaaaaaagtagtagaaattatgacaaaaatggatgttgatcaacaagagctgaatgaaacaatgagagctcaaattttagaagaaatcaaaacattacgaaacgtcagg

SEQ ID NO: 1534 - protein, 62 aa, Streptococcus agalactiae
MEFIYLLIIPSIVSFVVSIFWSKLVFKKVVEIMTKMDVDQQELNETMRAQILEEIKTLRNVR

SEQ ID NO: 1535 - DNA, 156 bp, Streptococcus agalactiae
atgaattggaaaaaactaatgctaggcgatttagaacacacgtttactagtcgtgatggcaaggaaaaaacaagcgttgaatttgaaggcggcgtattgccagcactgttagtgctaggtggtatcacttggctgatcgcttggcttattacaaaa

SEQ ID NO: 1536 - protein, 52 aa, Streptococcus agalactiae
MNWKKLMLGDLEHTFTSRDGKEKTSVEFEGGVLPALLVLGGITWLIAWLITK

SEQ ID NO: 1537 - DNA, 156 bp, Streptococcus pyogenes
atgaattggaaaaaactaatgtttggcgatttagaacacacgtttactaatcatgatggcaaagaaaaaacaagcatcgaatttgaaggtggagttttaccagctctgttagtgttgggcggtattgcttggatgatcgcttggtttattacaaaa

SEQ ID NO: 1538 - protein, 52 aa, Streptococcus pyogenes
MNWKKLMFGDLEHTFTNHDGKEKTSIEFEGGVLPALLVLGGIAWMIAWFITK

SEQ ID NO: 1539 - DNA, 222 bp, Streptococcus agalactiae
atggctaaaaatcaacatgtcgtacctaaccctaatggcggttgggatataaaaggtgcaggcaacagtcgtgcgaccaaacacacaacaacccaagccgaagctgtcgaaatcgctactggtatcgctaaaaacaatagcagtgaagttattatccatggcaaaaatggacgaattcgcgaacgtaacagctatggtaacgatccattcccacctaaaggt

SEQ ID NO: 1540 - protein, 74 aa, Streptococcus agalactiae
MAKNQHVVPNPNGGWDIKGAGNSRATKHTTTQAEAVEIATGIAKNNSSEVIIHGKNGRIRERNSYGNDPFPPKG

SEQ ID NO: 1541 - DNA, 141 bp, Streptococcus agalactiae
gtggaagaatctatattgaactctaagcgctacacaaaacttgtcgtagagacagaagatggcaaaaaaatagcagaagttactttgacggaagcaacccctgctgatggatacgtgattaggttaacccctaattatgac

SEQ ID NO: 1542 - protein, 47 aa, Streptococcus agalactiae
MEESILNSKRYTKLVVETEDGKKIAEVTLTEATPADGYVIRLTPNYD

SEQ ID NO: 1543 - DNA, 888 bp, Streptococcus agalactiae
ttgtcaagtatgttggacaaaaaacttgaaaaaaatttttttgtactgtataatatgtttaaaatgttagacattatattaaaggaattcgatatgcatctaggaaaatatataaaaaagtatcgagataccaataatctgagcatggctgaattcgctaaagaatcaggcatcagcaaagcttacgtttctattcttgaaaaaaacagagatcctcgtaacggaaaagaaatcatcccatctattccgattataaagaaagtttctgacacaattggcatctcttttgatgatttattaaattcgctagacgaaaatcagatagtcgcgttaaatgaaacgaaaactgaaaaaaatctaacttcctctaccctacaaaaaatcacttctacttcttctcaattagaacaacctagacaagaaaaagtccttagcttcgctaacgaacaattagaagaacaaaataaagttgtttctatgttcgatagaaaagttgaggagacagaaaattatatcactgactacgttgaggggttagttgctgctggtctgggggcataccaagaagacaatttacatatggaagttaaactacgggctgatgatgtccccgataagtatgatactattgcgaaagtagctggtaattcaatggaaccacttattcaagataacgatttactgttcgtcaaggtatctagtcaagtcgatatgaatgatatagggatattccaagtcaatggaaaaaactttgtaaaaaaactcaaacgtgattatgacggcgcttggtacttgcaaagtttaaataaaagctatgaggaaatctatctttcagagaacgacaacatccgcacgataggagaagtcgtagatatttacagggagaat

SEQ ID NO: 1544 - protein, 296 aa, Streptococcus agalactiae
MSSMLDKKLEKNFFVLYNMFKMLDIILKEFDMHLGKYIKKYRDTNNLSMAEFAKESGISKAYVSILEKNRDPRNGKEIIPSIPIIKKVSDTIGISFDDLLNSLDENQIVALNETKTEKNLTSSTLQKITSTSSQLEQPRQEKVLSFANEQLEEQNKVVSMFDRKVEETENYITDYVEGLVAAGLGAYQEDNLHMEVKLRADDVPDKYDTIAKVAGNSMEPLIQDNDLLFVKVSSQVDMNDIGIFQVNGKNFVKKLKRDYDGAWYLQSLNKSYEEIYLSENDNIRTIGEVVDIYREN

SEQ ID NO: 1545 - DNA, 813 bp, Streptococcus pyogenes
ttgatttataatcatggttttgatataatttacttatcaaaattaaaaaggaggtatcctatggagcaattaggggaccgaataagaaagttgagagaagggcgcaacatgactcagactgaactttcagaaatattgggcatgaaaacctatactactgtttcaaagtgggagaagaatgaaaattttccaaaaggtaaagacctaaaaaaactagcagagattttcaacgttacctctgactatcttttaggactcacagatagtaaacttgggaaaatcacaatacagaacgaacaacctgaaatcgtttctatatacaaccaactagaacaacctagacaagaaaaagtcctcaacttcgctaacgaacaattagaagaacaaaataaaaccgtttctatattcgataaaaaatctgaggagacagaagattatatcactgactacgttgagggattggttgccgctggtcttggggcataccaagaagacaatttacacatgaaagttaaactacgttctgatgatgtccccgatgagtatgatactattgcaaaagtagctggcgattcaatggaaccacttattcaagacaacgatttgctattcatcaaggtatctagccaagtcgatatgaatgatatagggatattccaagtcaatggtaaaaactttgtaaaaaaactcaagcgtgattatgatggcgcttggtacttgcaaagtttaaataaaagctatgaggaaatctatctatcaaaggatgacgacatccgcacaatcggtgaagttgtggatatttatagggaatat

SEQ ID NO: 1546 - protein, 271 aa, Streptococcus pyogenes
LIYNHGFDIIYLSKLKRRYPMEQLGDRIRKLREGRNMTQTELSEILGMKTYTTVSKWEKNENFPKGKDLKKLAEIFNVTSDYLLGLTDSKLGKITIQNEQPEIVSIYNQLEQPRQEKVLNFANEQLEEQNKTVSIFDKKSEETEDYITDYVEGLVAAGLGAYQEDNLHMKVKLRSDDVPDEYDTIAKVAGDSMEPLIQDNDLLFIKVSSQVDMNDIGIFQVNGKNFVKKLKRDYDGAWYLQSLNKSYEEIYLSKDDDIRTIGEVVDIYREY

SEQ ID NO: 1547 - DNA, 555 bp, Streptococcus agalactiae
atgctggaaaaagttgaacgcttaatctcggaaattaatagaatacaccttgtttattcgcaagattattttgaaactgggaaagttgaaaagattaatctaaaacataccttttcaaaagtacctgttcaagcgattttagattaccgcttgaatttacacgaatctatcaatgattacttgatgaaagctgatgttaaggatattccttatgtctatcgcgtaaaaacatcggaaagtatcttagacaaaattgaacgtttttccaaaagacaagatggttatcctgtgaattctattctcaatgacatttttggcgctcgtatcattttatcttctgaggatatttcacaagtgatggaacaacttgatgaatggaaagataagtttgacttaaaaaactggtatttacgagataaagataattacacaggaatacacgtttatttcaagaataagagcaatcactactatccttgggagttgcaaatttgggatgagaaagatgttgatcagaacattgaaagccataaattatttaaacgtcattttgta

SEQ ID NO: 1548 - protein, 185 aa, Streptococcus agalactiae
MLEKVERLISEINRIHLVYSQDYFETGKVEKINLKHTFSKVPVQAILDYRLNLHESINDYLMKADVKDIPYVYRVKTSESILDKIERFSKRQDGYPVNSILNDIFGARIILSSEDISQVMEQLDEWKDKFDLKNWYLRDKDNYTGIHVYFKNKSNHYYPWELQIWDEKDVDQNIESHKLFKRHFV

SEQ ID NO: 1549 - DNA, 213 bp, Streptococcus agalactiae
ttgaaaatttatggagattatcacacgcacttatttagacactcgcatatatcatttttagcagaaaaagggataccgctaaatgcgataatggatagagttggtcacagcgatccaaaaacaacattatctatttacagtcacacaactgtaaatatgaaagaaattataaataaacaaactgccccttttgtgccccttttaaaatcggaa

SEQ ID NO: 1550 - protein, 71 aa, Streptococcus agalactiae
MKIYGDYHTHLFRHSHISFLAEKGIPLNAIMDRVGHSDPKTTLSIYSHTTVNMKEIINKQTAPFVPLLKSE

SEQ ID NO: 1551 - DNA, 282 bp, Streptococcus pyogenes
ttgaaaatttacggagattatcacacgcacttatttagacactcgcatatatcatttttagcagaaaaagggataccgctaaatgcgataatggatagagttggtcacagcgatccaaaaacaacattatctatttacagtcacacaactgtaaacatgaaagaaattataaataaacaaactgacccttttaaaaccggaataaaacaaaaagcctttgatgtaaaggctttttcagtgacaataatgacccctgccggaatcgaaccagcaactactcct

SEQ ID NO: 1552 - protein, 94 aa, Streptococcus pyogenes
LKIYGDYHTHLFRHSHISFLAEKGIPLNAIMDRVGHSDPKTTLSIYSHTTVNMKEIINKQTDPFKTGIKQKAFDVKAFSVTIMTPAGIEPATTP

SEQ ID NO: 1553 - DNA, 417 bp, Streptococcus agalactiae
gtgatggacgcacaaaaaacggctaatccgctgagacaagtacttaagattagtaagagaaggagaataaaaatgaatccattaattcaaagtttgacagaaggtcaacttcgttctgatatccctgagttccgtgctggtgatactgtacgtgttcacgctaaagttgtcgaaggtactcgcgaacgtattcagatctttgaaggtgttgttatctcacgtaaaggtcaaggaatctcagaaatgtacacagtacgtaaaatttctggtggtatcggtgtagagcgtacattcccaattcacactcctcgtgttgataaaatcgaagttgttcgttatggtaaagtacgtcgtgctaaactttactacttacgcgcattgcaaggtaaagctgcacgtattaaagaaatccgtcgt

SEQ ID NO: 1554 - protein, 139 aa, Streptococcus agalactiae
MMDAQKTANPLRQVLKISKRRRIKMNPLIQSLTEGQLRSDIPEFRAGDTVRVHAKVVEGTRERIQIFEGVVISRKGQGISEMYTVRKISGGIGVERTFPIHTPRVDKIEVVRYGKVRRAKLYYLRALQGKAARIKEIRR

SEQ ID NO: 1555 - DNA, 345 bp, Streptococcus pyogenes
atgaatccattaatccaaagtttgacagaaggtcaacttcgctctgatatccctaacttccgtcctggtgacactgttcgcgttcacgcaaaagttgtcgaaggaactcgcgaacgtatccagatctttgaaggtgttgttatttcacgtaaaggtcaagggatctcagaaatgtacactgttcgtaaaatctcaggtggtatcggggtagagcgtacattcccaatccacacaccacgtgttgacaaaatcgaagttatccgccacggtaaagtccgtcgtgcgaaactttactacttgcgtgcattacaaggtaaagcagctcgtatcaaagaaattcgtcgt

SEQ ID NO: 1556 - protein, 115 aa, Streptococcus pyogenes
MNPLIQSLTEGQLRSDIPNFRPGDTVRVHAKVVEGTRERIQIFEGVVISRKGQGISEMYTVRKISGGIGVERTFPIHTPRVDKIEVIRHGKVRRAKLYYLRALQGKAARIKEIRR

SEQ ID NO: 1557 - DNA, 387 bp, Streptococcus agalactiae
atgaaggctcargcgattgtcacaagccaagggagaattgtttctttggatattgcagtgaactattgccacgatatgaagttgttcaaaatgagtcgcagaaacatcggacaagctgctaaaatcttggcagacagtggttatcaagggatcatgaagatgtattcacaagcgcaaactccgaggaaatcaagcaaacttaagccactaactcttgaagataaaacctataaccatacgctatccaaagagagaatcaaggttgagaatatttttgccaaagtaaaaacgtttaaaatattttcaacaacctatcgaaatcgacgcaaacggtttggattacgaatgaatttgattgctggaatgatcaaccgtgaactaggattt

SEQ ID NO: 1558 - protein, 129 aa, Streptococcus agalactiae; identical to SEQ ID NO: 690

SEQ ID NO: 1559 - DNA, 453 bp, Streptococcus agalactiae
ttgctaaacccatataaacggattttcacacttggattgttagctacttttttattgtttatcttccattttggacgatattcaggactgggaacaaatctaattgaggctagcttcactaataagaacctttatgattatgattggttgttaaaattgtgtttgacagttattactttggctgcaggttatcagggaggagaagtaactcccttatttgcaatcggagcaagtttaggagtgattattgcgcccattttaggtttgccagttattttagttgctgctttaggctatactagcgtttttgggagtgcaacgaatactctgttaggtcctatcttaataggaggcgaagtctttggctttgccaacactccttattttgttattgtatgtcttgttgcttactccatatcacatgctcatacgatttatggtgctcaatctaga

SEQ ID NO: 1560 - protein, 151 aa, Streptococcus agalactiae
MLNPYKRIFTLGLLATFLLFIFHFGRYSGLGTNLIEASFTNKNLYDYDWLLKLCLTVITLAAGYQGGEVTPLFAIGASLGVIIAPILGLPVILVAALGYTSVFGSATNTLLGPILIGGEVFGFANTPYFVIVCLVAYSISHAHTIYGAQSR

SEQ ID NO: 1561 - DNA, 1272 bp, Streptococcus pyogenes
gtggtgacattaatgattaaatcaattgcaacactgcctaaaccttccttgaaagaagtgttaggactagtaggattagcacttcccatagggggcgcggttggagtggttgatgttatttttggcaaagggcttttgtttctttccgaatatcgcgatcaccaccttttcttgcttcttccatttcttgccctagcaggccttgttatcgtttttctttacgataagttaggcaaagaggttcgtcaagggatgggattggtttttcaggtagggcatggtcaaaaaaatcagattcctcctatgctcattcctcttattttgttctcaacttgggtaacccacttatttggagcgagtgcgggtagagaaggggtagccgttcaaataggagctactatctctcattattgtcggagatttgtgactagtcaagaagccgcacgacatcttttgattatggggatggcagccggttttgcagggctttttcaaacgccaattgctgctgtcgtatttgccctcgaggttttattagtaggaacgcttcgttattccgctttattgccttccttagttgctgcttacgtggcttcttggacttcccatgccttgggattagagaaatttacgattgttcttgaagaaacattgaccataactcccttaacattggttaaattaattgggttaggccttatttttggtctggtgggaaatagttttgcctatttacttggctggtttaaaccttacctcagtcaaaagctaccaaatccttatttccggattgcttttatcggtgctttgttatctatctgtctgatgattggtcacgtcggaagatatagtggtctaggaaccaatttgattgcggcagctttttctggccaaactatcctaacttacgactggcttttaaaaatgatcgtgacggtgattagcttatctgcaggctttcaaggtggtgaagtgacgcctctatttgctattggagcttctttaggcatcgttttggccccttacttaggtcttcctgtactgttggttgctgcacttggttacaccacggtatttggaagtgcaacaaataccttttgggcccctatctttattgggatagaggtctttggtccagagaatgccctagcatattttgtcacctcggctgcagcctatatggttagtcacagacattccatttacagttatcaaaaagtagtcatgatcaatttaaaagacatgacggtaaatcagatggatttaaaaaaa

SEQ ID NO: 1562 - protein, 424 aa, Streptococcus pyogenes
VVTLMIKSIATLPKPSLKEVLGLVGLALPIGGAVGVVDVIFGKGLLFLSEYRDHHLFLLLPFLALAGLVIVFLYDKLGKEVRQGMGLVFQVGHGQKNQIPPMLIPLILFSTWVTHLFGASAGREGVAVQIGATISHYCRRFVTSQEAARHLLIMGMAAGFAGLFQTPIAAVVFALEVLLVGTLRYSALLPSLVAAYVASWTSHALGLEKFTIVLEETLTITPLTLVKLIGLGLIFGLVGNSFAYLLGWFKPYLSQKLPNPYFRIAFIGALLSICLMIGHVGRYSGLGTNLIAAAFSGQTILTYDWLLKMIVTVISLSAGFQGGEVTPLFAIGASLGIVLAPYLGLPVLLVAALGYTTVFGSATNTFWAPIFIGIEVFGPENALAYFVTSAAAYMVSHRHSIYSYQKVVMINLKDMTVNQMDLKK

SEQ ID NO: 1563 - DNA, 714 bp, Streptococcus agalactiae
gtgattaaacgatttgataattatgctcagtacgtacttgttttaggttttagcttactaattggtggtgtggttggggctattacagcagtctttggacgtgttctattattcctgacagcctttagaagtgattatatagcttacctactcccttttcttagcattgttggtttatttatagtttttgtctatcaaaaatttgggggtaagagtgttaaagggatgggattggtatttgaagtaggtcatggtaatgaggagactattccgaaacgtcttgttcctctcgtgatattaacaacttggttaacccacttatttggtggtagtgcaggtcgtgagggggttgctgtacagattggggctaccgtttcacactactttcaaaaatattgccgtttacaaaacgcttctcaacttttcctagtaatgggaatggcagcaggttttgctggtttatttcagactcctttagctgctactttttttgcgattgaagttttggtagtaggtcgtttaatggtttcgtatgtattaccaagtttaattgctgccctgacagcaaatttcgtctcacattctttaggtttagaaaaattttctcatagtatagcaacatcaatggcgttaacaccagatattattctaaaattattggttttaggactatgttttggtctgtgtggtaatttattgctttattttattggc

SEQ ID NO: 1564 - protein, 238 aa, Streptococcus agalactiae
MIKRFDNYAQYVLVLGFSLLIGGVVGAITAVFGRVLLFLTAFRSDYIAYLLPFLSIVGLFIVFVYQKFGGKSVKGMGLVFEVGHGNEETIPKRLVPLVILTTWLTHLFGGSAGREGVAVQIGATVSHYFQKYCRLQNASQLFLVMGMAAGFAGLFQTPLAATFFAIEVLVVGRLMVSYVLPSLIAALTANFVSHSLGLEKFSHSIATSMALTPDIILKLLVLGLCFGLCGNLLLYFIG

SEQ ID NO: 1565 - DNA, 273 bp, Streptococcus agalactiae
atggaattagaagagattcgtcaagaaatagatgaaatagatcagcaattagtaagccttttagaaactagaatgggtctaattttagaggtcatagcatttaaaaagaaacatcgacttccagttttagataataatcgtgaaaacgaagtgcttaacaatgtattgaagaaagtccaaaaccatcaatttgacgatgtgatacgagcaactttcaaagacattatgacagaatctcgtgtttatcaaaaggagaatattgtagacggtgat

SEQ ID NO: 1566 - protein, 91 aa, Streptococcus agalactiae
MELEEIRQEIDEIDQQLVSLLETRMGLILEVIAFKKKHRLPVLDNNRENEVLNNVLKKVQNHQFDDVIRATFKDIMTESRVYQKENIVDGD

SEQ ID NO: 1567 - DNA, 282 bp, Streptococcus pyogenes
atgcgtttagaaaagatacgacaagaaatcaatggtattgatcaccacttggttgccttattagaaaagcggatggcacttgtagagcaagtaacagcttataaactagccaatcacttgcctgtcttagatcaggcgagggaaaatcagatcctagatagggtttcttatctcgttaaagaccaagcatttgagccagctatccatgagacatttaaaaccattatgtctctttcacggcagtatcaaacgcaacacttaacaggtggtgacattaatgat

SEQ ID NO: 1568 - protein, 94 aa, Streptococcus pyogenes
MRLEKIRQEINGIDHHLVALLEKRMALVEQVTAYKLANHLPVLDQARENQILDRVSYLVKDQAFEPAIHETFKTIMSLSRQYQTQHLTGGDIND

SEQ ID NO: 1569 - DNA, 2487 bp, Streptococcus agalactiae
ttgatgtatgcaaccaatattttaagacttggagtttctatgacattaacctttgggaaaccttctataacgatacgccgtctaggagtgataactagtacatatatgatgctaggttttatcttattatgtggatttttgcatcctagtacaatttatagtgaggaaataaaatctgatataaactcttttatatcaatagatgatgaaaaaactactgttcccatatttgactctactttagataagcttactaattcaatagaggagaggcagttagaattagattctgatacatcggacagtttaatagtagatgatcaaaaagataaagatatggtaatagtcttaggtgattctgacagtcaagaaaaattgtcacctcctctaaaatcggaaatagcgacagaagaaaatcgtaaacaggcaaatttagcagaactaaatgcaactcaacctaataatagaactacctatattatacccgaaagcagtcattccattgcagaacaacagagattcctgatagaatcaaagggttattcggttgcattacttaatagcgatgaatttagaaagacagcgagagaggatagaggttttgaaagggataagttgaggtctttggatatcattcctaagggagatttatcgacaagtaatgtcataggtaatacggacattgctagtcagatatcgttgggctttaaaaagaatgcgatacaggaacaccatcttactaaaacattctctcaaaaggatggaaagttatcgtctgttatagaggggatgcttgctattggcaaagagaaagtagagaaggaaataaaatatagtggtaatttatggcaaaaattaaaagctaaggcacactgccttgtttgctgtgttgataatttgaattttgaagatataaaatcttattttcaatattattgtcatctaaaccatcagctcaaattacctaaaggtgctatactttctgctaaaacagaagtatataggggaggagattttgggagaaaaaataaagataatgtgtttggttaccgtatcccctcattattaaaaacggaaaaaggaactttacttgtgggagctgatgaaagaattgagcaagcttgtgattggggaaacataggaatggttattcgccgtagtgaggatgatggtgtcacttggggaaaaagagaaactattgtcaatctccgtaataaccctagagttccgctagttactagtggtgactatagtggctcacctattaatatggatatggcattagttcaagatactagctctaagacgaaacgtattttttcaatatatgatatgtttccagaaggaagaggcgttattagtattgctaacacacctgaaaaagaatatacccaaatcggaggacagtcttatcttaatttatataataatggaaagaaatcgaaggtttttactatccgtgacaaaggtattgtatataattttaaagggaaaaagactgattatcatgttataacagaaactactaaaagtgaccattcaaatctaggggatatttataagggaaaacagctacttggaaatatatattttacaaaacataaaacgtcaccatttcgtttagcaaaatcaagctatgtgtggatgtcatatagcgatgatgatggtaggacatggtcatcacctagagatataacagcaagtcttcgtcagaaaggcatgaaatttttaggaataggacctggaaaaggtatagttttaaaatgggggccacacgctggtcgtattattattcctgcctattctacgaattggaaatctcatctaagaggttcacaatcttcacgcctaatttattcagacgaccatggaaaaacgtggcatactggaaaagcagtcaatgataaccgtatactttctaatggtgaaaaaattcactccttaacaatggataataaaaaagaacaaaatacagaatccgtacccgttcaattgaaaaatggggacattaagttatttatgaggaatctaactggtaacctagaagtagccacaagtaaagacggcggggagacttggcaaaaccatgttaaacgatataaggaagttcatgatgcttacgtccaattatcagctattcgctttgagcatgacaaaaaagagtatattttattagtgaatgctaatgggccaggtaagaagcgtcaagatggatatgcacgtctagcgcaagttaatcgaaatggtagttttaagtggttatatcaccatcacattcaagatggttcgtttgcttacaactctgttcaacaacttaataatgataaatttggtgtcctttatgaacatagagaaaaacatcaaaatagttttactttaaattacaaagtttttaattggagttttcttagtcaaaatacagagaagcaaggcactttatgggagaaaatggcagcaaattggcatgttttgtttaaattttattta

SEQ ID NO: 1570 - protein, 829 aa, Streptococcus agalactiae
MMYATNILRLGVSMTLTFGKPSITIRRLGVITSTYMMLGFILLCGFLHPSTIYSEEIKSDINSFISIDDEKTTVPIFDSTLDKLTNSIEERQLELDSDTSDSLIVDDQKDKDMVIVLGDSDSQEKLSPPLKSEIATEENRKQANLAELNATQPNNRTTYIIPESSHSIAEQQRFLIESKGYSVALLNSDEFRKTAREDRGFERDKLRSLDIIPKGDLSTSNVIGNTDIASQISLGFKKNAIQEHHLTKTFSQKDGKLSSVIEGMLAIGKEKVEKEIKYSGNLWQKLKAKAHCLVCCVDNLNFEDIKSYFQYYCHLNHQLKLPKGAILSAKTEVYRGGDFGRKNKDNVFGYRIPSLLKTEKGTLLVGADERIEQACDWGNIGMVIRRSEDDGVTWGKRETIVNLRNNPRVPLVTSGDYSGSPINMDMALVQDTSSKTKRIFSIYDMFPEGRGVISIANTPEKEYTQIGGQSYLNLYNNGKKSKVFTIRDKGIVYNFKGKKTDYHVITETTKSDHSNLGDIYKGKQLLGNIYFTKHKTSPFRLAKSSYVWMSYSDDDGRTWSSPRDITASLRQKGMKFLGIGPGKGIVLKWGPHAGRIIIPAYSTNWKSHLRGSQSSRLIYSDDHGKTWHTGKAVNDNRILSNGEKIHSLTMDNKKEQNTESVPVQLKNGDIKLFMRNLTGNLEVATSKDGGETWQNHVKRYKEVHDAYVQLSAIRFEHDKKEYILLVNANGPGKKRQDGYARLAQVNRNGSFKWLYHHHIQDGSFAYNSVQQLNNDKFGVLYEHREKHQNSFTLNYKVFNWSFLSQNTEKQGTLWEKMAANWHVLFKFYL

SEQ ID NO: 1571 - DNA, 1446 bp, Streptococcus agalactiae
atgcaggtatttttaaatattgtcaataaattctttgatccaattatccatatgggttcgggagttgtgatgctaattgtcatgacaggtttagccatgatatttggagtgaagttttctaaagcacttgaaggtggtattaagttagctattgctcttacgggtattggtgctattattggtattttaactggtgctttttctgaatcacttcaagcttttgttaaaaatacaggaatcaatctaagcattattgacgttggttgggctccattagcaactattacatggggatcaccatatacgctttacttcttattaatcatgcttattgtcaatattgttatgattgttatgaaaaaaacggataccttagatgttgatatttttgatatttggcatttatctatcacaggtcttttaattatgtggtatgctaaaaaaaataatctaccaacacttttatctgtcattattgcaactgtagctattatcttcgttggtgttctaaaaattatcaattctgatttgatgaaacctacctttgatgatttattggggacaggtccaacttctcccatgacttcaacgcatatgaattatatgatgaaccccattattatggttttggataagctttttgataaagtttttccagggctagataaatatgactttgacgcggctaaattaaataaagccattggattctggggctctaagttctttattggtatgattttaggacttgtcatagggattatgggcaaccccgtgttctcatttgcagcattaggtggctggttttctctcggttttacagcaggtgcttgtttagagttgttctctttgattggttcttggttcattgctgcagtagaaccactttctcaaggaattactaattttgctaatggtaaaatgcatggtcgtcgtttcaatattggtttggactggccatttattgccggacgtgcagagatttgggcatgtgctaacattcttgcaccgattatgctagtagaagctattttactctctaaagttggtaatggtattctaccgcttgctggtattatcgcaatgggcgtaacccctgctttactggttgttacacgtggccgtttaattcgtatgattacctttggaacattgctattaccgctatttcttttatcaggaacaatgattgccccatttgcaactgaattagctaaaaaggtaggcgcattcccagctggggcgcgagcaggttcacttatcactcactctacactagaaggccctatggagaaaatctttggttacgttattggtaaagcgacaacaggtcaattatcagcgattataacattaattatttttgcgacagcttatcttggtttgtttatgtggtatgctaaacaaatgaaacgccgtaatgcagaatatgcagctaatcaaaaa

SEQ ID NO: 1572 - protein, 482 aa, Streptococcus agalactiae
MQVFLNIVNKFFDPIIHMGSGVVMLIVMTGLAMIFGVKFSKALEGGIKLAIALTGIGAIIGILTGAFSESLQAFVKNTGINLSIIDVGWAPLATITWGSPYTLYFLLIMLIVNIVMIVMKKTDTLDVDIFDIWHLSITGLLIMWYAKKNNLPTLLSVIIATVAIIFVGVLKIINSDLMKPTFDDLLGTGPTSPMTSTHMNYMMNPIIMVLDKLFDKVFPGLDKYDFDAAKLNKAIGFWGSKFFIGMILGLVIGIMGNPVFSFAALGGWFSLGFTAGACLELFSLIGSWFIAAVEPLSQGITNFANGKMHGRRFNIGLDWPFIAGRAEIWACANILAPIMLVEAILLSKVGNGILPLAGIIAMGVTPALLVVTRGRLIRMITFGTLLLPLFLLSGTMIAPFATELAKKVGAFPAGARAGSLITHSTLEGPMEKIFGYVIGKATTGQLSAIITLIIFATAYLGLFMWYAKQMKRRNAEYAANQK

SEQ ID NO: 1573 - DNA, 1449 bp, Streptococcus agalactiae
atgatgcaaccttttttagacattattaacaagattctgggatttcctattcagttgggatcaggtgtggtcatgctgattgtcatgacaggtttagccatgattttcggggttaaattcacaaaggcactggaaggtgggattaagttagccatcgctttgacagggattggagccattattggaattttgacgggggctttttcagagtctttacaggcctttgttaaaaatacagggatcagtttaaacattattgatgtcggttgggcaccgcttgcaacaattacctggggttccccttacaccctttatttcttgctggtgatgctggtggttaatattgtcatgattgtcatgaaaaaaacggacacccttgacgtcgatatttttgatatttggcatttgtccattacgggtctattgattatgtggtatgcggctcgtaaccatttaccagtctttgtgtctcttttgattgctactgtggcagttattcttgttggggtactgaaaatcattaactctgatttgatgaaaccgacctttgatgaccttcttgggacagggcctcaatcaccaatgacttcaactcacatgaactacatgatgaatccaatcattatggtcttagataagatttttgacaaggtctttccggggctggataaatatgactttgatgctgctaaattgaacaaaaaaattggcttctggggctctaagttctttatcggaatggctctaggttttgtgattgggattatgggagatcctcatttcactgttgaatctatcaaaaattggtttggcctaggctttaccgcgggtgcctgcttggaacttttctctttgattggctcttggtttatcgcagctgttgagcctttgtcacaagggattaccaattttgccaatgctagaatgcatgggcgtcgtttcaatatcggtttggactggcccttcattgctggtcgtgctgaaatctgggcctgtgccaatattcttgccccaatcatgttgattgaagccgttctcctatcaaaagttggcaatgggattttaccactggcaggaattattgctatggggatgacaccagctcttcttgtggtcacacgtggtcgtttgattcgcatgattatttttggttccctcttattgccattattcctcttgtcaggaactatgattgctccatttgcgacagagttggctaaaaaagtaggggcttttccagcaggtacaagcgctggttccttgattacgcattcaacacttgaaggaccaatggaaaaaatttttggttatgtgattggtcaagcgacaacaggtcagattgcctcaatcatcacgctaatcatctttgtggccatttacctaagtctctttgcttggtatgctaaccaaatgaaggcacgtaacgctgaatatgcgaaaacaatgaaa

SEQ ID NO: 1574 - protein, 483 aa, Streptococcus pyogenes
MMQPFLDIINKILGFPIQLGSGVVMLIVMTGLAMIFGVKFTKALEGGIKLAIALTGIGAIIGILTGAFSESLQAFVKNTGISLNIIDVGWAPLATITWGSPYTLYFLLVMLVVNIVMIVMKKTDTLDVDIFDIWHLSITGLLIMWYAARNHLPVFVSLLIATVAVILVGVLKIINSDLMKPTFDDLLGTGPQSPMTSTHMNYMMNPIIMVLDKIFDKVFPGLDKYDFDAAKLNKKIGFWGSKFFIGMALGFVIGIMGDPHFTVESIKNWFGLGFTAGACLELFSLIGSWFIAAVEPLSQGITNFANARMHGRRFNIGLDWPFIAGRAEIWACANILAPIMLIEAVLLSKVGNGILPLAGIIAMGMTPALLVVTRGRLIRMIIFGSLLLPLFLLSGTMIAPFATELAKKVGAFPAGTSAGSLITHSTLEGPMEKIFGYVIGQATTGQIASIITLIIFVAIYLSLFAWYANQMKARNAEYAKTMK

SEQ ID NO: 1575 - DNA, 303 bp, Streptococcus agalactiae
atgatcaaaatattagcagcttgtggtgcaggcgtaaactcaagtcatcaaattaaagatgctatcgagacacaattaggagatagaggttacaatgtacattgtgatgctgttatggttaaggatatcactgaggaaatggtcaacaaatatgatatctttactcctattgctaaaactgatttaggttttaatgtaccaattccagttgtagaagcaggacctattctttatcgcataccagttatgagcgaaccggtctttactgctttagaacaagttatcaaagaacacaatctatca

SEQ ID NO: 1576 - protein, 101 aa, Streptococcus agalactiae
MIKILAACGAGVNSSHQIKDAIETQLGDRGYNVHCDAVMVKDITEEMVNKYDIFTPIAKTDLGFNVPIPVVEAGPILYRIPVMSEPVFTALEQVIKEHNLS

SEQ ID NO: 1577 - DNA, 303 bp, Streptococcus pyogenes
atgattaaaattctagcagcctgcggtgcaggggttaactcaagccatcaaattaaagatgcgattgaaactcagatgagtgaccgtggttacgatgttcactgtgatgcggtgatggtcaaagacatcacagaagaattggtgtctcgttatgatatttttacgccgattgcaaaaactgacttgggatttgagatgccgattcccatagtagaagcaggaccgattctctatcgtatcccaatcatgagtgagcctgtttttgctgaattagagcgcgtgattaaagaaaatcatttgcag

SEQ ID NO: 1578 - protein, 101 aa, Streptococcus pyogenes
MIKILAACGAGVNSSHQIKDAIETQMSDRGYDVHCDAVMVKDITEELVSRYDIFTPIAKTDLGFEMPIPIVEAGPILYRIPIMSEPVFAELERVIKENHLQ

SEQ ID NO: 1579 - DNA, 471 bp, Streptococcus agalactiae
gtgtttgctgtgactcaagatattttatttattgatgcccattctcaggaagaattatttgacttagtatcaaaagcattgataaaacaacactatgttagtcctaactaccgacaggcagtaaaagaaagggagagagagtttccaacggggttaaaaattgatttaaaagatgggactcctattcaatatgttgctattccacacactgaaacgcagtattgtctagtagatagaatcttttatgtcaaaaatagtcagccaattactttcaaacatatgattaatccagaagaggagtgtagggttcaggattttttcttcatcattaatagtaggaatagtaaccaaagtgatattttatctaatttgattaccttctttattacaaaaggaaacctagatcggctacatgagcttggcgacaataaagaaaaaattaatcattatttaatagaaaaaggagtgttt

SEQ ID NO: 1580 - protein, 157 aa, Streptococcus agalactiae
MFAVTQDILFIDAHSQEELFDLVSKALIKQHYVSPNYRQAVKEREREFPTGLKIDLKDGTPIQYVAIPHTETQYCLVDRIFYVKNSQPITFKHMINPEEECRVQDFFFIINSRNSNQSDILSNLITFFITKGNLDRLHELGDNKEKINHYLIEKGVF

SEQ ID NO: 1581 - DNA, 471 bp, Streptococcus pyogenes
gtgtttcctaatattctatttactgaagcaaggacgcagccagagctttttgatcttgttgctagccacttggaaaaggttgggtatgtgacgcaagagtaccatcaggctttagtggagcgtgaggcggtatttccgacaggactcaaagtggacctcaaagatgggtcagatattttgtatgcggctattccgcatacagaaaccaagtattgcttggttgatcaagtggtctatgttagaaatagtcaagcccttacctttaagcacatgattaatccagaggaagactgtttggtaacggatttcttctttattatcaatagtcaaaacgagggtcaaacgacgattctatccaatctcattaccttctttattacgaaaggcaatcttagctatctagccagtctaaaagatgataaacaagctatttcaaactatttaatagaaaaaggagtgtttcagcatgat

SEQ ID NO: 1582 - protein, 157 aa, Streptococcus pyogenes
VFPNILFTEARTQPELFDLVASHLEKVGYVTQEYHQALVEREAVFPTGLKVDLKDGSDILYAAIPHTETKYCLVDQVVYVRNSQALTFKHMINPEEDCLVTDFFFIINSQNEGQTTILSNLITFFITKGNLSYLASLKDDKQAISNYLIEKGVFQHD

SEQ ID NO: 1583 - DNA, 774 bp, Streptococcus agalactiae
atgttaaagcgagaaagattacaaaaaataatagaaaaagtcaatataaatggcattgtcactgttaatgaaatcatggaagaacttgatgtatcagacatgactgttaggcgtgacttggatgaattagataaagcaggactgttaatacgcatccatggtggtgcacaaaaagtaaatgcatcaccaactccacaaaattatgaaaaatcaaacactgaaaaatacgatattcaaacaaatgaaaaattagaaattgcccaatttgcaaaacaattcatcaatgatggtgaaacaatctttattgggcctggaacaaccttagagaaattagccacgcaattacttgattttaaaattagggtagtaaccaatagccttcctgttttcaatattctgaatcaaagttcaacacttgaccttatccttgtagggggagagtacagagaaattactggtgcttttgtcggttctgttactattaactctattaaatcacttaatttttcaaaagctttcgttagtagtaatggtgtttttgaaaagtctatcgctacttacgacgagggagaaggtgaaattcagcgcattgctcttaataattcctttgaaaaattccttttagttgatagccaaaaatttggtaaatatgatttttatactttttatcaattagacgatattgattttgtattaacagatcataatattgataatgttgttaaggagcaatacagtagcttcaccaaaattttaactaataacaattacatg

SEQ ID NO: 1584 - protein, 258 aa, Streptococcus agalactiae
MLKRERLQKIIEKVNINGIVTVNEIMEELDVSDMTVRRDLDELDKAGLLIRIHGGAQKVNASPTPQNYEKSNTEKYDIQTNEKLEIAQFAKQFINDGETIFIGPGTTLEKLATQLLDFKIRVVTNSLPVFNILNQSSTLDLILVGGEYREITGAFVGSVTINSIKSLNFSKAFVSSNGVFEKSIATYDEGEGEIQRIALNNSFEKFLLVDSQKFGKYDFYTFYQLDDIDFVLTDHNIDNVVKEQYSSFTKILTNNNYM

SEQ ID NO: 1585 - DNA, 768 bp, Streptococcus pyogenes
atgttaaaaagagaaagacttctaaaaattaccgaaatagtcaatgagcaaggtattgttactgtgaatgatattattcagactttaaacgtttctgatatgacagttcgtagagacttagatgaactggaaaaagccggcaaattgatccgcatccatggaggtgcacaaagcattaccatgcctaataaaaaagagcggtcaaatattgaaaaacaaaccgttcaaacaaaggaaaaatgggaactagcttcatatgcgacacaactagtcaatgatggtgaaacaatctttattggtccaggaacaactttagaatgtttcgctgagcagttaaaaaatcgtcagattcgcattgtgaccaatagcctccctgtctttaacatccttcaggacagcgaaaccattgacctgattcttatcggtggtgaataccgatctattacaggagcttttgtagggtcccttgccagtcaaaatatctcatccttaaaatttgccaaggcttttattagctgtaatggtatttataaaaacgatattgcaacttatagcgaaactgaaggagagattcaaaagctagcttttaataattctattgaaaaatacctcttggtagataaccaaaaattcaatgcctacgacttcttcattttttaccatttaaacaacattgatgctgttgttacagattcgcaaataactgaggacgttatcgaacgttatagtcagttcacgcaattattagtagcccacgaaaacaaggag

SEQ ID NO: 1586 - protein, 256 aa, Streptococcus pyogenes
MLKRERLLKITEIVNEQGIVTVNDIIQTLNVSDMTVRRDLDELEKAGKLIRIHGGAQSITMPNKKERSNIEKQTVQTKEKWELASYATQLVNDGETIFIGPGTTLECFAEQLKNRQIRIVTNSLPVFNILQDSETIDLILIGGEYRSITGAFVGSLASQNISSLKFAKAFISCNGIYKNDIATYSETEGEIQKLAFNNSIEKYLLVDNQKFNAYDFFIFYHLNNIDAVVTDSQITEDVIERYSQFTQLLVAHENKE

SEQ ID NO: 1587 - DNA, 1137 bp, Streptococcus agalactiae
atgacacatgagcattgggtaccaaagaaagatttatcagagtcggaattaaaagcagctcaagaatttctttcaggaaaatctgaagcaaatcaagacaaaccaaaaacaggtaaaacagctcaagaaatctatgaggcaattgaaccaaaagcaattgttaaacctgaagatttattatttggaattgcacaagcgacagactataagaatggtacatttgtaattcctcataaagatcattaccattatgtggaattaaaatggtttgatgaagaaaaagatcttttagctgattcagataagacatattctttagaagactatttagctacggctaaatattacatgatgcacccagaaaaacgtcctaaagttgaaggatggggtaaagatgctgaaatttataaggaaaaggactctaataaagcagataaaccaagtcctgcaccaactgataataaatcaacatcaaattctagtgacaaaaacttaagtgctgcagaagtattcaaacaagcaaaaccagaaaaaattgtaccgcttgataaaattgctgctcacatggcatatgcagttggatttgaagatgatcaattgattgttcctcatcatgatcattatcataatgttcctatggcatggtttgacaagggtggtttatggaaagcaccagaaggctatacattacaacaactcttctcaacaattaaatactacatggaacatcctaatgaattaccaaaagaaaaaggttggggacacgacagtgatcataacaaaggctcaaataaagacaataaagccaaaaattatgctccagatgaagaacctgaagattcagggaaagtaactcacaactatggtttttatgatgttaataaagggtcagacgaagaagaaccagaaaaacaagaagatgaatcagagctagatgaatatgaactaggaatggcacaaaacgctaagaaatatggtatggatagacaatcttttgaaaagcaactcatccaattatcaaataaatatagtgtaagttttgaaagctttaattatattaatggtagtcaagttcaagttactaaaaaagatggctctaaagtgcttgttgatattaaaacactaacagaagtgaaa

SEQ ID NO: 1588 - protein, 379 aa, Streptococcus agalactiae
MTHEHWVPKKDLSESELKAAQEFLSGKSEANQDKPKTGKTAQEIYEAIEPKAIVKPEDLLFGIAQATDYKNGTFVIPHKDHYHYVELKWFDEEKDLLADSDKTYSLEDYLATAKYYMMHPEKRPKVEGWGKDAEIYKEKDSNKADKPSPAPTDNKSTSNSSDKNLSAAEVFKQAKPEKIVPLDKIAAHMAYAVGFEDDQLIVPHHDHYHNVPMAWFDKGGLWKAPEGYTLQQLFSTIKYYMEHPNELPKEKGWGHDSDHNKGSNKDNKAKNYAPDEEPEDSGKVTHNYGFYDVNKGSDEEEPEKQEDESELDEYELGMAQNAKKYGMDRQSFEKQLIQLSNKYSVSFESFNYINGSQVQVTKKDGSKVLVDIKTLTEVK

SEQ ID NO: 1589 - DNA, 2475 bp, Streptococcus pyogenes
gtgaagaaaacatatggttatatcggctcagttgctgctattttactagctactcatattggaagttaccaacttggtaagcatcatatgggttcagcaacaaaggacaatcaaattgcctatattgatgatagcaaaggtaaggcaaaagcccctaaaacaaacaaaacgatggatcaaatcagtgctgaagaaggcatctctgctgaacagatcgtagtcaaaattactgaccaaggctatgtgacctcacatggtgaccattatcatttttacaatgggaaagttccttatgatgcgattattagtgaagagttgttgatgacggatcctaattaccgttttaaacaatcagacgttatcaatgaaatcttagacggttacgttattaaagtcaatggcaactattatgtttacctcaagccaggtagcaagcgcaaaaacattcgaaccaaacaacaaattgctgagcaagtagccaaaggaactaaagaagctaaagaaaaaggtttagctcaagtggcccatctcagtaaagaagaagttgcggcagtcaatgaagcaaaaagacaaggacgctatactacagacgatggctatatttttagtccgacagatatcattgatgatttaggagatgcttatttagtacctcatggtaatcactatcattatattcctaaaaaggatttgtctccaagtgagctagctgctgcacaagcctactggagtcaaaaacaaggtcgaggtgctagaccgtctgattaccgcccgacaccagccccagccccaggtcgtaggaaagccccaattcctgatgtgacgcctaaccctggacaaggtcatcagccagataacggtggctatcatccagcgcctcctaggccaaatgatgcgtcacaaaacaaacaccaaagagatgagtttaaaggaaaaacctttaaggaacttttagatcaactacaccgtcttgatttgaaataccgtcatgtggaagaagatgggttgatttttgaaccgactcaagtgatcaaatcaaacgcttttgggtatgtggtgcctcatggagatcattatcatattatcccaagaagtcagttatcacctcttgaaatggaattagcagatcgatacttagccggccaaactgaggacgatgactcaggttcagatcactcaaaaccatcagataaagaagtgacacatacctttcttggtcatcgcatcaaagcttacggaaaaggcttagatggtaaaccatatgatacgagtgatgcttatgtttttagtaaagaatccattcattcagtggataaatcaggagttacagctaaacacggagatcatttccactatataggatttggagaacttgaacaatatgagttggatgaggtcgctaactgggtgaaagcaaaaggtcaagctgatgagcttgctgctgctttggatcaggaacaaggcaaagaaaaaccactctttgacactaaaaaagtgagtcgcaaagtaacaaaagatggtaaagtgggctatatgatgccaaaagatggcaaggactatttctatgctcgtgatcaacttgatttgactcagattgcctttgccgaacaagaactaatgcttaaagataagaaacattaccgttatgacattgttgacacaggtattgagccacgacttgctgtagatgtgtcaagtctgccgatgcatgctggtaatgctacttacgatactggaagttcgtttgttatccctcatattgatcatatccatgtcgttccgtattcatggttgacgcgcgatcagattgcaacaatcaagtatgtgatgcaacaccccgaagttcgtccggatatatggtctaagccagggcatgaagagtcaggttcggtcattccaaatgttacgcctcttgataaacgtgctggtatgccaaactggcaaattatccattctgctgaagaagttcaaaaagccctagcagaaggtcgttttgcaacaccagacggctatattttcgatccacgagatgttttggccaaagaaacttttgtatggaaagatggctcctttagcatcccaagagcagatggcagttcattgagaaccattaataaatctgatctatcccaagctgagtggcaacaagctcaagagttattggcaaagaaaaacgctggtgatgctactgatacggataaacccaaagaaaagcaacaggcagataagagcaatgaaaaccaacagccaagtgaagccagtaaagaagaagaaaaagaatcagatgactttatagacagtttaccagactatggtctagatagagcaaccctagaagatcatatcaatcaattagcacaaaaagctaatatcgatcctaagtatctcattttccaaccagaaggtgtccaattttataataaaaatggtgaattggtaacttatgatatcaagacacttcaacaaataaaccct

SEQ ID NO: 1590 - protein, 825 aa, Streptococcus pyogenes
VKKTYGYIGSVAAILLATHIGSYQLGKHHMGSATKDNQIAYIDDSKGKAKAPKTNKTMDQISAEEGISAEQIVVKITDQGYVTSHGDHYHFYNGKVPYDAIISEELLMTDPNYRFKQSDVINEILDGYVIKVNGNYYVYLKPGSKRKNIRTKQQIAEQVAKGTKEAKEKGLAQVAHLSKEEVAAVNEAKRQGRYTTDDGYIFSPTDIIDDLGDAYLVPHGNHYHYIPKKDLSPSELAAAQAYWSQKQGRGARPSDYRPTPAPAPGRRKAPIPDVTPNPGQGHQPDNGGYHPAPPRPNDASQNKHQRDEFKGKTFKELLDQLHRLDLKYRHVEEDGLIFEPTQVIKSNAFGYVVPHGDHYHIIPRSQLSPLEMELADRYLAGQTEDDDSGSDHSKPSDKEVTHTFLGHRIKAYGKGLDGKPYDTSDAYVFSKESIHSVDKSGVTAKHGDHFHYIGFGELEQYELDEVANWVKAKGQADELAAALDQEQGKEKPLFDTKKVSRKVTKDGKVGYMMPKDGKDYFYARDQLDLTQIAFAEQELMLKDKKHYRYDIVDTGIEPRLAVDVSSLPMHAGNATYDTGSSFVIPHIDHIHVVPYSWLTRDQIATIKYVMQHPEVRPDIWSKPGHEESGSVIPNVTPLDKRAGMPNWQIIHSAEEVQKALAEGRFATPDGYIFDPRDVLAKETFVWKDGSFSIPRADGSSLRTINKSDLSQAEWQQAQELLAKKNAGDATDTDKPKEKQQADKSNENQQPSEASKEEEKESDDFIDSLPDYGLDRATLEDHINQLAQKANIDPKYLIFQPEGVQFYNKNGELVTYDIKTLQQINP

SEQ ID NO: 1591 - DNA, 1398 bp, Streptococcus agalactiae
atgaatcgtaaaaaaacagttattattagtgctttatcagtagctctatttggtactggtgtaggtgcttaccaattaggtagctataatgcccaaaaatcagacaatagtgtttcttatgtgaaaacagataaatctgatagcaaagcacaagcaacagctgtaaataaaacgcccgaccaaatcagtaaagaagaaggcatatctgcagaacaaatcgttgttaaaattactgacgacggttatgtgacttctcatggagaccattaccattattacaatgggaaagtgccatatgatgccatcattagtgaagaattgattatgaaagaccctagctatgtctttaataaagctgatgtcattaatgaagtcaaagatggttatattatcaaagttaacggtaagtattacctctatcttaaagaaggtagcaaacgaacaaatgttcgtacaaaggaacaaatccaaaagcaacgcgaagaatggtctaagggtggttctaagggagaatcaggaaagcatagtagtgcaaaaactcaagctttatcagccagcgtacgtgaagcgaaagctagcggtcgctatactacagatgatggttatgtttttagtccaacagatgtcattgatgacatgggagatgcctttttagtaccacatggcgatcatttccattatatcccgaaagctgatttatctccatcagagttatcagccgcacaggcatattggaaccgcaagactggccgatcaggtaatagctcaaaaccatcaaattcaagttcatacattcatgcaagtgcaccaagcggtaatgtatcaacaggaagacatgctaatgcccctatttctattccaagagtcactcacgcaaatcactggtcaaaaccagctggtaatcatgctacggcaccaaaacaccatgcacctacaaccaaaccaatcaacaaagattctgctttagacaaaatgttgaaacgtttatatgctcaaccgttatatgctcgtcacgtagaaagtgatggtttggtttatgacccagcacaagttaatgctttcacagcaatcggtgtttctattccgcacggtaatcatttccactttattcactataaggatatgtctccattagagttagaagcaacaaggatggtggcagagcatagaggacatcatattgatgcattagggaaaaaagattctacagagaaaccaaagcatatttctcatgaacctaataaggaacctcacacagaggaagaacaccatgcagtaacaccgaaagaccaacgtaaaggcaaaccaaatagccagattgtctacagtgctcaagaaattgaagaggcaaaaaagctggtaaatacacaacatctgatggttacattatatgacaca

SEQ ID NO: 1592 - protein, 466 aa, Streptococcus agalactiae
MNRKKTVIISALSVALFGTGVGAYQLGSYNAQKSDNSVSYVKTDKSDSKAQATAVNKTPDQISKEEGISAEQIVVKITDDGYVTSHGDHYHYYNGKVPYDAIISEELIMKDPSYVFNKADVINEVKDGYIIKVNGKYYLYLKEGSKRTNVRTKEQIQKQREEWSKGGSKGESGKHSSAKTQALSASVREAKASGRYTTDDGYVFSPTDVIDDMGDAFLVPHGDHFHYIPKADLSPSELSAAQAYWNRKTGRSGNSSKPSNSSSYIHASAPSGNVSTGRHANAPISIPRVTHANHWSKPAGNHATAPKHHAPTTKPINKDSALDKMLKRLYAQPLYARHVESDGLVYDPAQVNAFTAIGVSIPHGNHFHFIHYKDMSPLELEATRMVAEHRGHHIDALGKKDSTEKPKHISHEPNKEPHTEEEHHAVTPKDQRKGKPNSQIVYSAQEIEEAKKLVNTQHLMVTLYDT

SEQ ID NO: 1593 - DNA, 921 bp, Streptococcus agalactiae
atgaaaaggatacggaaaagccttatttttgttctcggagtagttaccctaatttgcttatgtgcttgtactaaacaaagccagcaaaaaaatggcttgtcagtagtgactagcttttatccagtatattccattacaaaagcagtttctggtgatttgaatgatattaaaatgattcgatcacagtcaggtattcatggttttgaaccctcatcaagtgatgttgctgccatttatgatgctgatctatttctttatcattcgcacacactagaagcttgggcgagacgtttggaacctagtttgcatcactctaaagtatctgtaattgaagcttcaaaaggtatgactttggataaagttcatggcttagaagatgtagaggcagaaaaaggagtagatgagtcaaccttgtatgaccctcacacttggaatgaccctgtaaaagtatctgaggaagcacaactcatcgctacacaattagctaaaaaggatcctaaaaacgctaaggtttatcaaaaaaatgctgatcaatttagtgacaaggcaatggctattgcagagaagtataagccaaaatttaaagctgcaaagtctaaatactttgtgacttcacatacagcattctcatacttagctaagcgatacggattgactcagttaggtattgcaggtgtctcaaccgagcaagaacctagtgctaaaaaattagccgaaattcaggagtttgtgaaaacatataaggttaagactatttttgttgaagaaggagtctcacctaaattagctcaagcagtagcttcagctactcgagttaaaattgcaagtttaagtcctttagaagcagttcccaaaaacaataaagattacttagaaaatttggaaactaatcttaaggtacttgtcaaatcgttaaatcaa

SEQ ID NO: 1594 - protein, 307 aa, Streptococcus agalactiae
MKRIRKSLIFVLGVVTLICLCACTKQSQQKNGLSVVTSFYPVYSITKAVSGDLNDIKMIRSQSGIHGFEPSSSDVAAIYDADLFLYHSHTLEAWARRLEPSLHHSKVSVIEASKGMTLDKVHGLEDVEAEKGVDESTLYDPHTWNDPVKVSEEAQLIATQLAKKDPKNAKVYQKNADQFSDKAMAIAEKYKPKFKAAKSKYFVTSHTAFSYLAKRYGLTQLGIAGVSTEQEPSAKKLAEIQEFVKTYKVKTIFVEEGVSPKLAQAVASATRVKIASLSPLEAVPKNNKDYLENLETNLKVLVKSLNQ

SEQ ID NO: 1595 - DNA, 918 bp, Streptococcus pyogenes
atgaaaaaaggtttttttctcatggctatggtcgtgagtttagtaatgatagcagggtgtgataagtcagcaaaccccaaacagcctacgcaaggcatgtcagttgtaaccagcttttacccaatgtatgcgatgacaaaagaagtatctggagacctcaatgatgtgaggatgatccaatcaggtgcaggcattcattcctttgaaccgtctgtaaatgatgtggcagctatttatgacgcggatttgtttgtttaccattcacataccttagaagcttgggcaagggatctagaccctaatttaaaaaaatcaaaggttgatgtgtttgaagcgtcaaaacctttgacactagatagagtcaaagggctagaagatatggaagtcacacaaggcattgatcctgcgacactttatgacccacatacctggacagatcccgttttagctggtgaggaagctgttaatatcgctaaagagctaggacgtttggatcctaaacacaaagacagttacactaaaaatgctaaggctttcaaaaaagaagcagagcaactaactgaagaatacactcaaaaatttaaaaaggtgcgctcaaaaacattcgtgacgcagcacacggcattttcttatctggctaaacgattcggcttgaaacaacttggtatctcgggcatttccccagagcaagagccctctcctcgccaattgaaagaaattcaagactttgttaaagaatacaacgtcaagactatttttgcagaagacaatgtcaatcccaaaattgctcatgctattgcgaaatcaacaggagctaaagtaaagacattaagtccacttgaagctgctccaagcggaaacaagacatatctagaaaatcttagagcaaatttggaagtgctctatcaacagttgaag

SEQ ID NO: 1596 - protein, 306 aa, Streptococcus pyogenes
MKKGFFLMAMVVSLVMIAGCDKSANPKQPTQGMSVVTSFYPMYAMTKEVSGDLNDVRMIQSGAGIHSFEPSVNDVAAIYDADLFVYHSHTLEAWARDLDPNLKKSKVDVFEASKPLTLDRVKGLEDMEVTQGIDPATLYDPHTWTDPVLAGEEAVNIAKELGRLDPKHKDSYTKNAKAFKKEAEQLTEEYTQKFKKVRSKTFVTQHTAFSYLAKRFGLKQLGISGISPEQEPSPRQLKEIQDFVKEYNVKTIFAEDNVNPKIAHAIAKSTGAKVKTLSPLEAAPSGNKTYLENLRANLEVLYQQLK

SEQ ID NO: 1597 - DNA, 441 bp, Streptococcus agalactiae
atgaaaatcattattcaacgtgttaatcaagcaagtgtttctattgaagatgatgtagtcggatctattgagaagggtttagtacttctagttgggattgctccagaagatacaacagaagatattgcttatgcagttcgtaaaattactagcatgcgtattttttctgatgatgaggggaaaatgaacctttcaattcaagacattaaaggaagcgtcttatctatctcacaatttacactctttgcagataccaaaaaaggaaatcgtccagcttttactggggcagctgatcctgttaaagcgaatcagttttatgatatctttaatcaagaattagcaaatcatgtttcggtagaaacaggtcaatttggagctgatatgcaagtcagtctgattaatgatggaccagtaactatcgttttagatactaaaaataaa

SEQ ID NO: 1598 - protein, 147 aa, Streptococcus agalactiae
MKIIIQRVNQASVSIEDDVVGSIEKGLVLLVGIAPEDTTEDIAYAVRKITSMRIFSDDEGKMNLSIQDIKGSVLSISQFTLFADTKKGNRPAFTGAADPVKANQFYDIFNQELANHVSVETGQFGADMQVSLINDGPVTIVLDTKNK

SEQ ID NO: 1599 - DNA, 441 bp, Streptococcus pyogenes
atgaaacttgtcttgcaacgggtcaaagaggcctctgtttctattgatgggaaaattgctggcgctattaatcaagggttgttgttgttagtaggtgtgggaccagatgataatgcagaagatttggcttacgctgtgcgaaaaatagtcaacatgcgcattttttcagatgctgatggcaagatgaaccagtctatccaagacatcaagggcagtatcttatctgtgtcgcaatttaccctttatgctgacaccaaaaagggaaaccgtcctgcctttactggtgctgctaagccagatttggctagtcagttgtatgatagctttaatgaacaattggcagagtttgtgccagttgagcgtggcgtttttggggcagatatgcaggttagtctcatcaatgatggaccagttacgattattttagacacgaaatgtcac

SEQ ID NO: 1600 - protein, 147 aa, Streptococcus pyogenes
MKLVLQRVKEASVSIDGKIAGAINQGLLLLVGVGPDDNAEDLAYAVRKIVNMRIFSDADGKMNQSIQDIKGSILSVSQFTLYADTKKGNRPAFTGAAKPDLASQLYDSFNEQLAEFVPVERGVFGADMQVSLINDGPVTIILDTKCH

SEQ ID NO: 1601 - DNA, 2214 bp, Streptococcus agalactiae
atggtcaaagaaattaatttaacaggagaagaggttgttgcaatcacatcccagtacatgagtgagacggatgttgcttttgtaaaatttgccttaaattacgcaaccgcagctcattattatcaagcaagaaagtcgggcgagccctacattattcatccaattcaagtagcaggtattcttgcagatttacaccttgatgccgttacggtagcttgtggttttttacatgatgttgtagaagatacggaaattacccttgatgagattgaaactgattttggcaaggatgttcgcgatattattgacggcgtaacaaaattgggtaaagtggagtacaaatctcatgaagaacagttagcagaaaatcaccgtaaaatgttaatggctatgtctaaggatatccgtgttattttggttaagctcgctgaccgcttacataatatgagaacccttaaacacctcagaaaagataaacaagagcgtatttcacgtgagactatggaaatatacgctcctttagcgcatcgtttggggattagtcgtatcaagtgggaattagaagatttatcttttcgttacttgaatgagacggaattttataagatttctcatatgatgagtgaaaaacgtcgtgaacgcgaagagttggttgatataattgtcgataaaatcagatcctatactgaggaacagggtttatatggtgatatttatggtagaccaaaacacatttattctatttacagaaaaatgcgtgataaaaagaaacgctttgatcagatttatgatttaattgcgatacgctgtatcatggaaactgctagtgatgtttatgccatggtggggtatatccatgagttatggcgtcctatgccaggaaggtttaaagattatattgcggcaccaaaggccaatggttatcaatctattcacacgacggtttatggacctaaagggccaattgaaattcagattcgaactaaagaaatgcatcaagttgccgagtttggtgttgcagcccattgggcctataaaaaaggaatcaccagtaaggttaatcaagcagagcaatcggttggtatgggatggattcaagaattagttgagcttcaagatgaatcaaaagacgccaaggattttgttgactctgttaaggaagatatctttacagaacgcatctatgtttttaccccaaatggtgctgttcaggaattgccaagggaatctggaccaattgattttgcttatgctattcacacgcaagttggagaaaaagctactggcgctaaagtaaatggacgtatggttccattgactgctaagttaaaaacaggagatgttgttgagattatcacaaaccctaattcatttggaccaagtcgtgactggattaagattgttaagaccaataaagctcgcaataaaattcgtcagttcttcaaaaaccaagataaagaaacttctattaataaaggtagagaattactggttgattatttccaagaacaaggttatgtgcctaacaaatatttagataagaaacatattgaagaaatccttccacgtgtcagtgttaaaagtgaggaagctttgtatgcagccgtaggttttggtgatttgagtccgattagtatttttaataaactgacggaaaaagaacgccgtgaggaggaacgtgctaaggctaaagcggaagcagacgaacttattaacggtggtgaaatcaaaaccgataagcgtgatgttctcaaagttaagagtgaaaatggtgttatcattcaaggagcttcaggtttattaatgcgtattgcaaaatgttgtaatcccgttcctggagatctcattgaaggctatataactaaaggtagaggcgtggctatccatcgttcagattgtcaaaatttaaagagtcaggagaactacgaacaacgtttgattgatgttgagtgggatgatgatggatctaaaaaagagtacatggctgaaatcgatatttatggtttgaatcgtagtggcctccttaatgatgttcttcaaaccttatcaaatgcaacaaagctagtatcgacagtaaatgcacaaccaacaaaagatatgaaatttgctaatattcatgttagctttggaatttcaaatttagcacaattgacaactgtggttgataaaatcaaaattatcccagatgtttattctgttaaacgtacgaatggt

SEQ ID NO: 1602 - protein, 738 aa, Streptococcus agalactiae
MVKEINLTGEEVVAITSQYMSETDVAFVKFALNYATAAHYYQARKSGEPYIIHPIQVAGILADLHLDAVTVACGFLHDVVEDTEITLDEIETDFGKDVRDIIDGVTKLGKVEYKSHEEQLAENHRKMLMAMSKDIRVILVKLADRLHNMRTLKHLRKDKQERISRETMEIYAPLAHRLGISRIKWELEDLSFRYLNETEFYKISHMMSEKRREREELVDIIVDKIRSYTEEQGLYGDIYGRPKHIYSIYRKMRDKKKRFDQIYDLIAIRCIMETASDVYAMVGYIHELWRPMPGRFKDYIAAPKANGYQSIHTTVYGPKGPIEIQIRTKEMHQVAEFGVAAHWAYKKGITSKVNQAEQSVGMGWIQELVELQDESKDAKDFVDSVKEDIFTERIYVFTPNGAVQELPRESGPIDFAYAIHTQVGEKATGAKVNGRMVPLTAKLKTGDVVEIITNPNSFGPSRDWIKIVKTNKARNKIRQFFKNQDKETSINKGRELLVDYFQEQGYVPNKYLDKKHIEEILPRVSVKSEEALYAAVGFGDLSPISIFNKLTEKERREEERAKAKAEADELINGGEIKTDKRDVLKVKSENGVIIQGASGLLMRIAKCCNPVPGDLIEGYITKGRGVAIHRSDCQNLKSQENYEQRLIDVEWDDDGSKKEYMAEIDIYGLNRSGLLNDVLQTLSNATKLVSTVNAQPTKDMKFANIHVSFGISNLAQLTTVVDKIKIIPDVYSVKRTNG

SEQ ID NO: 1603 - DNA, 2229 bp, Streptococcus pyogenes
atgaggaacgaaatggcaaaaataatgaacgtaacaggagaagaagtcattgccttagcggccacctatatgaccaaggctgatgtggcttttgtggcaaaggctttagcatatgcaacagcggcccatttctaccaagtgagaaagtcaggcgaaccctatatcgtccatccgattcaggtggcggggattctggctgatttgcatctggatgctgtgacagttgcttgtggctttttacatgatgtcgtagaagatacggatattaccttagatgagatcgaagcagactttggccatgatgctcgtgatatcgttgatggtgtcaccaagttaggtgaagttgagtacaaatctcatgaggagcaactcgccgaaaaccatcgcaaaatgctgatggctatgtccaaagatattcgcgtgattttggtgaaattggctgaccgcctgcataatatgcgcaccctcaaacatttgcgcaaggacaaacaagagcgcatttcgcgcgaaaccatggaaatctatgcccccttggcgcatcgtttggggattagtcgcatcaaatgggaactagaagatttggcttttcgttacctcaatgaaaccgaattttacaaaatttcccatatgatgaaagaaaaacgtcgcgagcgtgaagctttggtagaggctattgtcagtaaggtcaaaacctatacgacacaacaagggttgtttggagatgtgtatggccgaccaaaacacatttattcgatttatcggaaaatgcgggacaaaaagaaacgattcgatcagatttttgatctgattgccattcgttgtgtcatggaaacgcaaagcgatgtctatgctatggttggctatattcatgagctttggcgtcccatgccaggccgcttcaaggattatattgcagctcctaaagctaatggctaccagtctattcataccaccgtgtatgggccaaaaggacctattgagattcaaatcagaactaaggacatgcatcaagtggctgagtacggggttgctgctcactgggcttataaaaaaggcgtgcgtggtaaggtcaatcaagctgagcaagccgttggcatgaactggatcaaagagctggtagaattgcaagatgcctcaaatggcgatgcagtggactttgtggattcggtcaaagaagacattttttctgaacggatttatgtctttacaccgacaggggccgttcaggagttaccaaaagaatcaggtcctattgattttgcttatgcgatccatacgcaaatcggtgaaaaagcaacaggtgccaaagtcaatggacgtatggttcctctcactgccaagttaaaaacaggagatgtggttgaaatcatcaccaatgccaattcctttggccctagtcgagactgggtaaaactggtcaaaaccaataaggctcgcaacaaaattcgtcagttctttaaaaatcaagacaaggaattgtcagtgaataaaggccgtgatttgttggtgtcttattttcaagagcagggctacgttgccaataaataccttgacaaaaaacgcattgaagccatccttccaaaagtcagtgtgaagagcgaagaatcactctatgcagccgttgggtttggtgacattagtcctatcagtgtctttaacaagttaaccgaaaaagagcgccgtgaagaagaaagggccaaggctaaagcagaagctgaagaattggttaagggcggtgaggtcaaacacgaaaacaaagatgtgctcaaggttcgcagtgaaaatggagtcattatccaaggagcatcaggcctcttgatgcggattgccaagtgttgtaatcctgtacctggtgatcctattgacggctacattaccaaagggcgtggcattgcgattcacagatcggactgtcataacattaagagtcaagatggctaccaagaacgcttgattgaggtcgagtgggatttggacaattcgagtaaagattatcaggctgaaattgatatctatgggctcaatcgtagtggtctgcttaatgatgtgctccaaattttatcaaactcaaccaagagcatatcgacagtcaatgctcagccgaccaaggacatgaagtttgctaatattcacgtgagctttggcattccaaatctgacgcatctgaccactgttgtcgaaaaaatcaaggcagttccagatgtttatagcgtgaagcggaccaatggc

SEQ ID NO: 1604 - protein, 743 aa, Streptococcus pyogenes
MRNEMAKIMNVTGEEVIALAATYMTKADVAFVAKALAYATAAHFYQVRKSGEPYIVHPIQVAGILADLHLDAVTVACGFLHDVVEDTDITLDEIEADFGHDARDIVDGVTKLGEVEYKSHEEQLAENHRKMLMAMSKDIRVILVKLADRLHNMRTLKHLRKDKQERISRETMEIYAPLAHRLGISRIKWELEDLAFRYLNETEFYKISHMMKEKRREREALVEAIVSKVKTYTTQQGLFGDVYGRPKHIYSIYRKMRDKKKRFDQIFDLIAIRCVMETQSDVYAMVGYIHELWRPMPGRFKDYIAAPKANGYQSIHTTVYGPKGPIEIQIRTKDMHQVAEYGVAAHWAYKKGVRGKVNQAEQAVGMNWIKELVELQDASNGDAVDFVDSVKEDIFSERIYVFTPTGAVQELPKESGPIDFAYAIHTQIGEKATGAKVNGRMVPLTAKLKTGDVVEIITNANSFGPSRDWVKLVKTNKARNKIRQFFKNQDKELSVNKGRDLLVSYFQEQGYVANKYLDKKRIEAILPKVSVKSEESLYAAVGFGDISPISVFNKLTEKERREEERAKAKAEAEELVKGGEVKHENKDVLKVRSENGVIIQGASGLLMRIAKCCNPVPGDPIDGYITKGRGIAIHRSDCHNIKSQDGYQERLIEVEWDLDNSSKDYQAEIDIYGLNRSGLLNDVLQILSNSTKSISTVNAQPTKDMKFANIHVSFGIPNLTHLTTVVEKIKAVPDVYSVKRTNG

SEQ ID NO: 1605 - DNA, 2400 bp, Streptococcus agalactiae
atgtcaaaacattatttttcaaaaagcgtattcgctttaactgtcttaacagctacagcaacaagtggtttagctgttcaagcagaagacattgttacaacaccaagttcaacctctacaaaggttgaatcaactacccccactagcacaattgcagaggaaaagtcaaacgttacttctactccaactgcaataactgatgcttcaacagccacaagcacaaataccactaccaataaccaaaatccacagcctgttgccacagaagccacaactagtgatctcaaacctattgaaggtgaaaaagttgaccttcgcatcatgtcaaccacagacctacacaccaatttagttaactatgattattatcaagataaagaatctcaaaaaatagggttagcaaaaactgctgtccttattgaagaagcaaaaaaagaaaatcctaataccgtcttagttgataacggagatgtcattcaagggacacctttaggaacttataaagcaatcgttaaacctgtcgcagaaaatgaagaacatcctatgtaccaagccatgaatgctcttggttatgatgcatcaacactaggtaatcatgagtttaattacggtttagattacctcaaaaaaatcattgctacagccaaccttccaatcctcaacgcaaatgttttggatttcaaaacacatcaaccagtttttaaaacttatgacatcattactaaaaccttcaaagattcaacaggaagagctgttgcactaaatattgggattacaggaattgtacctcctcaaatcttaaactgggacaaggctaacctagagggaaaggttattgtcaaagattcagttaaagcaatcgaagaaatcgttcctactatgcgtgctaaaggagcagatgtcattctcgttttatcacactctggcattggagatgatcgatatgaagaaggtgaagaaaacgttggctatcaaattgccagcatcaagggagtggatgccgttgttacgggacactcacacgctgaatttccatcaggtaacggtactggcttctatgaaaaatacactggagttgatggtatcaatggaaaaataaatggaacacctgttacaatggcaggcaagtacggggatcatcttggtattattgatttaggacttagttatactaatggaaaatggcaagtctccgaaagtagtgctaaaatccgtaaaattgatatgaactcaacaactgctgacgagcgtatcattgcattggctaaggaagcacacgatggcactatcaactatgttcgccaacaagtaggtacaacaactgcgccaattacaagttactttgcactagttaaagatgacccttcagttcaaattgttaacaacgctcaacgttggtacgttgcaaatgaattgaaaggaacacctgaggcaaatttaccacttctatctgctgcagcaccatttaaagctggaacacgcggcgatgctaccgcatatactgatattccagctggacctgttgcaattaaaaacgtagctgatctttacctttatgataatgttactgcacttttaaaagtgaccggagcagacttacgtgaatggttagaaatgtccgctggtcaatttaaccaaattgaccctaacaataaagcaccacaaaatattatcaataccgaatatcgtacctataattttgacgttattgacggcttgacttataaatttgatattacacaacctaataaatacaataaagatggaaaagttgttaatagtcaagctagtcgagtacgcgatttaatgtacaatggtaagcctgttgcagacaaacaagagtttatgattgtgaccaataactaccgtgctagtggtaccttccctggggctaaaaatgccacaatgaaccgtttgctgaacttagaaaatcgccaaactattatcaactatattatttcagagaaaaccatcaatcctacagctgataataactggggcttcacagagtctattaaagaccttgatttacgattccaaacagccgataaagctaaaaatcttgttactaatagcaaggatattcagtatatcgctagttctaccaaagatgaaggatttggtgattatcgatttgtctatactgaacaagaaaaagtagaccttactgagccatcacatcaagaaaagttaagccaaatagaaaaacaaaaaattcaccacatggttgcaactgcttatacaaaagcaaaagcttctccaaatattacaggcactgtctatacacaacagaaagaaaaaacattacctaaaactggacaagaaaaacaatcttatctggctttctttggtgtcgcaatacttggactcgtgggaagtttacttaaaaagaaacaaata

SEQ ID NO: 1606 - protein, 800 aa, Streptococcus agalactiae
MSKHYFSKSVFALTVLTATATSGLAVQAEDIVTTPSSTSTKVESTTPTSTIAEEKSNVTSTPTAITDASTATSTNTTTNNQNPQPVATEATTSDLKPIEGEKVDLRIMSTTDLHTNLVNYDYYQDKESQKIGLAKTAVLIEEAKKENPNTVLVDNGDVIQGTPLGTYKAIVKPVAENEEHPMYQAMNALGYDASTLGNHEFNYGLDYLKKIIATANLPILNANVLDFKTHQPVFKTYDIITKTFKDSTGRAVALNIGITGIVPPQILNWDKANLEGKVIVKDSVKAIEEIVPTMRAKGADVILVLSHSGIGDDRYEEGEENVGYQIASIKGVDAVVTGHSHAEFPSGNGTGFYEKYTGVDGINGKINGTPVTMAGKYGDHLGIIDLGLSYTNGKWQVSESSAKIRKIDMNSTTADERIIALAKEAHDGTINYVRQQVGTTTAPITSYFALVKDDPSVQIVNNAQRWYVANELKGTPEANLPLLSAAAPFKAGTRGDATAYTDIPAGPVAIKNVADLYLYDNVTALLKVTGADLREWLEMSAGQFNQIDPNNKAPQNIINTEYRTYNFDVIDGLTYKFDITQPNKYNKDGKVVNSQASRVRDLMYNGKPVADKQEFMIVTNNYRASGTFPGAKNATMNRLLNLENRQTIINYIISEKTINPTADNNWGFTESIKDLDLRFQTADKAKNLVTNSKDIQYIASSTKDEGFGDYRFVYTEQEKVDLTEPSHQEKLSQIEKQKIHHMVATAYTKAKASPNITGTVYTQQKEKTLPKTGQEKQSYLAFFGVAILGLVGSLLKKKQI

SEQ ID NO: 1607 - DNA, 2049 bp, Streptococcus pyogenes
ttgatctataacgattacgttaacttattaggagattttatgaaaaaatattttattttaaaaagtagtgtattgagtatcctgactagttttactctattagttacagatgttcaagcagatcaagttgatgtgcaattccttggcgtcaatgattttcacggcgctcttgataataccggaacagcttacacaccaagtggtaaaataccaaatgctgggacggctgctcaattaggtgcttatatggatgacgctgagatagacttcaagcaagcaaatcaagacggaacaagtatacgtgttcaagctggagatatggtcggagccagtcctgctaactctgcacttttacaagatgagcctactgtcaaagtctttaacaaaatgaaatttgaatatggcactcttggtaatcatgaatttgacgaaggactagatgaatttaaccgtatcatgacaggtcaagcgcctgatcctgaatcaacaattaatgatatcaccaaacaatatgagcacgaagcttcgcatcaaaccatcgtcattgctaatgttattgataaaaaaaccaaggatatcccctatggttggaaaccttatgctataaaagacatagccattaatgacaaaatcgttaagattggcttcattggtgttgtgactacagagattccaaatctcgttttaaagcaaaactatgaacactatcaatttttagatgtagctgaaaccattgccaaatatgctaaagaactacaagaacaacatgttcatgctattgtggttttagctcatgttcctgcaacaagtaaagatggtgttgttgatcatgaaatggctacggttatggaaaaagtgaaccaaatctatcccgaacatagcattgatattatttttgcaggacataatcatcaatacactaatggaactatcggtaaaacacgtatcgttcaagccctctctcaaggaaaagcttatgcagatgtccgtggtacgctagatactgataccaatgattttattaaaactccatcagcaaatgttgttgctgtagcaccaggtatcaaaacagaaaattcagatatcaaagctataataaatcatgctaatgatattgttaaaacagttactgaacgaaaaatcggaactgcaactaattcttcaactatttctaaaacagaaaatattgataaagaatctcctgtcggtaacttagcaacaacggctcagcttactattgctaagaaaacttttccaactgttgactttgctatgaccaataatggtggtattcgaagtgacctagttgtcaaaaatgaccggaccatcacctggggagctgcacaggctgtacaaccatttggtaatatccttcaagtcattcaaatgactggtcaacacatttacgatgtcctaaatcagcaatacgatgaaaaccagacctattttcttcaaatgtcaggtttaacatacacttatacagataatgatcctaagaactctgatacccccttcaagatagttaaggtttataaagacaatggtgaagaaattaacttaacaactacttacaccgttgttgtcaacgactttctttatggtggtggtgatggcttttcagcatttaaaaaagctaaattaatcggagctattaacacagatactgaagctttcatcacatatatcacaaatttagaagcatcaggtaaaactgttaatgctactataaaaggggttaaaaattatgtaacttcaaaccttgaaagttcgacaaaagttaatagtgctggtaaacacagtatcattagtaaggtttttagaaatcgtgatggcaatacagtgtctagtgaagtcatttcagaccttttgacttctactgaaaacactaataacagccttggcaaaaaagaaacaacaacaaacaaaaatactatctctagttccactcttccaataacaggggacaattataaaatgtctcctattatgacaatccttgccttgataagcttaggtggactaaacgcttttattaaaaaaaggaaatcc

SEQ ID NO: 1608 - protein, 683 aa, Streptococcus pyogenes
LIYNDYVNLLGDFMKKYFILKSSVLSILTSFTLLVTDVQADQVDVQFLGVNDFHGALDNTGTAYTPSGKIPNAGTAAQLGAYMDDAEIDFKQANQDGTSIRVQAGDMVGASPANSALLQDEPTVKVFNKMKFEYGTLGNHEFDEGLDEFNRIMTGQAPDPESTINDITKQYEHEASHQTIVIANVIDKKTKDIPYGWKPYAIKDIAINDKIVKIGFIGVVTTEIPNLVLKQNYEHYQFLDVAETIAKYAKELQEQHVHAIVVLAHVPATSKDGVVDHEMATVMEKVNQIYPEHSIDIIFAGHNHQYTNGTIGKTRIVQALSQGKAYADVRGTLDTDTNDFIKTPSANVVAVAPGIKTENSDIKAIINHANDIVKTVTERKIGTATNSSTISKTENIDKESPVGNLATTAQLTIAKKTFPTVDFAMTNNGGIRSDLVVKNDRTITWGAAQAVQPFGNILQVIQMTGQHIYDVLNQQYDENQTYFLQMSGLTYTYTDNDPKNSDTPFKIVKVYKDNGEEINLTTTYTVVVNDFLYGGGDGFSAFKKAKLIGAINTDTEAFITYITNLEASGKTVNATIKGVKNYVTSNLESSTKVNSAGKHSIISKVFRNRDGNTVSSEVISDLLTSTENTNNSLGKKETTTNKNTISSSTLPITGDNYKMSPIMTILALISLGGLNAFIKKRKS

SEQ ID NO: 1609 - DNA, 90 bp, Streptococcus agalactiae
ttggcctcagtttttagtgatgactatatttgtttctttttaagtaaacttcccacgagtccaagtattgcgacaccaaagaaagccaga

SEQ ID NO: 1610 - protein, 30 aa, Streptococcus agalactiae
MASVFSDDYICFFLSKLPTSPSIATPKKAR

SEQ ID NO: 1611 - DNA, 1125 bp, Streptococcus agalactiae
ttgaattgcgaggaacttctagcgacgttgaacgtatcgcaaatattatcgttgaaacattatcgaactttaaagcctaaaggaaatagtatggaaacaacattaaactacattaaaaccctgacatcaatcccttcaccaacagggtttacccaaacaatcatgacctatatcatcaaagaattggaagcgtttggctactcaccaattcgcacaaacaagggaggcgtcatggtttctctaaaaggaaaaaatgatactaaacatcgcatgataactgctcaccttgatacacttggtgctatggttagggccatcaaaccagatggtcggttaaaaattgaccttattggtggatatacatacaatgccattgaaggagaaaactgtactatacacctctcaaaaaatggtaaagaaatttctggaactgctcttattcatcaaactagtgtccatgtttacaaagacgctggaactgctgaacgtaatcaaacaaatatggaaattcgtttagatgagaaagtaacaactgctgacgaaacacgtgctttaggcatccaggtcggtgatttcatttcatttgatccgcgtacaatcataacagacagcggctttattaaatcacgttacctagatgacaaggtatccgctggtatcctaatggaacttctttctgtttacaagaaagaagacattcaacttccttatactactcatttctactttagtgcctttgaagagctaggacatggagcaaattcaagcatcccaaatgaaactgtagaatatctagcagttgatatgggagctatgggagacgatcaagaaactgacgaatatactgtctctatctgtgttaaagatgcttctggtccttatcattatgaattacgtcaacatcttgtttctctagctgaaaacaataatattccttataaacttgatatttatccttattatggtagtgacgcctccgctgccatgcgtgctggtgcggaagttaaacacgcgctacttggtgcaggtattgaatctagtcattcttatgaacgtacccatatcgattctattcaagcaactgaactcttagtggatgcctatctcaaaagcaatatggtggac

SEQ ID NO: 1612 - protein, 375 aa, Streptococcus agalactiae
MNCEELLATLNVSQILSLKHYRTLKPKGNSMETTLNYIKTLTSIPSPTGFTQTIMTYIIKELEAFGYSPIRTNKGGVMVSLKGKNDTKHRMITAHLDTLGAMVRAIKPDGRLKIDLIGGYTYNAIEGENCTIHLSKNGKEISGTALIHQTSVHVYKDAGTAERNQTNMEIRLDEKVTTADETRALGIQVGDFISFDPRTIITDSGFIKSRYLDDKVSAGILMELLSVYKKEDIQLPYTTHFYFSAFEELGHGANSSIPNETVEYLAVDMGAMGDDQETDEYTVSICVKDASGPYHYELRQHLVSLAENNNIPYKLDIYPYYGSDASAAMRAGAEVKHALLGAGIESSHSYERTHIDSIQATELLVDAYLKSNMVD

SEQ ID NO: 1613 - DNA, 495 bp, Streptococcus agalactiae
atggtagccacgctcattattatcaggggaaattcagctagcggaaagtctacaatagctaagcaacttcaagccgaattaggggaaaatacccttctcttatctcaggattaccttcgtagagagatgttaggaactaaggatggtgaaaatactactaccattccccttttgatcaatttactaaattatggttaccataactgttcctacatcatccttgaaggcatacttcgttctgattggtatacgcctgtttggaaacatattttaaaacataaccccaacaatacttatgcttattactatgatttaagctttcaagaaactgttaaaagacattcaactcgacttaaatctttagaatttggagaagattctcttgcaagatggtggcttgagaaagatttcttaaaagagatacctgaaaaaatattaacaaaagctatgagtttagaggatgtcaaaaaacttataatgaccgacgttttacct

SEQ ID NO: 1614 - protein, 165 aa, Streptococcus agalactiae
MVATLIIIRGNSASGKSTIAKQLQAELGENTLLLSQDYLRREMLGTKDGENTTTIPLLINLLNYGYHNCSYIILEGILRSDWYTPVWKHILKHNPNNTYAYYYDLSFQETVKRHSTRLKSLEFGEDSLARWWLEKDFLKEIPEKILTKAMSLEDVKKLIMTDVLP

SEQ ID NO: 1615 - DNA, 1035 bp, Streptococcus agalactiae
atgaaagaaaaacagtcgaaaaggcttatttatatactactggttgtttccattatttttataagtgtttttacatacagtattagccagccttctaaactacttccaccaaaagaattagttattctaagtccaaatagtcaagccattttaacaggaacgattccagcttttgaggaaaaatacggtataaaagttaagcttattcaaggtgggacagggcaactaatagatagattaagtaaggagggtaagcagttgaaggcggatattttctttggaggaaattatacgcaatttgaaagtcataaggcattgtttgagtcttacgtatcaaagaatgttcatactgttattccagactatatccatccaagtgatacggcgacaccttatactataaatgggagtgtcttgattgtaaataacgaattagctaagggacttaccatcaagagttatgaagatttattacagccttccttaaaaggtaaaattgcctttgcagatccgaatacttcctctagtgctttctcacaactcactaatatactcttggccaagggtggttacaccaatccaaaagcgtggaactatgttaaaaagctacaacataatattaatgctatcaaatcttctagctcttcagaagtttatcaatcagttgcagaaggaaaaatgattgtggggctgacttacgaagaccctagtgtcaatttgcaaaaaagtggtgccaatgtttctattgtatatccgacagaagggacagtttttgtcccatcttcggttgcaattataaagaatgctccttctatgaaagaagcaaagttatttattaattttatgctttctttagatgttcaaaatgcctttgggcagtcaacgagtaaccgacctattcgtaaagatgcccaaacgagtaatggcatgaaagctttaaaggatattgctactcttaaagaagattatcgctatgtcactaagcataagggccaaatccttaaaacctataatcgtattcgtagaaatgctgat

SEQ ID NO: 1616 - protein, 345 aa, Streptococcus agalactiae
MKEKQSKRLIYILLVVSIIFISVFTYSISQPSKLLPPKELVILSPNSQAILTGTIPAFEEKYGIKVKLIQGGTGQLIDRLSKEGKQLKADIFFGGNYTQFESHKALFESYVSKNVHTVIPDYIHPSDTATPYTINGSVLIVNNELAKGLTIKSYEDLLQPSLKGKIAFADPNTSSSAFSQLTNILLAKGGYTNPKAWNYVKKLQHNINAIKSSSSSEVYQSVAEGKMIVGLTYEDPSVNLQKSGANVSIVYPTEGTVFVPSSVAIIKNAPSMKEAKLFINFMLSLDVQNAFGQSTSNRPIRKDAQTSNGMKALKDIATLKEDYRYVTKHKGQILKTYNRIRRNAD

SEQ ID NO: 1617 - DNA, 1044 bp, Streptococcus pyogenes
atgttaaaactcaaacgcaaatggctattaagctttttgttagtaataattattctagcaatcgttaacgttgcaatgtatatattctcatcgtcaaaaaaagatagtgctaaagaattagttatcttgactcctaatagccaaactattttaacagggactattccagcctttgaggaaaagtatggggttaaagtaagattaatccaaggtgggacgggccaacttattgatcaattaggtcgaaaagataaaccattaaacgctgatattttctttggtggcaattacactcaatttgaaagccataaagatttatttgaatcttatgtttctccgcaggtttctactgtcatttcagattaccaattgcctagtcatcgcgcaaccccatatacgatcaatggcagtgtactgattgttaataacgaattagcaagaggacttcatattaccagttatgaggatttgctacaaccagctttaaaaggcaaaattgcttttgctgatcccaacagttcatcaagtgccttctcacagctgactaatatattgttagctaagggggggtacacaaacgctgacgcttgggcttacatgaagcgcttgttggtcaatatgaattctattagggctacgagttcttcagaagtctatcaatctgtcgctgagggtaagatgattgttgggctaacctacgaagatccttgtatcaacctgcaaaaaagtggtgccaatgtttccattgtttatccaaaagaaggaacggtgtttgtgccctcctctgttgctattatcaaacatgcgccaaacatgacagaggctaagctctttattaattttatgttatcacgtgatgtgcaaaatgcctttggccaatcaaccagtaaccgacccattcgtcaagatgcccaaaccagtcacgacatgaaagccttagaaacgatagctactttgaaagaggattatgcttatgttaccaagcacaagaaaaaaatagtggctacgtacaaccagttgcgccaacggttggaaaaagctaag

SEQ ID NO: 1618 - protein, 348 aa, Streptococcus pyogenes
MLKLKRKWLLSFLLVIIILAIVNVAMYIFSSSKKDSAKELVILTPNSQTILTGTIPAFEEKYGVKVRLIQGGTGQLIDQLGRKDKPLNADIFFGGNYTQFESHKDLFESYVSPQVSTVISDYQLPSHRATPYTINGSVLIVNNELARGLHITSYEDLLQPALKGKIAFADPNSSSSAFSQLTNILLAKGGYTNADAWAYMKRLLVNMNSIRATSSSEVYQSVAEGKMIVGLTYEDPCINLQKSGANVSIVYPKEGTVFVPSSVAIIKHAPNMTEAKLFINFMLSRDVQNAFGQSTSNRPIRQDAQTSHDMKALETIATLKEDYAYVTKHKKKIVATYNQLRQRLEKAK

SEQ ID NO: 1619 - DNA, 771 bp, Streptococcus agalactiae
atgtatagattacttatcgttgaggatgagcaccttattcgtaagtggttacgctatgctattgattatcaatcattgaatattttagtggttggtgaagcaaaagatggtaaagaaggagctcaattaattcaggaagagcagccagacattgttttaagtgatattaatatgccaattatgacagcattcgatatgtttgaggcaaccaaaggacaatcttatgccaaaattattttatctggctatgctgattttccaaatgcgcaatcagctattcactatggcgttcttgaatttttaacaaaaccactagaaaagcaagctttgattgattgtttaaaaacaattatggctagaattgaggaacataaggagaagcacctacaagagcatacagaattgtatttacctctaccacaagctaatgaccaagttcctgaagttattaaagatatgctagcatggattcatagccattttcatgggaaaattgtgattagccagttagctcacgatttaggttacagtgaaagttatctttacacagtcactaaaaagcaccttcatataactttgagtgattatataaatcaatatcgtattaatcaagccattcagttgatgtttagagaaccagacctaatggtttaccaaattgcagaagctgttggtatttatgattatcgttattttgatagggtttttaaaaagtacttgggtcagacagtaaaagcgtttaaggaagaacatatttttaaacaaatggat

SEQ ID NO: 1620 - protein, 257 aa, Streptococcus agalactiae
MYRLLIVEDEHLIRKWLRYAIDYQSLNILVVGEAKDGKEGAQLIQEEQPDIVLSDINMPIMTAFDMFEATKGQSYAKIILSGYADFPNAQSAIHYGVLEFLTKPLEKQALIDCLKTIMARIEEHKEKHLQEHTELYLPLPQANDQVPEVIKDMLAWIHSHFHGKIVISQLAHDLGYSESYLYTVTKKHLHITLSDYINQYRINQAIQLMFREPDLMVYQIAEAVGIYDYRYFDRVFKKYLGQTVKAFKEEHIFKQMD

SEQ ID NO: 1621 - DNA, 786 bp, Streptococcus pyogenes
atgtacaaattagtcattattgaagatgaacatattattaggaaatggttgcgatacgctattgattataaagctttagatattttggtcattggcgaggctaaagatggcaaagaaggagctgttttaatcaaagagagtcaaccagatatcgttttaaccgatattaacatgcccatcatgacagcttttgacatgtttgaagtaacaaaagatcaaacttacgccaaaattattttatctggctatgctgattttccaaatgcaaggtctgccatacactacggtgtacttgaatttttaacaaaaccgattgaaaaagcagctctttgggaatgtcttcaaaccattattgctaaaatagaaaagcaaaaggggtctaatcaaaaaacagatgcttgcgtctatattcccttaccccagatgactgatcagattcctgaagtagtcaaagatattttggagtgggtacatgctcattttcaagacaagatcagcacgagccgcctagctcatgacttagggtatagtgagagttatatctatcaaaatatcaaaaagcatcttcagatgcctttaagtgattacattaatcaatatcggattaatcaggcaattcaattgatgcaacaagaaccagatttaatggtatatgaaatagcacaagctgtaggtatttatgactatcgctattttgatagggtttttaaaaagtatctaggacaaactgtaaaggcttttaaagaagagcattttatgaaagataccgataggagtaagccatgt

SEQ ID NO: 1622 - protein, 262 aa, Streptococcus pyogenes
MYKLVIIEDEHIIRKWLRYAIDYKALDILVIGEAKDGKEGAVLIKESQPDIVLTDINMPIMTAFDMFEVTKDQTYAKIILSGYADFPNARSAIHYGVLEFLTKPIEKAALWECLQTIIAKIEKQKGSNQKTDACVYIPLPQMTDQIPEVVKDILEWVHAHFQDKISTSRLAHDLGYSESYIYQNIKKHLQMPLSDYINQYRINQAIQLMQQEPDLMVYEIAQAVGIYDYRYFDRVFKKYLGQTVKAFKEEHFMKDTDRSKPC

SEQ ID NO: 1623 - DNA, 135 bp, Streptococcus agalactiae
atggcgctagaattttttactgcgatgcgatcggctagaactctagatttttgtcgtaaaatcacaaaaataataactgatgatactagagaaaaaaggacgaccagagttactggtatcaggggacgatacatg

SEQ ID NO: 1624 - protein, 45 aa, Streptococcus agalactiae
MALEFFTAMRSARTLDFCRKITKIITDDTREKRTTRVTGIRGRYM

SEQ ID NO: 1625 - DNA, 1653 bp, Streptococcus agalactiae
atggaaatgagaggatatagaatggaagaacgctttaagaaacgactacaagatgatatctctaaacatttttcccgccagtctttaattttatccttgttattgattgcacttttcgtccttttttctttagcgcctcaacagataggtctttataaagatgttaattcagtttcctatagttataagcaattgattcaaaaacatgataccttattagatgacttaggtaaaaatagtttgaaaccatttgtctcaggacacttaggaagtgctgatttgagtaagcaatattatcatttaaggaatcatttacaaagtcaaacagaacttttagtattctcacctaatcaagaacttttgtttgctagtaattcacatttaggtaatttttttagtaagtctatttacattagtgaagttttagataaggctaaaataaatcaaaggctactaaaaattattgtggatagtgagggagggcattaccttgcactcattaagccaattatagttaataaaaaagtttcaggttatgcctttttattgatgaatgggaaagactttttacttccaacgaaggctattaactcagacttgattattgccgatcagctaaataatagctttacttttactaatcgtgattttatctcctctagtttagataaggtagatagtcaattcttaactagatattttagttttcacgatcatcgagcttttgttgttaggaaagtagctctgcaagacaatatcctactttacatgtatcgtcccctgataccagtaactctggtcgtccttttttctctagtatcatcagttattatttttgtgattttacgacaaaaatctagagttctagccgatcgcatcgcagtaaaaaattctagcgccataaatcaaatggtgctagatatggatgccatttcccgccaagaaaaatctagtattgagcttgatagtcaagatgaatttcaatatctatctgtgcaaatcaatcagatggtttcacggttaaaagatttacatgagaaaactcttgatttggaaacacaaaagttgttgtttgaaaagaggatgttagaagctcagtttaatcctcacttcctttataatacccttgagacaattttaataaccagtcactatgattcacaattaacagaaagaatcgttatacaactaacaaaattattgcgctatagccttagtggtagcacagaagcagctgtgcttaaggatgatttagcaatcattgaatcctaccttttgattaatcaagtgagatttgaagaattaacttacactatttcagtatctcctgaacttgaacacatgcgtgtaccaaaacttttcttgttaccgctaattgagaatgctattaaatatggcttaaaagaacgtcatgatgtagcaataaacatagatatttggcaagatagtgatggaatttggtttactgtttcaaataatggatcaggtattagtttggctaggcaacaagccatacgtacaatgttaagatcaactcactcgcatcatgggcttattaattcttatagacgattacaatatcaattttcaacagtattgttagagtttacgaagacagatgatgcttttcgagttagctatatagtaaaggag

SEQ ID NO: 1626 - protein, 551 aa, Streptococcus agalactiae
MEMRGYRMEERFKKRLQDDISKHFSRQSLILSLLLIALFVLFSLAPQQIGLYKDVNSVSYSYKQLIQKHDTLLDDLGKNSLKPFVSGHLGSADLSKQYYHLRNHLQSQTELLVFSPNQELLFASNSHLGNFFSKSIYISEVLDKAKINQRLLKIIVDSEGGHYLALIKPIIVNKKVSGYAFLLMNGKDFLLPTKAINSDLIIADQLNNSFTFTNRDFISSSLDKVDSQFLTRYFSFHDHRAFVVRKVALQDNILLYMYRPLIPVTLVVLFSLVSSVIIFVILRQKSRVLADRIAVKNSSAINQMVLDMDAISRQEKSSIELDSQDEFQYLSVQINQMVSRLKDLHEKTLDLETQKLLFEKRMLEAQFNPHFLYNTLETILITSHYDSQLTERIVIQLTKLLRYSLSGSTEAAVLKDDLAIIESYLLINQVRFEELTYTISVSPELEHMRVPKLFLLPLIENAIKYGLKERHDVAINIDIWQDSDGIWFTVSNNGSGISLARQQAIRTMLRSTHSHHGLINSYRRLQYQFSTVLLEFTKTDDAFRVSYIVKE

SEQ ID NO: 1627 - DNA, 1647 bp, Streptococcus pyogenes
atgcgaggtgaacaggtggaagaacattttaaaaaacaattacaagatgatatttctagacatttttcgtaccaatcgttaatgttatcattgttgctaattggtctttttattattttttcattagcgccacaacaattaggcctctatcgtgatatcaatgccactgcaacccgttatcaccgtttgattagcaaacaagaagccttgctggatgacttagggaaaaatagcttactaccttttttaaataaaaacctcagcactgctgatttaagcaagcactattttcatttgcgccatagcagccaaacgtcaccagaacttttactattttcacctagtcaagaccttttatttgctagtaacccacatttaggaaatgtttttagtaaatctgtttatattcaagaagtcttgagagcaactcattctccaaaaaccttgtttaaagatgctatggatagtgaagatggtcactacttgatgatcattatgccaatgatagatcaaaaccaactaaagggatatgcttttttagtgatgagtggcaaagattttcttcatcctacaaaaacattgacgtcagagttggtcattgctgataagctggacaatacgtttacgttttccaatcgtgagtttatagcatctagtctagataagatcaatagccagtatttacaccattattttgtttttcaagataatcgagcctttatcacaagaaaggttgccttacaaggaggtctttggctttacatgtataggcccttgattccaatggtatcggtgatgttattttcacttatttcatcagctgttatctttgtgattttgcaacgtaaatcaagtggtttagctaaccgaattgcagctaaaaattcaagagcaatcaatcaaatggttagagatatgagtgcgatctctcggcaagaaaaaagacgtattgaccttgagagtcaagatgaatttcaatatttatctgatcaaatcaatcaaatggtagagcgattgcaacagttacatgataaaacgttagatttggaaactcaaaaattattatttgaaaaacggatgttagaagctcaattcaatccgcatttcctctacaatacgctagaaaccattttgattacgagccattatgattctgccctaacagaaaaaattgttatccaattgacaaaattgttgcggtatagtctcacggattctagcaaacctgtcttgctcaaagatgatttaagtgtcatcgagtcttatttagtgattaatcaggtgcggtttgaagaattgcaatatagcattaacctatccccagaccttgatagtcttgaagtgcctaaattgttcttgttacctttgatagaaaatgccatcaaatatggcttgaaagaacgacacgatgtcaagattaacattgcttgttattatcaagatgaccacattattttttctgtgagagataatggttcgggaattgatgctcatcaccaaaaagtgattcgagagcaattggaagctggagagtcacaccatgggttaattaactcttatcgtcggcttaagtatcatttttcagaagtatccttggtttttgatcaaggtgataaacagtttaatgttagttaccatgttaaggag

SEQ ID NO: 1628 - protein, 549 aa, Streptococcus pyogenes
MRGEQVEEHFKKQLQDDISRHFSYQSLMLSLLLIGLFIIFSLAPQQLGLYRDINATATRYHRLISKQEALLDDLGKNSLLPFLNKNLSTADLSKHYFHLRHSSQTSPELLLFSPSQDLLFASNPHLGNVFSKSVYIQEVLRATHSPKTLFKDAMDSEDGHYLMIIMPMIDQNQLKGYAFLVMSGKDFLHPTKTLTSELVIADKLDNTFTFSNREFIASSLDKINSQYLHHYFVFQDNRAFITRKVALQGGLWLYMYRPLIPMVSVMLFSLISSAVIFVILQRKSSGLANRIAAKNSRAINQMVRDMSAISRQEKRRIDLESQDEFQYLSDQINQMVERLQQLHDKTLDLETQKLLFEKRMLEAQFNPHFLYNTLETILITSHYDSALTEKIVIQLTKLLRYSLTDSSKPVLLKDDLSVIESYLVINQVRFEELQYSINLSPDLDSLEVPKLFLLPLIENAIKYGLKERHDVKINIACYYQDDHIIFSVRDNGSGIDAHHQKVIREQLEAGESHHGLINSYRRLKYHFSEVSLVFDQGDKQFNVSYHVKE

SEQ ID NO: 1629 - DNA, 825 bp, Streptococcus agalactiae
atgaaatcacaggataatttgactaaagaagaccgtaaaatgcttcgctcagtcttctggcgctcatggacgatgaatgccagtcgtactggggcaacacaataccacgcagtaggagttatttatactttactaccagtcatcaatcgtttttataagactgataaggataaagcagaggcactggtccgtcatacaacatggtttaatgccaccatgcacattaataattttattatgggtcttgttgcatctatggaaaagaaaaacagtgaagatcctgattttgacgctagtgctatcaccgcagttaaggcttctttgatgggacctatatctggtgttggtgattcattcttttggggaattctaagggttattgcggcaggtatcggtatctccttagcaagtacaggctcagccatgggagctgttgtctttctactcttgtataacattccagcttttctgattcattattatagtctctatggaggttactctgtaggtgcagggtttatcaaaaaattgtatgaatcaggtggtattaaaattgttactaagacttcaagtatgcttggtttaatgatggtaggctcaatgactgcttcaaatgttaaattcaagacaatcttaacggtagcagctaaaggagctaaggaagcagcttccatacaaagttaccttgaccaattatttgttggcgtagtgccactgttggtaacgatattagccttctggcttctacgtaaaaaagtcaatatcaactggatcatgtttggtattatggtgttaggtattgtacttggtctcttaggtatttgc

SEQ ID NO: 1630 - protein, 275 aa, Streptococcus agalactiae
MKSQDNLTKEDRKMLRSVFWRSWTMNASRTGATQYHAVGVIYTLLPVINRFYKTDKDKAEALVRHTTWFNATMHINNFIMGLVASMEKKNSEDPDFDASAITAVKASLMGPISGVGDSFFWGILRVIAAGIGISLASTGSAMGAVVFLLLYNIPAFLIHYYSLYGGYSVGAGFIKKLYESGGIKIVTKTSSMLGLMMVGSMTASNVKFKTILTVAAKGAKEAASIQSYLDQLFVGVVPLLVTILAFWLLRKKVNINWIMFGIMVLGIVLGLLGIC

SEQ ID NO: 1631 - DNA, 825 bp, Streptococcus pyogenes
atgacatcacaagataatttgactaaagaagaccgtaaaatgcttcgctcagtcttttggcgctcatggacgatgaatgctagtcgtactggggcaacacaataccacgcagtaggggttatttacactttactaccagtcatcaatcgtttttataagactgataaggataaagcagaggcactggtccgtcatacaacatggttcaatgccaccatgcacatcaataactttatcatgggtcttgtggcatcgatggaaaagaaaaacagtgaagatcctgattttgatgctagtgctattacggcggtaaaagcatctctaatgggacctatctccggagttggagattccttcttctggggaattttaagggttattgcggcaggtatcgggatttccttggcaagtgcaggctcagccatgggagctgttgtcttcttactcttgtacaatattcctgcttttattattcactactatagcctttatggtggttattctgtaggtgcaggatttatcaaaaaactttacgaatctggtggtataaaaatcgtcactaaaacctcaagtatgcttgggttaatgatggtaggctcaatgacggcttcaaatgtaaaatttaaaacgattcttacagttgctgcgaaaggtgccaaagaagcagcttctattcaagattaccttgaccaattgtttattggtattgtaccattaatggtaacactagcagctttttggcttctacgaaagaaagtgaatatcatctggattatgtttggtatcatgttccttggcattatccttggacttttaggtatttgc

SEQ ID NO: 1632 - protein, 275 aa, Streptococcus pyogenes
MTSQDNLTKEDRKMLRSVFWRSWTMNASRTGATQYHAVGVIYTLLPVINRFYKTDKDKAEALVRHTTWFNATMHINNFIMGLVASMEKKNSEDPDFDASAITAVKASLMGPISGVGDSFFWGILRVIAAGIGISLASAGSAMGAVVFLLLYNIPAFIIHYYSLYGGYSVGAGFIKKLYESGGIKIVTKTSSMLGLMMVGSMTASNVKFKTILTVAAKGAKEAASIQDYLDQLFIGIVPLMVTLAAFWLLRKKVNIIWIMFGIMFLGIILGLLGIC

SEQ ID NO: 1633 - DNA, 807 bp, Streptococcus agalactiae
atgataatgccagcgacgatggcagctttagctgtattgatttgttttgggggaaattacttaacaggtcaaagtatgatggagagaccacttgtagttggtcttgtaacaggaatgctactaggtgatattaaggttggtatcctaatgggagcctccctagaagcgctatttttgggaaacgttaatattgggggtgttattgccgcagagccagtaacagcaacagcgatggcaacaacttttaccattatttcaaacattgatcaaaaagcagcaatgactctagctgttccgattggaatgttggcagcatttgttgttatgtttttgaaaaacgtcttcatgaatatctttgcaccgatggtggataaagctgcagccgcaaaccatcaaggtaaacttgtgatgcttcactatggtacatggattatttactatctcattatcgcttctatttctttcattggtattttagtaggtagtgggcctgttaatagttttgtccatcatattcctcaaaacctgatgaatggtttgagtgcggcgggaggcctccttccagctgttggttttgccatgctgatgaaattattatggacaaataaattagctgttttttacttgcttggttttgttttaacagcttatttaaaattaccagcggttgcagttgctgccctaggagcagttatttgcgtcattagttcacaacgtgatatagaattagacgcaattactagaggtgcgatcagtaaacagacaacctttgactctaaagaatcagaagaggaggacttcttcgca

SEQ ID NO: 1634 - protein, 269 aa, Streptococcus agalactiae
MIMPATMAALAVLICFGGNYLTGQSMMERPLVVGLVTGMLLGDIKVGILMGASLEALFLGNVNIGGVIAAEPVTATAMATTFTIISNIDQKAAMTLAVPIGMLAAFVVMFLKNVFMNIFAPMVDKAAAANHQGKLVMLHYGTWIIYYLIIASISFIGILVGSGPVNSFVHHIPQNLMNGLSAAGGLLPAVGFAMLMKLLWTNKLAVFYLLGFVLTAYLKLPAVAVAALGAVICVISSQRDIELDAITRGAISKQTTFDSKESEEEDFFA

SEQ ID NO: 1635 - DNA, 807 bp, Streptococcus pyogenes
atgttagtaccagcaacaatggcagctttagctgtattgatttgttttgggggaaattatttaaccggtcaaagcatgatggaaagacccctagtagttggactggtcacaggtcttcttttaggagatatgaaggtcggtatcttaatgggggcctctctagaagctcttttcctaggaaatgtgaatattgggggtgttattgcagctgagcctgtaacagcgactgccatggcaacaacctttaccattatttcacatattgaccaaaaagcagccatgaccctagctgttccaattggaatgttggcagcctttgtggttatgtttttgaaaaacgtcttcatgaatatctttgctccaatggttgataaagctgcagcagctaaccatcaaggtaaactagtgatgctccactatggcacttggattatctattacttaatcattgcctctatttctttcattggtatcttagtaggtagtggacctgttaatgcctttgtggaacacattcctcaaaatctcatgaatggcttgagtgctgcgggaggccttcttccagctgtcggttttgccatgctgatgaaattattgtggaccaacaaattagctgttttttacctattgggctttgtcttaacagcttatttgaaattaccagcggttgcagttgctgccctaggagcagttatttgcgtcattagttcccaacgtgatctagaattagacgcaattactagaggtgcaattagtaaacaaacaacctttgactctaaagaatcagaagaggaggacttcttcgca

SEQ ID NO: 1636 - protein, 269 aa, Streptococcus pyogenes
MLVPATMAALAVLICFGGNYLTGQSMMERPLVVGLVTGLLLGDMKVGILMGASLEALFLGNVNIGGVIAAEPVTATAMATTFTIISHIDQKAAMTLAVPIGMLAAFVVMFLKNVFMNIFAPMVDKAAAANHQGKLVMLHYGTWIIYYLIIASISFIGILVGSGPVNAFVEHIPQNLMNGLSAAGGLLPAVGFAMLMKLLWTNKLAVFYLLGFVLTAYLKLPAVAVAALGAVICVISSQRDLELDAITRGAISKQTTFDSKESEEEDFFA

SEQ ID NO: 1637 - DNA, 489 bp, Streptococcus agalactiae
atgattactcaaattcgtgttgacgaccgtttgattcacgggcaagtggcagttgtatggactaaagaattaaatgcaccacttttagtggtggctaatgatgaagctgcaaaaaatgaaatcacacagatgactcttaaaatggctgtgcctaatggcatgaaattattaatccgttcagttgaagaatcaatagctctatttaaagatccacgtgcaactgacaagcgcatttttgtgattgtcaattctgttaaagatgcctgtacaattgctaaaaatataaccgatttagaagcagtaaacgtcgctaatgtaggacgctttgataagtctgatccagctacaaaagtcaaactaacatcaagtctcttattaaatacagaagagttggaagccgcaaaagaattagccagcttaccagatttagacgtctttaaccaagtattgccttcaaatactaaggttaacttgagtcagttagtcaaa

SEQ ID NO: 1638 - protein, 163 aa, Streptococcus agalactiae
MITQIRVDDRLIHGQVAVVWTKELNAPLLVVANDEAAKNEITQMTLKMAVPNGMKLLIRSVEESIALFKDPRATDKRIFVIVNSVKDACTIAKNITDLEAVNVANVGRFDKSDPATKVKLTSSLLLNTEELEAAKELASLPDLDVFNQVLPSNTKVNLSQLVK

SEQ ID NO: 1639 - DNA, 489 bp, Streptococcus pyogenes
atgattacccaaattcgtgttgacgaccgtttgattcacgggcaagtggcagttgtatggaccaaagagttaaatgcgccgcttttagtagtggctaatgatgaagctgcaaaaaatgaaatcacacaaatgacgcttaaaatggctgtgccaaacggcatgaaactgcttattcgttcagttgaagactcgattaagctctttaatgatccacgcgccaaagacaagcgtatctttgtgattgtcaattctgttaaagatgcttgtgccattgctaaagaagttccagacttagaagctgttaatgtggctaatgtggggcgctttgataagtcagacccagcaagcaaagtcaaagtgacaccaagtcttttacttaacccagaagaaatggcagccgcaaaggaattagtcagtttaccagaacttgatgtctttaaccaagtcttaccatcaaataccaaggtccatttgagccaattagtcaac

SEQ ID NO: 1640 - protein, 163 aa, Streptococcus pyogenes
MITQIRVDDRLIHGQVAVVWTKELNAPLLVVANDEAAKNEITQMTLKMAVPNGMKLLIRSVEDSIKLFNDPRAKDKRIFVIVNSVKDACAIAKEVPDLEAVNVANVGRFDKSDPASKVKVTPSLLLNPEEMAAAKELVSLPELDVFNQVLPSNTKVHLSQLVN

SEQ ID NO: 1641 - DNA, 423 bp, Streptococcus agalactiae
atgaagcggaaattcctaatcggcagtcacggaaaacttgcgagtgggttgcagagttctattgatattctgacaggcaagggacaagagattcagacaatagatgcttacattgatgatagtgactatactaagtctattgtagaatttattgatgagattgcaccagatgaacaggggcttatttttacagatttgttaggtggcagcgttaatcagaaaatggcgactgctgtaatgaatagtgggaaaaataatatttttttaataacgaacagcaatttagcgaccttgttgtcattactatttttgaaacctgaagaggaattaactaaagaagaaattgtaaccgttatcaatgaatctcaagtgcagctggtagatcttagctttaaagcgggttcagaagatgactttttcgat

SEQ ID NO: 1642 - protein, 141 aa, Streptococcus agalactiae
MKRKFLIGSHGKLASGLQSSIDILTGKGQEIQTIDAYIDDSDYTKSIVEFIDEIAPDEQGLIFTDLLGGSVNQKMATAVMNSGKNNIFLITNSNLATLLSLLFLKPEEELTKEEIVTVINESQVQLVDLSFKAGSEDDFFD

SEQ ID NO: 1643 - DNA, 423 bp, Streptococcus pyogenes
atgaaacgaaaatttctcattgggagtcacggcagactagccagtggtttgcaaagctctattgacattttagcaggtatgggacaggcacttgaaaccattgatgcttatgttgatgatagtgactacactagccagattgatgactttatcgctggggtagcagcagatgagcagggccttatttttactgatttgttaggcggcagtgtgaatcagaaaatggtaaccgctgtaatgaacagtggcaaagacaatatctttttaatcacaaacagtaacttagccactttattgtcgttggtgtttttaaaaccaggcgaagcgcttactaaagatgaaattgtaaccgttatcaatgaatcgcaagttcagttagtggatttggtccctgagacaaattcagaagatgacttttttgat

SEQ ID NO: 1644 - protein, 141 aa, Streptococcus pyogenes
MKRKFLIGSHGRLASGLQSSIDILAGMGQALETIDAYVDDSDYTSQIDDFIAGVAADEQGLIFTDLLGGSVNQKMVTAVMNSGKDNIFLITNSNLATLLSLVFLKPGEALTKDEIVTVINESQVQLVDLVPETNSEDDFFD

SEQ ID NO: 1645 - DNA, 90 bp, Streptococcus agalactiae
gtgttaatgccaaggtcaccacaaaaatcacttttccttgatggtgtgcaactaaggaagttgattttaaacagtaagacactatgccaa

SEQ ID NO: 1646 - protein, 30 aa, Streptococcus agalactiae
MLMPRSPQKSLFLDGVQLRKLILNSKTLCQ

SEQ ID NO: 1647 - DNA, 1059 bp, Streptococcus agalactiae
atgttaaggatgaagagaagtcagtgcgtggataataagcagcataatacatcaatgattagtttgctacaataccttttttccatactggtcattttagttcatagtgggaggttatttagtcaggatgtcattcattttacctttaaaagtttcctaggtcggatggctgttccttattttttgatttgtactgctttctttttgagaggtcgtatacagcaaggtttgtgtaatcactcctactttcgtaaactgattaaaaagtatagcatgtggactatcatttatttgccttatggttatttcttttttgaatctctaaatatagcgaagatctatttgttgccggggtttattgtggcatttttgtatttaggtatgtcacataccctttggtacatccctgctgttattctaggttgggtcattattcaaggattattgaagtatgtaggaactagggggacatttatcacagttgttgtactctattgtattggagcagtagagacctattctgtctttatacagtcaacaaaattttatcccctgatgtccacttatatgtcaatttttcagacaacacgaaacggattattttacactccagtttatcttctagcaggatatttactctatgattattttaatactgacctatttaccaaatcgcgtggtcttaagtatattctcttccttttacttctagctttagagaatgttcttatttattttaatcaagggttggataaaaatttcttcttattagctcctttatgtgcagtattcttatttaactggagtatacgtacatcactgtttaaggaatatcgtttaagtcctttaaaacagttgagtgtctattatttcttccttccccctctttttattggcatagtgtcttactgtttaaaatcaacttccttagttgcacaccatcaaggaaaagtgatttttgtggtgaccttggcattaacacatgcttgtgctctactcataataaaggttgttaataagataccctatcaaaaaattattccattatctctttcgaaa

SEQ ID NO: 1648 - protein, 353 aa, Streptococcus agalactiae
MLRMKRSQCVDNKQHNTSMISLLQYLFSILVILVHSGRLFSQDVIHFTFKSFLGRMAVPYFLICTAFFLRGRIQQGLCNHSYFRKLIKKYSMWTIIYLPYGYFFFESLNIAKIYLLPGFIVAFLYLGMSHTLWYIPAVILGWVIIQGLLKYVGTRGTFITVVVLYCIGAVETYSVFIQSTKFYPLMSTYMSIFQTTRNGLFYTPVYLLAGYLLYDYFNTDLFTKSRGLKYILFLLLLALENVLIYFNQGLDKNFFLLAPLCAVFLFNWSIRTSLFKEYRLSPLKQLSVYYFFLPPLFIGIVSYCLKSTSLVAHHQGKVIFVVTLALTHACALLIIKVVNKIPYQKIIPLSLSK

SEQ ID NO: 1649 - DNA, 180 bp, Streptococcus agalactiae
atgataccaatctcttcagaagaatatctcaattatcccaaaaagtcattgaaacgccttaaatggtatctgataattattgttaataccttatcaaccatattaggaaataaaaaagctgatttcgcaaaagaaaatcagcttagaataatttcttgttcagataaccagtgggaacta

SEQ ID NO: 1650 - protein, 60 aa, Streptococcus agalactiae
MIPISSEEYLNYPKKSLKRLKWYLIIIVNTLSTILGNKKADFAKENQLRIISCSDNQWEL

SEQ ID NO: 1651 - DNA, 198 bp, Streptococcus agalactiae
gtgtctgtcgttgatactgagaaaatagttaataacttgtttatcacacctttattaaacatagccattaaaaagctaggagcaaaaaaggcaagcgttgaaacagcaaaagatgttaatggcgaatttgtgatacttgatataaagaaattaagactggctataaaaaggagtccaacaaattgtaagacaataata

SEQ ID NO: 1652 - protein, 66 aa, Streptococcus agalactiae
MSVVDTEKIVNNLFITPLLNIAIKKLGAKKASVETAKDVNGEFVILDIKKLRLAIKRSPTNCKTII

SEQ ID NO: 1653 - DNA, 1152 bp, Streptococcus agalactiae
atgatatcaatttttccttttgaattaaaaaaacttctacaacgtaaggcagcatttggggcttttattatcttccttcttgctatttttggtctattttaccagcatttttttgttgggcaaattagtggctattctgcagataaaatacatggtcgagaagcggttgccattaatcgtagaatagctgaaaaatattcaggggatttatctgaagaacgagtaacaaatattattaaaaactatgttaatccgccagcaggacgcccccctatatttgatgtttttagttattatgtggcagacacttttgatcgtgattttttaatttactataaccaattgaaagatgataaaacaattgattttaataaaataaatattaaagatcaaaaacagttgggttctgcgctaccactaaaacaactaaagctaggtaactttgctccttggaatcaacttttcgaagtaagtaatagtacttatattttaattgtcttatttactctattcttatcagctcctcttttttcaggagatagggctaagaagattaatcctatactactgacgactcggtatggacgtggtcagttgacctgggctaagttagctagtacaatgaccatcggtatttccacatttatcctagcatatgccctcattctgacggtatttgcagattattttggttttagtggttgggagacaagcgttcaactgaatttatactggacatcacctttggctaatattatgggatttcctgtacctatgacaatatcaactgcttttgttcatattattgtcttacaatttgttggactcctttttatagccagtcttaatttctttatatcaagtatcacaaattcgccattaacatcttttgctgtttcaacgcttgccttttttgctcctagctttttaatggctatgtttaataaaggtgtgataaacaagttattaactattttctcagtatcaacgacagacacttcagctttacttttaaaattatcacgtaatggtagtcatggctttttctttgatagtttttctgctaatgaaatctgtctgattagtctacgtatgttaattgcagtgttattgatagcctatacctatcgtttaatgcgacgaagaagttta

SEQ ID NO: 1654 - protein, 384 aa, Streptococcus agalactiae
MISIFPFELKKLLQRKAAFGAFIIFLLAIFGLFYQHFFVGQISGYSADKIHGREAVAINRRIAEKYSGDLSEERVTNIIKNYVNPPAGRPPIFDVFSYYVADTFDRDFLIYYNQLKDDKTIDFNKINIKDQKQLGSALPLKQLKLGNFAPWNQLFEVSNSTYILIVLFTLFLSAPLFSGDRAKKINPILLTTRYGRGQLTWAKLASTMTIGISTFILAYALILTVFADYFGFSGWETSVQLNLYWTSPLANIMGFPVPMTISTAFVHIIVLQFVGLLFIASLNFFISSITNSPLTSFAVSTLAFFAPSFLMAMFNKGVINKLLTIFSVSTTDTSALLLKLSRNGSHGFFFDSFSANEICLISLRMLIAVLLIAYTYRLMRRRSL

SEQ ID NO: 1655 - DNA, 864 bp, Streptococcus agalactiae
ttgaaaggagacaatactatgttattacagctagataatatcactaaaagctacgggaaaaaaatagtacttaaccagatttcctaccagtttactcctggtttgtatggactcttaggagcaaatggtactggcaaaacaaccttattaaatttgatgagccactttacattagcagatagtgggaatatttattggaatggacaggagcagtcggaagaattttatcgtcacattggttttttaccgcaacattttcgctattatgatcaatttactggcattgctttcttaaattatatcgctaccttaaaaggtgttgataaaaagaaagctaaacaagaaattcctagattactagagcttgttggtttaggcgatgtaggtaaaaagaagatttcatcatactccggtggtatgaagcaacgtttaggcattgctcaagcacttatcaatgatcctgaaatactcattctggatgaaccaactgttggacttgatcccaaggaacgggttaaatttcgccatattttgagtcagttatccaccaataaaattatcattttatcaacgcatattgtgtcggatgtggaagctgttgccaaagaaattatagtattaaaaaatggtaaatttatcgaacatggcaacaccgcacagctgttgaaaactattgagggaaaagtgtgggaaataacgactgaaccaggtttatctcagatacccaatattgctattgttaatgaaaaagtcttttcagatagtcgggtatttcgtgtagtgagtgatatttgtccgagtgattcggcacagttggttgttccgactctagaagatttctacatctatcattttagaggggag

SEQ ID NO: 1656 - protein, 288 aa, Streptococcus agalactiae
MKGDNTMLLQLDNITKSYGKKIVLNQISYQFTPGLYGLLGANGTGKTTLLNLMSHFTLADSGNIYWNGQEQSEEFYRHIGFLPQHFRYYDQFTGIAFLNYIATLKGVDKKKAKQEIPRLLELVGLGDVGKKKISSYSGGMKQRLGIAQALINDPEILILDEPTVGLDPKERVKFRHILSQLSTNKIIILSTHIVSDVEAVAKEIIVLKNGKFIEHGNTAQLLKTIEGKVWEITTEPGLSQIPNIAIVNEKVFSDSRVFRVVSDICPSDSAQLVVPTLEDFYIYHFRGE

SEQ ID NO: 1657 - DNA, 750 bp, Streptococcus agalactiae
gtgaatatttttatacttgaggatgattttgttcaacaagcccattttgaaaaaatcattaaagagattagagtacagtacaatctgcatttcaaaacagtagaaacgtttgctaaaccagttcaattattggaatcaatttatgaaataggtttacataatttatttttcttagatattgaaataaaaaatgatgagcagatgggcttagaggtagcaaaacaaattagacaagttgatccatatgctcagattgtttttgttacaactcattcagaattaatgcctttaacctttcgttatcaggtatcagctttagactatatcgataaaggactttcacaggaagagtttagccaaaggattgaggaagtattgttgtacgtagatggcatttgcaataagcccttagtggaaaattcattctactttaagtcgcgttacagccaggtacaattaccttttaacgatcttctttatatagaaacatcctcaagatcacatagagttgtcctttatactgaaaaagatagaatggaattcacagccactttgggggatattttaaaacaagaacctaggctctttcaatgtcatcgctcttttttagtaaatcccttaaatatttttaaagtggataggatagatagattagtttacttccaaaatggaacgacttgtctggtttcacgcaataaagtgagagatatagtatctatagtggataaatatcaaaaggatagaaaaaga

SEQ ID NO: 1658 - protein, 250 aa, Streptococcus agalactiae
MNIFILEDDFVQQAHFEKIIKEIRVQYNLHFKTVETFAKPVQLLESIYEIGLHNLFFLDIEIKNDEQMGLEVAKQIRQVDPYAQIVFVTTHSELMPLTFRYQVSALDYIDKGLSQEEFSQRIEEVLLYVDGICNKPLVENSFYFKSRYSQVQLPFNDLLYIETSSRSHRVVLYTEKDRMEFTATLGDILKQEPRLFQCHRSFLVNPLNIFKVDRIDRLVYFQNGTTCLVSRNKVRDIVSIVDKYQKDRKR

SEQ ID NO: 1659 - DNA, 738 bp, Streptococcus pyogenes
atgatgaacatttttattcttgaggatgattttatccagcagacacgcatagaatctatcgtagtaggcatcttaaaagagactagaataccatgtaatcagcttgaagtgttctcgactcctcaaaaattatttgagagtatccaagaaagaggagaccatcagctgtattttttagatattgaaattggtgaatatactcgttgtgggcttgaattagctgcagctattcgacaaaaagatcctaatgccgttattgtgtttgtcaccactcattcagaatttgctcctatttcttttaaatataaggtatccgctctagattttattgataaagcaggtggtcaaaaacagtttaaagaacaaatcgaagaatgtatccgatatacttacgatatgatgtctagtcgtgagtcaaaggacatgtttttatttgagactccacagacaagattaaaattgccctataaggatattttatactttgctacagccacaactcctcacaaagtttgtttatggactcagacagaaagattagagttttatggtaatctatctgagattcaagcagtagcaccgaaactttttttgtgccatagatcctaccttgtgaatctagataaggttgttcgaattgataagagtaagcagctcctttatttcgaaaatggtgattcttgtatggtatcacgattaaaaatgaaatgtctgtttgaacggtgggaggctcttcgc

SEQ ID NO: 1660 - protein, 246 aa, Streptococcus pyogenes
MMNIFILEDDFIQQTRIESIVVGILKETRIPCNQLEVFSTPQKLFESIQERGDHQLYFLDIEIGEYTRCGLELAAAIRQKDPNAVIVFVTTHSEFAPISFKYKVSALDFIDKAGGQKQFKEQIEECIRYTYDMMSSRESKDMFLFETPQTRLKLPYKDILYFATATTPHKVCLWTQTERLEFYGNLSEIQAVAPKLFLCHRSYLVNLDKVVRIDKSKQLLYFENGDSCMVSRLKMKCLFERWEALR

SEQ ID NO: 1661 - DNA, 828 bp, Streptococcus agalactiae
atgaaaggatactctatggcaaaatgcttaacgttaaatactcattcatggatggaagtaaatgctctaaagaaattatttgatttagcagagcatatcttccgtgaaaaatatgatatcatctgcctacaagaggtgaaccagagcatatcttcccctcttgctaagagtagtccaaattatcatccgattgaaggtacaccagctcttcatcaagataactttgccttgcaattagtgcattacctaaatcttcaaggtctacactatcattggacatgggcttataatcatattggttatagtaagtaccatgaaggggtagcgatactttctctgaaaccattaaagccagaggatattttagtttcagctgtagacgatgagactgattatcatactcgtcgtgctctggtagctgagaccactctgaatgacaaagtcgttacagtagttagcctccatttctcatggtttgagaaaggatttgcggaggagtggaaacgactagaaactaccctacttgaggtagaaactccacttttactcatgggtgactttaataatcctactggaaatcagggttatgaacttgttcttaatagtccattagcattaaaggatagccaccaaatagccaatcatgtatttggggaccatactattatggctgatattgatggttgggaagggaataaaaaggctcttaaagttgaccatatttttactagcgaagacctttcaatcagttcaagtcaagtagtttttgaaggtggtgaagcacctgtcgttagtgatcattacggcttggaaattaccatggatttc

SEQ ID NO: 1662 - protein, 276 aa, Streptococcus agalactiae
MKGYSMAKCLTLNTHSWMEVNALKKLFDLAEHIFREKYDIICLQEVNQSISSPLAKSSPNYHPIEGTPALHQDNFALQLVHYLNLQGLHYHWTWAYNHIGYSKYHEGVAILSLKPLKPEDILVSAVDDETDYHTRRALVAETTLNDKVVTVVSLHFSWFEKGFAEEWKRLETTLLEVETPLLLMGDFNNPTGNQGYELVLNSPLALKDSHQIANHVFGDHTIMADIDGWEGNKKALKVDHIFTSEDLSISSSQVVFEGGEAPVVSDHYGLEITMDF

SEQ ID NO: 1663 - DNA, 816 bp, Streptococcus pyogenes
atgaccaaggtattaacactgaatacccattcgtggatgcaagccaacactcttaaaaaattagttgctttggctgagcatattttagctgaaaaatacgatatcatttgcttgcaagaaatcaatcagttaatcgagagcgagctggccacagatttaccaagatatcaagctctttcagggacaccaagcattcataaagaccattttgcccttctcttgatccattatttacaaaaacgagggcagcactattattggtcttgggcttataaccatattggctatgacatttaccaggaaggcgtggcaatcttatcaaaacaacctattcatgtttcagatattctcgtgtcagcgatggatgatgaaacagactaccacaccagacgctcactcatagccaaaaccacgttagatggcaaagaagtcgctgttgtcaatgtgcacctatcttggtttgacaaggggtttttaggggagtgggagaaattagaaaaagaactgctcacactaaactgtcccttgctacttatgggagattttaacaatccaacggatcaagacggttatcaagtgatgatgggtagccccctagacctacaagatagccataagggtgctgaccacgtgtttggtgatcatagcatcgtggctgatattgatggctggcaaggtaacaaagaagccctcaaggtggaccatgtctttaccagtaaggacttcatcatccgatcttctaagattacctttgaaggcggagatgcgccagtcgtcagtgaccactatggtctagaagtgacattaggctggcgt

SEQ ID NO: 1664 - protein, 272 aa, Streptococcus agalactiae
MTKVLTLNTHSWMQANTLKKLVALAEHILAEKYDIICLQEINQLIESELATDLPRYQALSGTPSIHKDHFALLLIHYLQKRGQHYYWSWAYNHIGYDIYQEGVAILSKQPIHVSDILVSAMDDETDYHTRRSLIAKTTLDGKEVAVVNVHLSWFDKGFLGEWEKLEKELLTLNCPLLLMGDFNNPTDQDGYQVMMGSPLDLQDSHKGADHVFGDHSIVADIDGWQGNKEALKVDHVFTSKDFIIRSSKITFEGGDAPVVSDHYGLEVTLGWR

SEQ ID NO: 1665 - DNA, 2202 bp, Streptococcus agalactiae
gtgcataaaaggagattgaagatgaaaaataatgtcaaacagctctttagttttgaattttggcagaagtttgggaaggctttgatggttgttattgctgttatgccagcagcaggattgatggttagtattggtaactccattagtctattggatccatcaaatgttttattagggcgcatagctaatgttattgctcaaattggttggggagttattggtaacttacacatcttatttgcattggctattggtggtagctgggctaaagaacgtgccggtggtgcttttgcggctggcttatcctttattcttattaaccttattacagggaacttttttggtgttaaaacagatatgttagcagacagtaaagcaactgttcaaacggtatttggtgcaaccatcagagtttcagattactttgttaacgttcttgggcaacctgctcttaatatgggtgtatttgtcggtattatttcaggtttcgttggtgcaactgcctttaataaatattataactatcgtaaattaccagatgctttaacttttttcaatggaaaacgttttgttccatttgttgttatttatcgttcagtcattgttgcattaattttatcagtattttggccggttgttcaatcaggtatcaatggctttggtaaatggattgcaagttcacaagacagtgctccaatattagcaccatttgtctacggtacgttagagcgtttattgctcccatttggtttacaccatatgttaactattccaatgaactacacgcaactaggtggcacatacactgtccttacaggtgcaactaaaggagcacaggtgttgggacaagatccactgtggttagcatgggttggtgatttaattaacttaaaaggctcaaattcaagtcaataccatcacttattgacaagtgtcactccagcacgttttaaagtggggcaaatgattggtgcttcaggtattttgatgggattatcttatgctatgtatcgtaacgttgataaagataaaaaattgaaatacaagtcaatgtttatttcagcagcagcggctactttcttgacaggtgttactgagccaattgagtacatgttcatgtttgcagcaatgccactctaccttgtatatgctgtcgttcaaggatgtgcgtttgctatggcagatattgttaacctccgcgttcattcatttggtaatatagaatttttaacacgtgttcctatgggcataaaagcgggccttggtggtgatattttcaactttgtttgggtgacacttctttttgcagtattgatgtactttattgcaaactttatgattaaaaaattcaatttagcaacagcaggacgtaatggtaattatgataacgaagaggttgataatgctccttcaacagcttctggttctgctgatgcaaattctcaagttgtacaagttattaatttacttggtggtcgtgataacattgaagatgtagatgcatgtatgactcgtcttcgtgtcacagttaaagatggaaatagcgtgggttctgaagcagcttggaaaaaagctggtgcaatgggattggtgttaaaaggtaatggcgttcaagctatttacggacctaaagcagatgtccttaaatcagacattcaagatttgctagattcaggtacagttattccaatagttgatttagaaacaggtcaacctgtagcagcagccccagttacaacttataaaggaataacagaagaaattgtttcggtggctaatggtcaagtagaagcattggatgttgttaaagaccctgtcttttctcaaaaaatgatgggtgatggctttgctgtggaaccaactgatggcaatatttatgttccagtttcaggtacagttactagtgtctttccaacaaaacatgcttttggtttattaacagaaagtggcctagaagttttagtacatatcggtctagatacagtagctcttgatggtcaaccatttgaggttaaaatttctagtggtcaaaaagtggtagcaggcgatcttgctgtagtagcagatttggaagctatcaaagcagctggtaaagagacaagtgtgattatcgtctttacaaatgtttcagatataaaaactgttaaacttgaaaaatcaggtccacaaatagctaaaacagttgtggcaaaagtcgaactg

SEQ ID NO: 1666 - protein, 734 aa, Streptococcus agalactiae
MHKRRLKMKNNVKQLFSFEFWQKFGKALMVVIAVMPAAGLMVSIGNSISLLDPSNVLLGRIANVIAQIGWGVIGNLHILFALAIGGSWAKERAGGAFAAGLSFILINLITGNFFGVKTDMLADSKATVQTVFGATIRVSDYFVNVLGQPALNMGVFVGIISGFVGATAFNKYYNYRKLPDALTFFNGKRFVPFVVIYRSVIVALILSVFWPVVQSGINGFGKWIASSQDSAPILAPFVYGTLERLLLPFGLHHMLTIPMNYTQLGGTYTVLTGATKGAQVLGQDPLWLAWVGDLINLKGSNSSQYHHLLTSVTPARFKVGQMIGASGILMGLSYAMYRNVDKDKKLKYKSMFISAAAATFLTGVTEPIEYMFMFAAMPLYLVYAVVQGCAFAMADIVNLRVHSFGNIEFLTRVPMGIKAGLGGDIFNFVWVTLLFAVLMYFIANFMIKKFNLATAGRNGNYDNEEVDNAPSTASGSADANSQVVQVINLLGGRDNIEDVDACMTRLRVTVKDGNSVGSEAAWKKAGAMGLVLKGNGVQAIYGPKADVLKSDIQDLLDSGTVIPIVDLETGQPVAAAPVTTYKGITEEIVSVANGQVEALDVVKDPVFSQKMMGDGFAVEPTDGNIYVPVSGTVTSVFPTKHAFGLLTESGLEVLVHIGLDTVALDGQPFEVKISSGQKVVAGDLAVVADLEAIKAAGKETSVIIVFTNVSDIKTVKLEKSGPQIAKTVVAKVEL

SEQ ID NO: 1667 - DNA, 2184 bp, Streptococcus pyogenes
atgaaaacatcattcaagcaactgtttcgtttcgaattttggcaaaaatttgggaaatgtcttatggtcgttattgctgtcatgccagcggctggtttaatgatcagtatcggaaactctattccaatgattaaccacgactcagcatttttggcatctctaggcaacattatcgctcaaattggttgggctgttattgttaaccttcacttgctatttgccttggccattggtggtagttgggctaaagaaagagctggaggggcctttgcctcagggcttgcttttgtcttgatcaatcggataacaggtgctttttatggcgtgtctagtactatgctagctgatccagaagcaaaaatcacaagcctccttggcactcaaatgatcgttaaagattatttcaccagtgtcttggaatctccagctttaaacacaggggtttttgttgggattattgcagggttcgtaggagcaacggcctataacaaatactataattaccgtaaacttcctgaagttttgaccttctttaatgggaagcgttttgtaccatttgtcgttattttacgttctatttttgtagcccttattttggttgttgtttggccggtgatccagtctgggattaacagttttgggatgtggattgcctcttcacaagattcagctccaatcctagccccattcctatatggtaccttggaacgtctcttgttgccatttggtcttcaccacatgttgacgatcccaatgaactatacagctcttggtggaacttatgaggtcatgacaggtgcagcagcggggacaaaagtatttggtcaagaccctttgtggcttgcttgggtaactgaccttgttcaccttaaaggatcagacgcttcagcctatagtcacttaatggatagtgtgactccagctcgtttcaaagtaggacaaatgattggagctaccggaacattgatgggggttgccttagccatgtaccgtaatgtggatgccgataaaaaacacacatacaaaatgatgttcatctcagcagcggcagcggtctttttgacaggggtaactgagccacttgagtacctatttatgtttgcagcaatgccactttacatcgtctatgcccttgttcaaggagcttcatttgccatggcagaccttgtgaatctccgtgttcactcatttggaaatatagagctactaacccgcacccctatggctcttaaagcaggcctaggcatggatgtgattaactttgtttgggtttctgtcctctttgcagttatcatgtactttattgcagatatgatgatcaagaaaatgcatctcgcaacagctggccgtttaggcaactacgatgccgatatactgggtgaccgtaacactcaaacaagacctacccaagtagcagatagcaactctcaagtcgtgcaaatcgttaatctccttggtggggcaggcaatattgatgatgttgatgcttgtatgacgcgcttacgagtgacggtcaaagaccccgctaaggttggtgctgaggacgattggaaaaaagctggcgctataggcttgatccaaaaaggcaacggcgttcaagcggtctatggccctaaagcagatattttgaaatcagatattcaagatttgctggactcaggtgctcttattccagaagtcaatatgtcacagctcactagcaaaccgactcccgcaaaagattttaaacacgtgacagaagatgtgctatcagtggcagacgggatggttctcccaatcacaggtgtaaaagaccaggtgtttgcggctaagatgatgggagatgggtttgcggttgaaccaacccatggtaatatctatgcacccgtagctggccttgtgaccagtgtctttccgaccaagcatgcctttggtttactgacagataatggtcttgaagtgctggtgcacgtgggacttgataccgtcgccttaaatggtgtgcctttttcagtcaaagtctcagaagggcaacgggttcatgcaggtgacctattagtcgtagcagatcttgctgctattaaatcagcagagcgtgaaacaatcattgttgttgcttttaccaacacaacagagatccaagatgtgaccttgacatctttaggagctcagcctgctaagactaaagtagctaccgtagaactt

SEQ ID NO: 1668 - protein, 728 aa, Streptococcus pyogenes
MKTSFKQLFRFEFWQKFGKCLMVVIAVMPAAGLMISIGNSIPMINHDSAFLASLGNIIAQIGWAVIVNLHLLFALAIGGSWAKERAGGAFASGLAFVLINRITGAFYGVSSTMLADPEAKITSLLGTQMIVKDYFTSVLESPALNTGVFVGIIAGFVGATAYNKYYNYRKLPEVLTFFNGKRFVPFVVILRSIFVALILVVVWPVIQSGINSFGMWIASSQDSAPILAPFLYGTLERLLLPFGLHHMLTIPMNYTALGGTYEVMTGAAAGTKVFGQDPLWLAWVTDLVHLKGSDASAYSHLMDSVTPARFKVGQMIGATGTLMGVALAMYRNVDADKKHTYKMMFISAAAAVFLTGVTEPLEYLFMFAAMPLYIVYALVQGASFAMADLVNLRVHSFGNIELLTRTPMALKAGLGMDVINFVWVSVLFAVIMYFIADMMIKKMHLATAGRLGNYDADILGDRNTQTRPTQVADSNSQVVQIVNLLGGAGNIDDVDACMTRLRVTVKDPAKVGAEDDWKKAGAIGLIQKGNGVQAVYGPKADILKSDIQDLLDSGALIPEVNMSQLTSKPTPAKDFKHVTEDVLSVADGMVLPITGVKDQVFAAKMMGDGFAVEPTHGNIYAPVAGLVTSVFPTKHAFGLLTDNGLEVLVHVGLDTVALNGVPFSVKVSEGQRVHAGDLLVVADLAAIKSAERETIIVVAFTNTTEIQDVTLTSLGAQPAKTKVATVEL

SEQ ID NO: 1669 - DNA, 111 bp, Streptococcus agalactiae
ttgtttaaaggctctgatactttttttgctatatatcgtgcaattaatacagataaaataatagcaagtaagatgataattgctaagggacttatcataccaaggagaaga

SEQ ID NO: 1670 - protein, 37 aa, Streptococcus agalactiae
MFKGSDTFFAIYRAINTDKIIASKMIIAKGLIIPRRR

SEQ ID NO: 1671 - DNA, 1677 bp, Streptococcus agalactiae
ttggataccgtttggaggaaagacatgactaaaaaaattttccgtacaactttatctgctagtttgggaattgttttagttacaattttgatgattatgggatttctctataattacttcaatcacattcagcgagaacagttgagaacacaaacggcactggcgtcacaaggaatttcctttgaaggtaaagattattttgaaaatcttaaaacttcaaatgtgcgtattacttgggtagataataagggacaagtgctttatgatacccaatcagatgcaaaacatatgaaaaatcacgccaatcgtcaagaaattaaagaagctatcaagagtggttatggtgagagcacgaggtggtcagcgacacttactgagaagtctatctatgctgcgcaacgtttaaataatggaacgatagttcgtttatcagttgcgcaacaaactattttttatcttctccttggtatgataagtcccttagcaattatcatcttacttgctattattttatctgtattaattgcacgatatatagcaaaaaaagtatcagagcctttaaacaatattgacttagatcatcctttatcaaatgatagttacgaggagataacaccattattaaggcgtcttgatagccatcaggctaagattcaacatcaaaaactgttattacaaaagcgtcaaaaagaatttgataccattatttctaaaattaaggaaggaatgattcttttagatgatcaagcaagaatcgttagtatcaacgcagaagctttaaagttattccaaattaatgatgattggcatgggcgctttatgatggaagttagccgagatttaactctcaaagacttaatcgatcaaggactaaaagggaaaaagaaagaggctaatattggcattgaaaataatcattaccgcgtcttggtaagaccaactacagataacaaccgagtaacaggattggttgttctactgtttgatgtgactgatcaactccaaatggaacaacttcaacgtgaatttactgccaatgtctctcatgaattgaaaaccccgcttcatgttatttctggttactcagaactgttagctaatcaaatggttccaaacgaagaagtcccacaatttgcagctaaaattcataaagaatctgaacgattagttaaattggttgaggatattatcaacctttctcaccttgatgaacaagaaaaattaccgcaagagacagtaaatctgtatgacttaacacaaaaagttttagaaggtttacaagctaaagcagataagaagcacatacaaatcaattttaatggagaagaagctattttgcgagggaatccagttttattgaattccttggtgtacaacttgtgtgacaatgctatcacctataaccatgagaaaggtcaagtaaatgtgactttgaaaaattcacctgatacaattaccttagaagttagtgatacgggactaggcattgcagagaaggacaaaaaacgtattttcgaacgtttctatcgcgtcgataaaagtcgctcaaaaatagttggggggactggtttaggtttgtctattgtaaagagtgctttagattttcacaatggtagtataaaagtggacagccatttggggcagggaacaacaatgaccgttttacttcacaaacaa

SEQ ID NO: 1672 - protein, 559 aa, Streptococcus agalactiae
MDTVWRKDMTKKIFRTTLSASLGIVLVTILMIMGFLYNYFNHIQREQLRTQTALASQGISFEGKDYFENLKTSNVRITWVDNKGQVLYDTQSDAKHMKNHANRQEIKEAIKSGYGESTRWSATLTEKSIYAAQRLNNGTIVRLSVAQQTIFYLLLGMISPLAIIILLAIILSVLIARYIAKKVSEPLNNIDLDHPLSNDSYEEITPLLRRLDSHQAKIQHQKLLLQKRQKEFDTIISKIKEGMILLDDQARIVSINAEALKLFQINDDWHGRFMMEVSRDLTLKDLIDQGLKGKKKEANIGIENNHYRVLVRPTTDNNRVTGLVVLLFDVTDQLQMEQLQREFTANVSHELKTPLHVISGYSELLANQMVPNEEVPQFAAKIHKESERLVKLVEDIINLSHLDEQEKLPQETVNLYDLTQKVLEGLQAKADKKHIQINFNGEEAILRGNPVLLNSLVYNLCDNAITYNHEKGQVNVTLKNSPDTITLEVSDTGLGIAEKDKKRIFERFYRVDKSRSKIVGGTGLGLSIVKSALDFHNGSIKVDSHLGQGTTMTVLLHKQ

SEQ ID NO: 1673 - DNA, 675 bp, Streptococcus agalactiae
atgatatattgtgttgaagatgatgctgatattcgcgaaatgatgctctatactttgcaaatggcaggttttaaagctcaaggattttcgagttcagagcttttttgggaagctattcaggagaaagttccagacttgattttgcttgatattatgttgccgggagatgatggtttgactattttagagcgtttaaggagaaaacatcaaacggaaatgataccagtaatcatgacaactgctaaaggtagtgagtatgataaagttaaagggttagatcttggagcagatgattatctcgtcaaaccttttgggatgatggaaatgatttcacgaataaaagcagtcttgagacgtagccgccaagtagattcaaaagctcatattatcattggaaatttagagattgatccgactaattattgggtcaaaaggggaacggaaaaaatccacttaaccctaaaggaatttgagttattagtattattcttccgtaatcccaatagagtctttacaaggcaagaacttctggataaggtttggggagaacaatttttaggagaaactagaactgtggatgttcacattgggacactgcgaacaaaacttggtgaggatggctatttgattgctacagtaaggggagttggataccgtttggaggaaagacatgac

SEQ ID NO: 1674 - protein, 225 aa, Streptococcus agalactiae
MIYCVEDDADIREMMLYTLQMAGFKAQGFSSSELFWEAIQEKVPDLILLDIMLPGDDGLTILERLRRKHQTEMIPVIMTTAKGSEYDKVKGLDLGADDYLVKPFGMMEMISRIKAVLRRSRQVDSKAHIIIGNLEIDPTNYWVKRGTEKIHLTLKEFELLVLFFRNPNRVFTRQELLDKVWGEQFLGETRTVDVHIGTLRTKLGEDGYLIATVRGVGYRLEERHD

SEQ ID NO: 1675 - DNA, 654 bp, Streptococcus agalactiae
atgattcgttcacgatttgcaagtcaacttaatgaccttaataaagaaattatttttatgggggcattgtgtgaggacatcattgggaagtccttaggtgctctaacaaatagtaatgacgtttaccttgacgatatttctgaaacttatcacaagattgaacaaatggaacgggatattgaggagagatgtttaaaacttttactccgtcagcaaccagttgccaaggatttacgccgtatttcttctgcattaaaaatggtttatgatatgaaacgtattggtgctcaagcttatgaaattgcggaaattgttagtttaggtcatattatccaaggttcaggttctgaaagggatcaacttaacagcatgtctaataatgtcattagtatgctgactaagagtatagatgcttttatttatgacaatgaagaacaagcgcatcaagtaattgaacaagataggacagttaaccaggaatttgatacaataaagaaacagttagtgttatatttttcggtacaggatgttgatggtgaatatcccatagatgttttaatgatcgccaagtacctagagcgtattggtgatcatacagtaaatattgctaagtgggtgcttttctcaataacaggtaacctagatggagaagcg

SEQ ID NO: 1676 - protein, 218 aa, Streptococcus agalactiae
MIRSRFASQLNDLNKEIIFMGALCEDIIGKSLGALTNSNDVYLDDISETYHKIEQMERDIEERCLKLLLRQQPVAKDLRRISSALKMVYDMKRIGAQAYEIAEIVSLGHIIQGSGSERDQLNSMSNNVISMLTKSIDAFIYDNEEQAHQVIEQDRTVNQEFDTIKKQLVLYFSVQDVDGEYPIDVLMIAKYLERIGDHTVNIAKWVLFSITGNLDGEA

SEQ ID NO: 1677 - DNA, 651 bp, Streptococcus pyogenes
atgttaagaacgaaatttgaagaagaattagataaattgcataaccagttttattcaatgggaatggaagtattggcacaaatcaataaaactgttcgtgcctttgttagtcatgatcgtgaattggccaaagaagttatcgaagaagatgacactattaataattttgagacaaagcttgaaaagaaatcgctggaaattattgccctacaacagccagtttcgaatgatcttagaatggttattactgttttaaaggcatcaagtgatattgaacgtatgggtgaccatgctgcttcgattgccaaggccactattcgtatgaaaggtgaggagcgtattccagtggttgaagaacaaatcaaccttatgggaaaagctgtgaaacagatggtagaagaagcccttaatgcatatatcaatgctgacgatacaaaagcttatgaaatcgcagcttctgatgagattatcgatcaatatttccgtaatatccaaaccttagctgttgaagaaatccgtaagtctccagatgctgtttttgccggaaaagaatattttcaagtattaatgtatttggaacgtattggtgactatgctcgcaacatttgtgaatggattgtttatcttaaaactggaaaaattattgaatta

SEQ ID NO: 1678 - protein, 217 aa, Streptococcus pyogenes
MLRTKFEEELDKLHNQFYSMGMEVLAQINKTVRAFVSHDRELAKEVIEEDDTINNFETKLEKKSLEIIALQQPVSNDLRMVITVLKASSDIERMGDHAASIAKATIRMKGEERIPVVEEQINLMGKAVKQMVEEALNAYINADDTKAYEIAASDEIIDQYFRNIQTLAVEEIRKSPDAVFAGKEYFQVLMYLERIGDYARNICEWIVYLKTGKIIEL

SEQ ID NO: 1679 - DNA, 759 bp, Streptococcus agalactiae
gtgagtcgaacagtgagtaaattagtaattaataatttagatttgtattatggagaatttcacgctctgaaggatgttaatttagacattgaagaaaaagaaatcacagcctttattggaccttctgggtgcggaaagtctactctcttgaaaagtattaaccgtatgaatgatttggtcaaaaattgcaaaatcacaggggatattactttagaaggcgaggatgtctatagacaattggatattaaccaattgcgtaaaaaggttggaatggtgtttcaaaaacctaatccgtttccaatgagcatttatgataatgttgcttttggtccaagaacgcacggtattcattccaaagcagagttagatgatatcgttgaacgttcccttaaacaggcggctctatgggatgaggttaaagatcgtcttcacaaatctgctctgggtatgtctggcggacagcagcaacgtttgtgtattgcgcgtgctcttgctattgagcctgatgttttacttatggatgaacccacaagtgccttggatcctatttcaacagcaaaaattgaagaattggttatccaactgaagaagaactacactattgttatagtgacacataatatgcaacaagctgttcgtatttctgataaaacagcattctttctgatgggagaagtggttgaatataacaaaacgagccaactcttttcattgccacaagatgagcgtacagaaaactacattacagggagattcgga

SEQ ID NO: 1680 - protein, 253 aa, Streptococcus agalactiae
MSRTVSKLVINNLDLYYGEFHALKDVNLDIEEKEITAFIGPSGCGKSTLLKSINRMNDLVKNCKITGDITLEGEDVYRQLDINQLRKKVGMVFQKPNPFPMSIYDNVAFGPRTHGIHSKAELDDIVERSLKQAALWDEVKDRLHKSALGMSGGQQQRLCIARALAIEPDVLLMDEPTSALDPISTAKIEELVIQLKKNYTIVIVTHNMQQAVRISDKTAFFLMGEVVEYNKTSQLFSLPQDERTENYITGRFG

SEQ ID NO: 1681 - DNA, 801 bp, Streptococcus pyogenes
atgacagaatacaattggaatgaacgtcatatcatcacttttcctgaagaaacgcttgctctagctaccaaggatttacatgtttactatggtgcgaaagaagctatcaaagggattgatatgcagtttgaaaaacataaaataacagccttgattggtccatctggttgtggcaaatcaacttatcttcgtagtcttaaccgcatgaacgataccattgatattgctcgggttacaggtgagattctttatcagggcattgatgttaatcgaaaagacatgaatgtttacgagattcgcaagcacttaggaatggtttttcaaagacccaatcctttcgctaaatccatttataaaaacattacctttgcccatgaaagagctggtgtgaaagacaaaaaagttttagatgaaattgttgagacttcactgaaacaagccgcgctttgggatcaagttaaagatgaccttcacaaatcagccttcaccttatcagggggtcagcaacaacgcttgtgtattgctagagccatttctgtcaaacctgatattctattaatggatgaaccagcctctgcccttgacccgattgcaacgatgcagctggaagaaaccatgtttgaattgaagaagaattacacgattattattgtgacccacaatatgcaacaagcagctcgtgccagtgattacactgccttcttctatttaggcaacctcattgaatatgataagacacgtaatattttccaaaatgcgcaatgtcagtcaacaaacgactacgtttcagggcactttggt

SEQ ID NO: 1682 - protein, 267 aa, Streptococcus pyogenes
MTEYNWNERHIITFPEETLALATKDLHVYYGAKEAIKGIDMQFEKHKITALIGPSGCGKSTYLRSLNRMNDTIDIARVTGEILYQGIDVNRKDMNVYEIRKHLGMVFQRPNPFAKSIYKNITFAHERAGVKDKKVLDEIVETSLKQAALWDQVKDDLHKSAFTLSGGQQQRLCIARAISVKPDILLMDEPASALDPIATMQLEETMFELKKNYTIIIVTHNMQQAARASDYTAFFYLGNLIEYDKTRNIFQNAQCQSTNDYVSGHFG

SEQ ID NO: 1683 - DNA, 876 bp, Streptococcus agalactiae
atggaaaatattaaccaaagaacgtcaaaacaatatttagcatctttaaaaaaagatcccctttccttctttctttttgctattgtctatttgggagcaattctaagttttgctacaattgcatttgttgttatttatattttagttaaggggcttcctcatgtgaatactggcttgtttgcatggacttataatactcagaacgtttcactattaccagctttcattaacactatctttatcatcgccttaactttattatttgcagttccacttggtattggtggatcaatttatctaacggaatatgctagacgtgataatccttatctcaaaattatccgtgttgcaaccgagacattggcagggataccttcaattatttatggtttgtttggtgcattattttttgtaaaatacacacacttaggcttatctttgatatcgggttctctgactttgagcatcatgattttacctttgattatgaggacaactgaagaagctttactatctgttccggattcttatcgagaaggagcctttgcgcttggtgctggtaaattgagaaccatatttaaaatcgtattacctagtgctatgtctggtatttttgctggtattattttagcggtaggacgtatcattggtgagtcagcagcacttattttcacagctggaacagttgcaaaagtagcacattcggtatttagttcatctcgtactttagcagtacatatgtatgctatttcgggtgagggcttatatgttgaccaaacttatgcgactgcggtcatcttattgcttttagttattattgtcaattttgtatctggactagtagccaaacgattaggaagtgagtcgaacagtgag

SEQ ID NO: 1684 - protein, 292 aa, Streptococcus agalactiae
MENINQRTSKQYLASLKKDPLSFFLFAIVYLGAILSFATIAFVVIYILVKGLPHVNTGLFAWTYNTQNVSLLPAFINTIFIIALTLLFAVPLGIGGSIYLTEYARRDNPYLKIIRVATETLAGIPSIIYGLFGALFFVKYTHLGLSLISGSLTLSIMILPLIMRTTEEALLSVPDSYREGAFALGAGKLRTIFKIVLPSAMSGIFAGIILAVGRIIGESAALIFTAGTVAKVAHSVFSSSRTLAVHMYAISGEGLYVDQTYATAVILLLLVIIVNFVSGLVAKRLGSESNSE

SEQ ID NO: 1685 - DNA, 885 bp, Streptococcus pyogenes
atgaacgctaaaaaagtcgataaagtagcaactggtactctttataccattgctggaattattgtagctattttagcttccttaattctatatatccttgtccgtggcttgccacacatcagctggtcctttttaacaggaaaatcgtcttcgtacgaagctggtgggggaattggtatccagttgtataattccttcttcctattgattgttactttaattatttccattcctttatcaactggagcggggatttacttggctgaatatgccaaaaaaggacctgttaccaactttattagaacctgtattgagattctgtcttccctaccatctgtggttgtggggctctttggttacttgattttcgttgtgcagtttgaatatggcttttctattatttcaggggctcttgctttgacggtctttaatcttcctcaaatgacccgtaatgttgaagatagtttactgcatgttcatcatacccaaagagaagcaggattagctttaggcctgtcacgctgggaaacggttttttatgtggttatcccagaagctctcccgggaatggtaacaggtattgtcttagcttcaggtcgtatttttggtgaagcggcagcgcttatctatactgctggtcaatcagcaccagctctggattggtcaaattggaatccacttagtgttactagtccaatctctattttccgtcaatctgagacccttgctgttcatatttggaaagtcaatagcgaagggacaattccagatgctactcttgtatccgcaggaagtgcagcagtgctattaatttttatccttattttcaacttttcagctcactttattgggaagaaacttcattctaaaatgacagcagcgaaa

SEQ ID NO: 1686 - protein, 295 aa, Streptococcus pyogenes
MNAKKVDKVATGTLYTIAGIIVAILASLILYILVRGLPHISWSFLTGKSSSYEAGGGIGIQLYNSFFLLIVTLIISIPLSTGAGIYLAEYAKKGPVTNFIRTCIEILSSLPSVVVGLFGYLIFVVQFEYGFSIISGALALTVFNLPQMTRNVEDSLLHVHHTQREAGLALGLSRWETVFYVVIPEALPGMVTGIVLASGRIFGEAAALIYTAGQSAPALDWSNWNPLSVTSPISIFRQSETLAVHIWKVNSEGTIPDATLVSAGSAAVLLIFILIFNFSAHFIGKKLHSKMTAAK

SEQ ID NO: 1687 - DNA, 123 bp, Streptococcus agalactiae
atgctaacaattgttggtaaaatcataattcctagcaaaattgaagctgctaagactcccataccaaagccaccaatatattgccttatcatagggacaataacaacgagtccaaagaaacca

SEQ ID NO: 1688 - protein, 41 aa, Streptococcus agalactiae
MLTIVGKIIIPSKIEAAKTPIPKPPIYCLIIGTITTSPKKP

SEQ ID NO: 1689 - DNA, 843 bp, Streptococcus agalactiae
atgaaacaaacaaaagaaggtcttatgcaagctgtgtttttcatcacggcttgcgtcagtgttatatcagctattttaatttgcctctttctcttctctagtggtcttccagctattacgaaaatcggctggggaaattttatatttggtaaagtctggcatcctagtaataatatttttggcatctttccaatgattgtaggttccttatatgttacagcgggagctttacttttaggaggaccgataggtatccttactgctgtttttatggcttatttctgcccagaaaatatttataagcctttaaagtcagctatcaatttaatggcgggaatcccttcagttgtttatggtttctttggactcgttgttattgtccctatgataaggcaatatattggtggctttggtatgggagtcttagcagcttcaattttgctaggaattatgattttaccaacaattgttagcatttcagaatcttctttaagagctgttccagagagctattatgaaggcggtattgcccttggtgcctctcatgaacgaagtgtcttctttgctgttttaccagctgctaaacgtggcattttagcatcggttgttttgggaattggacgtgctattggtgaaacaatggctgtcatcatggtagcgggtaatcaagctgtcttgcctcaatcgctgacatcaggcgttagaactctaaccactaacattgttatggaaatgggctattcttctggtttgcatcgtcaagccttaattggtacagctgtggtactctttatctttatattaatgattaatatcagtttttcagcattacagaaagaggaa

SEQ ID NO: 1690 - protein, 281 aa, Streptococcus agalactiae
MKQTKEGLMQAVFFITACVSVISAILICLFLFSSGLPAITKIGWGNFIFGKVWHPSNNIFGIFPMIVGSLYVTAGALLLGGPIGILTAVFMAYFCPENIYKPLKSAINLMAGIPSVVYGFFGLVVIVPMIRQYIGGFGMGVLAASILLGIMILPTIVSISESSLRAVPESYYEGGIALGASHERSVFFAVLPAAKRGILASVVLGIGRAIGETMAVIMVAGNQAVLPQSLTSGVRTLTTNIVMEMGYSSGLHRQALIGTAVVLFIFILMINISFSALQKEE

SEQ ID NO: 1691 - DNA, 933 bp, Streptococcus pyogenes
atggaaaatcaggaattggctaaaaaattagcctcaccatcaaagaattcaaggcttgaaacctttggccgcaccattacgtttttgtgtctggctttgattgtttttatcgttgcgatgattctgatcttcgttgctcaaaaagggttgtcaaccttctttgttgacaaggttaatctttttgatttcttgtttggaaaggagtggcaaccaagtgtaaaaaatgcggccggcattccttatcttggtgctctgccaatgattacaggatcctttttggttaccattttatctgctattattgccaccccatttgccattggcgcagccgtttttatgactgaaatctcacctaaatatggcgctaaattattacagcctgcggttgagcttttggttggaattccttcggttgtttatgggtttatcggtttgcaagtgattgttccttttatgcgctctatctttggtggcacaggttttggaatcctatctggggtctgtgtcttgtttgttatgattttaccaacagtgacttttatgacaacagacagtctgcgggcggtgcctcgtcattaccgcgaagcgtctatggctatgggagcaacacgttggcaaaccatttggcgtgttgtccttaatgcagctcgtccaggaatttttaccgctgttatttttggaatggcaagagcttttggagaagccttggctatccaaatggtagtcggtaactctgctgtaatgccaagttcactaacgacaccagccgcaaccttaacgtctgtcttgacaatgggtattggtaacacggttatgggaacggtccaaaataatgtgctttggtcccttgccctagtcttattattaatgagtctggccttcaattcccttgtcaaattaatcacgaaagaaagaaagagaaattatgaacgc

SEQ ID NO: 1692 - protein, 311 aa, Streptococcus pyogenes
MENQELAKKLASPSKNSRLETFGRTITFLCLALIVFIVAMILIFVAQKGLSTFFVDKVNLFDFLFGKEWQPSVKNAAGIPYLGALPMITGSFLVTILSAIIATPFAIGAAVFMTEISPKYGAKLLQPAVELLVGIPSVVYGFIGLQVIVPFMRSIFGGTGFGILSGVCVLFVMILPTVTFMTTDSLRAVPRHYREASMAMGATRWQTIWRVVLNAARPGIFTAVIFGMARAFGEALAIQMVVGNSAVMPSSLTTPAATLTSVLTMGIGNTVMGTVQNNVLWSLALVLLLMSLAFNSLVKLITKERKRNYER

SEQ ID NO: 1693 - DNA, 879 bp, Streptococcus agalactiae
atgaaaaaacacaaaatgctatctcttttggcggtatctggtcttatgggaattggcatcctagcaggatgctcaaatgattcatcatcttcatctaaagggacaattaacattgtttctagagaggaagggtctggaactcgtggagctttcatagagttatttgggatcgagtcaaaaaataaaaagggcgaaaaagtagaccatacttctgatgcagcaactgttaccaattcaacttcagttatgctaaccactgtctctaaagacccgtcagctattggttattcttcactaggttcattaaatagtagcgttaaagtgcttaaaattgatggcaaaaatgcgactgtaaaagatattaaatcaggaagctataagatttctcgtcctttcaatattgtaacaaaagaaggtaaggaaaaagaagcaacaaaagattttattgattatatcttaagcaaagatgggcaagcagtcgttgagaaaaatggctatattccacttgacaatgctaaagcatatcaagcaaaagtgtcatctggtaaagttgttatagcaggttcaagttcagtaacgccggttatggaaaagattaaagaagcctatcataaagtaaatgcaaaagtagatgttgaaattcaacaaagtgattcttcaactgggattacaagcgcaattgatggatcagcagatataggtatggcatcacgtgaattggataagacagagtcatccaaaggggtcaaagctactgttattgcaacagatggtattgcagtagttgttaataagaaaaataaagttaatgatctatcaacaaaacaagtaaaagacatttttactggaaagacaacgtcttggtctgacttatcaaag

SEQ ID NO: 1694 - protein, 293 aa, Streptococcus agalactiae
MKKHKMLSLLAVSGLMGIGILAGCSNDSSSSSKGTINIVSREEGSGTRGAFIELFGIESKNKKGEKVDHTSDAATVTNSTSVMLTTVSKDPSAIGYSSLGSLNSSVKVLKIDGKNATVKDIKSGSYKISRPFNIVTKEGKEKEATKDFIDYILSKDGQAVVEKNGYIPLDNAKAYQAKVSSGKVVIAGSSSVTPVMEKIKEAYHKVNAKVDVEIQQSDSSTGITSAIDGSADIGMASRELDKTESSKGVKATVIATDGIAVVVNKKNKVNDLSTKQVKDIFTGKTTSWSDLSK

SEQ ID NO: 1695 - DNA, 864 bp, Streptococcus pyogenes
atgaaaatgaaaaaaaaattctttttgttaagtcttttggccctatcaactttctttttatccgcatgttctagctggattgataaaggtgagtcaataaccgctgtaggatcaacagcactacaacccttagtagaagcagtagctgatgaatttggaagcagtaatctaggcaagactgtcaatgttcaaggtggtggttcaggtacagggttgtctcaagttcaatcaggagctgtccaaattggaaatagtgatgtctttgcggaagaaaaagatggtattgatgcttctaaattagttgatcatcaagtagctgttgcaggacttgcagttattgccaatcctaaagtcaaggtttccaatctcagtagtcagcagttgcaaaagattttttcaggagaatataccaattggaaacaagttggaggagaagatcttgcgatttcagtgatcaaccgagcagcaagttctggctcacgagcaacctttgacagtgttatcatgaaaggggtcaacgctaaacaaagtcaagagcaagactccaatgggatggttaaatcgattgtttcacaaacaccaggtgccatttcttacctttcctttgcctacgttgattcatctgttaaatctttgcaattaaatgggtttaaggcaaatgctaagaacgtggctacaaatgattggccaatctggtcctacgaacacatgtataccaaagataaaccaacagggttgaccaaggaatttcttgattatatgttttcagatgaagtacaacagaacattgttacacatatgggatatatttcgataaatgatatggaagtggtcaaatctcatgatggaaaagtaacaaaaagg

SEQ ID NO: 1696 - protein, 288 aa, Streptococcus pyogenes
MKMKKKFFLLSLLALSTFFLSACSSWIDKGESITAVGSTALQPLVEAVADEFGSSNLGKTVNVQGGGSGTGLSQVQSGAVQIGNSDVFAEEKDGIDASKLVDHQVAVAGLAVIANPKVKVSNLSSQQLQKIFSGEYTNWKQVGGEDLAISVINRAASSGSRATFDSVIMKGVNAKQSQEQDSNGMVKSIVSQTPGAISYLSFAYVDSSVKSLQLNGFKANAKNVATNDWPIWSYEHMYTKDKPTGLTKEFLDYMFSDEVQQNIVTHMGYISINDMEVVKSHDGKVTKR

SEQ ID NO: 1697 - DNA, 585 bp, Streptococcus agalactiae
atgattattgctattcaaggtggtatggctgtagggaaaaccacagctttgaaaatcattgagaatgtttaccccaaaatcgctattagttttgaggatatttctccagtagttgataagattaataaacatcagcttgataacaataaattagacgattattgtgaaattcaacaactatttattcagcatgagcgagatagatacgaacttgttagagataatgaaatagtgttaatggattatggagctgaggaaattgctttttatacacaatactttccaaaggtggcgggttatagttggactttaccttctaatttgttactagaggtaaataggctaaaggaatgttttgctgattatattatttttctagatgcagatgagacggtcctataccaacgtcaaaaaaatgattttaatagacagcgtcattttttcaaatggtatactcatcacctgctgcctgctaaaaaacattatttagacacattttccaatgttattcatattaatacaaatcatttaaatgctgaggaagtggctgaaaaaatcattgacatcattcgtaagttaactcta

SEQ ID NO: 1698 - protein, 195 aa, Streptococcus agalactiae
MIIAIQGGMAVGKTTALKIIENVYPKIAISFEDISPVVDKINKHQLDNNKLDDYCEIQQLFIQHERDRYELVRDNEIVLMDYGAEEIAFYTQYFPKVAGYSWTLPSNLLLEVNRLKECFADYIIFLDADETVLYQRQKNDFNRQRHFFKWYTHHLLPAKKHYLDTFSNVIHINTNHLNAEEVAEKIIDIIRKLTL

SEQ ID NO: 1699 - DNA, 738 bp, Streptococcus agalactiae
atgcaacagtattttgtaaatggcgaagcaggtgcctatgtgaccatcgaggacaaggataccatcaagcacatgttcaatgtcatgcgattgacagaagatgaccaagtggtcttggtttttgatgatgccatcaagcgtctggcaaaggtggtggacagctctgctcatcgcttccaaattctagaagagctagacaacaatgttgaaatgccagttcaagtgaccattgcctcaggttttcccaagggagacaagttggattttgtgacgcaaaaggcaacagaattgggtgctgcggctatctggggattcccagctgactggtcagtcgtcaagtgggacggcaagaaactagctaaaaaagaagataagctggcaaaaattgctctgggcgcagcggagcagagcaagcgtaatcgtcttcctcaggttcgtttatttgagaagaaggctgattttcaagcggagcttgcaggctttgataagatttttatcgcctatgaagagtctgccaaggagggtgaattgtcagcgctagcccagaacttgcagactgtaaaagcaggtgacaagctcctcttcatctttggaccagaagggggcatttctccaaaagaaatcgcagcttttgaagaggttggagctatcaaggtgggcttggggccacgcatcatgcgcacagaaacagcgccgctctatgctctaagtgttattagttactcagcggagttatta

SEQ ID NO: 1700 - protein, 246 aa, Streptococcus agalactiae
MQQYFVNGEAGAYVTIEDKDTIKHMFNVMRLTEDDQVVLVFDDAIKRLAKVVDSSAHRFQILEELDNNVEMPVQVTIASGFPKGDKLDFVTQKATELGAAAIWGFPADWSVVKWDGKKLAKKEDKLAKIALGAAEQSKRNRLPQVRLFEKKADFQAELAGFDKIFIAYEESAKEGELSALAQNLQTVKAGDKLLFIFGPEGGISPKEIAAFEEVGAIKVGLGPRIMRTETAPLYALSVISYSAELL

SEQ ID NO: 1701 - DNA, 747 bp, Streptococcus pyogenes
atgcaacagtattttattaaaggcaaagcagaaaaaaaggtaacgattaccgataaagataccatcaagcacatgtttcaagtgatgcgcttggctgacgaggctgaagttgtcttggtctttgatgatggggtgaagtatttagctaaggtgaccaatagtatggctcatgagttagagattatagaggctttgccagatcaggtggaattgcctgttaaagtgactattgcttctggatttcctaaaggcgataagttagacacgattgcccagaaagtgactgaattgggagccagtgcgctatggggctacccagcagactggtcagtggtcaaatgggatggcaaaaaattagctaaaaaagaagacaaattggctaagattgtattaggagcggctgagcagagcaaacgaaatagggtgcctgaagttcacctttttgaacataaagcagagtttctaaaaagcctttctagctttgatcatatcttcattgcttatgaggaaacagctaaggcaggtcagctagcgaccttggcgcgtgaagtaaaagaagttaagccaggggcaaaaatcctctttatctttggaccagaagggggaatttccccaactgaaatcactcagtttgaggcagcaagtgccattaaggtgggcttaggccctcgcattatgcgagcagagacagcgccgctatatgccttaagtgctcttagttatgctttggaattgcaggcatcaaaa

SEQ ID NO: 1702 - protein, 249 aa, Streptococcus pyogenes
MQQYFIKGKAEKKVTITDKDTIKHMFQVMRLADEAEVVLVFDDGVKYLAKVTNSMAHELEIIEALPDQVELPVKVTIASGFPKGDKLDTIAQKVTELGASALWGYPADWSVVKWDGKKLAKKEDKLAKIVLGAAEQSKRNRVPEVHLFEHKAEFLKSLSSFDHIFIAYEETAKAGQLATLAREVKEVKPGAKILFIFGPEGGISPTEITQFEAASAIKVGLGPRIMRAETAPLYALSALSYALELQASK

SEQ ID NO: 1703 - DNA, 951 bp, Streptococcus agalactiae
atgaacacatggaatgaactaacggttcacgtgaatcgtgaggcagaggaagctgtctcgaatttattgattgaaactggcagtcagggggttgccattagcgattcggctgactaccttggacaggaggatcgtttcggtgagctttatcctgaggtggagcagtctgatatgattgctattactgcttattatcctgatacgcttgatattgaggcggttaaggctgatttggctgatcgtttagctaattttgaaggctttggtcttgcgacgggtagcgtcaaccttgacagtcaggaattggtcgaagaggactgggctgataactggaagaagtactatgagccagctcgcattacccatgatttgaccatcgtgccgtcatggacggactacgaggctaaggctggtgagaagattatcaagatggatcctggtatggcttttgggactgggactcacccaacgactaagatgagtctttttgccttggagcaagtgcttcgtggtggtgagacggttatcgatgtggggactggttctggcgttttgtctattgctagctctctcttgggtgccaaggacatctatgcctatgatttggatgatgttgcagtgcgcgtggctcaggaaaatatcgatatgaaccctggcactgaaaatattcatgtggctgctggtgatctgctcaaaggtgtccagcaagaggtagatgttattgttgccaatattttggcggatattttgatccatctgacagacgacgcctaccgtttggtcaaggatgagggctatctcatcatgtctggtatcatttctgagaagtgggacatggtgcgtgagagtgctgaaaaagctggtttcttccttgagactcacatggttcaaggtgagtggaatgcctgcgttttcaaaaagacagatgatatttcaggagtgattggcggc

SEQ ID NO: 1704 - protein, 317 aa, Streptococcus agalactiae
MNTWNELTVHVNREAEEAVSNLLIETGSQGVAISDSADYLGQEDRFGELYPEVEQSDMIAITAYYPDTLDIEAVKADLADRLANFEGFGLATGSVNLDSQELVEEDWADNWKKYYEPARITHDLTIVPSWTDYEAKAGEKIIKMDPGMAFGTGTHPTTKMSLFALEQVLRGGETVIDVGTGSGVLSIASSLLGAKDIYAYDLDDVAVRVAQENIDMNPGTENIHVAAGDLLKGVQQEVDVIVANILADILIHLTDDAYRLVKDEGYLIMSGIISEKWDMVRESAEKAGFFLETHMVQGEWNACVFKKTDDISGVIGG

SEQ ID NO: 1705 - DNA, 951 bp, Streptococcus pyogenes
atggaaacgtggcaagaagtgacggttcatgtgcatcgtgatgcgcaagaggctgtttcacatgtgttgattgagacaggcagtcaaggggttgctatcgcagatagcgcagactatattgggcaaaaggaccgctttggggagttatacccagatgtggagcagtctgacatgatagctatcacagcctattacccaagtagtactaatttggcggatattattgcgaccattaatgaacagttagcggagttagctagttttgggttacaggttggtcaggttactgtggacagtcaagaattggctgaggaagactgggcagacaattggaaaaaatactatgaaccagctcgcatcacgcatgatttaaccattgtccctagttggacggattatgacgcttctgctggggaaaaagtgattaaactagatcctggaatggcatttgggacagggacacatcccacaactaagatgagcctttttgccttggaacaaatccttcgtggtggtgagacagttatcgatgtagggaccggttcaggtgtcctctcgattgccagttccttactaggtgctaaaaccatctacgcttatgacttagatgacgtggctgttcgagtggctcaagacaacattgatttaaaccaaggaacagacaacattcatgtggctgctggtgaccttttaaaaggggttagccaagaagcggatgtgattgtagccaatatcttggcggatatcttagtcttattgactgatgatgcttaccgtttggtcaaaaaggaaggttaccttatcttatctggcatcatttctgagaaattggatatggttctggaagctgcctttagcgcaggctttttcttagaaactcacatggttcaaggtgagtggaatgcccttgtctttaaaaaaacagatgatatctcaggagtgattggcggc

SEQ ID NO: 1706 - protein, 317 aa, Streptococcus pyogenes
METWQEVTVHVHRDAQEAVSHVLIETGSQGVAIADSADYIGQKDRFGELYPDVEQSDMIAITAYYPSSTNLADIIATINEQLAELASFGLQVGQVTVDSQELAEEDWADNWKKYYEPARITHDLTIVPSWTDYDASAGEKVIKLDPGMAFGTGTHPTTKMSLFALEQILRGGETVIDVGTGSGVLSIASSLLGAKTIYAYDLDDVAVRVAQDNIDLNQGTDNIHVAAGDLLKGVSQEADVIVANILADILVLLTDDAYRLVKKEGYLILSGIISEKLDMVLEAAFSAGFFLETHMVQGEWNALVFKKTDDISGVIGG

SEQ ID NO: 1707 - DNA, 306 bp, Streptococcus agalactiae
atggggtattttacagtattttggcagaaagatggaaatggtaaaaatattcctttttatgaacaagatgaagtggaagatttgattattgtcattaaagatggtaggtggaaaggtttgttcatcattcccaaagaggttgcagtgagtaagggtattctttcatctgctaactctcaaggaaagatggctatgcgattttaccctccttggtgtagcgatttaaatagaacagctttggtgacacagcgatggcagttgaactattttattgatttaagtagaaataatgaaggagttactaca

SEQ ID NO: 1708 - protein, 102 aa, Streptococcus agalactiae
MGYFTVFWQKDGNGKNIPFYEQDEVEDLIIVIKDGRWKGLFIIPKEVAVSKGILSSANSQGKMAMRFYPPWCSDLNRTALVTQRWQLNYFIDLSRNNEGVTT

SEQ ID NO: 1709 - DNA, 714 bp, Streptococcus agalactiae
atgaaaacagttaaagaagtcagtatcttaagcggtgtaagtgtgcgcaccttgcatcactatgataaaatcggtttattcccacctaccgccctatccgaagcaggctatcgactttatgacgatgaagcattgattcgcctgcaagaaattttgctatttcgtgagttggaattccctctcaaagatatcaaatacctgcttgagcaagcaaaagaggaaaggcaagacttattagcccaacaaatcaaattgcttgaatggaaaagatcgcaccttgagcaggttatcacccatgcgaaacgattacaagaaaaaggagatgattatatgaatttcgatgtttataataaaacagaattagaacaattacaagctgaagcaaaagaaaagtggggacaaacagcagcctacaaagaatttgctcaaaaacatgcttcagatgactttgcacaaattagccaagaaatggcaaaaataatggtacaatttgggcaattaaagacacaaaatgtatctgatgaatctgttcaaatgtgtgtgaaacggctacaagactatatctctcagaatttttacacctgtaccaatgaaatccttgctggactaggacaaatgtatcaatcagatgaccggtttagtcaatcaattgacaaagctggtggagcaggaacaagtgaatttgtcagccaagctattgcttactattgccaa

SEQ ID NO: 1710 - protein, 238 aa, Streptococcus agalactiae
MKTVKEVSILSGVSVRTLHHYDKIGLFPPTALSEAGYRLYDDEALIRLQEILLFRELEFPLKDIKYLLEQAKEERQDLLAQQIKLLEWKRSHLEQVITHAKRLQEKGDDYMNFDVYNKTELEQLQAEAKEKWGQTAAYKEFAQKHASDDFAQISQEMAKIMVQFGQLKTQNVSDESVQMCVKRLQDYISQNFYTCTNEILAGLGQMYQSDDRFSQSIDKAGGAGTSEFVSQAIAYYCQ

SEQ ID NO: 1711 - DNA, 741 bp, Streptococcus pyogenes
gtggaaatgtctcaattctattcgactggagaattggccaacttagctggcgtttctattcgaactgtccaatactatgaccaacgtgggattttgattccgacagcattgacagcaggtggacggcgactctatacggattctgatttagaacaattacgcatgatttgctttctgcgcgatttgggattttccattgagcagattcgcaaagtcttagcagaggaaaatgcagcccaggtgctggaattgcttctagttgatcatattgcgactgccaaggaagacttggctgcaaaagagcaacaagttgacatagctgtcaagatacttgacagacttcgaaaacaagacccccagtcactagattttctgatggacatttcgcttagcatgaaaaatcaaaaagcttggaaaaaattacaatggaagatgggtatcagtatatttttagccattgtttcatatgtaggacttattttactatctagttatctgcaaaaattttggttagtttatgttgctatgggactatttctaccaggtttcagttggttggtaatttattttaggaagcaatttatttatctctgtccccattgtcatcagaaatttgaacctagctttaatgaatttgcccttgcaggccatacaccacgaaccagaaagttaacctgctcccattgccatcaaaaatcgtattgcttggaactggcaaaagaggacactgtctcaagaaga

SEQ ID NO: 1712 - protein, 247 aa, Streptococcus pyogenes
VEMSQFYSTGELANLAGVSIRTVQYYDQRGILIPTALTAGGRRLYTDSDLEQLRMICFLRDLGFSIEQIRKVLAEENAAQVLELLLVDHIATAKEDLAAKEQQVDIAVKILDRLRKQDPQSLDFLMDISLSMKNQKAWKKLQWKMGISIFLAIVSYVGLILLSSYLQKFWLVYVAMGLFLPGFSWLVIYFRKQFIYLCPHCHQKFEPSFNEFALAGHTPRTRKLTCSHCHQKSYCLELAKEDTVSRR

SEQ ID NO: 1713 - DNA, 468 bp, Streptococcus agalactiae
atgattactttacaaaaggcggaagctagtgatttagagaagattattgccattcagagagctagctttaaggcagtctatgagaaataccacgatcaatacgatccctatgtggaagaagttgagcagattcgatggaaactagtggagcgaccagattgtttctatcattttgtccttgttgatgagacaattgttggttttcttagattggttatcaaagacgaggagaagcgtgcttggcttggtacggcggctattcttccccaatatcaagggcagggctacggctcagcagcgatggctttattagagaaaacctatcctaagcttacaaagtgggatttatgtacgattgcgcaagaaaaactaatggtcagtttttatgaaaaatgtggttatcattcaacccataccgaacctgagcaagaaggaatggatatggtctatatgacaaagaagatagaa

SEQ ID NO: 1714 - protein, 156 aa, Streptococcus agalactiae
MITLQKAEASDLEKIIAIQRASFKAVYEKYHDQYDPYVEEVEQIRWKLVERPDCFYHFVLVDETIVGFLRLVIKDEEKRAWLGTAAILPQYQGQGYGSAAMALLEKTYPKLTKWDLCTIAQEKLMVSFYEKCGYHSTHTEPEQEGMDMVYMTKKIE

SEQ ID NO: 1715 - DNA, 456 bp, Streptococcus agalactiae
atggatatttttgatgagttatttgatttctcaggtgcaaagatcgctcttttctgcgagggaaagattttgaccagcctaagagatgattttccagatttgccctatgcaggcttttgggacttaccaggcggtggtcgtgaggacaatgaaacacctttggaatgtctttttcgtgaagttgatgaagaattaagtctgaccttaactcgaaaccatattgattgggtcaagacttataggggtatgttgaagcctgataaattatcagtttttatggttggacatatcagtcagaaagagtacgatagcattgttctaggcgatgaaggacaagactacaaactcatgtccattgacgaatttttaagccataaaaaggtcattcctcagttgcaggagaggttgagagattatttggaggtggaagatgattactttacaaaaggcggaagc

SEQ ID NO: 1716 - protein, 152 aa, Streptococcus agalactiae
MDIFDELFDFSGAKIALFCEGKILTSLRDDFPDLPYAGFWDLPGGGREDNETPLECLFREVDEELSLTLTRNHIDWVKTYRGMLKPDKLSVFMVGHISQKEYDSIVLGDEGQDYKLMSIDEFLSHKKVIPQLQERLRDYLEVEDDYFTKGGS

SEQ ID NO: 1717 - DNA, 468 bp, Streptococcus agalactiae
atggctaaatttggatttttatcggtactagaagaagaattggataagcatttacagtatgactttgccatggattgggataagaaaaatcatactgtagaagtcacttttatattagaagcacaaaacagctctgctattgaaaccgtggacgaccagggggagacgagtagcgaggacatcgtttttgaggactatgtactcttttacaaccctgtcaagtctcgctttgatgctgaggactatctggtgactatcccctatgagcctaagaagggcttgtcgcgtgagtttctggcttattttgcggagactctcaacgaggttgccactgaagggttgagcgacctcatggacttcctcaccgatgacagtatcgaagagttcggtctttcttgggatacggatgcttttgaaaatggcagagcagaactgaaagagacagagttttacccttatccgagatat

SEQ ID NO: 1718 - protein, 156 aa, Streptococcus agalactiae
MAKFGFLSVLEEELDKHLQYDFAMDWDKKNHTVEVTFILEAQNSSAIETVDDQGETSSEDIVFEDYVLFYNPVKSRFDAEDYLVTIPYEPKKGLSREFLAYFAETLNEVATEGLSDLMDFLTDDSIEEFGLSWDTDAFENGRAELKETEFYPYPRY

SEQ ID NO: 1719 - DNA, 468 bp, Streptococcus pyogenes
atggcaacatacggctttttatcagtattagaagaagaaatggataagcattttcagtatgactatgctatggattgggacaagaaaaatcatgcggttgaagtgacttttgtgttagaagctcaaaataaagaggctataaaaaccattgacgatagtggcgaagtgacccaagatgatattgtctttgaggactatgtgctcttttataaccctgccaagtctcaatttgatgcagcagattatttggttactattccttttgacgctaaaaagggcttttctcgtgaattcttagcttactttgcgcaatttctcaacgatgttgctattgaagggcacagcgatttgatggatttcttagcagatgacagcaaggctgatttcttcttggagtggaacgcgcaagcttttgaagaaggtcaacaaggactagaagaagcagcaagttacccttacccaaggtac

SEQ ID NO: 1720 - protein, 156 aa, Streptococcus pyogenes
MATYGFLSVLEEEMDKHFQYDYAMDWDKKNHAVEVTFVLEAQNKEAIKTIDDSGEVTQDDIVFEDYVLFYNPAKSQFDAADYLVTIPFDAKKGFSREFLAYFAQFLNDVAIEGHSDLMDFLADDSKADFFLEWNAQAFEEGQQGLEEAASYPYPRY

SEQ ID NO: 1721 - DNA, 489 bp, Streptococcus agalactiae
atgattatcagacctatgcaggactgcgaccgtgaggcagttctgaccttacaaaatactggctggactgctcttacctctcctgtctatgaccgcaagtggactgagagtgatttggagaagaatctggcaaatggcatgtccttctttgtcgctgaggtcgatgataagatcgctggcgtcttggactttggtccctactatcctttcccagctggcaagcatgttgccactttcggcattctcatcgctgaaccctaccaaggtcagggactgggtaaagctctcttgaaagctctgctaactgaggctaaagctcaaggttacatcaagattgccatgcatgtcatgggcaataacagcagagccatttccctctatcaaaaatacgggtttaccgaagaggctcgaatcactaaagcctttttcattgaaaatcattatgttgatgctttaattttcgcaaaagatttggagaataatcatggc

SEQ ID NO: 1722 - protein, 163 aa, Streptococcus agalactiae
MIIRPMQDCDREAVLTLQNTGWTALTSPVYDRKWTESDLEKNLANGMSFFVAEVDDKIAGVLDFGPYYPFPAGKHVATFGILIAEPYQGQGLGKALLKALLTEAKAQGYIKIAMHVMGNNSRAISLYQKYGFTEEARITKAFFIENHYVDALIFAKDLENNHG

SEQ ID NO: 1723 - DNA, 522 bp, Streptococcus pyogenes
atggttcagcaaagtctcgttattgaagaaggcgtacctcaagatgcaaaagctgtactttccttagtgacggcagctgccaaagaaacagattttataacaggcgtagagactatattagaggctactcctcaagaattgtcagactttttatcaagaagtcaaacctcttttattgatttttgcctgctagctagattagatgaaaaagtagtagggcttttaaatctttctggggaagtattatcccaaggccaagctgaagcagatgtatttatgttagttgctaagacttaccgtggttatggtatcggtcaattattgttagagattgctcttgattgggctgaagaaaacccttatatcgaaagccttaagttggacgttcaagtaagaaatactaaggctatttacctgtataaaaagtatggttttcgtattgaaagtatgcgaaaaaacgacatcaaatcaaaaaatggagatgacttagatgtttatcatatgcgtaaatctgtaagtcag

SEQ ID NO: 1724 - protein, 174 aa, Streptococcus pyogenes
MVQQSLVIEEGVPQDAKAVLSLVTAAAKETDFITGVETILEATPQELSDFLSRSQTSFIDFCLLARLDEKVVGLLNLSGEVLSQGQAEADVFMLVAKTYRGYGIGQLLLEIALDWAEENPYIESLKLDVQVRNTKAIYLYKKYGFRIESMRKNDIKSKNGDDLDVYHMRKSVSQ

SEQ ID NO: 1725 - DNA, 1266 bp, Streptococcus agalactiae
atggctgacaatcttgctctacgtatgcgtcctcgcaatattaatgaagttatcgggcagcaacatctcgttggtaatggcaaaattattgatcgaatggttgcagctaatatgttatcttccatgatcctatatggcccaccaggtattgggaagacttctattgcttctgctattgctggtactactaaatatgcctttcgtacttttaatgccactgttgatagtaaaaaacgtcttcaagaaattgcagaagaagctaaattttctggtggcttagttttattacttgacgagattcatagacttgacaagacaaaacaagattttcttttacctctacttgagaatggcaatattattatgattggagcaacaactgaaaatcctttcttttcagtaactcctgccattagaagtagggtacaaatttttgagttagaacctctttctaacgaggatattaaaaaagccattcagctagcaatttccgataaagaacggggatttccttttttagtgacaattgatgatgaggcgctagattttattgttaccgccacaaatggagacctacgatctgcttataattccttggatctagcagtcatgtctacttctcctaatgaagatggtagccgtcatattagtctagagacaatggaaaatagtctgcagtgtagttatattacaatggataaaaacggagatgggcattatgatatcctatcagccttacaaaaatcaattagaggttctgatgtcaatgccagcctgcactatgccgctcgtttagtagaagccggagatttacctagtttagcaagacgtttgaccattattgcttatgaagatatcggcttagctaaccccgaagcacaaatacatactgtgactgcattggaagctgcccaacgcattggttttccagaagctcgtattcttattgctaacattgttgtggatttagctctatcacctaaatcaaattcagcctatttggctatggatgcagctttagctgatttacgtcgttcaggaaatttacctattccacgtcacctaagagatggacattacagcggtagtaaaaccttgggcaatgcaagggattacaagtaccctcacgcctatcctgaaaaatgggttaaacaacaatacttaccagataaactagtaggacataattactttgaagccaatgaaactggtaaatacgaacgcgcacttggttcaaataaagagcgcattgataagctctcagac

SEQ ID NO: 1726 - protein, 422 aa, Streptococcus agalactiae
MADNLALRMRPRNINEVIGQQHLVGNGKIIDRMVAANMLSSMILYGPPGIGKTSIASAIAGTTKYAFRTFNATVDSKKRLQEIAEEAKFSGGLVLLLDEIHRLDKTKQDFLLPLLENGNIIMIGATTENPFFSVTPAIRSRVQIFELEPLSNEDIKKAIQLAISDKERGFPFLVTIDDEALDFIVTATNGDLRSAYNSLDLAVMSTSPNEDGSRHISLETMENSLQCSYITMDKNGDGHYDILSALQKSIRGSDVNASLHYAARLVEAGDLPSLARRLTIIAYEDIGLANPEAQIHTVTALEAAQRIGFPEARILIANIVVDLALSPKSNSAYLAMDAALADLRRSGNLPIPRHLRDGHYSGSKTLGNARDYKYPHAYPEKWVKQQYLPDKLVGHNYFEANETGKYERALGSNKERIDKLSD

SEQ ID NO: 1727 - DNA, 1266 bp, Streptococcus pyogenes
atgcctgatcatttagcgctcagaatgcgccccaaaaccatttcagaggtcatcggacaaaaacaccttgttggcgaaggcaaaatcatccgtcgcatggtggaagcaaatagactatcgtccatgatcctctatggccctccaggaatcggtaaaacttccattgcttctgctattgctggtactactagatatgcctttcggacctttaatgccaccattgacagcaaaaaacgtctccaagaaattgcggaagaagctaaattttctggtggcttggtattattactagacgagattcatcgccttgacaagacaaaacaagattttcttttacctttacttgagaatggcaccattatcatgattggcgcaaccactgagaaccccttcttttcagtgacacccgctatcagaagcagggtccaaatttttgaattggaaccactttctaacgaggatattaaaacagccattcagctagcaatttccgacaaagaacggggatttccttttttagtgacaattgatgatgaggcgctagatttcattgttaccgccacaaatggagacctacgatctgcttataattccttggatctagcagtcatgtctacttctcctaatgaagatggtagtcgtcatattagtctagagacaatggaaaatagtctgcagcgtagttatattaccatggataaaaacggggacgggcattatgatgttttatctgccttacaaaaatccattagaggttctgatgtcaatgctagcctgcactatgccgctcgtttagtagaagctggagacttgcctagtttagcaagacgattgaccattattgcttacgaagatattggcttagccaaccctgacgcccaagttcataccgtcaccgcactagatgccgcccaacgcattggttttccagaagctcgtattcctatcgctaacgtggtcattgatttggctctatcacctaaatccaattcagcttatttagctatggatgcagctttagctgatttgagaacatcaggcaacctccccattccaagacatcttagagacgggcattatgctggcagcaaggacctaggcaatgccaaagattacctctacccacacgcctaccctgaaaaatgggtcaaacaacaatacctaccagataaattagtaggacatcattattttgaagccaatgaaaccggtaaatacgaacgcgcacttggttcaaataaagagcgtattgataagctctcagac

SEQ ID NO: 1728 - protein, 422 aa, Streptococcus pyogenes
MPDHLALRMRPKTISEVIGQKHLVGEGKIIRRMVEANRLSSMILYGPPGIGKTSIASAIAGTTRYAFRTFNATIDSKKRLQEIAEEAKFSGGLVLLLDEIHRLDKTKQDFLLPLLENGTIIMIGATTENPFFSVTPAIRSRVQIFELEPLSNEDIKTAIQLAISDKERGFPFLVTIDDEALDFIVTATNGDLRSAYNSLDLAVMSTSPNEDGSRHISLETMENSLQRSYITMDKNGDGHYDVLSALQKSIRGSDVNASLHYAARLVEAGDLPSLARRLTIIAYEDIGLANPDAQVHTVTALDAAQRIGFPEARIPIANVVIDLALSPKSNSAYLAMDAALADLRTSGNLPIPRHLRDGHYAGSKDLGNAKDYLYPHAYPEKWVKQQYLPDKLVGHHYFEANETGKYERALGSNKERIDKLSD

SEQ ID NO: 1729 - DNA, 99 bp, Streptococcus agalactiae
ttggctttgtttctgaatcaacaacatgggattccattccttggtaactttgaaaaagccagagatgaaaaaggctacaatggtcatcagacaagctat

SEQ ID NO: 1730 - protein, 33 aa, Streptococcus agalactiae
MALFLNQQHGIPFLGNFEKARDEKGYNGHQTSY

SEQ ID NO: 1731 - DNA, 108 bp, Streptococcus agalactiae
atgggattccattccttggtaactttgaaaaagccagagatgaaaaaggctacaatggtcatcagacaagctattaatacgcctgcagttttacgaaagattacagag

SEQ ID NO: 1732 - protein, 36 aa, Streptococcus agalactiae
MGFHSLVTLKKPEMKKATMVIRQAINTPAVLRKITE

SEQ ID NO: 1733 - DNA, 759 bp, Streptococcus agalactiae
atgaccggattgatccccatgctcaaaaaagagtggctagaaaatagccgtagtcataaagctcttgcccttctccttatttcaatcattttcggaatattaggaccactcacagcattactgatgccagaaatcatggcagggattttgcctaagaaactgcaagaagctattcctgacccaacctaccttgattcttatagtcaatattttaaaaatattaatcagctaggattgattctattagtttttctttttagtggtagtttgactcaagaatttaccagaggtacacttattaatcttattaccaaaggactaagcaaaaaagccattatcttagcaaaatttatcatgatgacacttatttggagcatcagctatatactaggatcacttacccagtatgcttatacactttattattttaataatcatggtcagcataaacttattgtttacggtacatcctggatctttggattattattgctgagtctcattcttttttactctgtaatctttcgtaaaactgcaggcgtattaatagcttgtctgatgaccattgtagcctttttcatctctggctttttcaaagttaccaaggaatggaatcccatgttgttgattcagaaacaaagccaaatcctaagtggtcaatatgacatcaaagatttattacaaccaactctcttagtcatcggtattatcttaatcagtttgatatctgctaaagtcatttttgagaaaagtgaagtt

SEQ ID NO: 1734 - protein, 253 aa, Streptococcus agalactiae
MTGLIPMLKKEWLENSRSHKALALLLISIIFGILGPLTALLMPEIMAGILPKKLQEAIPDPTYLDSYSQYFKNINQLGLILLVFLFSGSLTQEFTRGTLINLITKGLSKKAIILAKFIMMTLIWSISYILGSLTQYAYTLYYFNNHGQHKLIVYGTSWIFGLLLLSLILFYSVIFRKTAGVLIACLMTIVAFFISGFFKVTKEWNPMLLIQKQSQILSGQYDIKDLLQPTLLVIGIILISLISAKVIFEKSEV

SEQ ID NO: 1735 - DNA, 900 bp, Streptococcus agalactiae
atgacagccatttctttacaaaatctgtccaaatcctttggggatcaaatcattttaaatcaggtttccttagagctagaagaaaataagatttatggctttgttggtccaaacggggccggtaaaaccaccaccattaagatgattttaggtttattgaaagtagactctggtaccatttcagtaatgggaaacccagtgacttttgggcagacaaaaagtaatcaagttattggttatttgcctgacgttccggagttttatgactatatgacggcacaagaatacttacaactttgcgctggcttagctcaaaacaaaaccagtttaccaattgctgatctgctagaacaggtcggcttagccgataatcagcaacgcattagcacctattctcgaggtatgaaacaacgcttaggtctagcccaagcactgattcacaatcctaaaattctgatttgtgatgaaccaacatcagccttagaccctcaaggacgacaagaaatcctctccattatttctcaactacgtggtcaaaagacagtcattttctcgacacacatcttatcagatgtggaaaaagtctgtgatcaagttctaattctaacaaaatcaggtatccataatctagaagatctaagagacaaagcgtcagccagtgtgaatcaactgaaccttttaataaaagtctcagacaatgaagcacaaaaattagctctgcgatttcctttaaatcaaaaagatcaatattataaggtacatttggaattgagtgaggcaaacaatcgtgaacaagcattagcaagtttttacaggtatttagttgagcaagaaatcacgccatacttcattgaattactggaagatagcctggaagacttctatttggaggtgattaaa

SEQ ID NO: 1736 - protein, 300 aa, Streptococcus agalactiae
MTAISLQNLSKSFGDQIILNQVSLELEENKIYGFVGPNGAGKTTTIKMILGLLKVDSGTISVMGNPVTFGQTKSNQVIGYLPDVPEFYDYMTAQEYLQLCAGLAQNKTSLPIADLLEQVGLADNQQRISTYSRGMKQRLGLAQALIHNPKILICDEPTSALDPQGRQEILSIISQLRGQKTVIFSTHILSDVEKVCDQVLILTKSGIHNLEDLRDKASASVNQLNLLIKVSDNEAQKLALRFPLNQKDQYYKVHLELSEANNREQALASFYRYLVEQEITPYFIELLEDSLEDFYLEVIK

SEQ ID NO: 1737 - DNA, 1077 bp, Streptococcus agalactiae
atgattggtgatactattttatttgaacgcacacgtcttggtatgactcaagaaaaactgagtgactatttgcatttaaccaaggctacaatttccaaatgggaaaacaatcaggcaaaacctgatatcgattacttgattctaatggcaaaactatttgatatgactttagatgagttggtaggttttcaaaaaacactaactgactctgaaagagggcatctttttgaacaattgcgaggacaaattgaccaacaaaatgggactgaattctttcataacattcaagacttagcaaaacattatatcaatgataacaaaacccttttactcctcgtccaactggttttgagcaatccagctcagattgatagtaacccttggtcattagaactaatcaatcggattatcagcaaaacaactgttgaatctgaacttcagtctgccatcatgttaaaagtagtaatactttttcaacaaaaaaaatacgatgatattatcgcactttatcagaatcgtccttataaacttggtgaggagttatttttggccaatagcttcgctgctaagggggaaacagagcaagcaaaacaagttttacaagttgaaatttaccagcaaattctgctgatttgccaatatctgttaagcctaacggcttttgaatgtcccgaacggcaagaattcattttggaacgactggaaaatcttatggccacatttgacctcaaaaagcttcatcctaatacagccatttcctcttactacagtttggcctgttatttcgctgaaagtcagccccaaaaagcaattagttacttaaatcaattggcagaggctacccgaaacctattaaaacaatttgaactgcatggcgacagcttttttgatgccatcgatccttggctccaacagttaccaacaggaattcagccaccaaccaattctcaaatcttaatccaaagggtaattgccctgtttcatagtccacagtttcaatacttacagcaagaaaagtccttccaagctcagcttgctgctttaaaaaaactcgaaaaggagatttcagatgaacac

SEQ ID NO: 1738 - protein, 359 aa, Streptococcus agalactiae
MIGDTILFERTRLGMTQEKLSDYLHLTKATISKWENNQAKPDIDYLILMAKLFDMTLDELVGFQKTLTDSERGHLFEQLRGQIDQQNGTEFFHNIQDLAKHYINDNKTLLLLVQLVLSNPAQIDSNPWSLELINRIISKTTVESELQSAIMLKVVILFQQKKYDDIIALYQNRPYKLGEELFLANSFAAKGETEQAKQVLQVEIYQQILLICQYLLSLTAFECPERQEFILERLENLMATFDLKKLHPNTAISSYYSLACYFAESQPQKAISYLNQLAEATRNLLKQFELHGDSFFDAIDPWLQQLPTGIQPPTNSQILIQRVIALFHSPQFQYLQQEKSFQAQLAALKKLEKEISDEH

SEQ ID NO: 1739 - DNA, 594 bp, Streptococcus pyogenes
gtgatatttatggaaattggtcagcaaattattcgctaccgtaaacaacaagcgctctcgcaagaaaaattagccgagaaagtctatgtaagccgtcagagcatatctaactgggaaaatgacaaaacttacccagacatccatagcctcttactcctaagtcaaatttttcaagtgagcttagaccaactcattaaaggagacattgagaaaatgaaatataccatcactcaggttgataaaaagaattttaaacgagataccaaagtaatggtaacattgatgatactattaatgatttcaagttatccattagtctatttcttagagtggctaggacttggcatttttgttttattatcgataattactatgacttatgctaatcgtgtggaacgttttaagaaaaaatatgatgtgcaaccttataaggaaatcctagctgtttcaaatggaaaattattagacgaaatcgaaaaacgagaagaaagagcaacacttccttatcagaaaccccttattgtcactgtatttttcctcattactgttgcttttgcttttgcaagtcgttttatgtttacatggttattccat

SEQ ID NO: 1740 - protein, 198 aa, Streptococcus pyogenes
VIFMEIGQQIIRYRKQQALSQEKLAEKVYVSRQSISNWENDKTYPDIHSLLLLSQIFQVSLDQLIKGDIEKMKYTITQVDKKNFKRDTKVMVTLMILLMISSYPLVYFLEWLGLGIFVLLSIITMTYANRVERFKKKYDVQPYKEILAVSNGKLLDEIEKREERATLPYQKPLIVTVFFLITVAFAFASRFMFTWLFH

SEQ ID NO: 1741 - DNA, 315 bp, Streptococcus agalactiae
ttggatataacagcttatcaaaaatgggttagtgaattttacaaaaaaagaaattggtaccagtataattcgtttataagaagtaattttttatgcgaagaggttggggaattagcgcaagctattcgaaaatatgaaattggtcgtgatagaccagatgaaatcgagaaatcaaacaacgaaaatttaaacgatatcaaagaagagcttggggatgtattggataatatttttattctcgcagatcaatataacatttccttagaagaaattattgaggcacataaaaacaaattagaaaagagatttgaagaa

SEQ ID NO: 1742 - protein, 105 aa, Streptococcus agalactiae
MDITAYQKWVSEFYKKRNWYQYNSFIRSNFLCEEVGELAQAIRKYEIGRDRPDEIEKSNNENLNDIKEELGDVLDNIFILADQYNISLEEIIEAHKNKLEKRFEE

SEQ ID NO: 1743 - DNA, 564 bp, Streptococcus agalactiae
atgaaaataactgtcttttgcggtgcaagcaacgggaataacccaatctacagtcagaaaatagtagaacttggtgaatggatgattaaaaataatcatgatttagtttatggtggcggaaaagttggcttaatgggagtaattgctgatactgttattaataatggtggccaagcaattggcgttatacctacatttttaaaagatagagagatcgcccacactaatttatcaaagcttattgttgtcgaaaatatgccacaacgaaaagggaaaatgatgtctcttggagaagcatatattgcattacctggtggaccaggaactttagaggaaatttcagaggtaatctcttggtctcgaattggtcaaaatgatagtccatgcattctttataatatcaatggttatttcaatcacctagaaagtatgtttgatcatatggtctctgaaggcttcctgagtcaaaatgatagaaataacgtactattctcagacgatatcattgaaattgaaaagtttattaaagattatcaatcacctacaattcgtaagtatagcaat

SEQ ID NO: 1744 - protein, 188 aa, Streptococcus agalactiae
MKITVFCGASNGNNPIYSQKIVELGEWMIKNNHDLVYGGGKVGLMGVIADTVINNGGQAIGVIPTFLKDREIAHTNLSKLIVVENMPQRKGKMMSLGEAYIALPGGPGTLEEISEVISWSRIGQNDSPCILYNINGYFNHLESMFDHMVSEGFLSQNDRNNVLFSDDIIEIEKFIKDYQSPTIRKYSN

SEQ ID NO: 1745 - DNA, 153 bp, Streptococcus agalactiae
atgatagatgaagaatttaaaaatttggtagaacaaaaaagtataggtaaaaaactaaatatcaataataaagaagctattgaagaattttttgtagatgaagatatttctgagtatgattctttattttcgaataaaattgaaaagttagaa

SEQ ID NO: 1746 - protein, 51 aa, Streptococcus agalactiae
MIDEEFKNLVEQKSIGKKLNINNKEAIEEFFVDEDISEYDSLFSNKIEKLE

SEQ ID NO: 1747 - DNA, 1125 bp, Streptococcus agalactiae
atggcaaatgcaagatatagaaggagaggaaaccagaatttatgggcttatgaaatccgagaggaaggtaaaacagttgcttataatagtggctttaaaacaaagaaactagcagaggcagaagcagagcctattctccaaaaattgagaactggtagcataatcacaaaaaatatttcattaccagaactttatcaagaatggctagatttaaaaatcatgcctagtaatagaagtgatgtgactaaaaagaaatatcttagtcggaaggtaacgcttgaaaagctatttggtgataaacccatttctcaaatcagacctagtgaatatcaacgaattatgaataactatggacaacgagttagtcgcaatttcttaggccggttaaatactggcgtgaaacagagtttgcaaatggctattgctgataaggttatgatagaagattttactcaaaatgtagaattattctcaacagtaaaaagtcaggatgcagatagtaaataccttcatagtgaaaaagcttatttggatctcattaatgctgtaaaagataaattcaattataagaaatcggtagtaccatatattatctattttttattaaaaacaggtatgagatacggagaattaattgctttaacttgggaagatattgattttgataagggaatctttaaaacatatagaagatttaactctgaaacaagtcagtttgttccacctaaaaataaaacctcaatcagaattgttccagttgataatgagtgtctagaaatcttgaaaaatcttaagattgaacaaaatcaatcaaataaagagcttggattacaaaatacaaacaatatggtatttcaacattttggttatcctaatagtgtaccgagtacaaacggtacaaataaggttttaagaggcatcgttcaagagttgaatatagaacccatcattacaacaaaaggtgctagacacacctatggaagcttcctatggcatagaggatatgatctaggaattattgcgaaaattcttggccataaagatatttctatgctaattgaagtctatggtcatactcttgaagaaaaaattcaagaagagtacaatgagataaaacaactatgg

SEQ ID NO: 1748 - protein, 375 aa, Streptococcus agalactiae
MANARYRRRGNQNLWAYEIREEGKTVAYNSGFKTKKLAEAEAEPILQKLRTGSIITKNISLPELYQEWLDLKIMPSNRSDVTKKKYLSRKVTLEKLFGDKPISQIRPSEYQRIMNNYGQRVSRNFLGRLNTGVKQSLQMAIADKVMIEDFTQNVELFSTVKSQDADSKYLHSEKAYLDLINAVKDKFNYKKSVVPYIIYFLLKTGMRYGELIALTWEDIDFDKGIFKTYRRFNSETSQFVPPKNKTSIRIVPVDNECLEILKNLKIEQNQSNKELGLQNTNNMVFQHFGYPNSVPSTNGTNKVLRGIVQELNIEPIITTKGARHTYGSFLWHRGYDLGIIAKILGHKDISMLIEVYGHTLEEKIQEEYNEIKQLW

SEQ ID NO: 1749 - DNA, 183 bp, Streptococcus agalactiae
atgacaaataatgtaatgactaataaagacttaattgaaatgggctattgtccttcaacagcaaaccatattatccatcaagctagaaatttaatggtggaacgtggttatactttctatgatcgtaaacgtcttatggttgtccctagaagtgcagtttcagaagtgattggacttgaggta

SEQ ID NO: 1750 - protein, 61 aa, Streptococcus agalactiae
MTNNVMTNKDLIEMGYCPSTANHIIHQARNLMVERGYTFYDRKRLMVVPRSAVSEVIGLEV

SEQ ID NO: 1751 - DNA, 1026 bp, Streptococcus agalactiae
ttgtttaacagcgttaagatagattatttcgctgttacagtaaaagatgtcactccagagtatgtaatagagaaacttttattaatacctttaaccaattttactttgaacgaatggggagtcaataagtatcaacgtcactatgcttgttcagagataaaagtttactttaacttagatcctaatagtagcatgggagttcatgttgaactaaaaggacaaggctgtcggcagtatgaggaatttatagaaggtaatgataataattggactagtttagtaaagagactaattgataataattcgaactttaccagattagatattgcgaatgatatttttgatgagtcgttaaatgttcaaaggctttatgagtatagtaaaaaaggcttatgtataacaactgcgagacatgcagagtaccatgaaaaattcgttattgattcaggtgaactcgttggtgaaacagttgtctttggtgcaagaggaaaccaacaatggtgtgtttataataaattaatggagcaaaatggaaaattacagacggatattgacattaattcatgggttcgagctgagctaagatgttggcaagagaaggctaatctaattgctcatcagctaaatgatatgcgccctctcgcctctatatattttgaggctatcaatggacattaccgttttgtttctccaaaagcaagagataaaaataaacgaagaagagaatctgtaagatggtggcaaaactatatcaatacagaggagaaaacacgactgagtattgtgagagaaaaaccaacattaaggcagtctgaagcgtggactgataaacaagtgtcaaagacaattgcaaaggtttatatggcaaaatacgaagcctacggtatcgatcaggcagaggtctttttacaagacttacttcgcaggggagttgaaaagtttactgataatgacgaaaaggagattgaacaatatgtacgtgaacagcaaagctctgaatattggggcataaaaaaagccgacttg

SEQ ID NO: 1752 - protein, 342 aa, Streptococcus agalactiae
MFNSVKIDYFAVTVKDVTPEYVIEKLLLIPLTNFTLNEWGVNKYQRHYACSEIKVYFNLDPNSSMGVHVELKGQGCRQYEEFIEGNDNNWTSLVKRLIDNNSNFTRLDIANDIFDESLNVQRLYEYSKKGLCITTARHAEYHEKFVIDSGELVGETVVFGARGNQQWCVYNKLMEQNGKLQTDIDINSWVRAELRCWQEKANLIAHQLNDMRPLASIYFEAINGHYRFVSPKARDKNKRRRESVRWWQNYINTEEKTRLSIVREKPTLRQSEAWTDKQVSKTIAKVYMAKYEAYGIDQAEVFLQDLLRRGVEKFTDNDEKEIEQYVREQQSSEYWGIKKADL

SEQ ID NO: 1753 - DNA, 417 bp, Streptococcus agalactiae
atggcaacaattaaattaacagatacagtaagtctaggtgacttaaacttggaaaaatctcaatttgaaattcccaaaaaagtaattatcttatccgcacgtattaacaataaatataataatatcaatggtgaatcagttcaaactgatgaaatttcaaaaataacttgccaagtacaagatgcggaaaaagttaaagtcttaaaagaaatgggaatgtctgccgacgacttaaaaacaattccattagaaatcttggataatcttgataagattagtaaaattgcaagcaatgatgggcttattgaaaaaacgattgaattgattaatccccaagttcgtctagcatggaatataaatcgaaaaggttggggtggaataaaactgactacctcagatatcaaaattataggtgaa

SEQ ID NO: 1754 - protein, 139 aa, Streptococcus agalactiae
MATIKLTDTVSLGDLNLEKSQFEIPKKVIILSARINNKYNNINGESVQTDEISKITCQVQDAEKVKVLKEMGMSADDLKTIPLEILDNLDKISKIASNDGLIEKTIELINPQVRLAWNINRKGWGGIKLTTSDIKIIGE

SEQ ID NO: 1755 - DNA, 612 bp, Streptococcus agalactiae
atgacatatataattcaaaatttcggtccaaatttgactagattacgaaaagaacgtggaatcagtcaagttgaactttccaatcaactccaaattggtaagcagtcaatttctgattatgaaaagcaaaaggcgtttcctacatttgctaatctagataaaattgcagaatattttcgtgcaacccccactcaactattcggaaccataaaagaaattgagctagagaatagtgtcttagaaacagatacttatacttcaaaagcagatcatattcttaagtctgttaaagaattttatgaactaactaattatcttaatgattttaatagcccagaattttacaccagcgaaacaattaataatttgtatcatcttattactccaaaaccaatattggatccagaaactgatgaacaacttatgagatttattccaactggaaaactagtacgagcagaagatattagcggaaatcccgaagactatgaattggcatttaaaccaagtccacttactcaaactttaagtagaatagatgaaataaatgaactttatgaaaaagtaaggtttgttgaagcttttaaacataataatgaaactaattctaga

SEQ ID NO: 1756 - protein, 204 aa, Streptococcus agalactiae
MTYIIQNFGPNLTRLRKERGISQVELSNQLQIGKQSISDYEKQKAFPTFANLDKIAEYFRATPTQLFGTIKEIELENSVLETDTYTSKADHILKSVKEFYELTNYLNDFNSPEFYTSETINNLYHLITPKPILDPETDEQLMRFIPTGKLVRAEDISGNPEDYELAFKPSPLTQTLSRIDEINELYEKVRFVEAFKHNNETNSR

SEQ ID NO: 1757 - DNA, 765 bp, Streptococcus pyogenes
atggctaaaaatagtccccaagatttaataaatagagaaattttctcaacaaatctcaacatgcttatggctaaaaagaatatcaaacagatagatattcacaacaaactaggaatacctaagagtacgataactggctatgttaaaggtcgttcactcccaactgctggaaacgttcaaaagctggcggacttcttcggagttctaaaatcagacattgacccccgttttgattctaataatattgaaacaaatagtaatattatcccatcaaccctacaaaaagtaacatctactttatctcagctagaacacaagcgacaattaaacgtccttgattatgctgaaacacaattagaacaacaaaacacagtagaagaaccacaagccacctactacacttacaattactacgaccacgcagcttcagctggtacaggtcagtatctaaatgatgtacaagtagaaacaattgaattaccagtcgattacgacgctgattttgtcataccggtttatggcgattctatggaacccgaataccattctggggactatgtatttatcaaactatctattaacctgtcagatggtgatataggagtttttgagtattacggtgatgcttatatcaaacaacttgttataaacgattctggagcatttctgcatagtctgaacgacaagtatgacgatatactcatagatagagatagtgatttccgtattatcggagaagttattgggagttttacatctaaatca

SEQ ID NO: 1758 - protein, 255 aa, Streptococcus pyogenes
MAKNSPQDLINREIFSTNLNMLMAKKNIKQIDIHNKLGIPKSTITGYVKGRSLPTAGNVQKLADFFGVLKSDIDPRFDSNNIETNSNIIPSTLQKVTSTLSQLEHKRQLNVLDYAETQLEQQNTVEEPQATYYTYNYYDHAASAGTGQYLNDVQVETIELPVDYDADFVIPVYGDSMEPEYHSGDYVFIKLSINLSDGDIGVFEYYGDAYIKQLVINDSGAFLHSLNDKYDDILIDRDSDFRIIGEVIGSFTSKS

SEQ ID NO: 1759 - DNA, 1554 bp, Streptococcus agalactiae
gtgaattttatagaacaaatcagtgaaaacaatcaattcccaattatatttgttggttcaggtattactcaaagatattttgagaatgcaccgacatgggagaaactattaaaagatatatggctagagttgtttgatgaagaatcatattatgcaaaagccttcgaattaagagaaagatttgaaaacaatgattttgatatttatactaatctagcttcattattagaaaaagaagtgtcaaaagcttttataaatggtaatattcaagttgataatttagacttaaagacagcttatgaattaaatatatctccatttaaacagttagtagcaaatagattctcaaacttaaaaattcgggaagagaaaattgaggagataaaacaattttctcaaatgttatctaaagcaagaataataattacaactaattacgataattttattgaagagtgtttaaaaacaataaatgtcagtgtgaagattaatgtaggaaataaggggctatttttaaagtcttctgattatggtgaattgtataagatacatggaactgtagatgatgcttcaacaataactataacaaaggaagactatgaaaagaatgtaacaaagtcagcattaattaatgcaaaaatactttcaaatttggtggagtcaccaatcctatttttgggctattcattaactgatgaaaatattagaaaattattgacagattttgcagaaaatagtccttttgatatatcggaatcagctcaaaaaataggtgtagttgaatatctaccagattctgaatctattgaaacagtggtctcaagcttacctgacttaagcgtttactattcgtgtttaaaaactgataattttaccaatatttatagattaatctctaagataaatcaaggatttttaccttcggaaatagcgaaatatgaaaatgtatttcgaaaaataatagaagttaaaggagagagcaaagatttaaaaactgtcttgactagttatgaagatttagcaaacctaacagaggatgaaattcgttcgaaaaatatagttgttgcctttggggatgaaagatacatatataagtttccagattttaaagagtatgttagatcatattttctagataaagaaacaattcctcaggaaattgttattcgatttattgcaacccaaccagtagcaagtcatcttccaataaaaaaatatatgtttgcaatgtcagaatatatttctaaagattcaaataagtacactgaaaacattaaaaaaagattatcaaaggaagaagagctatcattagatgactttactagtagtattggcgtcccattgctacactcaaaaacgttagaaagacaaacggaaattgttggcatacttgaagctgacgtaccggacaatgttagatataattttatagcaactcatattaaaaattttccaaaagaagaattatttttgctagttgaaaaaataattgatgaaggaatttttgaaacgtctagacgaagatttttgaaagcttttgatttattgcattac

SEQ ID NO: 1760 - protein, 518 aa, Streptococcus agalactiae
MNFIEQISENNQFPIIFVGSGITQRYFENAPTWEKLLKDIWLELFDEESYYAKAFELRERFENNDFDIYTNLASLLEKEVSKAFINGNIQVDNLDLKTAYELNISPFKQLVANRFSNLKIREEKIEEIKQFSQMLSKARIIITTNYDNFIEECLKTINVSVKINVGNKGLFLKSSDYGELYKIHGTVDDASTITITKEDYEKNVTKSALINAKILSNLVESPILFLGYSLTDENIRKLLTDFAENSPFDISESAQKIGVVEYLPDSESIETVVSSLPDLSVYYSCLKTDNFTNIYRLISKINQGFLPSEIAKYENVFRKIIEVKGESKDLKTVLTSYEDLANLTEDEIRSKNIVVAFGDERYIYKFPDFKEYVRSYFLDKETIPQEIVIRFIATQPVASHLPIKKYMFAMSEYISKDSNKYTENIKKRLSKEEELSLDDFTSSIGVPLLHSKTLERQTEIVGILEADVPDNVRYNFIATHIKNFPKEELFLLVEKIIDEGIFETSRRRFLKAFDLLHY

SEQ ID NO: 1761 - DNA, 1119 bp, Streptococcus agalactiae
atggcaacatatagacaaagaggtaaaaagaaattatgggattatagaatattcaatgaaaaaagtgagttagttgcttctggttcaggttttaagacaaagcgtgaagctatgaatgaagctatgaggatagagcaacaaaagttattagtaaattctatatcttctgatataacattgtatgatttgtggtttgaatggtacagtttaattataaagcctagcaatctagcagagactacaaagaacaaatattttacaagaggttctgttattcgtaaactttttggaaatcagaaagtaaataaaataaagcatagtgcgtatcagaggaaattaaatacgtacgctgaaaaatacactaaaaaccatgttagaaggttaaattcagatataaaaaaagctatccaatttgctaaaagagatggtgtcttattatctgattttactgatggagttgtcatagctggtaggaaatttgttaaggatgcagatgataaatatctacatagtatttttgattacaagaaagtgatatcttatttagaaaacaatttggattattcaaatagtatcgtttattatttattactggtgctatttaaaacaggtttacgagtgggtgaagctttagcattaacttgggatgatgttaattttgaagatctagaaattaagacgtatcgaagatttagtggcgataagggaacttttagtccacctaaaacaaaaacttctatccgcactattcctattagtcaatctttagcattaatcttaagagatttgaaggatgatcagcaagttatgttgaaaaacttaaaaattgtaaacatgaataatcaaatattttatgactatagatatggtgtttcgacaaatagtgcgataaataaaagtcttaaaaatgttttaaaaatattaaatattaattcaaaaatgactgcaacaggtgcaaggcatacttatggaagttacttattagcaaaaggtgtagatatttgggtagttgcaagattaatgggtcataaggatattacacagttacttgaaacttatggtcacgtcttgacagaagtaataaataaggaatatgaaacggtcagaagtttagtatct

SEQ ID NO: 1762 - protein, 373 aa, Streptococcus agalactiae
MATYRQRGKKKLWDYRIFNEKSELVASGSGFKTKREAMNEAMRIEQQKLLVNSISSDITLYDLWFEWYSLIIKPSNLAETTKNKYFTRGSVIRKLFGNQKVNKIKHSAYQRKLNTYAEKYTKNHVRRLNSDIKKAIQFAKRDGVLLSDFTDGVVIAGRKFVKDADDKYLHSIFDYKKVISYLENNLDYSNSIVYYLLLVLFKTGLRVGEALALTWDDVNFEDLEIKTYRRFSGDKGTFSPPKTKTSIRTIPISQSLALILRDLKDDQQVMLKNLKIVNMNNQIFYDYRYGVSTNSAINKSLKNVLKILNINSKMTATGARHTYGSYLLAKGVDIWVVARLMGHKDITQLLETYGHVLTEVINKEYETVRSLVS

SEQ ID NO: 1763 - DNA, 330 bp, Streptococcus agalactiae
atgagtatgcaacaggtttttaatgtgagtgttcctgtaccagatgatgttgttattatttcaaaagaagaatatttaaatttattaagtgataatgaacaaggcaagtggtgggatattgataacttgcaagagttattgggaattggaaggtcaaaattgattaatgatattttgttaaatccagatataaaaaaagaagtagatttatcaattaatccaaatggttttattgtttatccgaaaggtaaaggtagtcgatataaaatattagcaacaaaagctagaaaatattttgaagataattttggttctattttattaaatagt

SEQ ID NO: 1764 - protein, 110 aa, Streptococcus agalactiae
MSMQQVFNVSVPVPDDVVIISKEEYLNLLSDNEQGKWWDIDNLQELLGIGRSKLINDILLNPDIKKEVDLSINPNGFIVYPKGKGSRYKILATKARKYFEDNFGSILLNS

SEQ ID NO: 1765 - DNA, 630 bp, Streptococcus agalactiae
atgataggggattattcagtaatggattgggctactttaggtggtgttgtaggaattatttttacaaatgtgggagttttgatttcaaactctagggataataaagctattcaacgagaacttgagcttttagaagaaggtcaagagaaattggtagacgaattttccaaaatttcgacaaatcaatatgataaatatgttctgatacaaagcaatttatcaaacaatattgaaaagaataaacaagaattagttcaaaaaaactcatatgttaaagaagatactaaatatatccgtgatgaaatgcttattgagaaaaagtcaaaggaagaagtttataatcatgtgaaaaatggagataaacttattgaaaaaatggcttttgctaatgaattaattttgaagtttggtgaagtaagcagagaaaatcaaatgttaggcttaaaagttaattctttagaggaaaaaatagtcgatttatcaaatcaacctaaaaatgatgaaatatcaaaattacgtaaatcaatttcaagttttgaaagggaattatctaggtttgaggatgtcggttatagcgaagcagaagaaataaaaagtactttaagaagaatattaaatgatcttgaagga

SEQ ID NO: 1766 - protein, 210 aa, Streptococcus agalactiae
MIGDYSVMDWATLGGVVGIIFTNVGVLISNSRDNKAIQRELELLEEGQEKLVDEFSKISTNQYDKYVLIQSNLSNNIEKNKQELVQKNSYVKEDTKYIRDEMLIEKKSKEEVYNHVKNGDKLIEKMAFANELILKFGEVSRENQMLGLKVNSLEEKIVDLSNQPKNDEISKLRKSISSFERELSRFEDVGYSEAEEIKSTLRRILNDLEG

SEQ ID NO: 1767 - DNA, 789 bp, Streptococcus agalactiae
atgtcaaaagtaaaagttttaagtttaattactgtttcaggactatttttaatggctggtaatttatcagcaagtgcagatgttgtaattagtggaggtgatactataatgctatcaggggtagatgcaggtgtatctgattctataatgccaccaccatcaagtataaatccagtaacagataccacagaaccaagtgcgccaacaccaagtacagatccaataacagataccacagaaccaagtgcgccaacaccaagtacagatccaataacagataccacagaaccaagtgcaccaacaccaagtacagatcaaacaacaggtacgacagattcaagtactccatcatcaagtacaacaaatccagtagatggaattactgataatggtactaaaccaaatgccggtattgacaaaccttctacgaataaacctagtgatcattcagaatcatctataaaaccagtaacaaagccaactattaatcaacctattacaactgtaacaggagatcaagtcattggtactcaagatggtaaagttttagtacagacaccatcaggtacgcaattaaaagatgctgctgaagttggtggaaatgttcaaaaagacggtactgtagcaattaaaaaatcagatggaaaaatagaagtattgccaaaaactggtgagggtaagactatctttacaatagtaggtctcttgttaattgctggagcagtttggattggttttaaagataatataaaaaagtatttaacctttttcaaaaagaaaagtgaaaaa

SEQ ID NO: 1768 - protein, 263 aa, Streptococcus agalactiae
MSKVKVLSLITVSGLFLMAGNLSASADVVISGGDTIMLSGVDAGVSDSIMPPPSSINPVTDTTEPSAPTPSTDPITDTTEPSAPTPSTDPITDTTEPSAPTPSTDQTTGTTDSSTPSSSTTNPVDGITDNGTKPNAGIDKPSTNKPSDHSESSIKPVTKPTINQPITTVTGDQVIGTQDGKVLVQTPSGTQLKDAAEVGGNVQKDGTVAIKKSDGKIEVLPKTGEGKTIFTIVGLLLIAGAVWIGFKDNIKKYLTFFKKKSEK

SEQ ID NO: 1769 - DNA, 546 bp, Streptococcus agalactiae
atgaaacgtagaaaaatagttttatttttaatggtgttagtgatggcttttatagtttataaagttattcaaaaagataatccagtgattaaaacaagtggtaatcatacaaaagttgaacgagttgaaccgaaacataaggttaagtcttatgattcaactaaagaagcaaaatctactttggaagctagtgatcgtcaagtatctgataaggaaaaggagaaggttaaaagatctataactgtacctattgattaccttgtaaaaatcccaacacaatcagatattaagggtgattatcaaaataaattatccattacaaatcctacagttgcccaaactgtaaaaaccatgttgatggctggttatcattttgatttggaaagtttacaagtatatgagtcagatgcgagtaatgtttatcagtttactattaatttagtaacagataaaagagacaaattaagtttagctggtaattatgtattaggtacagaccaatttgagattgcgagtgtacatggtacacctgtaaatgtagtattt

SEQ ID NO: 1770 - protein, 182 aa, Streptococcus agalactiae
MKRRKIVLFLMVLVMAFIVYKVIQKDNPVIKTSGNHTKVERVEPKHKVKSYDSTKEAKSTLEASDRQVSDKEKEKVKRSITVPIDYLVKIPTQSDIKGDYQNKLSITNPTVAQTVKTMLMAGYHFDLESLQVYESDASNVYQFTINLVTDKRDKLSLAGNYVLGTDQFEIASVHGTPVNVVF

SEQ ID NO: 1771 - DNA, 1371 bp, Streptococcus agalactiae
ttgggaatactgattgtatttccttttttattggttttattgttgactgcttcgtcaagttctcaacaagattgtcaaattacaccagatgtatcttcacaagttgaaacctcaagtgagaatgcttccaatagtgattggacaaaaaakggaacagttgcaaatcaaacagcagagaaggtattcaatgcttgggtaagtaaaggcttatctggtgcgagtgcatcagggattgttggttgggttaattcagaaggtggatttgctatgataggtcgagcagaagggcattatggtaatgatttaaaaacaaattcaattgcctttaatgtgagacctactgggttatcttactatacgactgaagctggaggtggtatttatcaaatcacacctttcacaaagtatgccccattaggcgatcccaaatgggaagatgcagatgccatgaatgcctttgttatgaaatccattaaatcaggagactggaataaagcaatggatttatcaggtggaaatcattcttttgaagagatggcacagatgactgatcccaagcaggccactttagtttggaatgcttacgaacgaggaaatactgcatatattaataaagctcaaaagactgcggatgggcaaaaagcctatgaaatatttaatggttcaaaatataaatttgatgcagaaaaattttctaaaagttttggtggtggttcaaaaacgtcctcgtctggtaagagcgatataatttctgattctacagttttatctctttgtgattcagctagtaatgcggtacagggcttatttggtaaagataagtcagggaaagttaaatacacttcttataatgcatggaaaccagatcaattaccaagtgatttgaaaaagtatgcaatagatcctaagtcagttggtttattttatcgaacgtctagtggatggaatgcgatagcttctactggtggtcaatgtacagatctttcagcaagtttgatgtatggtttatggcttaaaggcggaatgcatccaacgcaaagaatgggaaatggtaatatggttgtttctaattgggtatctgcattcggtggacgctctgaaaatactccatcttctggagctgttttttcaagttcaggtacttctagtgctgggcatactggagtggttagtcatgtatttgaaaatggcgatatgttaatagtagagcaaaattattcaacttattctggagataatagaggatttggaccatattcatggaattatcgttatgtttctactttagaattaaaaaaagagcattatagtttttataatccctctaaagctggttataaattgtctgataaagtgaaaacggtaggtagt

SEQ ID NO: 1772 - protein, 457 aa, Streptococcus agalactiae
  misc_feature (1)..(457): Xaa = Any Amino Acid
MGILIVFPFLLVLLLTASSSSQQDCQITPDVSSQVETSSENASNSDWTKXGTVANQTAEKVFNAWVSKGLSGASASGIVGWVNSEGGFAMIGRAEGHYGNDLKTNSIAFNVRPTGLSYYTTEAGGGIYQITPFTKYAPLGDPKWEDADAMNAFVMKSIKSGDWNKAMDLSGGNHSFEEMAQMTDPKQATLVWNAYERGNTAYINKAQKTADGQKAYEIFNGSKYKFDAEKFSKSFGGGSKTSSSGKSDIISDSTVLSLCDSASNAVQGLFGKDKSGKVKYTSYNAWKPDQLPSDLKKYAIDPKSVGLFYRTSSGWNAIASTGGQCTDLSASLMYGLWLKGGMHPTQRMGNGNMVVSNWVSAFGGRSENTPSSGAVFSSSGTSSAGHTGVVSHVFENGDMLIVEQNYSTYSGDNRGFGPYSWNYRYVSTLELKKEHYSFYNPSKAGYKLSDKVKTVGS

SEQ ID NO: 1773 - DNA, 99 bp, Streptococcus agalactiae
atgataaccacgaacaagtggatcaaacgtttagaaaaatctccttttgaaaaaagatatgaaataaatattgaaaaagctgaaatcgcaaccaataaa

SEQ ID NO: 1774 - protein, 33 aa, Streptococcus agalactiae
MITTNKWIKRLEKSPFEKRYEINIEKAEIATNK

SEQ ID NO: 1775 - DNA, 1998 bp, Streptococcus agalactiae
atggacaaaatagatgatggtttgattgcttcgacctttgcgaaggtaaaagatgtggatatatttgcgttaaaggcttatatggagataactcacggagctgagactggagctcaaagcattttgttagatgtttttgttaattttccctttttcctacttaacttgattgttggtttattttctgttattctacgcttttttgaaaatttcagtttgtatgatacctataaacaaacagtttatcattcgtctcaaaaattatgggaaaatctatcaggtaatgggtcttatacaagctccttgctttatttattggttgcgatttcagctttttcaatatttatttcatatcttttttcaaaaggagatttttctaaacgtttgatccacttgttcgtggttatcattttaggtatgggttactttggtacgattcaatcaacatcaggtggtatttatattttagataccgttcatcaactagctggttcgttttcagatgcggtaactaatttatcactggataatccatcaggtggtaaaacaaagatcacacaaaaatcatcagtagctgataattatgtgatgaaaacttcttatacggcttatttgtttgtcaatactggtcagttaaatggtaagtttcacaataatcaaacaggtaaagaagaaaagtttgataacgaacaagttttaggtaagtacgataaatcaggtaaatttatcactccaaaacaaaaggatatattgaattatactgataatttgggagataaggcaaccgaaggggaggaaaaaaatagatggctttctgcagtaaatgattatctttggataaaatcaggctatgttatcttaaagatttttgaagcggttatactcgcagttccattaatactcattcagttaattgcttttatggcagatgttttagtgattatattaatgtttatttttccattagctttattagtttcatttttgcctagaatgcaagatatcattttcaatgttttgaaagtcatgtttggggctgtttcctttcctgccttagctggttttttaaccttgatagtcttctatactcaaactttaatagccacctttgttaagaaaaaatttacagatggttccctgcttagtggtagtaattttaaaggtcaggcaatactgtttatgttgctaataacagttttcgtccaaggttgtgtgttttggggaatttggaaatataaagaaactttcttaagactgattatagggtctagagcttctcaagtcattaatcagtctgtagataaaattaatgaaaaagcagaaaatctaggaattacgccaaaatccatttatgagagggcacacgatatgtcaagccttgccatgatgggagctggctatggtgttggtacaatgatgaatgcacaagataattggaatgctttcaaagaaagacaacaagctaatttagatgatggtcagtctaaaactaatgatgctgataagtatgatgaagctaatgcggatgatactgttatttctaaagaggctgagctgactaatgaaggtgaatatcaatcagagttacctaaagaagcaagtaaaaggattgaacaattgggaaaggaatcttcttatgagctatcgtttatatcagaaggtaattcaacagaggaaattttaaaaaatgttaagtcggataatcacacgtttcaagaaggagatggagatacttcattaacaaatcaggatatgataacaaatgatatagaaaatcattcaaataactatacttcaccattaaaacagcgaaagcttaataagctagagggtgaattaagtcaatttaatagtgatgtatccatgacaaaaaatcatggtaaaaatgcttttgaaaagggatttaatgccagtaaaactaaggaagttagaaagcaacataatcttgaacgacagtcaaaagttttggaagaactagaaaagctgagagaaggtaag

SEQ ID NO: 1776 - protein, 666 aa, Streptococcus agalactiae
MDKIDDGLIASTFAKVKDVDIFALKAYMEITHGAETGAQSILLDVFVNFPFFLLNLIVGLFSVILRFFENFSLYDTYKQTVYHSSQKLWENLSGNGSYTSSLLYLLVAISAFSIFISYLFSKGDFSKRLIHLFVVIILGMGYFGTIQSTSGGIYILDTVHQLAGSFSDAVTNLSLDNPSGGKTKITQKSSVADNYVMKTSYTAYLFVNTGQLNGKFHNNQTGKEEKFDNEQVLGKYDKSGKFITPKQKDILNYTDNLGDKATEGEEKNRWLSAVNDYLWIKSGYVILKIFEAVILAVPLILIQLIAFMADVLVIILMFIFPLALLVSFLPRMQDIIFNVLKVMFGAVSFPALAGFLTLIVFYTQTLIATFVKKKFTDGSLLSGSNFKGQAILFMLLITVFVQGCVFWGIWKYKETFLRLIIGSRASQVINQSVDKINEKAENLGITPKSIYERAHDMSSLAMMGAGYGVGTMMNAQDNWNAFKERQQANLDDGQSKTNDADKYDEANADDTVISKEAELTNEGEYQSELPKEASKRIEQLGKESSYELSFISEGNSTEEILKNVKSDNHTFQEGDGDTSLTNQDMITNDIENHSNNYTSPLKQRKLNKLEGELSQFNSDVSMTKNHGKNAFEKGFNASKTKEVRKQHNLERQSKVLEELEKLREGK

SEQ ID NO: 1777 - DNA, 2268 bp, Streptococcus agalactiae
atgtcggattttgaagcggatctagcagatgatgttaaagaattagggttagaaacactcgattttacagttgatacgttaacacatgaaatggagataccgtatcagtttgattggttaattggagttgatcttggtaaagggcaatacaatgctaatataaaagaatttatttataatcagtttgaatctatcgcatcaaacttcgcttctttagctggttatgaggtagaagtagatgaagattggtataaagaacattcagaagaagaattacttgtctatagtttattgtctaccctgaaagccaaaagattaacggatgttgatttattttattatcaacggatgcaatttttaagatatgttccccatactaaaagtgaggttatagctaatcggaatatgttaaatgtgacagatacgttgattaaatcactagaaggtggttttttaaaattggagagtgcttatgggagttcatttgtatccgttcttccagtaggtcggttctctaccatatttaatggctttcatcttggtgaactagttcaaagaatgagttttccggttgaattaagatttaaagcggaatttatagataagacaaaattgggtggcactatgggtcgctcaaatacacgctatgatcaaatcatgaaagaagcttataacacaaatacggttcaacaagatgatatcttgatgggagcatattcgcttaaggatcttatgaaaaaagttggaaataaggaagaaatcatagagtatggttgttatttggtagttgctggttctagtttaaatcaactaaaacaacgtagatatgccattttaagttactttgatgatatgaaagtcaatgtttatgaagccagtcatgatacaccatatttatttcaagcgttactttatggtcaagatttacaaaaaacaactcgtaagtggaatcatttagtaactgctcgaggtttttcggagttgatgctttttacaaatacccaatcaggtaacaggattggttggtatattggacgagtagataatcgtttaactgcttgggattctattgacgaagctattatgggatctaaaaatcttgtcttatttaatgcgacagtcgcgaataaagaagatgttgctggtaaggttactaaaaatcctcacgtgattataactggggcgacaggtcaagggaaatcatacttagcacagatgatctttttacatactgctcaacaaaatgttcgtgtcctttatgttgaccctaaacgagaactacggcaacactatttaaaagttgtttctgatccagagtatgcacgtaagtttcctctacgtaagaagcaaattgaggaaacgaattttgtcactcttgatagttctgtcaaagaaaatcatggtgtattagatcctattgttattcttgataaggaaggtgcttcctcaacggctaaaaatatgttgctttatttgttaaaaaacgctacagagattaaattagatcaaacaacagctttaacagaagcaattagtcaagtcattgcaaaacgtgaagctggtgaagtcgttggttttaatcaggttattgaagttcttattgattctgaaagtgatgaagttcagtcagttggtcgttattttaaagctattattcagaattctattttagagttggcattttcagatggtgatgttgctggtctttcttacgaagaacgtgtgacagttttagaagttgcggatttatcattgcctaaggacggttcagatcatatatctgatcatgaaagtaattcgattgctttaatgtttgctttaggtgcgttttgtaagcattttggtgagcgtagtgatgatgaaacagttgaaatttttgatgaagcatgggtacttatgcaatcctcagaaggtaaggctgttatcaagtctatgcgtcgtgttggtcgctctaagtataatgtgttgatgctagtatctcaatcggttcatgatgcagaaaacgatgatgatacgaccggctttgggacaattttttcattttatgaaaaatcggaacgtgaagatattttaagtcatgttggtttagaagtaacacctaagaatctagaatggattgataatatgatttcaggtcaatgtctttattatgatgtttacggtaacttgaatatgatttcgatacataacattcatccagatattgatccattgttaaaacctatgaagaaaacagtatcaagtcaccttgaaaataaatatgcttcg

SEQ ID NO: 1778 - protein, 756 aa, Streptococcus agalactiae
MSDFEADLADDVKELGLETLDFTVDTLTHEMEIPYQFDWLIGVDLGKGQYNANIKEFIYNQFESIASNFASLAGYEVEVDEDWYKEHSEEELLVYSLLSTLKAKRLTDVDLFYYQRMQFLRYVPHTKSEVIANRNMLNVTDTLIKSLEGGFLKLESAYGSSFVSVLPVGRFSTIFNGFHLGELVQRMSFPVELRFKAEFIDKTKLGGTMGRSNTRYDQIMKEAYNTNTVQQDDILMGAYSLKDLMKKVGNKEEIIEYGCYLVVAGSSLNQLKQRRYAILSYFDDMKVNVYEASHDTPYLFQALLYGQDLQKTTRKWNHLVTARGFSELMLFTNTQSGNRIGWYIGRVDNRLTAWDSIDEAIMGSKNLVLFNATVANKEDVAGKVTKNPHVIITGATGQGKSYLAQMIFLHTAQQNVRVLYVDPKRELRQHYLKVVSDPEYARKFPLRKKQIEETNFVTLDSSVKENHGVLDPIVILDKEGASSTAKNMLLYLLKNATEIKLDQTTALTEAISQVIAKREAGEVVGFNQVIEVLIDSESDEVQSVGRYFKAIIQNSILELAFSDGDVAGLSYEERVTVLEVADLSLPKDGSDHISDHESNSIALMFALGAFCKHFGERSDDETVEIFDEAWVLMQSSEGKAVIKSMRRVGRSKYNVLMLVSQSVHDAENDDDTTGFGTIFSFYEKSEREDILSHVGLEVTPKNLEWIDNMISGQCLYYDVYGNLNMISIHNIHPDIDPLLKPMKKTVSSHLENKYAS

SEQ ID NO: 1779 - DNA, 621 bp, Streptococcus agalactiae
atggtaaaaaaattggaatatccgattgatagaatacatcagaatttagctttacgaaaagataaagttgttgtcgcatactatcgtattccaaataccccaatcactattacagatagtgataagaaagatagtcacaaaacgaaagtagcacaggttatcaaaaaattagctaaatataaaaattttgatatttcattaatagacttcctgcgaaacaaaatatggtacaatagttctatgaattatgaagcaagcaaacaattaactgatgtacgatttaagcgccttgttggtgttcagcgcactacttttgaagagatgttagctgtgttaaaaacagcttatcaacgtaaacacgcaaaaggtggccgaacccctaagttaagcttagaagatctcctcatggctactcttcaatacatgcgagaataccgcacttatgaacaaattgcggctgattttggcattcacgaaagcaacttaatccgtcgaagtcaatgggttgaatcaactcttattcaaagtggttttacgatttcaaaaactcatcttagtgctgaggatacggtgattgtggatgcaacagaggtaaaaatcaatcgtcctaaaaaaatcaac

SEQ ID NO: 1780 - protein, 207 aa, Streptococcus agalactiae
MVKKLEYPIDRIHQNLALRKDKVVVAYYRIPNTPITITDSDKKDSHKTKVAQVIKKLAKYKNFDISLIDFLRNKIWYNSSMNYEASKQLTDVRFKRLVGVQRTTFEEMLAVLKTAYQRKHAKGGRTPKLSLEDLLMATLQYMREYRTYEQIAADFGIHESNLIRRSQWVESTLIQSGFTISKTHLSAEDTVIVDATEVKINRPKKIN

SEQ ID NO: 1781 - DNA, 408 bp, Streptococcus agalactiae
atggaagaagaaaaatattttgattacagcaggggcttgaatgctccttactggattcaggaagttaaaacggcaaaaggcaaagtgatttggtatttttctacacctatgcagttatcattttttattgttttctttatcatcttaatgttgatgctgacggtatgttctccattaatgcaggtgttaaatgctttaacgcattccgtttcaatgctcttgtattggtttgttccaagcaagttagcgaaattttatgtagaatatgaaccgcaaggaaaaaagatgcatatctttttgtgggattatctggtttatctcaaagattttgggttaaataaaaaaggtatctatcaaggagaacgtgttgatattgaagaagaaatagtttttgagaaaacgaaaata

SEQ ID NO: 1782 - protein, 136 aa, Streptococcus agalactiae
MEEEKYFDYSRGLNAPYWIQEVKTAKGKVIWYFSTPMQLSFFIVFFIILMLMLTVCSPLMQVLNALTHSVSMLLYWFVPSKLAKFYVEYEPQGKKMHIFLWDYLVYLKDFGLNKKGIYQGERVDIEEEIVFEKTKI

SEQ ID NO: 1783 - DNA, 264 bp, Streptococcus agalactiae
atgaatttagtaaaagtgaatagtgttattttagcaggtggtcccaacgtttcaggactaaagcaattttttcaaggtgatgggatttacctcattagtgtaattgctgtctttataattattaagaattggaaagaagctaattggttaaaagttttctcaaccttagctatttatgcgattattgtatcaatgcttaaaggtcaacagattctatcttttttgggtggaatgcttcgctggtttggtgttgagacggggtta

SEQ ID NO: 1784 - protein, 88 aa, Streptococcus agalactiae
MNLVKVNSVILAGGPNVSGLKQFFQGDGIYLISVIAVFIIIKNWKEANWLKVFSTLAIYAIIVSMLKGQQILSFLGGMLRWFGVETGL

SEQ ID NO: 1785 - DNA, 951 bp, Streptococcus agalactiae
atgattgatatacaaaaaataaaaaagtttctattgagatatacaaagaaagaagagggaggtaaacagcctaagacaaaagaagtaaagcaaaggacagccaattttattgtctatggtatcttaggtttgttatttattgtaggattttttggatcattgagggcaattggcttatctaatcaggtacaacatttaaaagaaacagttattgctgtagaaaaaaagtcaaaacataagaagactgatgattcattagatatatctagaattcagtattacatgaataattttgtctactactatatcaactattcacaagatactgcagatcaaagaaaaacagaattagaaaattattattctttctcaactgccagtatgacagatgatgttagaaagtctaggactttgcagacacaacgtttaataagtgttgaaaaagaaaaagattactatatagctttgatgcgtattggttatgaagttgataaaaaatcatatcagatgaacttggctgttccttttcagatgcaaagaggattgcttgcaatcgttagtcaaccttatactgtggcagaagatttgtatttaggtaaatctaaagcatttgagaagaaaacattagatcaagtcaaggaactatcgaaagaacaagtaagttctattcaaaagtttttaccagttttctttaataaatatgccttaattaacaagacagacttgaaactgttaatgaaaactccagaactgatggggaaaggatttaaagttagtgagctagatcttaataatgcgatttattatcaagaaaaaaagcatcaagtcgtgcaattatcagtaacttttgaagatcttgtaacaggtggcacacgatcagaaaactttacattatatttatttaaagcagacaatggttggtatgttgaagagatgtatcattattttaaa

SEQ ID NO: 1786 - protein, 317 aa, Streptococcus agalactiae
MIDIQKIKKFLLRYTKKEEGGKQPKTKEVKQRTANFIVYGILGLLFIVGFFGSLRAIGLSNQVQHLKETVIAVEKKSKHKKTDDSLDISRIQYYMNNFVYYYINYSQDTADQRKTELENYYSFSTASMTDDVRKSRTLQTQRLISVEKEKDYYIALMRIGYEVDKKSYQMNLAVPFQMQRGLLAIVSQPYTVAEDLYLGKSKAFEKKTLDQVKELSKEQVSSIQKFLPVFFNKYALINKTDLKLLMKTPELMGKGFKVSELDLNNAIYYQEKKHQVVQLSVTFEDLVTGGTRSENFTLYLFKADNGWYVEEMYHYFK

SEQ ID NO: 1787 - DNA, 252 bp, Streptococcus agalactiae
atgtttaattttactgaagaagcatggaaagattatgtttcttggcaacaggaagataaaaaaatcttgaaacgaattaatcgtttgatagaagatattaaaagagacccatttgaaggcattggaaaaccagaacctttaaaataccattattcaggggcttggtctcgaagaattacagaagaacataggttgatttatatgatagaagatggagaaatctattttttatcttttagagatcattataag

SEQ ID NO: 1788 - protein, 84 aa, Streptococcus agalactiae
MFNFTEEAWKDYVSWQQEDKKILKRINRLIEDIKRDPFEGIGKPEPLKYHYSGAWSRRITEEHRLIYMIEDGEIYFLSFRDHYK

SEQ ID NO: 1789 - DNA, 273 bp, Streptococcus agalactiae
gtgattaatatggaggctattgtttattcacattttagaaataatttaaaagattatatgaagaaggtcaatgatgaatttgagcctttgattgtagttaataaaaatcctgatgaaaatatagtggttttatctcaagatagctgggaaagtttacaagaaacgattcgtttgatggaaaatgattatctatcacataaggttattaatggtatatcacaagttaaagagaagcaagtcactaaacatggtttaattgaggtagaagatgtt

SEQ ID NO: 1790 - protein, 91 aa, Streptococcus agalactiae
MINMEAIVYSHFRNNLKDYMKKVNDEFEPLIVVNKNPDENIVVLSQDSWESLQETIRLMENDYLSHKVINGISQVKEKQVTKHGLIEVEDV

SEQ ID NO: 1791 - DNA, 471 bp, Streptococcus agalactiae
atgattgcaattataaggactcgtgaaaaaggtagaagtcaatttttatgtgagttagacatcatgcagtttacggaaaatcaagtaagaaaccgtatgatagaaaaaggcattaaggatgatgccttttttatttgtggtttttctgattggaatgttgataggattatgtcacttacagaagtctatcttttaaaaagatgtattgaaggactttatgatggtgatgactatattgttcaatatcttttgaaaaaaggtttatcagttcattcaatagtgacaaaatattatatatttttgtcaaataatgaaaataaagtaatgaaatatatcttaaggaaagttgaatttgattctttaattgatttttggcaacggtcagtaacttgggtaaatgctttaaatgcttatattgaagaaggaatagtattaaacacctcaaaaggtttttacgtgttaaaaacagaa

SEQ ID NO: 1792 - protein, 157 aa, Streptococcus agalactiae
MIAIIRTREKGRSQFLCELDIMQFTENQVRNRMIEKGIKDDAFFICGFSDWNVDRIMSLTEVYLLKRCIEGLYDGDDYIVQYLLKKGLSVHSIVTKYYIFLSNNENKVMKYILRKVEFDSLIDFWQRSVTWVNALNAYIEEGIVLNTSKGFYVLKTE

SEQ ID NO: 1793 - DNA, 489 bp, Streptococcus agalactiae
gtgtcaaaaatggatgttagtgcaattgttagagatataaaaactggtagagctacgttagtttgttttcctgtggaaatgagtgagcttaagttagctttggggcttcgtgaagaagatgatttagagtatattattgcagattcggattgtcagttactaaaagaacatgattctattgagatgattaatcaatttgttgaactggtagagaatgttgatagtgaacttgttaaagcagtgcatcaggtaataggttatactgcctcagactttgtggattatgattttaattttggtgattgttgtttactgtctgatgtcacaactagacgagaactaggtgaatattatttcgatgaattaggcgtacaaggagttggtaaagaggctctggagatgtattttgatcatgaagcttatggtcgagatattgacttagaaagccaaggtggtttttcagactacggatatgtcgaaatatcaggg

SEQ ID NO: 1794 - protein, 163 aa, Streptococcus agalactiae
MSKMDVSAIVRDIKTGRATLVCFPVEMSELKLALGLREEDDLEYIIADSDCQLLKEHDSIEMINQFVELVENVDSELVKAVHQVIGYTASDFVDYDFNFGDCCLLSDVTTRRELGEYYFDELGVQGVGKEALEMYFDHEAYGRDIDLESQGGFSDYGYVEISG

SEQ ID NO: 1795 - DNA, 270 bp, Streptococcus agalactiae
atgtcaggaacacgttcagaagcagataaaaagttgttagtggttactcaggagctttcagagctgttggtcagccatcagtatgaacagtcatgggaaaaagctggagagttaaatagcttacttaaaaagcgtgaagaattgactttaccaggttatatggtcgacatgattcaacaacatttgaaatcatactactaccaaaataatatgattaataaggctcataagtctatgtcagcgattggtcataaactacaagaatttcat

SEQ ID NO: 1796 - protein, 90 aa, Streptococcus agalactiae
MSGTRSEADKKLLVVTQELSELLVSHQYEQSWEKAGELNSLLKKREELTLPGYMVDMIQQHLKSYYYQNNMINKAHKSMSAIGHKLQEFH

SEQ ID NO: 1797 - DNA, 567 bp, Streptococcus agalactiae
atgagttttcgtaaatacacaaaagccatagtaattgttcacggtaaaagtgaactggattttgttaaacatattaaatcaaaactgaggcttcctcttgaaatatactcgaggtcaaatgggaaaacatctatacaaatatcttcgattaatgatattttaaaaaatagagattttaaaactaaaaaatgttttaaagaaaaatttttcaaggttgagtgcgataaaaaaggaaatcccaaaaacgttaaaatctttattatcatggatattgatgatacatcgcaggaaaagatagattcctataagagttctacattatttgtaaaagattggaaaaaagattttattgttcctatatggaatgatagcaatttcgaggaggtccttaatgatattggttattggtatgctaagaatgataaagaaaagagacactacaaaaagctgtttcctgtagaacgaggggagcaggatgtggagacgataaaagagctaagagataagttaatttcttcaaataagagtaatttagatgaatttttaactttctgtattgaatcctcg

SEQ ID NO: 1798 - protein, 189 aa, Streptococcus agalactiae
MSFRKYTKAIVIVHGKSELDFVKHIKSKLRLPLEIYSRSNGKTSIQISSINDILKNRDFKTKKCFKEKFFKVECDKKGNPKNVKIFIIMDIDDTSQEKIDSYKSSTLFVKDWKKDFIVPIWNDSNFEEVLNDIGYWYAKNDKEKRHYKKLFPVERGEQDVETIKELRDKLISSNKSNLDEFLTFCIESS

SEQ ID NO: 1799 - DNA, 1353 bp, Streptococcus agalactiae
atgcatatgtttagtaaaatagaatttaaaaactttatgtccttttcaaatttgacttttgatttgctgaatagaggaaaatgtaaggatattattgcaatctatggagaaaacggttcaggaaaaacaaatattgttgaagcttttaagttactagttttgtcattacaatcaatggaatccttaaatgaaaatacacgattacaatcattattaaaagaacaaacaaataaagaagaaaatcaaaaaactaactttggtgatatatcagaaatcttagataaaatcagtttcttcaccacttttaagggcatagcgaaaaatactcatagaattgcatctgaaggtaatacgattctaaaatattattttaatatcgaaaaagataatggttattaccttctagaatataatgaaaataatgaactagtaaaagaggagctagtatttaagataaaatccaataagggagttcatttcagtattactaacatagatggtttatctcaatcattaaataagacaatttttaagaatactatttttaaagatttgactgaacaaatagaaaaatattggggtaaacatacattcctatcaatatttaataattattgtctagaagtaaatgaagagtttattaatgaacaagtttctataaattttcaaaaagtagttgatgaatttgataaaatttttatttggagtggtaattttagaggtccttttcattcgacagaattattattgaaagatatttcaaaaggtaaaattgataagtcggaaaaagaaaaactttcctatactgaggaaattatttataaatattttagtgcattatatattgatataaaagatgttaaatataagcaggatgctcaaggtcaagaaataaaatatgaactcatgatccgaaaaaatattggaggtgatcttttagatgtaccaataagtttagaatctcagggaacaaaaaatcttctggatcttctaaaagtttttaacaatgtgttggatgggaaaatatgtatcgttgatgaaattgactcaggtattcatgatcttttaatgaatagtattctgaatgacttgaaaggaagtgtgaatggtcagttaatatttacaacgcatgatacaacgttattgaaggaattatcaccgagctcagcttattttttaaatgtagatattaaaggtaataaagttatcatttctggcaatgaggcagataaaaaaataggagtaaataacaatttagaaaaattatatttgtctggtttctttggtgctgtaccagatccattagatattgatttttcagatttatttcttgatcataatttaagcgaggac

SEQ ID NO: 1800 - protein, 451 aa, Streptococcus agalactiae
MHMFSKIEFKNFMSFSNLTFDLLNRGKCKDIIAIYGENGSGKTNIVEAFKLLVLSLQSMESLNENTRLQSLLKEQTNKEENQKTNFGDISEILDKISFFTTFKGIAKNTHRIASEGNTILKYYFNIEKDNGYYLLEYNENNELVKEELVFKIKSNKGVHFSITNIDGLSQSLNKTIFKNTIFKDLTEQIEKYWGKHTFLSIFNNYCLEVNEEFINEQVSINFQKVVDEFDKIFIWSGNFRGPFHSTELLLKDISKGKIDKSEKEKLSYTEEIIYKYFSALYIDIKDVKYKQDAQGQEIKYELMIRKNIGGDLLDVPISLESQGTKNLLDLLKVFNNVLDGKICIVDEIDSGIHDLLMNSILNDLKGSVNGQLIFTTHDTTLLKELSPSSAYFLNVDIKGNKVIISGNEADKKIGVNNNLEKLYLSGFFGAVPDPLDIDFSDLFLDHNLSED

SEQ ID NO: 1801 - DNA, 297 bp, Streptococcus agalactiae
atgaagaagttgactaattttccacaaaaactaaaagaattgcgtaaagaaaaaaaactaactcaaactgagctagcgtctaaattaaatataagtcaaaagtcatatagtaattgggaaagtggtaaagctgaacctactttagataatataataaagttagcaaatatcctagatgttactgtagattatttacttggtagaagtgataattttagtaatactattgtgctttcaaaaaacaatatgaaaagtttttctaaaagactgaaagagttaaggttagaaaaagaatat

SEQ ID NO: 1802 - protein, 99 aa, Streptococcus agalactiae
MKKLTNFPQKLKELRKEKKLTQTELASKLNISQKSYSNWESGKAEPTLDNIIKLANILDVTVDYLLGRSDNFSNTIVLSKNNMKSFSKRLKELRLEKEY

SEQ ID NO: 1803 - DNA, 375 bp, Streptococcus agalactiae
ttgtatagtaaccgagaatttgcttattgtgttaatagacgaaataatttagataaaatgattgatttactagtttttatgattcctgatcgtgagttttattatcctgagattcaaacaggtgagcttagagattatcagatagacatttatgatttgattaagattggttatgttggtgtttatgaaattcaaaaagactacgaagataagttaagggaacttgctgattttaaacggaaacttttaaagtttggtttgcttatgcaacctttagaaaagcaaaaagagatagttattcgtttagctggtaaatatcgtttggaaaaaagaattctgatgagaagggaaatgtttagagatgaagaagttgac

SEQ ID NO: 1804 - protein, 125 aa, Streptococcus agalactiae
MYSNREFAYCVNRRNNLDKMIDLLVFMIPDREFYYPEIQTGELRDYQIDIYDLIKIGYVGVYEIQKDYEDKLRELADFKRKLLKFGLLMQPLEKQKEIVIRLAGKYRLEKRILMRREMFRDEEVD

SEQ ID NO: 1805 - DNA, 1287 bp, Streptococcus agalactiae
gtgggtcattttagtgaaaaaagtgggtcactaatcctaagaaggagtttgtttattgtggatgctatctatttaaaaaaatttcgaaagaaaacaggtctaaaacaaaaggaatttgctttaagttctggtttgacattgaaatcacttagaaactatgagcaaggaaagcggaagttgacacttgaaaagtatcaagagataaaatcacattttggatatctagtagaaaatgatagttcacgattacaagtgatgattgactatgtcagaattacgttaaaggatgttagggatcttgaatttttctgtcgtaactttttgcactgtgcatttaaagaatttcagccttttgaatcgaagttgatgaattacaatcatctttggaaacgtggagatatttggatatttgattttgcggataaacatgagacaggtaattttcaaataactgttcaattgtctggtcgtggatgccgacaattggaattgttgatggaaactgaaaaatttacatggcatgattggttaagttatctaagaaattcatatcgtgatgatatgaatgtgacacgttttgatattgctattgatgaattgtatctgggtaaggatagagaaaatgaacagtttcatttgtcagatatgatttcaaaatattatcgtcatgagttagattttgaaagtttgagaacttggaattatataggtggcggttctttaaatttttcggatatggaagagattgagcagaatagacaaggaatatcgctttattttggtagtcgtcaatcagaaatgtattttaacttttatgaaaaacgttatgaaattgcaaagcaggaaggaattactgttgaagaagctttagaaatttttgaattgtggaatcgttatgagatacggttatctcaaagtaaagctaatgcggcagttgatgaatttatttctggagtgccgattggtgaaatatccagagggttaattgttagtaagattgacgtgtatgatgggaaaaatgaatatgggtcgtttcaagcagatagaaagtggcaattaatgtttggaggtgttgagcctttaaaatttgttacaaagccagaggcttatagtattgaacgaaccttacgttggttaagtgattctgtttctccgtctttagctatgataagagagtatgacatgattgtggatggtgactatttacaaaccattcttaattctggggaagtcaatgaacgtggggagaagatacttgacagtatcaaagctagcttaggtattttg

SEQ ID NO: 1806 - protein, 429 aa, Streptococcus agalactiae
MGHFSEKSGSLILRRSLFIVDAIYLKKFRKKTGLKQKEFALSSGLTLKSLRNYEQGKRKLTLEKYQEIKSHFGYLVENDSSRLQVMIDYVRITLKDVRDLEFFCRNFLHCAFKEFQPFESKLMNYNHLWKRGDIWIFDFADKHETGNFQITVQLSGRGCRQLELLMETEKFTWHDWLSYLRNSYRDDMNVTRFDIAIDELYLGKDRENEQFHLSDMISKYYRHELDFESLRTWNYIGGGSLNFSDMEEIEQNRQGISLYFGSRQSEMYFNFYEKRYEIAKQEGITVEEALEIFELWNRYEIRLSQSKANAAVDEFISGVPIGEISRGLIVSKIDVYDGKNEYGSFQADRKWQLMFGGVEPLKFVTKPEAYSIERTLRWLSDSVSPSLAMIREYDMIVDGDYLQTILNSGEVNERGEKILDSIKASLGIL

SEQ ID NO: 1807 - DNA, 1716 bp, Streptococcus agalactiae
ttggctcgtttaataccacaatatagagggattaaggtaaaaccatatatgaggtatatgagttattaccttttttcttttctatttattttgtttttgacacctgtaggcgtgtatagttattactatttagatttgttaaaaatgatggataaaatgtctatgatcagtgtaggtacaggtttgtttttagcattttttgtttcttggtatttgacttggtttttgcaagaagctaatccattatttaataaactagatcgattaaaaagaatgtctaagtttttatatgagaatggctatgtttatgaaaaacgtaaaaaatcaaataagaaaacgaagacaaaatatcgttttccaaaagtttatgtgaaacaaggtaagtatgatttaagtgtttcatttgaaatggctggaggaaaatttcaaaagaaatttaaggatattggtggagaattagaagatacttttttcatggattttatggaaaaaactgatgatccacgctttaaaatttacaaattagcttattcggctttcttatcacgtattacggttaaagatgtgatatggaataaagataagggaattaagttaatggatggctattattgggatttcatcaatgatcctcatttattagttgctggtggtactggtggaggtaaaacagtattactaaggtcaatccttcgttgtcttgcggaaattggagtttgtgatatatgtgaccctaaaagagccgattttgttactatgtcagatttatcagcttttgaaggtagaattgcctttgaaaaggctgatattattgagaagtttgaaaatgctgttacgataatgtttgcacgttatgattttgttcgaaatgaaatgaagcgtttaggtcataaagacatgaaaaagttttatgattatggattggaaccttatttttttgtatgtgatgaatataatgctttaatgagttctttgtcttatcaggaacgtgagattgtagataatgcatttactcaatatatattgttaggacgtcaggttggatgtaatgcgattatagcaatgcaaaagccgtctgcagatgatcttcccactaaaattagatctaatatgatgcaccatatctcggttggtcgtctcgatgatggtggttatgtgatgatgtttggtgatgaaaatagaaataaggaatttaggtttattaaatatcttgcaggtcgtcgtgtttatggtcgaggttattcagctgtttttggtgaagtagcaagagaattttattctcctttattacctaaaaatttctctttttatgatgcttttgaaaaaataaataggcatgagaatccttttgatcctacagaaaatcaggaagtttctaaggcgattcttaaagacgaatctttgagagagtttgtggaaaaaacgtctgaaaatgagttacttaagggttcagtagggtttgattttgatgatgaaatggaggaaatggaaaatatgagtattggtgatttagctaagaaaacaggtttttcatttggtaagattaagaatttaatagatatgattgaaaaagataattatatgacttttagtcgtgaagatgaaaaggttgtattaaatgattctgatgcagtcgtcttagaaagtttactgacacaaaaagatgaatttgagggtagctggaaagagttactattgaattattttaagggtgaa

SEQ ID NO: 1808 - protein, 572 aa, Streptococcus agalactiae
MARLIPQYRGIKVKPYMRYMSYYLFSFLFILFLTPVGVYSYYYLDLLKMMDKMSMISVGTGLFLAFFVSWYLTWFLQEANPLFNKLDRLKRMSKFLYENGYVYEKRKKSNKKTKTKYRFPKVYVKQGKYDLSVSFEMAGGKFQKKFKDIGGELEDTFFMDFMEKTDDPRFKIYKLAYSAFLSRITVKDVIWNKDKGIKLMDGYYWDFINDPHLLVAGGTGGGKTVLLRSILRCLAEIGVCDICDPKRADFVTMSDLSAFEGRIAFEKADIIEKFENAVTIMFARYDFVRNEMKRLGHKDMKKFYDYGLEPYFFVCDEYNALMSSLSYQEREIVDNAFTQYILLGRQVGCNAIIAMQKPSADDLPTKIRSNMMHHISVGRLDDGGYVMMFGDENRNKEFRFIKYLAGRRVYGRGYSAVFGEVAREFYSPLLPKNFSFYDAFEKINRHENPFDPTENQEVSKAILKDESLREFVEKTSENELLKGSVGFDFDDEMEEMENMSIGDLAKKTGFSFGKIKNLIDMIEKDNYMTFSREDEKVVLNDSDAVVLESLLTQKDEFEGSWKELLLNYFKGE

SEQ ID NO: 1809 - DNA, 459 bp, Streptococcus agalactiae
atggcaaaaattggtttaaactttggagaaaaattacaaattgcagataaggaatatcgtacctttaatgatggattggatgtaaatgttttgttaggagatttaacttggagacgatatgaagaaccagttcaatttacggaagatgatacgacacaaccaccagatcgatttggtcgttatccacaaaaaccaacaggtgaagtgaagtggaatgatattgcagtatttagtactgctcaaaatgaaacaatttttgtttcaattactgatatgccttcttatgcaatcgaggatttaggtcttaaattgggtgaccctattgaattaagtgatgttgttgtgacatggtctaacgtttcaggtggtatgtttaaaatttttgcatcatcacttaagaaaaaggatgttgcaaataatggaaacgcatcaaaaaatgaagcatctaaagttaataaa

SEQ ID NO: 1810 - protein, 153 aa, Streptococcus agalactiae
MAKIGLNFGEKLQIADKEYRTFNDGLDVNVLLGDLTWRRYEEPVQFTEDDTTQPPDRFGRYPQKPTGEVKWNDIAVFSTAQNETIFVSITDMPSYAIEDLGLKLGDPIELSDVVVTWSNVSGGMFKIFASSLKKKDVANNGNASKNEASKVNK

SEQ ID NO: 1811 - DNA, 324 bp, Streptococcus agalactiae
gtgcttcttatttttagaaaagaggaaattatgaaacaagaaacattagtgttacttccaaattttattggagatgcaatttatgaaggatttgaagctggacctgctcaattaaatggtaaaaaagggtcttatacaagacacattttgtttaatgaaaaacatggtaagttttatgtttatacaccagcatcttcacgtgtgattggaaatggaaaaatggtaactgttgaaaaaccgttattgtttattgacaatacaattaatggtagaaatattgaacctgcaaaaaatgtatgggctgaaaagcttattgaagtgaaa

SEQ ID NO: 1812 - protein, 108 aa, Streptococcus agalactiae
MLLIFRKEEIMKQETLVLLPNFIGDAIYEGFEAGPAQLNGKKGSYTRHILFNEKHGKFYVYTPASSRVIGNGKMVTVEKPLLFIDNTINGRNIEPAKNVWAEKLIEVK

SEQ ID NO: 1813 - DNA, 2505 bp, Streptococcus agalactiae
atgatcacgacattacagactagtcaagtgtctgctgatcaagttacaactcaagcaacaactcaaacagtaacgcaaaatcaagcagaaacagtaacatcaactcaacttgataaagcagtagctacagctaaaaaagcagctgtagctgttacaaccacagctgcagttaatcatgcgacaactactgatgcacaagctgatttagctaatcaaacacaaacagttaaagatgttactgcaaaagcacaagctaatacacaagctattaaagatgctactgctgaaaatgcaaaaattgacgcagaaaacaaagcagagtctcaacgtgtaagtcagttaaatgcacaaactaaagcaaaaattgatgctgaaaacaaagatgcacaagctaaagcagatgcgactaatgcacaattacaaaaagattatcaagctaaattagcgaaaatcaaatcagttgaagcttataatgcaggtgtacgtcaacgtaataaagatgcacaagctaaagcagatgcgactaacgcacagttacaaaaagactatcaagctaaattagcactttataatcaagctctaaaagctaaagcagaagcagataaacagtctattaataatgttgcttttgatatcaaagctcaagctaaaggtgttgataacgctgaatatggaaactcaatcatgactgcaaaaactaaacctgacggaagtttcgagtttaaccatgatatgatcgatggtgtgaagacaatcggctatgggaaattgacaggtaaagttaatcatcattatgttgctaacaaagatggctctgtgacagcatttgttgactctatcactctttacaagtacgagtatcgtaatgttgctcaaaatgctgctgttaatcaaaatattgctttcagagtcttaactaaagacggacaaatcatttttgagaagaaacataatggtaacaaaacttttgcagaaactttaaacaaaactttacaactcaatcttaaatatgagcttaaaccacatggttctagtggaagcgttgaagtctttaagattcatgatgactgggtacatgacacacatgggtctgctttagtgtcttatgttaataataatgatgttgttcctaacgttgttataccaaaacagccaacaccaccgtcaacagaaaaagtgactcctgaagcagaaaaaccagtacctgaaaaaccagttgagcctaaatttgtaacacctacattaaaaacttacactccagctcaaccaaaagtgaaaccacatgtgtctattcctgaaaagattaactactcagttagtgttcatcctgttttagttccagctgctaatccttcaaaagctgtcattgatgaagcaggtcaatctgttaatggtaaaaccgtattaccaaatgctgaattaaattacgttgctaaacaagactttagccaatataaaggaatgactgcatcacaaggtaaaatagctaaaaactttgtctttattgatgattataaagatgacgcactagatggtaagtctatgaaagtgaactcaatcaaagcatctgatggcacagatgtgtcacaactcttagaaatgcgacatgtgctttctacggatactttagatgagaaacttcaaacgcttattaaagaagcaggaatcagtcctgttggtgagttttacatgtggactgcaaaagatccacaagctttttataaagcttatgttcaaaaaggtctagatgttacttataacttatcatttaaagttaaaaaagagtttactaaaggtcaaattcaaaatggtgttgcacaaatcgactttggcaatggatatacaggtaatattgtagtcaatgatttgacaactccagaaatacataaagatgtgttagacaaagaagatggcaagtctatcaacaatggtactgtcaaattaggtgatgaagttacttacaaattagagggttgggtagttccaacaggtcgttcttatgatctatttgaatacaaatttgtggatcaattacaacgcacacctgatctttacttacgtgataaagtggtcgctaaagttgatgtgacattaaaagatggtacagtcattaaaaaagggactaatttaggagagtacacagaaacagtttacaacaaaaagacaggtctctatgaattagtcttcaagaaagacttccttgaaaaagttgcacgttctagtgaatttggggcagatgattttgtggtggttaaacgtatcaaagcaggtgatgtttacaataccgcagacttttttatcaatgggaataaggttaaaactgaaactgtggtaacacatactcctgagaaaccaaaaccagttgaaccacaaaaagcaactccaaaagctcctgctaaaggattacctcaaactggtgaagcaagcgttgcccctcttacagcacttggagcaatcatcttgtcagctatcggtttagcaggatttaaaaaacgcaaagaaaat

SEQ ID NO: 1814 - protein, 835 aa, Streptococcus agalactiae
MITTLQTSQVSADQVTTQATTQTVTQNQAETVTSTQLDKAVATAKKAAVAVTTTAAVNHATTTDAQADLANQTQTVKDVTAKAQANTQAIKDATAENAKIDAENKAESQRVSQLNAQTKAKIDAENKDAQAKADATNAQLQKDYQAKLAKIKSVEAYNAGVRQRNKDAQAKADATNAQLQKDYQAKLALYNQALKAKAEADKQSINNVAFDIKAQAKGVDNAEYGNSIMTAKTKPDGSFEFNHDMIDGVKTIGYGKLTGKVNHHYVANKDGSVTAFVDSITLYKYEYRNVAQNAAVNQNIAFRVLTKDGQIIFEKKHNGNKTFAETLNKTLQLNLKYELKPHGSSGSVEVFKIHDDWVHDTHGSALVSYVNNNDVVPNVVIPKQPTPPSTEKVTPEAEKPVPEKPVEPKFVTPTLKTYTPAQPKVKPHVSIPEKINYSVSVHPVLVPAANPSKAVIDEAGQSVNGKTVLPNAELNYVAKQDFSQYKGMTASQGKIAKNFVFIDDYKDDALDGKSMKVNSIKASDGTDVSQLLEMRHVLSTDTLDEKLQTLIKEAGISPVGEFYMWTAKDPQAFYKAYVQKGLDVTYNLSFKVKKEFTKGQIQNGVAQIDFGNGYTGNIVVNDLTTPEIHKDVLDKEDGKSINNGTVKLGDEVTYKLEGWVVPTGRSYDLFEYKFVDQLQRTPDLYLRDKVVAKVDVTLKDGTVIKKGTNLGEYTETVYNKKTGLYELVFKKDFLEKVARSSEFGADDFVVVKRIKAGDVYNTADFFINGNKVKTETVVTHTPEKPKPVEPQKATPKAPAKGLPQTGEASVAPLTALGAIILSAIGLAGFKKRKEN

SEQ ID NO: 1815 - DNA, 1260 bp, Streptococcus agalactiae
atgaataatatgtcagacttattatccctaccagacattaaaacaatagaaccgccacaagaaaatgaaaccgatatgatgtttaaagttgaagcagtcggaccacctgaacgttgtcctgaatgtggttttgacaagttgtacaaacacagttcaagaaatcaactaattatggatttgcccattcgtttaaagcgagtgggcttacatttgaaccgtagacgatacaagtgtcgtgaatgcggatctaccatatctgtagatgaaaagcgtagtatgaccaaaaggcttttaaagtccattcaagagcaatccatgtctaagacctttgtagaagtcgcagaaagcgttggtgttgacgagaaaaccattaggaacgtttttaaggactatgtggcactcaaagaacgtgaataccagtttgaaactcctaagtggcttgggatagacgagatacatattatccgtagacctcggcttgtattgactaatattgaacgcaggactatttatgacatcaagcctaaccgtaacaaggaaacagtcatccaacgtctttcagaaatcagtgacaggacttacattgagtacgtcacaatggatatgtggaagccctacaaagacgcagtgaacactatccttccacaagctaaagttgtcgtagataagtttcatgtagttagaatggctaatcaagccttagataacgtcagaaagtctttgaaagcccatatgagccaaaaagaaagacgtacccttatgcgtgaaaggtttatccttctaaagcgtaaacacgatctaaatgaacgtgaatcattcctcttagatacttggttaggtaatcttcctgctttaaaagaagcctatgaactcaaagaagagttttactggatatgggatactcctgatccagatgaaggtcatcttcgttatagtcaatggagacaccgttgtatgtccagcaactctaaagacgcatataaagacctcgtgagagccgtagacaactggcatgttgaaatattcaactactttgataaaaggctcactaatgcttatacggagtcaattaacagcattattaggcaggtagagcgaatgggtagaggttactcgtttgatgccttacgagccaaaatccttttcaatgagaagctccataaaaagcgtaagccacgatttaattcaagtgctttcaataaagctatgttatacgatactttcaattggtatgaagtgaatgatcacgacattacagac

SEQ ID NO: 1816 - protein, 420 aa, Streptococcus agalactiae
MNNMSDLLSLPDIKTIEPPQENETDMMFKVEAVGPPERCPECGFDKLYKHSSRNQLIMDLPIRLKRVGLHLNRRRYKCRECGSTISVDEKRSMTKRLLKSIQEQSMSKTFVEVAESVGVDEKTIRNVFKDYVALKEREYQFETPKWLGIDEIHIIRRPRLVLTNIERRTIYDIKPNRNKETVIQRLSEISDRTYIEYVTMDMWKPYKDAVNTILPQAKVVVDKFHVVRMANQALDNVRKSLKAHMSQKERRTLMRERFILLKRKHDLNERESFLLDTWLGNLPALKEAYELKEEFYWIWDTPDPDEGHLRYSQWRHRCMSSNSKDAYKDLVRAVDNWHVEIFNYFDKRLTNAYTESINSIIRQVERMGRGYSFDALRAKILFNEKLHKKRKPRFNSSAFNKAMLYDTFNWYEVNDHDITD

SEQ ID NO: 1817 - DNA, 1638 bp, Streptococcus agalactiae
atgaataaatttaaggtaaacatttcaggaatgacttgtacgggttgtgaaaaacacgtagaatcagcacttgaaaagataggtgctaaaaatattgagtctagttatcgtcgtggtgaagcagtatttgaactgcccgatgatattgaggttgaaagtgcaataaaggcgattgatgaagcaaattaccaagccggagaaattgaagaagtatcatcactagaaaacgtggcgttaattaatgaagacaattatgaccttcttattattggttctggtgctgctgccttttcttcggcaattaaagctatagaatacggtgcaaaagttggaatgattgagcgtggaacggttgggggaacctgtgtgaatattggctgtgttccgtcaaaaactcttcttagggcaggggaaatcaatcatttatcaaaagacaatccgtttataggtttacaaacatccgctggagaagtggatttagctagtttaatcacgcaaaaggataaattggtgagcgaacttcggaatcaaaaatatatggatttaattgatgaatataattttgatttaattaaaggtgaagcaaaattcgttgatgctagtacggttgaggtcaatgggacaaagttatctgcaaaacgctttttaattgcaacaggtgcatcgccttcgttgccccaaatttcaggacttgaaaaaatggactatttaactagtacaacacttcttgagttaaagaaaataccaaaacgattaactgtaattggttcaggatacattggaatggagcttggacaactatttcatcatttaggttcagaaataacgcttatgcaaagaagtgagcgacttttaaaggagtatgatcctgagatttcagagtcagttgaaaaagcgttaattgaacagggtataaaccttgtcaaaggggcaacttttgagcgtgttgaacaaagtggagagataaaaagggtttacgtaacagtaaatggcagtagagaagtcattgaatcagatcagttacttgttgccactggaagaaaaccaaatacggattctttaaatttaagtgcagcaggtgttgaaactggaaaaaataatgaaatcctgatcaatgattttggtcaaacaagtaatgaaaagatttatgcagcaggagatgtgactttaggaccacaatttgtatatgtagcagcctatgaaggtggaattattactgataatgctattggtggattaaacaaaaaaatagatttatcggtagttcctgctgttacgtttacgaatccgacggttgcaacggttggtttaacagaagaacaagcaaaagagaaagggtatgatgtgaagacatctgtattacctttaggtgctgttccaagagcaattgtaaaccgtgaaacaaccggtgtatttaaactagtagcagatgcagaaacactaaaagtattaggggttcatattgtatctgaaaatgcaggagatgtcatctatgcagcatcattagctgttaaatttggcttaacgatagaagatttaacagaaaccctagcaccatatttaacaatggctgaagggctaaaattagttgcacttacgttcgataaagatatttcgaaattatcttgttgtgcaggc

SEQ ID NO: 1818 - protein, 546 aa, Streptococcus agalactiae
MNKFKVNISGMTCTGCEKHVESALEKIGAKNIESSYRRGEAVFELPDDIEVESAIKAIDEANYQAGEIEEVSSLENVALINEDNYDLLIIGSGAAAFSSAIKAIEYGAKVGMIERGTVGGTCVNIGCVPSKTLLRAGEINHLSKDNPFIGLQTSAGEVDLASLITQKDKLVSELRNQKYMDLIDEYNFDLIKGEAKFVDASTVEVNGTKLSAKRFLIATGASPSLPQISGLEKMDYLTSTTLLELKKIPKRLTVIGSGYIGMELGQLFHHLGSEITLMQRSERLLKEYDPEISESVEKALIEQGINLVKGATFERVEQSGEIKRVYVTVNGSREVIESDQLLVATGRKPNTDSLNLSAAGVETGKNNEILINDFGQTSNEKIYAAGDVTLGPQFVYVAAYEGGIITDNAIGGLNKKIDLSVVPAVTFTNPTVATVGLTEEQAKEKGYDVKTSVLPLGAVPRAIVNRETTGVFKLVADAETLKVLGVHIVSENAGDVIYAASLAVKFGLTIEDLTETLAPYLTMAEGLKLVALTFDKDISKLSCCAG

SEQ ID NO: 1819 - DNA, 1761 bp, Streptococcus pyogenes
atggctgttgaaattattatgccaaaactcggtgttgacatgcaagaaggtgaaatcatcgagtggaaaaaacaagaaggtgatactgtcaatgaaggcgatattcttcttgaaatcatgtcagataaaaccaatatggaacttgaggcagaagactcaggtgttcttcttaaaattacacgtcaagcaggtgaaacagtacctgtaacagaagttatcggatatatcggtgctgaaggtgaatctgttgaggtttctagcccagctgcttcagatgtgaatgttgctcgtacaacagaagatttagaagctgctggacttgaagtgccaaaagcaccagctcaagctgcttcagctgcaccaaaagctgcacttgctgatgatgagtatgacatcatcgttgttggtggtggccctgcaggttattatgcagctattcgtggtgctcaacttggtggtaaaattgccatcgttgagaaatctgaatttggtggaacttgcttgaacgtagggtgtatcccaaccaaaacttaccttaaaaatgctgaaatccttgatggtattaagattgcagcaggacgtgggattaaccttgcctcaactaactatactattgacatggacaaaacagttgactttaaaaacaccgttgttaaaaccttaacaggcggcgttcaaggtcttctaaaagctaataaagtcactatctttaatgggcttggtcaagtcaaccctgacaagactgtaaccattgggtcacaaaccattaagggtcgcaacgttatccttgctacaggttctaaagtatcacgtatcaatatcccaggtattgactctaaacttgtcttaacgtcagatgatatccttgacctccgtgaaatgccaaaatcactagcagttatgggcggtggtgttgttggtatcgagcttggacttgtttgggcatcttacggtgtggatgttaccgttattgaaatggctgaccgtattatcccagctatggataaagaagtctctcttgaacttcaaaaaatcctttctaagaaaggcatgaagatcaaaacatctgttggtgtctctgaaattgttgaagcaaataaccaattgactttgaaacttaacaatggtgaagaagttgttgctgaaaaagctcttctttctatcggacgtgtatcacaaatgaacggtctggaaaatcttaaccttgaaatggatcgtaaccgtatcaaagttaatgactaccaagagacatcaattccaggtatctatgcgccaggtgacgttaacggaacgaaaatgcttgctcacgctgcttaccgtatgggtgaagtggctgcagaaaatgcgatgcatggcaacacaactcgtaaagctaaccttaaatacactccagcagctgtttacacacaccctgaagtggcaatggttggtttaactgaagaacaagcgcgtgaacaatatggtgatgtgcttattggtaaaaacagctttactggtaatggacgcgcgattgcttcaaatgaagcacatggttttgttaaagttattgctgatgccaaataccacgaaatcttaggtgttcatattattggtccagctgcagctgagatgattaacgaagcagctactattatggaatctgaattaaccgttgatgaattgttattatcaattcatggacacccaaccttctctgaagtgatgtacgaagcctttgcagatgtgcttggcgaagctatccataacccaccaaaacgtaag

SEQ ID NO: 1820 - protein, 587 aa, Streptococcus pyogenes
MAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVSQMNGLENLNLEMDRNRIKVNDYQETSIPGIYAPGDVNGTKMLAHAAYRMGEVAAENAMHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 1821 - DNA, 390 bp, Streptococcus agalactiae
atgatttatcgcattagtgagtttgcagataaatgtggagttaataaagaaacgatcagatattacgagcgaaaaaatttattacaagaacctcaccgaacggaagctggttatcggatatattcatatgatgacgttaagcgtgttgggtttattaaacgaatacaggaacttggtttctctttaagcgagatttataaattacttggtgttgtagataaagatgaagttcgttgtcaagatatgttcgaatttgtttctaaaaaacaaaaggaagtgcaaaaacaaatagaggatttaaaacgaattgaaactatgttagacgacttaaaacaacgatgtccagatgaaaagaaattacattcgtgtccaataatagaaacattaaca

SEQ ID NO: 1822 - protein, 130 aa, Streptococcus agalactiae
MIYRISEFADKCGVNKETIRYYERKNLLQEPHRTEAGYRIYSYDDVKRVGFIKRIQELGFSLSEIYKLLGVVDKDEVRCQDMFEFVSKKQKEVQKQIEDLKRIETMLDDLKQRCPDEKKLHSCPIIETLT

SEQ ID NO: 1823 - DNA, 1566 bp, Streptococcus agalactiae
atgaatctacaaaaaaatgataaaacaaatagttttatccattatgcaaacggtccttccctagaagaaataaatgggacaattgaagttcctaaagatttgagcttttttaaaactttactagcttattctggaccgggtgcacttgttgctgttggttatatggatcctggaaattggtccacttccataactggcggtcaaaattttcaatatttactaatttcaattatcttaatgtctagtttaattgctatgctacttcaatacatgtcagctaagctaggtattgttactcagatggatcttgctcaagctatccgagcaaggaccagtaaacagttgggaattgtcttatggattctcactgagcttgctataatggcaacagatattgctgaagttattggtggggctattgcactttatttactgtttcatattccacttgcgattgctgttttcattacagtatttgatgtattactcttattattgttgacaaaaataggatttcgaaaaattgaagctctagtagttgctttaatattggttattttcttagtttttgcatatcaagtggctctttctcatcctatatggacggatatttttaaaggtttagtacctacatctgaagctttctcaacctctcatacagtaaatggacaaacaccactttcaggtgccttaggcattattggggcaactgttatgccacataatctttatctacattcttcagttgttcaaagtcgaaaactagatcataataacaaaaaagatatcgctagagcaattaggttttcaacttttgattcaaatattcaattaacagtagccttttttgttaattcactattactcattatgggcgttgctgttttcaaaacaggaagtgttactgatccatcattctttggtctatttaaagcactatctaattctactattatgagtaattctattttagctcatatagcaagttcaggtattttatcacttttatttgcaatagctttattagcatctggacagaattcaactattactggaacattaacaggtcaaattattatggaaggatttattcatatgaaagttccaatttggttccgtcgtatcattactcgcctaatttctgttattcctgtaatgatttgtgtcttagtaactagtggtagaagtactgttgaagaacatatagctattaataacttaatgaataactctcaagtcttcttagcatttgcattaccattctcaatgttacctctactaatatttactaatagtaaagttgaaatggatgatgattttaaaaatacttggataattaagattcttggttggctttcagttataggattaatttatctcaatatgaagggattgccaaatcaaattgaaggtttttggggagataacccaactcatcaacaaattattcttgcgcatcaaatagctcatatcatcattattagtgtaatactaactttaatatggactattgttgaattgtataaaggaaataaaaaatacagtacgatgcaacaaagtgcaact

SEQ ID NO: 1824 - protein, 522 aa, Streptococcus agalactiae
MNLQKNDKTNSFIHYANGPSLEEINGTIEVPKDLSFFKTLLAYSGPGALVAVGYMDPGNWSTSITGGQNFQYLLISIILMSSLIAMLLQYMSAKLGIVTQMDLAQAIRARTSKQLGIVLWILTELAIMATDIAEVIGGAIALYLLFHIPLAIAVFITVFDVLLLLLLTKIGFRKIEALVVALILVIFLVFAYQVALSHPIWTDIFKGLVPTSEAFSTSHTVNGQTPLSGALGIIGATVMPHNLYLHSSVVQSRKLDHNNKKDIARAIRFSTFDSNIQLTVAFFVNSLLLIMGVAVFKTGSVTDPSFFGLFKALSNSTIMSNSILAHIASSGILSLLFAIALLASGQNSTITGTLTGQIIMEGFIHMKVPIWFRRIITRLISVIPVMICVLVTSGRSTVEEHIAINNLMNNSQVFLAFALPFSMLPLLIFTNSKVEMDDDFKNTWIIKILGWLSVIGLIYLNMKGLPNQIEGFWGDNPTHQQIILAHQIAHIIIISVILTLIWTIVELYKGNKKYSTMQQSAT

SEQ ID NO: 1825 - DNA, 90 bp, Streptococcus agalactiae
ttgaggttatcaaaaatttcatttaaaatcgcaacgaatccacttcaaggaacactaaaagccccatccctagggctttttttgttgagt

SEQ ID NO: 1826 - protein, 30 aa, Streptococcus agalactiae
MRLSKISFKIATNPLQGTLKAPSLGLFLLS

SEQ ID NO: 1827 - DNA, 720 bp, Streptococcus agalactiae
atgttaggattggagtttagaaagtctataagaggtagaacattattttatattatatctactgtagctttgacctatgtattaggatatattttaccagtagggatagataaaataagacatttaactttgggagaattttactttagtacctacacagtatttacccaatttggatttttaatattcggctttgtcattgtatatttctttaataaagattactctgacaaatgtattttatatcactatttttcagggtatcatctaactaaatacttttatactaaactgttagtattattttcagaattttttattgctataatagtttgcaatatattagcttcattgctttggggatattcactattttattttttaacaactacaatcttattttcactcgttgttctacagtatctactagtcgtctcaactattagtatcctgttttctaatatgctagtttctattggagttactattttttattggattacatccattattttagtggcaattggaggaatttttaaagtatctgctatttttgatgcttcaaattctctctataaaataatagggaaacttttctcacatccgatgactattgatttaaccgacttttttataattgttccttatatgatatgccttagtgtaattagttttttgatagtgtgcttatcaaatagaagatggttattaaatggaatg

SEQ ID NO: 1828 - protein, 240 aa, Streptococcus agalactiae
MLGLEFRKSIRGRTLFYIISTVALTYVLGYILPVGIDKIRHLTLGEFYFSTYTVFTQFGFLIFGFVIVYFFNKDYSDKCILYHYFSGYHLTKYFYTKLLVLFSEFFIAIIVCNILASLLWGYSLFYFLTTTILFSLVVLQYLLVVSTISILFSNMLVSIGVTIFYWITSIILVAIGGIFKVSAIFDASNSLYKIIGKLFSHPMTIDLTDFFIIVPYMICLSVISFLIVCLSNRRWLLNGM

SEQ ID NO: 1829 - DNA, 615 bp, Streptococcus agalactiae
atgtttattaataattacaccttaaaaataggaaatagaatacttttagagaatactaacttagactttgaagaaggggaaataaatcatcttttaggtaggaatggatcaggtaaatctcaactagctaaagattttatcataaatagagggaattatttttcaaatgatatttatgaagacacgctgattatttcgagttattctaatcttcctagtgatgttaccattaacgatttagaaaggacaattccgtggaagctttctaaagaaatttatcagttattgaatattaatcaaataagtaaaacggttaagttaaagcaattaagtgatgggcagaaacaaaaggtgaaattattagttttgttgtctttagacaagcatattattatacttgatgaaattactaatgctttagataaaaagtctgttgatgagataaacgtatttttgcaaaactatattcagtattatcccgaaaaaattattattaatatttcacatgatatcaataatatcaggtctttaaagggaaactattttctaattgataatcaaaaaatttgtaaagtagacacattagatgatgctattagttggtatttaggagaa

SEQ ID NO: 1830 - protein, 205 aa, Streptococcus agalactiae
MFINNYTLKIGNRILLENTNLDFEEGEINHLLGRNGSGKSQLAKDFIINRGNYFSNDIYEDTLIISSYSNLPSDVTINDLERTIPWKLSKEIYQLLNINQISKTVKLKQLSDGQKQKVKLLVLLSLDKHIIILDEITNALDKKSVDEINVFLQNYIQYYPEKIIINISHDINNIRSLKGNYFLIDNQKICKVDTLDDAISWYLGE

SEQ ID NO: 1831 - DNA, 744 bp, Streptococcus pyogenes
ttgttttgcttactatacactaaacgctcagcaatatatagaatgggagtaactaatatgttgaaaatacaaaatctaaaaaaatcttatggtaagagaaccatattgaataatgtcaatatgaatattcctaagggaaaagtgtatgctttaatcggtccaaatggtgctggaaaatcaactattatgaaaattttgacaggcttagttagtaagacaagtggttctattatttttgaaggtagagaatggtcacgtcgggatctgcgaaaaatcgggagtattattgaagaaccaccactttataaaaatttgagtgcttacgataatatgaaggtagttacaacaatgcttggtgtttcagaaagcactatacttccattattaaataaagttggtctaggaaatattgacaagagaccagtaaaacaattttctcttggaatgaagcaacggttaggtatagctatctctttaataaattcacctaaactacttatattagacgaacctactaatggcttggacccaattggaattcaagaattaagggaaattatagagtcatttaaatcagaaggaatgacaattatgatttcaagccatatactgtcagaagttgaacatctagctgattttattggatttatctatgaaggaaagattattctggaaaaagaatatgacggctctgagaatcttgaagagttattcaataatcaaattttatttgaaaagaggagg

SEQ ID NO: 1832 - protein, 248 aa, Streptococcus pyogenes
LFCLLYTKRSAIYRMGVTNMLKIQNLKKSYGKRTILNNVNMNIPKGKVYALIGPNGAGKSTIMKILTGLVSKTSGSIIFEGREWSRRDLRKIGSIIEEPPLYKNLSAYDNMKVVTTMLGVSESTILPLLNKVGLGNIDKRPVKQFSLGMKQRLGIAISLINSPKLLILDEPTNGLDPIGIQELREIIESFKSEGMTIMISSHILSEVEHLADFIGFIYEGKIILEKEYDGSENLEELFNNQILFEKRR

SEQ ID NO: 1833 - DNA, 852 bp, Streptococcus agalactiae
atgagagatgagcaagaaatatataatttggtgttaaacatagcaaaccaagataagagaatcgaagctgtactattgaatggatctcgggctaacccaaatgtaccgaaagatgattttcaagattatgatattgtttttgttactaattttatagaagatattatttctgacactaattatcataaaaaattcggtgatattcttataatgcagaaaccaaatgagtttagaaataagacggaatacaattgctttgcttacttaatgcagtttcaagatctgacgaggattgatttaagacttattaaaccagaattcttggaggattatttagatgatgctttttcaaaagtacttttagataaaaagaataaatatcttgattataattttgaaagaagttctctgtacgaaacaaagcaattgtcagaagatgaaatcaacaaaattcttaatgaaatatattgggttagtacttatgtagtcaaggggatagcaagaaatgatattatttattcagagtttatgatatctaatcctattaaaaatgcttttattaaacttctaaaacaaaaaatattaatagaaaaagagcttgattcattatcttttggaaagctcgacaaggatatcttgcaatatattacagataaagatcaactattgaaaattttttcaaataaatctttaaaagacattgaggctaatttgcgatttttattggatgaaacaaatcaaatggcgaaatatatttctattaataggaaacttaatctgaaccaaggagaataccaatcagcaatgaaatttatgaatatctttttgtcaaattcatatcaaaatttcaac

SEQ ID NO: 1834 - protein, 284 aa, Streptococcus agalactiae
MRDEQEIYNLVLNIANQDKRIEAVLLNGSRANPNVPKDDFQDYDIVFVTNFIEDIISDTNYHKKFGDILIMQKPNEFRNKTEYNCFAYLMQFQDLTRIDLRLIKPEFLEDYLDDAFSKVLLDKKNKYLDYNFERSSLYETKQLSEDEINKILNEIYWVSTYVVKGIARNDIIYSEFMISNPIKNAFIKLLKQKILIEKELDSLSFGKLDKDILQYITDKDQLLKIFSNKSLKDIEANLRFLLDETNQMAKYISINRKLNLNQGEYQSAMKFMNIFLSNSYQNFN

SEQ ID NO: 1835 - DNA, 390 bp, Streptococcus agalactiae
atgcaaagccagaaattaaatgtccttcagagagttttaagggataaatttcttttacaaggattaggagtacccaacagtaatactgtgttaaacagatcttttactgctctattactagctttattattggaggactcaaataataaaagttggatatctgaagaagatcagataaaaattatgaatcaggcattctcctggcttatagatgaacctgattttagaggctttgacgaggagcttggatggatacatgcctttgctcatggagctgatttattaacagaaatagtcaagatgaaatgtttttcaaaagatgatagtttaaaaatcttaactatcataaaaagagtgatgataactgatgacatactaacattaaacggt

SEQ ID NO: 1836 - protein, 130 aa, Streptococcus agalactiae
MQSQKLNVLQRVLRDKFLLQGLGVPNSNTVLNRSFTALLLALLLEDSNNKSWISEEDQIKIMNQAFSWLIDEPDFRGFDEELGWIHAFAHGADLLTEIVKMKCFSKDDSLKILTIIKRVMITDDILTLNG

SEQ ID NO: 1837 - DNA, 621 bp, Streptococcus agalactiae
ttgggggagatagttatgataaagtttaaattattttttaaatccacagaaaaagaggaagaatggatcgataaggttcaaaaaagtggctatgcttttacaggcattaactcatttcttccagccttctattattttaagagagataaagaaaaagacaagatgtcaataaaaatggattttaaaaaatacatgtcgaaagatgactatgctaactatatcactttatttgaggacagtggatggaagcatattagcggtagtcgttggggagggctgcattattttcaaaaaataaagcctgaaaccagttcagagattttttctgatcaagaatcaaaatcagcgatggctatgagttattataaatatacttgtgagcatgcgtttttctctttattttatttctttctcttgataagaacaacttctatcaccatatttgatccaaaaagttggtatctgacgcaaggtctatgggaaatgcaagggaaaatattttggttagcattcttatttgaaacaccatttgccttattaagaatattacctatgttttactttttaatttctggaatatactatattacacgagctgtaaaacccaaggaaattataaat

SEQ ID NO: 1838 - protein, 207 aa, Streptococcus agalactiae
MGEIVMIKFKLFFKSTEKEEEWIDKVQKSGYAFTGINSFLPAFYYFKRDKEKDKMSIKMDFKKYMSKDDYANYITLFEDSGWKHISGSRWGGLHYFQKIKPETSSEIFSDQESKSAMAMSYYKYTCEHAFFSLFYFFLLIRTTSITIFDPKSWYLTQGLWEMQGKIFWLAFLFETPFALLRILPMFYFLISGIYYITRAVKPKEIIN

SEQ ID NO: 1839 - DNA, 336 bp, Streptococcus agalactiae
ttgatgaaaaggaataaacatttaccgttaacagaaactacctattatatcttattagctttgtttgaggaagcacatggctatgctattatgcaaaaagttgaagaaatgagtggcggtgatgttagaatagccgcagggacaatgtacggtgccattgaaaatttacttaaacaaaaatggataaagtctatcccaagtgacgatagaagaagaaaagtttatattattactgagacaggaaaagaaatagtagaacttgaaacgaatcgattaagaaagttacttaatactgctaatcagttgggttttgggggagatagttatgataaagtt

SEQ ID NO: 1840 - protein, 112 aa, Streptococcus agalactiae
MMKRNKHLPLTETTYYILLALFEEAHGYAIMQKVEEMSGGDVRIAAGTMYGAIENLLKQKWIKSIPSDDRRRKVYIITETGKEIVELETNRLRKLLNTANQLGFGGDSYDKV

SEQ ID NO: 1841 - DNA, 591 bp, Streptococcus agalactiae
ttgctgctatttgacttatctagatcaatatttccaactaatatgatatcctatgcatacctcattgcagaaatatactttaaagtcaaaataaggaaatatattatggaaattaaagaatacgagaataatccgtaccatttagcacagctagtagatttaattaattattgtcagaatatagaagctaaacttgatataaagatggctgaacaagacgatatttttcaaatagaaaattattatcaaaacagaaaaggtcaattttggattgccttagaaaatgaaaaagtagttggttcgattgcgttactgcgtattgatgataaaacagctgttctaaaaaaattttttacatatccaaaatatagaggaaatcctgttcgacttggtcgaaaattatttgaaagatttatgctttttgctcgagctagtaaattcacaagaattgtcttggatactccagaaaaagagaaaagatctcacttcttttatgaaaatcaaggatttaagcaaataacaagagatgaactagatgtagactacatttttccagatagagattcaaggatatatgtaaaacttcttgat

SEQ ID NO: 1842 - protein, 197 aa, Streptococcus agalactiae
MLLFDLSRSIFPTNMISYAYLIAEIYFKVKIRKYIMEIKEYENNPYHLAQLVDLINYCQNIEAKLDIKMAEQDDIFQIENYYQNRKGQFWIALENEKVVGSIALLRIDDKTAVLKKFFTYPKYRGNPVRLGRKLFERFMLFARASKFTRIVLDTPEKEKRSHFFYENQGFKQITRDELDVDYIFPDRDSRIYVKLLD

SEQ ID NO: 1843 - DNA, 759 bp, Streptococcus agalactiae
atgaaatctttagcagtaatgttaaaaaaagaatggatggagaatgttaggacatacaaagttatatctattctgattacttgttcaatatttggtatattaggtcccttaactgcacttatgatgcctgatattatggcaggaattttacctaaaaaactacagggagcgataccagagcctacctatattgattcttatattcagtattttaaaaatatgaatcagcttggtttagttattttagtatttttatttagtagtacactgacgcaagaattttcaaaaggaaccttaattaatctagttacgaagggattagccaaaaaagttataatccttgctaaatttatagtaattacccttctatggacagtgtcatacttattaagtgttgtcatccattttagttatacgttatattactttagtaacgaaggaagtcataaattaatggtttacggtgcaacatggtttatcggtattcttttcataagcttaatactctttttttcagttctttttcgtaaaactttagggggtttgttaggttgtctttttatggtggtgttatgtgtagtatctggattttttaaaatcagtaaaagctataatcctatgcttcttatccaaaaacaaggagaaatattaagtggaaagtttaaagttcaagacttaatggaaccgagcatattagtgtttttgcttattataatgacgttattacttagcatgtacatttttgaaaaaagtgaagtt

SEQ ID NO: 1844 - protein, 253 aa, Streptococcus agalactiae
MKSLAVMLKKEWMENVRTYKVISILITCSIFGILGPLTALMMPDIMAGILPKKLQGAIPEPTYIDSYIQYFKNMNQLGLVILVFLFSSTLTQEFSKGTLINLVTKGLAKKVIILAKFIVITLLWTVSYLLSVVIHFSYTLYYFSNEGSHKLMVYGATWFIGILFISLILFFSVLFRKTLGGLLGCLFMVVLCVVSGFFKISKSYNPMLLIQKQGEILSGKFKVQDLMEPSILVFLLIIMTLLLSMYIFEKSEV

SEQ ID NO: 1845 - DNA, 900 bp, Streptococcus agalactiae
atgaaagctatctcatttcaaaacgttacaaaatcttttggtcctaaaaaaatattaaataatgtttcttttgatttagaagaaaatatgatttatggattcgtaggaccaaatggagcaggtaaaacaacgacaataaaaatgattttaggattgttaaaatttgatacgggtttcataacaatttttggtaaaaaagttaattttggaagaacagataccaatcaactgattggctatctcccagatgttcccgagtactacgattatatgacagctctagaatatcttgatttatgttctggtttagcgagatcaaagcataagctttctaacaaagaactacttaggtcagttggacttgacgataatcaccaaaagattgctacttattctcgaggaatgaaacagcgtcttggattagcccaagcactggttcatgatcctaaaattattatttgcgatgaaccaacctctgcattagacccgaaaggtcgccaagatattttagatattatttcaaatcttagaggagaaaaaactgtgattttttctacccatattctctctgatgtcgaaaaaatatgtgatcatgttctggtgttaactaagtgtgggatttattctcttgaagagttaaaaggaaaaaaatcagaggaaaattattcggttcgtattttaataaaagtgacaaagtctgaagctaaggtactatctcataactatcagatagaaaagaaagataatgagtatgcactgactctcaaaggctctaaaatggataacaaagcagatttactagctggtttttaccaagatttagtttctttaaagattagcccatcagctattgaagtcattgacaatagtttagaggagctttatttggaggttaccaaa

SEQ ID NO: 1846 - protein, 300 aa, Streptococcus agalactiae
MKAISFQNVTKSFGPKKILNNVSFDLEENMIYGFVGPNGAGKTTTIKMILGLLKFDTGFITIFGKKVNFGRTDTNQLIGYLPDVPEYYDYMTALEYLDLCSGLARSKHKLSNKELLRSVGLDDNHQKIATYSRGMKQRLGLAQALVHDPKIIICDEPTSALDPKGRQDILDIISNLRGEKTVIFSTHILSDVEKICDHVLVLTKCGIYSLEELKGKKSEENYSVRILIKVTKSEAKVLSHNYQIEKKDNEYALTLKGSKMDNKADLLAGFYQDLVSLKISPSAIEVIDNSLEELYLEVTK

SEQ ID NO: 1847 - DNA, 1074 bp, Streptococcus agalactiae
atgcttggagagaatatctatttacaacgtactcagattggtatgacgcaagagaatttgagtgattatctgcatttaacaaaaactacaatttcaaagtgggaaaataatcaagctaaaccggatattgactatcttattttgatggctaatctttttgatattagcttggatgacttagtcggttatcaaaaaacattgtcagatgatcaaagaaatcagctcattaaggatctaaaaataaaagcaaatgtattgtctgagagagatttctttcaggaagttaaggaattatcaaaacagttccctaacgattttaagactctgttgataatgattaatatggtcttgagcaacctaaccaaccttaatgattcagaaatgaaagagtggtcactaagtacactaaataaaattattagtaaaacagtagttgagtctgacctccagacggcgataatgttcaaaacggtcgttctttttcacaaccttgaatatgatgaagtgataaacctttaccagaatagtccctataaattaggtgaagaattacttttagctaatagcttttttgcaaaagtcgatgtttaccgagctaagcaagtattacaggttgaaatttatcagcagattctacttgtatgcgagtatctattgagtttatcaacttttgaagttgaagaaaacaaaggcgatatttttgaaaggcttgaacatatgatagaagcgtttcaattaaactctttgcatcccaacacagtcatcaagtgttattatagtttagcttgtcattatagtaaaagtgatgatgataaggcattaggatacttaaaacaatgttttaaatctttaaaacaattgctccaaagatttgaattacacggtgatactttcttttataccatcgatgattggttagagacaatacctactggtattgcaccaccgacgagtcaattacaggtaatagaacgagttgaggacttatttcaaaattcacaatttaaagaactatcagggcataaagaatttcaacaaatgattcaaaaacttaacgatttaaaaaaggattac

SEQ ID NO: 1848 - protein, 358 aa, Streptococcus agalactiae
MLGENIYLQRTQIGMTQENLSDYLHLTKTTISKWENNQAKPDIDYLILMANLFDISLDDLVGYQKTLSDDQRNQLIKDLKIKANVLSERDFFQEVKELSKQFPNDFKTLLIMINMVLSNLTNLNDSEMKEWSLSTLNKIISKTVVESDLQTAIMFKTVVLFHNLEYDEVINLYQNSPYKLGEELLLANSFFAKVDVYRAKQVLQVEIYQQILLVCEYLLSLSTFEVEENKGDIFERLEHMIEAFQLNSLHPNTVIKCYYSLACHYSKSDDDKALGYLKQCFKSLKQLLQRFELHGDTFFYTIDDWLETIPTGIAPPTSQLQVIERVEDLFQNSQFKELSGHKEFQQMIQKLNDLKKDY

SEQ ID NO: 1849 - DNA, 612 bp, Streptococcus agalactiae
gtgaacaagaaatcctttttccagtgtgttatactacttgtttcttttttagtgttaacattagcagttaaatctcaaagtgatatgataagttatttggataatatcacttcagctttttttcaaagcatacgaaatcccgatttaactaacttaatgacgataatatcaacagttgtcagccctttgacaacgtcattaatagcacttgttatccttgggtatcaatattttttaaaccaaagaatagctgtgtggctatttatgttattttttggtaccaatgctttggcattgcttttaaaagatatcatcgcacgtcatagacctatgaatcaacttgtttttgattcgggttatagttttcccagtggacatacgatatcagcgtttttattaatgattcttgttttagtggttgcgagacagagattgagaagagtattgtcacaagtagttttcgtaatatttgcattagtgatccttgcatcagttattttttcaagactctatttagaaaatcattttttaacggatattttagggtcgttgttactaggagcatcgtcatattatggtttgtctgctattgtatctttgaaagagttacaa

SEQ ID NO: 1850 - protein, 204 aa, Streptococcus agalactiae
MNKKSFFQCVILLVSFLVLTLAVKSQSDMISYLDNITSAFFQSIRNPDLTNLMTIISTVVSPLTTSLIALVILGYQYFLNQRIAVWLFMLFFGTNALALLLKDIIARHRPMNQLVFDSGYSFPSGHTISAFLLMILVLVVARQRLRRVLSQVVFVIFALVILASVIFSRLYLENHFLTDILGSLLLGASSYYGLSAIVSLKELQ

SEQ ID NO: 1851 - DNA, 651 bp, Streptococcus pyogenes
atgatgacaaacaaacaaactcactttttaatagcttcttttgcattgctaatctttgttataataggctatacggtcaaattttttcctgaacgtttggcacttctagataatactattcaagcagagattagaggcaaccttcctatagtgctgacgcaattctttaggggtgttactgtatttggaaatgtcatgacacaagttttgttagttattgtgtcggtcctagttttattctttatgaagtggaaaattgaagccttgtttatcttgtcaaatggtgccattgcagcatttttgattacgactctcaagctcttttaccaaagaccaagacctgctattgagcatttggtttatgctggtggctattcgtttcccagtggccatgcgatgggtagcatgctgatttttggtagcctattgattatttgttatcagaggctacattcaaaactattacaatttgtgactagcatgatctttataatactaattttattaattgggttatctcgtatttatctaggagtacactacccaagtgatattttagcaggctttgtattaggatttggtattttgcactttatttatcctttttataagcaaaaacgatttgaatggcgatttcttttgaaacaagac

SEQ ID NO: 1852 - protein, 217 aa, Streptococcus pyogenes
MMTNKQTHFLIASFALLIFVIIGYTVKFFPERLALLDNTIQAEIRGNLPIVLTQFFRGVTVFGNVMTQVLLVIVSVLVLFFMKWKIEALFILSNGAIAAFLITTLKLFYQRPRPAIEHLVYAGGYSFPSGHAMGSMLIFGSLLIICYQRLHSKLLQFVTSMIFIILILLIGLSRIYLGVHYPSDILAGFVLGFGILHFIYPFYKQKRFEWRFLLKQD

SEQ ID NO: 1853 - DNA, 294 bp, Streptococcus agalactiae
atggatattacagattatcaaaaatgggtgagtgaattctataaaaaaagaaactggtatcaatacaattcttttattagaagtaactttctttcagaagaagtcggcgaattggctcaagccattcgcaaatatgaaattggacgtgacagacctgacgaaaccgaacaaactgatttggaaaacttaaatgatataaaagaagaactaggagatgtcttagataatatcttcatacttgctgatcagtataatatctcactagaagagattatcagcgcacatcgcactaat

SEQ ID NO: 1854 - protein, 98 aa, Streptococcus agalactiae
MDITDYQKWVSEFYKKRNWYQYNSFIRSNFLSEEVGELAQAIRKYEIGRDRPDETEQTDLENLNDIKEELGDVLDNIFILADQYNISLEEIISAHRTN

SEQ ID NO: 1855 - DNA, 558 bp, Streptococcus agalactiae
atgagaataactattttttgtggagcaagtactggggaaaatcctgtttatagtgaaaaaacagttgccttagcacaatggatggcacaaaacaaacattctctggtgtatggtggaggaaaagttggcttaatgggagtcatggctgatactgtgattgcaaatggtggctacactactggtgttattccgacatttttaagagatcgtgaaattgcacatgaaaatttatcagagcttatcatagtaaataatatgcctgaacgtaaggcaaaaatgatgctacttggagatgcctttatcgctctacctggtggacctggtacccttgaagaaatttccgaagttatctcttggtctcgcatcggtcaaaatgataatccttgcattttatataatgttaatggctactttaatgatttaaaaaatatgtttgatcatatggttggtgagggttttcttagtctggaagatagagaaaatgtcctattctcagatgatattactgaaatcgaagattttataacgaattataaagtccctagcacgcgccaatac

SEQ ID NO: 1856 - protein, 186 aa, Streptococcus agalactiae
MRITIFCGASTGENPVYSEKTVALAQWMAQNKHSLVYGGGKVGLMGVMADTVIANGGYTTGVIPTFLRDREIAHENLSELIIVNNMPERKAKMMLLGDAFIALPGGPGTLEEISEVISWSRIGQNDNPCILYNVNGYFNDLKNMFDHMVGEGFLSLEDRENVLFSDDITEIEDFITNYKVPSTRQY

SEQ ID NO: 1857 - DNA, 861 bp, Streptococcus agalactiae
ttgaatcaagaaaaaaagagacttaacctaatcgggctgatacttttagctcaggctattgttttaagtttggcgactacactatttgctgaaatcttacaaaatgatgtctggataggtatagcaagtactttaatcgccttactcattccttgtttttttatgggttttaaaaatttaaaaaaacatctaacggcaacccatcatacaatcactttcaccactattttattcttgttaagcattatatatactactaataatatagtctccacaatatgggatgttgtgctaaatcatctcaatattatggaatcggaaagtcaaaattatgatgccacattcaatatacttatgattagttattctgttgttgtaggtcctttttttgaagaagttttataccgaggaatagtattgaatttattatccaagtatggtaaatggtttgccattatcacttctggcatcctatttggtttaatgcaccaagacatttctcagctattgactacatctattgcgggtatcataatgggttttatcgcttaccattattcctttaaggtagccctactccttcatatctgcaataactttatcgtagaaattttcacccagctatcaacagtaaacgagttatacgggacttattttgaaaatatattgctaattttagcaatcttatttatattatattacctttttactcataggaatactgctcgccgtcgtataagtctgcactctaacgttcgagaggctgactcaataaactctaaacaacatacaaaattattacttactagttggccttttattctccttgtcatttacgacattgtcctaacaactattaat

SEQ ID NO: 1858 - protein, 287 aa, Streptococcus agalactiae
MNQEKKRLNLIGLILLAQAIVLSLATTLFAEILQNDVWIGIASTLIALLIPCFFMGFKNLKKHLTATHHTITFTTILFLLSIIYTTNNIVSTIWDVVLNHLNIMESESQNYDATFNILMISYSVVVGPFFEEVLYRGIVLNLLSKYGKWFAIITSGILFGLMHQDISQLLTTSIAGIIMGFIAYHYSFKVALLLHICNNFIVEIFTQLSTVNELYGTYFENILLILAILFILYYLFTHRNTARRRISLHSNVREADSINSKQHTKLLLTSWPFILLVIYDIVLTTIN

SEQ ID NO: 1859 - DNA, 1065 bp, Streptococcus agalactiae
  misc_feature (1)..(1065): n = a, c, g, or t
ttgcgctatcataaggttataaaaaatgctataatacgaataaaggaggcaagtatggcaagaatcccttatcagaaaacacttattttttgtgtagccgttattattgctatttttattttggggttatctaaggatttagcacaatctaaagggcaaaaggttgcaaataataatactgtaaaaacagcacgtgtggttgcaaacggagatattttgctgcacgatgtactatatgccagtgcgcgccaacccgacggcacttataattttactccttattttaaagaggtaaaatcttggattgagagcgctgatttagcgattggtgattatgaagggacgattagttcagaatatcctttagcgggctatcctttatttaatgctcctaatgagattgcaactactatgaaagaaactggatatgatgtcgttgacttagcacataatcatattctggattcacaactggcaggtgctatcaatactgtcaagacttttaatcgtctgggattggatactattggggtttatttaaaggatagaaataaagaagatatcttaattaagcatgtaaatggtattaaaattgctattttaggttattcgtatggctacaatggtatggaagctaatgtttcaaagagtgactatgaaaaacatatgtctgatttagatactaaaaagattaagcaagatattaaaaaggctgaaaaagaagcagatatcaccattgtcatgccacagatggggatagaatatcaaaaaaaacctactacagaacaagtaatgctttatcatagtatgattaaatggggggcagatattatattcggaggacaccctcacgttgttgaaccgtctgaagtgataaaaaaagatggccagaaaaaatttattatttactctatgggaaattttatttcaaatcagcgtttagaaacggttgatgatatctggacagaaagaggattattaatggatgtaaccatagagaaaaaaggtcaaaaaacagtaattaaaaaagttaaggcgcatccaacactagtagaagcannnnnt

SEQ ID NO: 1860 - protein, 355 aa, Streptococcus agalactiae
  misc_feature (1)..(355): Xaa = Any Amino Acid
MRYHKVIKNAIIRIKEASMARIPYQKTLIFCVAVIIAIFILGLSKDLAQSKGQKVANNNTVKTARVVANGDILLHDVLYASARQPDGTYNFTPYFKEVKSWIESADLAIGDYEGTISSEYPLAGYPLFNAPNEIATTMKETGYDVVDLAHNHILDSQLAGAINTVKTFNRLGLDTIGVYLKDRNKEDILIKHVNGIKIAILGYSYGYNGMEANVSKSDYEKHMSDLDTKKIKQDIKKAEKEADITIVMPQMGIEYQKKPTTEQVMLYHSMIKWGADIIFGGHPHVVEPSEVIKKDGQKKFIIYSMGNFISNQRLETVDDIWTERGLLMDVTIEKKGQKTVIKKVKAHPTLVEAXX

SEQ ID NO: 1861 - DNA, 1290 bp, Streptococcus pyogenes
atgatactattgaaaagcctctataagggcttttttgctgcaatgaaggaggaaaattttgaggcaagatgttataatagagaaaaaggagggtgtgtcttgattaaaactatgcaatacaaaaaaacgatggcaacagttgttgctcttatcgtcgcacttttgctatttggcttgatttatgatttacttggggttcaaaaaaatgagctagcagctcaaaaatctgctcagccaaaggtcaaaacagcgcgtgttgtagctaatggcgacattttaattcatgatattctctacatgagtgctagaaaagctgacgatacctatgatttcactccttattttgaatatgttaaggactggattagcggtgctgacttagctattggagattatgaagggaccattagcccagattatcccttagcaggctatcccttattcaatgctccagaagagattgcaggtgctctgaaaaatactggctatgatgtagtcgatttagcccataatcatatcttagattcccaattagacggtgcccttaacactaaaaaggtttttcatcaattaggtatagacagtattggcatctatgacaaggatcgttcaaaagaatccttcttaattaaaaatgtcaatggtatcaaaattgcaattttaggttattcttatggttataacggcatggaggccacacttagccaagaagactatgagaaacacatgtctgatttagatgaagctaagataaaaaaagaacttcagctagctgaaaaaaaggctgacgtgaccattgttatgccacaaatgggaacagaatatgccttagaaccgacagcagaacaaaaagaactttaccacaaaatgattgattggggagctgacgtcgtcctaggaggccatccgcatgttattgaaccttcagagacagttataaaaggtaggcaaaagaaattcattatttactctatgggaaattttatttcaaatcagcggcttgaaaccgtagatgatatctggactgagcgtggcctattgatggaccttacttttgagaaaaaagataacaaaacaaaaattaaaacagttgaggcccatccaaccatggttttagccaaaggtaaaggcattgtgggtaaagaaggttttgaactatacaattatcgaacaatggttttagaagattttatcaaaggtggaaaataccacgacaagattgatgaggaaaccaaagcaaaagtagcacttgcctatcaggaaattaatgatttagttaacctgaaatgg

SEQ ID NO: 1862 - protein, 430 aa, Streptococcus pyogenes
MILLKSLYKGFFAAMKEENFEARCYNREKGGCVLIKTMQYKKTMATVVALIVALLLFGLIYDLLGVQKNELAAQKSAQPKVKTARVVANGDILIHDILYMSARKADDTYDFTPYFEYVKDWISGADLAIGDYEGTISPDYPLAGYPLFNAPEEIAGALKNTGYDVVDLAHNHILDSQLDGALNTKKVFHQLGIDSIGIYDKDRSKESFLIKNVNGIKIAILGYSYGYNGMEATLSQEDYEKHMSDLDEAKIKKELQLAEKKADVTIVMPQMGTEYALEPTAEQKELYHKMIDWGADVVLGGHPHVIEPSETVIKGRQKKFIIYSMGNFISNQRLETVDDIWTERGLLMDLTFEKKDNKTKIKTVEAHPTMVLAKGKGIVGKEGFELYNYRTMVLEDFIKGGKYHDKIDEETKAKVALAYQEINDLVNLKW

SEQ ID NO: 1863 - DNA, 1242 bp, Streptococcus agalactiae
atgaaaaaactaagaaagttagaggataagatgcagtattcagaaattatgattcgttatggagaactctctactaagaagaaaaaccgtatgcgcttcatcaataagttaaaaaataatatggagcatgtactctccatttatccagatgtttcagtaaaaacagatcgtgatagaggacatgtatatctcaatggtacagattatcatgaagttgcagagtccttaaaagagatttttggtatccaagctttttctccatcttttaaagtagaaaaaaatgttgatacattggtaaaagctgtccaggaaattatgacttccgtttataaagatgggatgacttttaaaattaccgcaaaacgtagtgaccactcatttgaattggatagccgtgctctaaatcatactttaggagatgctgttttttcagtcttgccaaatattaaggctcagatgaagcaaccagatatcaatcttaaagtcgagatacgagatgaggctgcttatatttcatatgaggatattaggggtgcaggaggattaccagtaggaacatctggaaaagggatgctgatgttgtctggtgggattgattctccggtagcaggttacctagcgttaaaacgtggtgtagatatagaagcagtccattttgcaagtcctccttatactagcccaggtgcattgaaaaaagcacatgatttaacacgtaaattgacaaaatttggtggtaatattcaatttattgaagttccattcacagaaattcaagaggaaattaaggcaaaagctcccgaagcctacttgatgacgttaacacgtaggtttatgatgcgtattacagatcgtattcgtgaggaccgaaatggtcttgttattattaacggtgaaagtttaggacaggtggcaagccaaacgttagaaagtatgcaagctattaatgctgtcactgcaacaccgattattcgtcctgtggtcacgatggataagctagaaattattgatattgctcaaaaaatagatacttttgatatttcaattcaaccatttgaggattgctgtacgatttttgcaccagatcgcccaaaaactaaccctaaaattaagaatacagaacagtatgagaaacgtatggatgtagaaggtcttgtagagagggcagttgcagggattatggtaactactattcaacctcaagcagatagtgatgatgttgatgacttgattgacgatttatta

SEQ ID NO: 1864 - protein, 414 aa, Streptococcus agalactiae
MKKLRKLEDKMQYSEIMIRYGELSTKKKNRMRFINKLKNNMEHVLSIYPDVSVKTDRDRGHVYLNGTDYHEVAESLKEIFGIQAFSPSFKVEKNVDTLVKAVQEIMTSVYKDGMTFKITAKRSDHSFELDSRALNHTLGDAVFSVLPNIKAQMKQPDINLKVEIRDEAAYISYEDIRGAGGLPVGTSGKGMLMLSGGIDSPVAGYLALKRGVDIEAVHFASPPYTSPGALKKAHDLTRKLTKFGGNIQFIEVPFTEIQEEIKAKAPEAYLMTLTRRFMMRITDRIREDRNGLVIINGESLGQVASQTLESMQAINAVTATPIIRPVVTMDKLEIIDIAQKIDTFDISIQPFEDCCTIFAPDRPKTNPKIKNTEQYEKRMDVEGLVERAVAGIMVTTIQPQADSDDVDDLIDDLL

SEQ ID NO: 1865 - DNA, 1212 bp, Streptococcus pyogenes
atggactattcagaaattatggttcgccatggtgaactatcaactaaagggaagaatcgcatgcgattcattaacaaacttaaaaacaatattcaagacgtactggctcctttcccagccattactgtccgttcagatcgtgataggacccatgtgtctctaaatggcacagattatcagcctattgtagaagctttaaagctggtgtttggtgttcaagctctatctcctgtttataaacttgaaaaaagtgtccctcttttggtaacagctgttcaagatatcatgacttctctttatcgtgatggactgacgtttaagattgccactaagcgtagtgatcacgcgtttgaattggatagtcgtgagcttaacagtcttcttggtggagctgtttttgaggttttaccaaatatccaagcccagatgaaacatcccgatgtgactctcaaagtcgaaattcgtgatgaagcagcttacatttcttatgaagagattaagggagcaggcgggttaccggtaggaacgtcagggaaagggatgctgatgttatcgggcggtattgattcaccagtagctgggtatttagcccttaaacgtggccttgatattgaagttgttcattttgctagccctccgtacaccagtccaggtgccttggctaaagcccaagaccttactcgtcgattaactcgttttggtggaaatatccaatttatcgaggttccttttacagaaattcaagaagaaattaaaaataaggcaccagaggcttaccttatgacattaacccgccgctttatgatgcgcatcacagatgccattcgtgagcaacgtaagggtcttgttattgttaacggtgagagcctaggtcaggttgctagtcaaacccttgaaagcatgcaggccattaatgcggtaacatcaactccaattattagaccagtcgtgacaatggataaacttgaaattatcgagatggctcaggcgattgatacttttgacatttctattcaaccgttcgaagattgctgtactatttttgcaccagaccgtcctaaaaccaaccctaaactaggtaatgctgaaaaatatgaagaatgctttgatattgatggtcttgtccagcgtgctgtgtcaggaattgttgtcacagaaatcacacctgaaatcgtcaatgatgaggttgaaaatctcattgatgctttactt

SEQ ID NO: 1866 - protein, 404 aa, Streptococcus pyogenes
MDYSEIMVRHGELSTKGKNRMRFINKLKNNIQDVLAPFPAITVRSDRDRTHVSLNGTDYQPIVEALKLVFGVQALSPVYKLEKSVPLLVTAVQDIMTSLYRDGLTFKIATKRSDHAFELDSRELNSLLGGAVFEVLPNIQAQMKHPDVTLKVEIRDEAAYISYEEIKGAGGLPVGTSGKGMLMLSGGIDSPVAGYLALKRGLDIEVVHFASPPYTSPGALAKAQDLTRRLTRFGGNIQFIEVPFTEIQEEIKNKAPEAYLMTLTRRFMMRITDAIREQRKGLVIVNGESLGQVASQTLESMQAINAVTSTPIIRPVVTMDKLEIIEMAQAIDTFDISIQPFEDCCTIFAPDRPKTNPKLGNAEKYEECFDIDGLVQRAVSGIVVTEITPEIVNDEVENLIDALL

SEQ ID NO: 1867 - DNA, 1143 bp, Streptococcus agalactiae
atgatttattttgataattcggcaactactattccctatccagaagttttaaggacttatcaagaagtagctagtaaaatctatggaaacccctcaagtttacatgagctaggaacaacatcttctcggattttagaggctagccgtaaacaaattgctagtttacttgagcttaaagcaaatgaaattttctttacctctggtggtacagaggccgataattgggttattaagggtcttgcgtttgagaaacaacattttggaaatcatattattgtttctgatatcgaacacccagctgttaaagagtctgctaaatggcttggagagtatgggtttgagattgattatgcgccagtagatgataaaggatttgtagacgtagaagcactggtcaaattaattaaaccagaaacgattcttatttcaattatggcaataaacaatgaaattggttctattcagccaataaaagctatttcagacttgttgtcagataaacctactatatcgtttcatgttgatgctgttcaagcaataggtaagataccgactaaagattatttgactgagcgagttgattttgcatctttttctagtcataaatttcacggcgttcgtggggttggctttctatatattaaagaaggaaaacgtatttcaccattactaacaggtggtggacaagaaactgatttacgttcaactactgagaatgtcgcagggattgcagctactgctaaagctttacgaatggttatggacaaggaagtagtagctattcctaaaataagtaaaatgaaaaccattattcatgatgaattagccaaatatgaggatattacgttattttcgggtaaggaagatttttcacctaacattatcacgtttggtatcaagggtgtccgaggagaagttcttgtccatgcctttgagggacatgatatttttatctcgacaactagcgcttgctcttctaaagcaggtaaaccagcaggaactcttatagcaatgggaatttcaactaagttagcccaaactgctgtacgtatcagcttagatgatgataatgatatgggacaagtagagcaatttttaactatttttaaacaagtttatgaaaaaactaagaaagttagagga

SEQ ID NO: 1868 - protein, 381 aa, Streptococcus agalactiae
MIYFDNSATTIPYPEVLRTYQEVASKIYGNPSSLHELGTTSSRILEASRKQIASLLELKANEIFFTSGGTEADNWVIKGLAFEKQHFGNHIIVSDIEHPAVKESAKWLGEYGFEIDYAPVDDKGFVDVEALVKLIKPETILISIMAINNEIGSIQPIKAISDLLSDKPTISFHVDAVQAIGKIPTKDYLTERVDFASFSSHKFHGVRGVGFLYIKEGKRISPLLTGGGQETDLRSTTENVAGIAATAKALRMVMDKEVVAIPKISKMKTIIHDELAKYEDITLFSGKEDFSPNIITFGIKGVRGEVLVHAFEGHDIFISTTSACSSKAGKPAGTLIAMGISTKLAQTAVRISLDDDNDMGQVEQFLTIFKQVYEKTKKVRG

SEQ ID NO: 1869 - DNA, 1119 bp, Streptococcus pyogenes
atgatttattttgataatgcagccacaaccataccttatggagaggctcttaaaacttaccaagaagtagcaacaaaaatatatggcaatccctcaagtctgcaccaattagggacaaatgcgtctcgcattttagaagcttcccgtaaacagattgctggtttgttgggtgttaagtcagaagaaatcttttttacgtctggtgggactgaaagtgctaattgggctattaagggaattgcttttgaaaaaaacgcttttggcaaacatattattatctcagccattgaacaccctgccgtgagtgaaagtgtcaaatggcttctcacacaaggattcgaagtttcttatgctccagtgacaacacagggagttgttgatgtgaatgctttagctgagctgattagaccagacaccatcttaatctcgattatggctgttaataatgaaatgggagctatccaaccgattagagccatttcaaacctattggctaaccaaccaacgatcacctttcacgttgatgctgttcaagccattggtaaaataccactctgtgattatatgactaatcgtgtggatttggcttctttttcagggcacaaatttcatagtgttcgtggtgttggcttcctttataaaaaagcaggcaagcgactcaatcctctcttgtcaggcggcggccaagagcaggagttacgttcaaccactgaaaatgttgcaggaattgctagcatggccaaagcattaagaatagtcactgaaaaacaagtgagcgtcttacctaaactaacagcgatgcgagatgtgatttacaaatctttgtccgcttacccagatgtgacagtattttcagctcaagaaggctttgcgcccaatattttgacctttgggattagaggggttcgaggagaagttattgtccacgcctttgaaaaatatgagatttatatttcgaccacaagtgcatgttcgtccaaagcaggtgagccagcaggaagcctagtggctatggggattcctgtaaaaactgcccagacagccgttcgtattagtctagacgatgacaacgatatgggacaagtagagcagtttttgaccatattccaaacagattta

SEQ ID NO: 1870 - protein, 373 aa, Streptococcus pyogenes
MIYFDNAATTIPYGEALKTYQEVATKIYGNPSSLHQLGTNASRILEASRKQIAGLLGVKSEEIFFTSGGTESANWAIKGIAFEKNAFGKHIIISAIEHPAVSESVKWLLTQGFEVSYAPVTTQGVVDVNALAELIRPDTILISIMAVNNEMGAIQPIRAISNLLANQPTITFHVDAVQAIGKIPLCDYMTNRVDLASFSGHKFHSVRGVGFLYKKAGKRLNPLLSGGGQEQELRSTTENVAGIASMAKALRIVTEKQVSVLPKLTAMRDVIYKSLSAYPDVTVFSAQEGFAPNILTFGIRGVRGEVIVHAFEKYEIYISTTSACSSKAGEPAGSLVAMGIPVKTAQTAVRISLDDDNDMGQVEQFLTIFQTDL

SEQ ID NO: 1871 - DNA, 96 bp, Streptococcus agalactiae
atgatcaaacaaataatactactaccgatacctcaactattgaaaatacaacaacaccttaaaaaagctaggttccctagctttttttgtattctt

SEQ ID NO: 1872 - protein, 32 aa, Streptococcus agalactiae
MIKQIILLPIPQLLKIQQHLKKARFPSFFCIL

SEQ ID NO: 1873 - DNA, 1347 bp, Streptococcus agalactiae
atgtcaaaacaatatgattatatcgttattggtggaggtagtgcaggcagtggtaccgctaatagggcagccatgtatggagcaaaagtcctgttaattgaaggtggacaagtaggtggaacttgtgttaacttaggttgtgtaccgaagaaaatcatgtggtatggtgcacaagtttctgagacactccataagtatagttcaggttatggttttgaagtcaataatcttaattttgattttactactctaaaagctaatcgcgatgcttacgtgcagcggtctagacagtcgtatgccgctaattttgagcgtaatggagtcgaaaagattgatggatttgctcgttttattgataaccatactattgaagtgaatggtcagcaatataaagctcctcacattactattgcaacaggtggacaccctctttaccctgatattattggaagtgaacttggtgagacttctgatgatttttttggatgggagaccttaccagattctatattgattgttggggcgggctatatcgcggcggaacttgctggagtggttaatgaattaggcgttgaaacccatcttgcatttagaaaagaccatattctacgcggatttgatgacatggtaacaagtgaggttatggctgaaatggagaaatcaggtatctctttacatgctaaccatgtacctaaatctcttaaacgcgatgaaggtggcaagttgatttttgaagctgaaaatgggaaaacgcttgtcgttgatcgtgtaatatgggctatcggccgtggaccaaatgtagacatgggacttgaaaataccgatattgttttaaatgataaaggttatatcaaagcagatgaatttgagaatacttctgtagatggcgtgtatgctattggagatgttaatgggaaaattgccttgacaccggtagcaattgcagcaggtcgtcgcttatcagaaagactttttaatcataaagataacgaaaaattagattaccataatgtaccttcagttatttttactcaccctgtaattgggacggtaggactttcagaagcagcagctatcgagcaatttggagaagataatatcaaagtctatacatcaacttttacctctatgtatacggctgttaccactaatcgccaagcagttaagatgaagctcataaccctaggaaaagaggaaaaagttattgggcttcatggtgttggttatggtattgatgaaatgattcaaggtttttcagttgctatcaaaatgggggctactaaagcagactttgatgatactgttgctattcacccaactggatctgaggaatttgttacaatgcgc

SEQ ID NO: 1874 - protein, 449 aa, Streptococcus agalactiae
MSKQYDYIVIGGGSAGSGTANRAAMYGAKVLLIEGGQVGGTCVNLGCVPKKIMWYGAQVSETLHKYSSGYGFEVNNLNFDFTTLKANRDAYVQRSRQSYAANFERNGVEKIDGFARFIDNHTIEVNGQQYKAPHITIATGGHPLYPDIIGSELGETSDDFFGWETLPDSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKADEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLITLGKEEKVIGLHGVGYGIDEMIQGFSVAIKMGATKADFDDTVAIHPTGSEEFVTMR

SEQ ID NO: 1875 - DNA, 1359 bp, Streptococcus pyogenes
gtgataaaaatggttattccttatgattatattgttattggtggagggagtgcaggtattgcttctgcgaacagggcagccatgcatggggccaaagtattgttagctgaaggtaaagagattgggggaacctgtgttaacctaggctgcgttcctaaaaaagtcatgtggtatggcgctcaagtagcagatattttagggacttacgctaaggattatggatttgactttaaagagaaagcatttgattttaaacaattgaaagcaaatcgtcaagcttatattgatcggattcatgcttcttatgagcgaggctttgagcagaatggtgttgaccgtatttatgattatgctgttttcaaagatgctcatacggtagaaattgcagggcagctttataccgcaccgcatattttgattgctacaggaggacatcctgtttttccagatattgagggggcacaatacggtatcagctcggacggcttttttgccttagatgaggtaccaaaacgtacggctgtggttggggcaggctatattgctgtggaacttgctggtgttttgcatgctttgggatcgaagacggatttgtttatccgtcacgatcgacctttaagaagttttgacaaaaccattgttgatgtcttagttgatgaaatggcagttaatgggccgcgtttacacactcatgcagaagtggcaaaggttgtcaaaaatactgatgagtccttgaccctttacctcaaagatggccaagaagttgaggttgaccagctcatttgggctatcggtcgcaagcctaatctagaaggttttagtcttgacaaaactggagtgacgttaaatgataaaggttatattgagacagatgcctatgaaaacacgtctgtcaaaggtatttatgccgtgggagatgttaatgggaaactggctttaactccagttgctgtggcagctggacgtcgcctatcagagcgtcttttcaatggcaaaacagacgagaaattggactaccaaaacgttgctactgtgatttttagtcaccctgttattggctctgttggcttgtcagaagaagcagcagtcaaacagtatgggcaagaagcagttaaaacatatcaatcacgttttacgtctatgtttactgctatcactaaccatcgccaaccttgtctgatgaagttggtaacagtcggagataccgaaaaaatagttggtcttcacggaatcggatacggggttgacgaaatgattcagggctttgcagtagccatcaaaatgggagcaaccaaggcggattttgataacaccgttgctattcacccaactggctcagaagaatttgtcaccatgcgc

SEQ ID NO: 1876 - protein, 453 aa, Streptococcus pyogenes
VIKMVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHASYERGFEQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKTIVDVLVDEMAVNGPRLHTHAEVAKVVKNTDESLTLYLKDGQEVEVDQLIWAIGRKPNLEGFSLDKTGVTLNDKGYIETDAYENTSVKGIYAVGDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 1877 - DNA, 333 bp, Streptococcus agalactiae
atggctaatgtatatgatttagcaaatgaattagaacgtgctgttcgtgctttaccagaataccaagcagttttaactgcaaaatcagctattgaaagtgatgcggatgcacaagtgctttggcaagactttttggctacccaatcaaaagttcaagaaatgatgcaatctggccaaatgccaagtcaagaagaacaagatgaaatgtctaaacttggggaaaaaattgaatccaatgaccttttaaaagtttattttgaccaacaacaacggttgtctgtctatatgtctgatatcgaaaaaattgtctttgcacccatgcaggacttgatg

SEQ ID NO: 1878 - protein, 111 aa, Streptococcus agalactiae
MANVYDLANELERAVRALPEYQAVLTAKSAIESDADAQVLWQDFLATQSKVQEMMQSGQMPSQEEQDEMSKLGEKIESNDLLKVYFDQQQRLSVYMSDIEKIVFAPMQDLM

SEQ ID NO: 1879 - DNA, 339 bp, Streptococcus pyogenes
atgtcacaagaaatttatgactatgctaatcaacttgaaagagcagttcgtgctctgccagaataccaaaaagtgttagaagtaaaagaggccattcaagcagacgttagtgctagcgaactgtttgatgagtttgtcgctatgcaagaaaaaatccaagggatgatgcaatcaggccaaatgccaacggctgaagaacaaacaagcattcaagaacttagccaaaagattgaagctaatgaccagctaaaagcttattttgaagcgcagcaggccttatctgtttacatgagtgatattgagcgtattgtatttgctccgttgaaagatttagtcaag

SEQ ID NO: 1880 - protein, 113 aa, Streptococcus pyogenes
MSQEIYDYANQLERAVRALPEYQKVLEVKEAIQADVSASELFDEFVAMQEKIQGMMQSGQMPTAEEQTSIQELSQKIEANDQLKAYFEAQQALSVYMSDIERIVFAPLKDLVK

SEQ ID NO: 1881 - DNA, 1164 bp, Streptococcus agalactiae
atgagatatttaactgctggtgagtcacatggacctagtttaacagctattatcgaagggattcctgcgggactgaaattatctgctaaagatattaatgaagatttaaaacgccgccaaggtggttatggtcgtgggaatcgaatgaaaattgaaactgatcaagtgatcattagttctggtgtgcgccatggaaaaaccttgggttcacctattacactgacagtaactaataaggatcatagcaaatggctggacatcatgtcagtcgaagacattgaagagcgcctaaagcaaaaacgtcgtattaagcatcctagacctgggcacgcagatttagtaggtggaattaaataccgtttcgatgatttgagaaatgctttagagcgttcttcggctcgtgagaccacaatgcgagtagctattggtgcgattgctaaacgtatcttgaaagaaattggtatcgaaattgccaaccatattgtagtttttggtggcaaggagattactgtccctgataagctaacagttcaacaaatcaaagtgttatctagtcaatcgcaagtagctatcgtcaatccatccttcgaacaagaaatcaaggattatattgacagtgtgaaaaaggctggagatactatcggaggagtggttgaaactatcgttggaggagttcccgttggtttaggctcttatgtacactgggatagaaagttagatgctaagatagcgcaagcagttgtatctatcaatgcttttaaaggtgttgaatttggtctaggttttaagtcagggtttttaaaaggaagtcaagtaatggactccatatcatggacaaaggaccaaggttatatacgtcagtcaaataatttaggcggttttgaaggcggtatgactaatggagagcctattatcgttaggggagtaatgaaaccaattcctacgctttacaagccactaatgtcagttgatattgatactcacgagccttatagagctacagtggaacgttctgatcccacggcacttccggctgcaggtgtcgttatggaagctgtagtagccaccgtcctggtgacagaagtgctagaaaaattttcttcagacaacatgtatgaactaaaagaagctgtaaaactatatcgcaattatgttgatcatttt

SEQ ID NO: 1882 - protein, 388 aa, Streptococcus agalactiae
MRYLTAGESHGPSLTAIIEGIPAGLKLSAKDINEDLKRRQGGYGRGNRMKIETDQVIISSGVRHGKTLGSPITLTVTNKDHSKWLDIMSVEDIEERLKQKRRIKHPRPGHADLVGGIKYRFDDLRNALERSSARETTMRVAIGAIAKRILKEIGIEIANHIVVFGGKEITVPDKLTVQQIKVLSSQSQVAIVNPSFEQEIKDYIDSVKKAGDTIGGVVETIVGGVPVGLGSYVHWDRKLDAKIAQAVVSINAFKGVEFGLGFKSGFLKGSQVMDSISWTKDQGYIRQSNNLGGFEGGMTNGEPIIVRGVMKPIPTLYKPLMSVDIDTHEPYRATVERSDPTALPAAGVVMEAVVATVLVTEVLEKFSSDNMYELKEAVKLYRNYVDHF

SEQ ID NO: 1883 - DNA, 1164 bp, Streptococcus pyogenes
ttgcgttatttaacagcaggagaatctcatgggccatccttaacagctattattgaaggtataccagcaggattaactcttcatccagcggatattgatcacgaattacagcgacgtcaaggaggttatggccgtggtgccagaatgtctattgagactgatcgggttcaaatatcctcaggagttcgtcatggtaaaacaacaggggcccccattaccttaacggtaattaataaggaccaccaaaaatggctagatgtcatggctgtaggagacattgaagagactctcaagttaaagcgtcgtgttaagcatcctagaccaggacatgcggatttggtaggaggtattaaatatcattttaacgatttaagagatgctttagagcgttcctcggctagagaaacaacgatgagagtggctgtaggcgctgttgctaaacgtatcttagctgaacttggaattgatatgttacatcatatcttaatatttggtggtataacgatcacaataccttctaagctctcttttagagagctgcaagaaagggctctccattcagaattatctattgttaatccaaagcaagaagaagaaattaaaacgtatattgataagataaaaaaagaaggggataccattggtggtattatcgaaacgatagttcaaggggtgccagcaggtcttggatcttatgtccaatgggataaaaaattagatgccaagctggctcaagcagttctttccattaatgcttttaaaggggtggaatttggagctgggtttgatatgggattccaaaagggctctcaggtaatggatgaaatcacctggacacctacccagggctatggtcgtcaaacaaaccacttaggtggctttgaaggtggcatgaccacaggacaacctcttgttgttaaaggggttatgaagcccattcctactttgtataaaccactcatgtcggtagatattgatagtcatgaaccttataaagcaacggtggaacgctctgatccgacggccttaccagctgcaggggttatcatggaaaatgtggtggcgacggtgcttgccaaagagattttagagactttttcttctactaccatgtctgaattgcaaaaagctttttcggactatcgtgcctacgtcaagcaattt

SEQ ID NO: 1884 - protein, 388 aa, Streptococcus pyogenes
LRYLTAGESHGPSLTAIIEGIPAGLTLHPADIDHELQRRQGGYGRGARMSIETDRVQISSGVRHGKTTGAPITLTVINKDHQKWLDVMAVGDIEETLKLKRRVKHPRPGHADLVGGIKYHFNDLRDALERSSARETTMRVAVGAVAKRILAELGIDMLHHILIFGGITITIPSKLSFRELQERALHSELSIVNPKQEEEIKTYIDKIKKEGDTIGGIIETIVQGVPAGLGSYVQWDKKLDAKLAQAVLSINAFKGVEFGAGFDMGFQKGSQVMDEITWTPTQGYGRQTNHLGGFEGGMTTGQPLVVKGVMKPIPTLYKPLMSVDIDSHEPYKATVERSDPTALPAAGVIMENVVATVLAKEILETFSSTTMSELQKAFSDYRAYVKQF

SEQ ID NO: 1885 - DNA, 1065 bp, Streptococcus agalactiae
atgcaggttgaagttgacttaccgaatcacccttatcatattaaaattgaagaaggatgtttttctgaggctggtgactgggtatcacatttatggcagaaacaaatgataactattatcacagatagtaacgtagaaatattatacggggagtcgcttgtcaaccagttaaaaaaacaaggttttacagtacatgtttttagttttgctgcgggtgaagctagtaaaactttggaagttgctaatcgtatttatgcttttttagcaaagcatcatatgaccagaagcgatgggatcattgcacttggtggaggcgtcgtcggagatttagcagcgtttgttgcttctacttatatgcggggaatccattttcttcaaattccaactagtttaacagcacaggttgattcttccattggcggaaaaacaggagtcaacacttcattcgctaaaaatatggtaggtacttttgcacaacctgatggtgtactgatagatcctgttactctaaaaacattgggcaatcgtgaattagttgaaggtatgggagaagtcatcaaatatggcttgattgatgatataaaactctggcatattttagaagagatggatgggactattgatagtatccttgataatgcattagctattatttatcactcttgtcaagttaaacgaaagcatgttttagctgatcaatatgataaagggttaaggatgcatttgaattttggccacactatcggtcatgctatcgaagtacatgctggctatggagaaataatgcatggagaagctgttgcaattggaatgatccagctttctcgtgtggctgagcgtaaaaatcttatgccaagaggtatcagtcaagatatttataatatgtgtttaaaatttggccttccggtccactatgcggaatgggataaggacgtcttatttgacatattgagtcatgataaaaaagcaagtggacaatttattaaaattgttatactgcctcaattaggtagtgcaacagtccaccaaatacctttagaagaaatgagagattatttggagaaa

SEQ ID NO: 1886 - protein, 355 aa, Streptococcus agalactiae
MQVEVDLPNHPYHIKIEEGCFSEAGDWVSHLWQKQMITIITDSNVEILYGESLVNQLKKQGFTVHVFSFAAGEASKTLEVANRIYAFLAKHHMTRSDGIIALGGGVVGDLAAFVASTYMRGIHFLQIPTSLTAQVDSSIGGKTGVNTSFAKNMVGTFAQPDGVLIDPVTLKTLGNRELVEGMGEVIKYGLIDDIKLWHILEEMDGTIDSILDNALAIIYHSCQVKRKHVLADQYDKGLRMHLNFGHTIGHAIEVHAGYGEIMHGEAVAIGMIQLSRVAERKNLMPRGISQDIYNMCLKFGLPVHYAEWDKDVLFDILSHDKKASGQFIKIVILPQLGSATVHQIPLEEMRDYLEK

SEQ ID NO: 1887 - DNA, 1071 bp, Streptococcus pyogenes
atgccacaaacacttcatgtccattctcgggtcaaggattatgatatcctgtttaccgaccatgttttaaaaaccttagcagattgccttggtgagcgcaagcagcgtaaactcttgtttatcaccgatcaaacggtctaccacttgtatcagactctctttgaagaatttgctcagcaatacaacgcttttgtccatgtctgccctccgggaggtcaatccaaatccttggaacgtgtcagtgctatctacgaccagctcatcgctgaaaatttttccaaaaaagatatgattgttactattggtggtggtgttgttggggatctgggtggttttgtcgctgcaacctattaccgtggtattccctacattcaaatcccaacgactttacttagtcaggtggatagcagtatcgggggcaaagttggagtccattttaaaggtctaaccaatatgattggcagcatttaccctccagaagctatcattatttcaaccacctttttggagaccttaccgcaacgggaattctcctgcggcatcagtgagatgctcaaaatcggcttcattcatgatagaccgctttttcagcagttacgtgattttcaaaaagaaaccgataagcagggacttgaacgtctgatttaccaatccatttccaataaaaaacggattgttgaacaagatgaatttgaaaatggtttgcgcatgtctttaaattttgggcataccttgggccacgcgattgaatcgctctgccaccatgatttttaccatcacggtgaagccattgctatcggtatggtggttgatgctaaactggctgtttccaaaggactcttgccaaaagaggacttggatagcctccttcaagtttttgaacgttaccagttaccaacaacacttgaaagagctgatgtctctgcgacatccctctttgacgtctttaaaacagataagaagaattctgagcaacatattatctttatattacccacagaaaccggttttaccaccctagccattaacaaagacgatcaccaatttgtcgagaagctcgacagtttatta

SEQ ID NO: 1888 - protein, 357 aa, Streptococcus pyogenes
MPQTLHVHSRVKDYDILFTDHVLKTLADCLGERKQRKLLFITDQTVYHLYQTLFEEFAQQYNAFVHVCPPGGQSKSLERVSAIYDQLIAENFSKKDMIVTIGGGVVGDLGGFVAATYYRGIPYIQIPTTLLSQVDSSIGGKVGVHFKGLTNMIGSIYPPEAIIISTTFLETLPQREFSCGISEMLKIGFIHDRPLFQQLRDFQKETDKQGLERLIYQSISNKKRIVEQDEFENGLRMSLNFGHTLGHAIESLCHHDFYHHGEAIAIGMVVDAKLAVSKGLLPKEDLDSLLQVFERYQLPTTLERADVSATSLFDVFKTDKKNSEQHIIFILPTETGFTTLAINKDDHQFVEKLDSLL

SEQ ID NO: 1889 - DNA, 675 bp, Streptococcus agalactiae
atgaaaatagtagtaccagtaatgcctcgcagtcttgaagaggctcaagaaatagatttatcaaaatttgatagtgttgatattattgaatggcgagctgatgccttaccaaaggatgacattattaatgtagctccagctatttttgagaaattcgcaggtcatgaaattatttttactcttcgtacaacgcgtgaaggtggtaatattgtcttatctgatgctgagtatgttgagttaatccagaaaattaattctatctacaatccagattatattgattttgagtatttttcacataaagaagtttttcaagaaatgctagaatttccaaatttagtcctgtcttatcacaattttcaagagacaccggagaatattatggagatattttcagaattaacagccctagcaccacgagttgtgaaaatcgcagtaatgccaaagaatgaacaagatgtcttagacgttatgaattacactcgcggtttcaagactattaatcctgatcaagtttatgcgacggtatctatgagtaaaattggacgtatttctcgttttgctggtgatgtaactggatctagttggacatttgcatatttagattcatctatcgcacccggacaaattactatttcagagatgaagcgtgtcaaagcattgcttgacgctgac

SEQ ID NO: 1890 - protein, 225 aa, Streptococcus agalactiae
MKIVVPVMPRSLEEAQEIDLSKFDSVDIIEWRADALPKDDIINVAPAIFEKFAGHEIIFTLRTTREGGNIVLSDAEYVELIQKINSIYNPDYIDFEYFSHKEVFQEMLEFPNLVLSYHNFQETPENIMEIFSELTALAPRVVKIAVMPKNEQDVLDVMNYTRGFKTINPDQVYATVSMSKIGRISRFAGDVTGSSWTFAYLDSSIAPGQITISEMKRVKALLDAD

SEQ ID NO: 1891 - DNA, 684 bp, Streptococcus pyogenes
atgagaattgtagcaccagtcatgccaagacattttgacgaggctcaagccattgatatttctaaatatgaagatgttaatttaattgaatggcgagcagactttcttcccaaggatgagattgtcgcagtagcaccagctatttttgaaaaatttgccggaaaagaaattatctttacccttcggaccgttcaagaaggggggaatattaccctttcaagtcaggagtatgttgatattatcaaagaaatcaatgctatttataatccagactatattgactttgagtattttacgcacaagtcagtatttcaagaaatgcttgattttccaaatcttattttgtcttatcacaactttgaagagactcctgaaaatttaatggaagctttttcagaaatgaccaagttggcaccgcgtgtggttaaaattgctgtgatgccccagagtgaacaagatgttctagatttgatgaactataccagaggctttaagacgctcaatcctgagcaagaatttgcaactatatctatggggaaattaggaagattgtctcgttttgcgggagatgtcattggctcttcctggacatacgtttcattagatcatgttagcggtccaggtcaagtgactctcaatgatatgaaacgtattattgaggtcttagaaatggatatctctaac

SEQ ID NO: 1892 - protein, 228 aa, Streptococcus pyogenes
MRIVAPVMPRHFDEAQAIDISKYEDVNLIEWRADFLPKDEIVAVAPAIFEKFAGKEIIFTLRTVQEGGNITLSSQEYVDIIKEINAIYNPDYIDFEYFTHKSVFQEMLDFPNLILSYHNFEETPENLMEAFSEMTKLAPRVVKIAVMPQSEQDVLDLMNYTRGFKTLNPEQEFATISMGKLGRLSRFAGDVIGSSWTYVSLDHVSGPGQVTLNDMKRIIEVLEMDISN

SEQ ID NO: 1893 - DNA, 165 bp, Streptococcus agalactiae
gtgtatgaaaacatatttagaacttttttaccttctgatagattagttgctaaggcttttctgacatcatgttggtcaaggaaaatacctgtcattaatccatcattcaaaaagacactatatttgatattattttctaaaatcaaaaatgattcaggagcctct

SEQ ID NO: 1894 - protein, 55 aa, Streptococcus agalactiae
MYENIFRTFLPSDRLVAKAFLTSCWSRKIPVINPSFKKTLYLILFSKIKNDSGAS

SEQ ID NO: 1895 - DNA, 1155 bp, Streptococcus agalactiae
atgaataaacttaaagtgaattctgtcgttgaaagaaaaatcaaatcaggtgctcagttactggaaaaaaaagattttgataccagtttagttaaccagttggttcaacttttttcacagtcaaatcaattcttagggatggcctatctttcaccacaaaataaaggtattggttggttactatcaagacaagtttttgattttaaccatgattactttgtatcgctattcgaaaaatctagagagaagcgtcaaaaatttgaaaaatctagccaaacaacagcctaccgcttgtttaatcaggatggagataactttggtggcctaactatagatttttatagtgactatgctcttttttcgtggtacaatgaatttgtttatactaatcgacaaatgattgttgcagcctttaagcaggtctatcctaatattaaaggggcatatgaaaaaattcgtttcaaaggtttagactttgaaagtgctcatttgtacggtcaagaggctcctgaatcatttttgattttagaaaataatatcaaatatagtgtctttttgaatgatggattaatgacaggtattttccttgaccaacatgatgtcagaaaagccttagcaactaatctatcagaaggtaaaaaagttctaaatatgttttcatacactgcggctttttctgtagctgcagctgttggaggagcattagagacaacttctgttgatttagcaaaacgctcgcgtgaactttcaaaagcacactttgatgctaatcagattgtcacagataaccatcgatttatcgttatggatgtttttgaatattataagtatgccaaaagaaaacatctatcatatgatgtgattgttattgatccaccaagttttgctcgaaataaaaaacaaactttttcggttactaaagattactataaattaattgaacaagctttagatattttaacccctggtggaactatcattgcatcaactaacgcagctaatctaaccgtatcacaatttaagaaacaattggaaaaggggtttggtaaagcttcacataattacattagcttacagcagttgcctgaagatttcactataaatgataaggaccaacaaagtaattatttaaaagtatttacaataaaggtaaaa

SEQ ID NO: 1896 - protein, 385 aa, Streptococcus agalactiae
MNKLKVNSVVERKIKSGAQLLEKKDFDTSLVNQLVQLFSQSNQFLGMAYLSPQNKGIGWLLSRQVFDFNHDYFVSLFEKSREKRQKFEKSSQTTAYRLFNQDGDNFGGLTIDFYSDYALFSWYNEFVYTNRQMIVAAFKQVYPNIKGAYEKIRFKGLDFESAHLYGQEAPESFLILENNIKYSVFLNDGLMTGIFLDQHDVRKALATNLSEGKKVLNMFSYTAAFSVAAAVGGALETTSVDLAKRSRELSKAHFDANQIVTDNHRFIVMDVFEYYKYAKRKHLSYDVIVIDPPSFARNKKQTFSVTKDYYKLIEQALDILTPGGTIIASTNAANLTVSQFKKQLEKGFGKASHNYISLQQLPEDFTINDKDQQSNYLKVFTIKVK

SEQ ID NO: 1897 - DNA, 1161 bp, Streptococcus pyogenes
atgaataaactctatattgattcttttgtcgaaaagaagctgacagcaggggtacaattattagatgaaaaagatttttctaatataaaggaaaaaaatcagttggttcaactggtgaccaagtccaatcgtcccattggaacagcatatatctctaagcaaaataaaggaattggttggtatctaggaccagaaaaaatcgacttgtctatctcttattttgttagtctattttcagttgctaaggccaaaagacaagattttgctcaatcggacgagaccaatgcttatcgcctttttaatcaagaaggagacggttttggtggagtaacaattgatctttataaagattttgcagtcttttcatggtacaatgcctttgtctatgacaaaaaagaaatgattatggaggcttttcaacaggtttttcctgaagtcaaaggagcttatgaaaagtgtcgctttaaaggtccagatactgaaactgctcatctgtatggtgagctggcacaagaaaccttttcgattttagaaaatggcatagcctatcaagtcttcttgaatgagggcttaatgacaggtatttttctagaccagcatgatgttagaagagcactagtagatggtttagctatgggcaagtcccttcttaacctattttcctatacagctgccttttctgtagcagctgctatgggtggtgctatcgagaccacttctgtggacttggctaaacgatcgagagaattatcactagctcattttgagcataaccagttaaacttagcctcacatcattttgtggtgatggatgtttttgaatacttcaaatatgccaaacggaaaaaattaatctttgatgtgattgtgattgacccaccaagctttgctagaaataaaaaacaaactttctctgtgagcagggactaccacaaattaatcacagaggccttggacatattgagtcctaagggaactattatagcttcaacaaatgctgctaatatgactgttagccagttcaaaaagcaaattatcaaaggatttggaagtcgtcgtcctgagtctatgactctccagcagcttccgagtgactttactatcaataaagcagatgaaagaagtaactatttaaaggtatttactataaaggtacgagaa

SEQ ID NO: 1898 - protein, 387 aa, Streptococcus pyogenes
MNKLYIDSFVEKKLTAGVQLLDEKDFSNIKEKNQLVQLVTKSNRPIGTAYISKQNKGIGWYLGPEKIDLSISYFVSLFSVAKAKRQDFAQSDETNAYRLFNQEGDGFGGVTIDLYKDFAVFSWYNAFVYDKKEMIMEAFQQVFPEVKGAYEKCRFKGPDTETAHLYGELAQETFSILENGIAYQVFLNEGLMTGIFLDQHDVRRALVDGLAMGKSLLNLFSYTAAFSVAAAMGGAIETTSVDLAKRSRELSLAHFEHNQLNLASHHFVVMDVFEYFKYAKRKKLIFDVIVIDPPSFARNKKQTFSVSRDYHKLITEALDILSPKGTIIASTNAANMTVSQFKKQIIKGFGSRRPESMTLQQLPSDFTINKADERSNYLKVFTIKVRE

SEQ ID NO: 1899 - DNA, 2142 bp, Streptococcus agalactiae
gtgaaaaaaattaaagattttgctagccgtgcgatcaatacacgactcggctttattttattgttagtagttatatattggttaaagacaatttgggcttaccatactgattttaatttaggtttagaaaattcctatcagttgtttttgaccattataaaccccatccccttaggactcttaatcataggtttggccttatatgttaagcgaaccaaagctttttatattaccgcttttatcacctatgctatcgtaaatatccttctaattgcaaacgcaatctactatagagagttttccgatttcattacagttagcgccgtcttggctagtagtaaaacttcggctggccttggagactctgctcttaatctattgagaatttgggatcttgtctacgttttcgatttcattatccttattttcttatttgcaaccaagaaaatccacttagatgatcgtccatttaataaacgtgctagtttttctatcacagctttgtctggtttactcttttcaattaacttattcttagctgaaattgatcgtccagaactactaagtcgtggtttttcaaacacctatattgttaaagctcttggcttgccatcattttcgatttatagtggtaatcaaacttatcaagcacagaaagaaagaaatggtgccactgcacaagaattagcgactgccaaaaaatatgtagcagagcattatgccaaacccaatccagaatattatggtatcggaaaagggcgaaacgttatcatgattcatttggagagttttcaacaattcttgattgactataaattaaatattgatggtaaagaacatgtggttactccatttattaacagcctttatcattcgaaagagactgtctccttctctaacttcttccatcaagtcaaagctggtaagacatccgatgctgagacactcatggaaaactcactttttggtctaagtagtggttcattcatggttaattatggtggtgaaaatacacaatttgctgctccacatatcttagctcaaaatggaggttacagtagtgcggtcttccacggaaacgtcggaacattttggaatagaaataatgcttacaaacagtggggttatgactacttctttgactctagctacttctcaaaacaaaccaaagataattcattccaatacggtttgaatgataaatatatgtttgctgactctatcaaatatctagagcacatgcaacaaccattttatactaaatttattacagtaagtaaccattacccttacacaagtttgaagggagagtctgacgaagagggattcccacttgcaaagactaacgatgaaacgattaacggttattttgccacagcaaactaccttgatacagctcttaaatcattttttgaatatctaaaagctgctggtgtgtatgataattctattattgtaatgtatggggatcactacggtatttctaatacacgcaatcctagcttagctgaattattaggtaaagaccctgaaacatggtctgaatacgacaacgctatgttacaacgtgttccatatatgattcacattcctggctattcaaaaggttttatcagtaatacatacggtggtgaggtagataatttaccaactttacttcatattctaggaatagatacgtctaaatatactcagttaggacaagacttattatctaaagataataaacaaatggtcgctatgagaacaactggtcagtatattactcctaaatacactaactatagtggacatctctattacactgattcaggacaagaaatcacaaatcctgatgaaacaactaaagctgaaataaaagctattcgagatgctactaataaacaattatctacaagtgattcgattcaaactggagatttactacgatttgatgaaaacaatggtttgaaaactgtagaagttgaaaaattcaattacacacattctcttaaagcactcaaagctaaagaacgtaaattgaaagatcgttcaacaagcatatacagcaaacataacaacaaatcaacagttgatctcttccatgctccaagttacttggaattgcaagatcctaataagacacataaaacatctaaaaaa

SEQ ID NO: 1900 - protein, 714 aa, Streptococcus agalactiae
MKKIKDFASRAINTRLGFILLLVVIYWLKTIWAYHTDFNLGLENSYQLFLTIINPIPLGLLIIGLALYVKRTKAFYITAFITYAIVNILLIANAIYYREFSDFITVSAVLASSKTSAGLGDSALNLLRIWDLVYVFDFIILIFLFATKKIHLDDRPFNKRASFSITALSGLLFSINLFLAEIDRPELLSRGFSNTYIVKALGLPSFSIYSGNQTYQAQKERNGATAQELATAKKYVAEHYAKPNPEYYGIGKGRNVIMIHLESFQQFLIDYKLNIDGKEHVVTPFINSLYHSKETVSFSNFFHQVKAGKTSDAETLMENSLFGLSSGSFMVNYGGENTQFAAPHILAQNGGYSSAVFHGNVGTFWNRNNAYKQWGYDYFFDSSYFSKQTKDNSFQYGLNDKYMFADSIKYLEHMQQPFYTKFITVSNHYPYTSLKGESDEEGFPLAKTNDETINGYFATANYLDTALKSFFEYLKAAGVYDNSIIVMYGDHYGISNTRNPSLAELLGKDPETWSEYDNAMLQRVPYMIHIPGYSKGFISNTYGGEVDNLPTLLHILGIDTSKYTQLGQDLLSKDNKQMVAMRTTGQYITPKYTNYSGHLYYTDSGQEITNPDETTKAEIKAIRDATNKQLSTSDSIQTGDLLRFDENNGLKTVEVEKFNYTHSLKALKAKERKLKDRSTSIYSKHNNKSTVDLFHAPSYLELQDPNKTHKTSKK

SEQ ID NO: 1901 - DNA, 2214 bp, Streptococcus pyogenes
ttggagatgacatctttaggaaaaaacgataaggaagttgctactgtgaagaaatttaaaacacttatcacaggttttatcaacacaagattgggttttataattactctactcttttgttactggataaagaccctgtgggcatatcatacagacttttcactagatttgggaaatatataccaagtctttctaactattatcaatccaatcccactagcttttttacttttgggggttgctctttacgttaagaatacccgagccttttatatctgttcttgggtggtttatattatccttaacattctcttgatatcaaattctatatattaccgagaattttcagactttattacagtgagtgccatgctagctagtagtaaagtctccgctggattaggggactctgctttaaaccttttacgcatctgggatattatctatattcttgattttattattctaattagtttatctatcgctaaaaaaatcaaaaatgatcaacgtccttttaacaagcgcgcagcatttgccatcaccgctttatctagtctattgctttctattaatctttttttagcagaaattgatcgtccggaactattaacacgtggcttttcaaatacttatattgtgagagctttaggactaccagcgtttaccctctatagcggcaatcaaacctatcaagctcaaaaagaacgaaatggagctactgcagaagaattaattgatgttaaaacttatgtcaaaggacattatgcagcacctgatcctcagtattttggaattggaaaaggcaaaaatattattgttcttcatttagaaagctttcaacaattcttaatagattataaactaaaagaaggagataaagaatatgaggtaacgccttttatcaactcactttatcactcaaatgctaccttagcattccctaacttttttcatcaggttaaagcaggtaaaacttctgatgctgaaaccatgatggagaattccttatttggtttaaatagtggttcttttatggtgaactacggtggtgaaaatacacaatttgctactccaagtattttagcccaaaaaggtggctataccagcgctgtctttcatggtaacgttggaactttctggaatcgcaataatgcttataaacaatggggctataattatttttttgattctagctacttctctaaacaaaatagtaagaactcttttcaatatgggttaaatgataagtacatgtttaaggattccataaaatatcttgaacagatgcaacaacctttttataccaagtttatcactgtgagtaatcactatccttatactagtctaaaaggcgaaagtagtgaagaaggttttcctttagccaaaacagacgatgaaacgatcaatggttactttgctactgccaattatttagacgctgcccttaaatctttttttgattacttgaaagccactggtttgtacgacaattctatttttgttttatatggtgatcattatggtatttcaaattctcgtaattctagtcttgctccacttcttggtaaagattctgaaacttggtctgaatatgataatgctatgctacaacgagtcccgtatatgatccatattccaggttatacgaatggtagtatcaaagaaacctttggcggtgaaatcgatgctcttcctactttactccacatacttggtattgacactagtcagtttgttcaattaggacaagatttattatcacctcaaaatagccagattgtggcacaacgaacatctgggacttatatgactcctgaatacactaactatagtggacgtctgtacaacacgcaaacaggtttagaaatcactaatcccgatgaaatgactatagccaaaactaaggaaattcgctctgctgttgctcaacaactagcagctagcgacgctattcaaacgggtgatctcctgcgctttgatactcaaaatggtctaaaagctattgatcctaaccagtttatctacactaagcagttaaaacaactgaaagatatttcagcaaaactcggatcagagtcaacaagtttatacagtaaaaatggtcataaatcaactcagaaactttttaaagcaccatcttacttagaactaaatcccgtagaagctgacgcggcaacttctgaactaaaagaggataaccccaaaaataaagaa

SEQ ID NO: 1902 - protein, 738 aa, Streptococcus pyogenes
LEMTSLGKNDKEVATVKKFKTLITGFINTRLGFIITLLFCYWIKTLWAYHTDFSLDLGNIYQVFLTIINPIPLAFLLLGVALYVKNTRAFYICSWVVYIILNILLISNSIYYREFSDFITVSAMLASSKVSAGLGDSALNLLRIWDIIYILDFIILISLSIAKKIKNDQRPFNKRAAFAITALSSLLLSINLFLAEIDRPELLTRGFSNTYIVRALGLPAFTLYSGNQTYQAQKERNGATAEELIDVKTYVKGHYAAPDPQYFGIGKGKNIIVLHLESFQQFLIDYKLKEGDKEYEVTPFINSLYHSNATLAFPNFFHQVKAGKTSDAETMMENSLFGLNSGSFMVNYGGENTQFATPSILAQKGGYTSAVFHGNVGTFWNRNNAYKQWGYNYFFDSSYFSKQNSKNSFQYGLNDKYMFKDSIKYLEQMQQPFYTKFITVSNHYPYTSLKGESSEEGFPLAKTDDETINGYFATANYLDAALKSFFDYLKATGLYDNSIFVLYGDHYGISNSRNSSLAPLLGKDSETWSEYDNAMLQRVPYMIHIPGYTNGSIKETFGGEIDALPTLLHILGIDTSQFVQLGQDLLSPQNSQIVAQRTSGTYMTPEYTNYSGRLYNTQTGLEITNPDEMTIAKTKEIRSAVAQQLAASDAIQTGDLLRFDTQNGLKAIDPNQFIYTKQLKQLKDISAKLGSESTSLYSKNGHKSTQKLFKAPSYLELNPVEADAATSELKEDNPKNKE

SEQ ID NO: 1903 - DNA, 267 bp, Streptococcus agalactiae
ttgttccgtactgcaaaagaacaagtaatgaattcttactactatgcataccgtgaccgtcgtcagaaaaaacgtgacttccgtaaattatggatcactcgtatcaatgcggctgctcgtatgaatggtttatcatattcacaattgatgcacggtttgaaattagctgaaatcgaagttaaccgtaaaatgcttgctgatttagcagttaacgatgcagcagctttcacagctcttgcagatgcagctaaagctaaacttggtaaa

SEQ ID NO: 1904 - protein, 89 aa, Streptococcus agalactiae
MFRTAKEQVMNSYYYAYRDRRQKKRDFRKLWITRINAAARMNGLSYSQLMHGLKLAEIEVNRKMLADLAVNDAAAFTALADAAKAKLGK

SEQ ID NO: 1905 - DNA, 357 bp, Streptococcus pyogenes
atggcacgtgttaaaggtggcgttgtttcacgcaaacgtcgtaaacgtattttaaaattagctaaaggttactatggagcaaaacacatcttgttccgtactgcaaaagagcaagtgatgaactcttactactatgcataccgtgatcgccgtcagaaaaaacgtgatttccgtaaactatggatcactcgtatcaatgcggctgctcgtatgaacggtttgtcatactcacaattgatgcacggtttgaaacttgctgaaatcgaagtaaaccgtaaaatgcttgctgatttagcagtagctgatgcagcagctttcacagctcttgctgatgcagccaaagcaaaacttggcaaa

SEQ ID NO: 1906 - protein, 119 aa, Streptococcus pyogenes
MARVKGGVVSRKRRKRILKLAKGYYGAKHILFRTAKEQVMNSYYYAYRDRRQKKRDFRKLWITRINAAARMNGLSYSQLMHGLKLAEIEVNRKMLADLAVADAAAFTALADAAKAKLGK

SEQ ID NO: 1907 - DNA, 171 bp, Streptococcus agalactiae
atgcctgcgttggttctttcttcctcgacgaacctagtcattgttgttaaggttactaatgctgcgactaaatataaaataatggggaaaagattactgattttagaagtgctatttgtactggagtcaaaagtgttatatccttgtcctccaggaaaggtagtacggttg

SEQ ID NO: 1908 - protein, 57 aa, Streptococcus agalactiae
MPALVLSSSTNLVIVVKVTNAATKYKIMGKRLLILEVLFVLESKVLYPCPPGKVVRL

SEQ ID NO: 1909 - DNA, 2571 bp, Streptococcus agalactiae
  misc_feature (1)..(2571): n = a, c, g, or t
atgggaaagacattttggaaagatatctatcgatcaattacgacttcaaaaggtagattttcatcaatcctcttacttatgatgttaggctcatttgcttttataggactgaaggtctcagcacctaatatgcaaagaacagcacaaaattaccttgctcatcatcatgttatggatattaccgttttcaattcttggggacttgacaaacatgatcaaactgttttagaaagcttaaaaggatcacaagttgaattttcttactttgtagatacaacccctcaacagaatagtaaatcttatcgattgtattccaataccaaaacgatatcaacctttgatcttgttaagggacgtctccctttaaataaatcagaaattgctctctcatttcaggaacgaaaaaaatatgcaataggtgataaaattaattttaaacaagataaaaacaaactgttttcaaatacaggtcctctaactattgtaggttttgttaattctaccgagatttggtctaagacaaaccttggtagttctcaaacaggggacggcgacttagatagttatggcgtattagataagacagcatttcactctccagtatatacaatggcaagggtaacttttaaagatcttaggttgattaaccctttctcaataagttacaaagaaaaagtagcgaaataccaagaaaaggtatcgcgaaaattaaatattcacaataaaataagatataccaaaacaaaaaaagagagcctacgtaaaatcgatgaggaggaaaaaagcctactaaaagctcaaaaacaaatcaatcggttagataatgatagcctagcgatgccactatctcaaagacaagctattcaaatgaaaattaaacaagaccgactatctcttttgaaacgaacaaaagagcttctaaaattgagacataacacccaaataatggaatcgcctcaaattattgtctacaaccgtactacctttcctggaggacaaggatataacacttttgactccagtacaaatagcacttctaaaatcagtaatcttttccccattattttatatttagtcgcagcattagtaaccttaacaacaatgactaggttcgtcgaggaagaaagaaccaacgcaggcatattaaaagcactaggctatagtgaccgccaagttatctttaaatttattatttatggttttatagcaggaacattagggactactttgggtatcattggagggcattatcttttacctcgtattatttctgatatcatttccaaagacctgactattccaaacacacagtatcatcttttcttaaattacagtttactagcctttgttttttcattattaagcattgttcttccagtttttgttatcactcgacgtgagttgaaagaaaaagcagcatttttattattaccaaaaccaccagctaaaggatctaaaatagctttagagtatatcaattggatttggaaaaaactgtccttcacacaaaaagtaactgctagaaatatttttcgttacaaacaaaggatgattatgaccatatttggagttgctggatcagtagcgctcttattttcaggtctaggaatacaatcctccttaaagcaaaccgtcaatgaacatttcggtcgtattatgccctatgatatattgctaacatataacacaaatgcttctcccccaaaaatacttgaactactttcaaaagattcaaaaatagacaaataccaaccaatacaccttgaaaatcttgacgaatccattcctggacaaattaataaacagtcaatttccctattcataacagacaaaaaacaattactaccttttatttatttacaagaagcaacaactaataagtcattgcacttgaataataaagggattattatttctaaaaaattagctcaattttatcatgttaataccggtgattttatccatttatctcattcacaaacacttccttctagaaaattaaaaataacaggagttgtcaatgcgaatgttggtcactatatttttatgacaaaacaatactatcgaactatttttaagaaagaagctaaagataacgcttttttggttaagttaaccaaacataaaatcgcaaataacttagcagaaaaacttttagaaattaatggagttgagtctcttacgcaaaatgctcttcagctggctagtgtagaagccgttgtgcgttctttagatggctctatgactattttagttgtcgtatctttattgttagccattgtaattctctataatctcactaatattaatttagcagaacgtaagcgggagctatcaactataaaggtattaggtttttataatgaagaagtaactttatacatttaccgcgaaaccattattttatcaaccatcggtgtgattctaggcaccattagcggtacttatttacaccgtcaaatgatgttgctaattggttcagatcaaatactttttggtgaaaaagtatcaccaactacatttataataccaataagcgtagtagtcatcattctaannnnnttaattaat

SEQ ID NO: 1910 - protein, 857 aa, Streptococcus agalactiae
  misc_feature (1)..(857): Xaa = Any Amino Acid
MGKTFWKDIYRSITTSKGRFSSILLLMMLGSFAFIGLKVSAPNMQRTAQNYLAHHHVMDITVFNSWGLDKHDQTVLESLKGSQVEFSYFVDTTPQQNSKSYRLYSNTKTISTFDLVKGRLPLNKSEIALSFQERKKYAIGDKINFKQDKNKLFSNTGPLTIVGFVNSTEIWSKTNLGSSQTGDGDLDSYGVLDKTAFHSPVYTMARVTFKDLRLINPFSISYKEKVAKYQEKVSRKLNIHNKIRYTKTKKESLRKIDEEEKSLLKAQKQINRLDNDSLAMPLSQRQAIQMKIKQDRLSLLKRTKELLKLRHNTQIMESPQIIVYNRTTFPGGQGYNTFDSSTNSTSKISNLFPIILYLVAALVTLTTMTRFVEEERTNAGILKALGYSDRQVIFKFIIYGFIAGTLGTTLGIIGGHYLLPRIISDIISKDLTIPNTQYHLFLNYSLLAFVFSLLSIVLPVFVITRRELKEKAAFLLLPKPPAKGSKIALEYINWIWKKLSFTQKVTARNIFRYKQRMIMTIFGVAGSVALLFSGLGIQSSLKQTVNEHFGRIMPYDILLTYNTNASPPKILELLSKDSKIDKYQPIHLENLDESIPGQINKQSISLFITDKKQLLPFIYLQEATTNKSLHLNNKGIIISKKLAQFYHVNTGDFIHLSHSQTLPSRKLKITGVVNANVGHYIFMTKQYYRTIFKKEAKDNAFLVKLTKHKIANNLAEKLLEINGVESLTQNALQLASVEAVVRSLDGSMTILVVVSLLLAIVILYNLTNINLAERKRELSTIKVLGFYNEEVTLYIYRETIILSTIGVILGTISGTYLHRQMMLLIGSDQILFGEKVSPTTFIIPISVVVIILXXLIN

SEQ ID NO: 1911 - DNA, 2634 bp, Streptococcus pyogenes
atgataaagaaaaccttatggaaggatattttgagagctatcaagaatagtaaagggcgattcatttccttatttttcctaatggccttaggctcctttgctttagttggacttaaagtcaccggtccagatatggaacgaacagccagccgttacctcgaaagacaccaggtgatggacctaacggtactggcttctcatcaattttcccaagccgataaacaagagttagatacgttaaaaggggctcatttagaatatggtcatttacttgatgtcagtctaactagcaaccagaaatctcttaggctctatagcgtgccaaagaaagtgtctaagccagtcttggttaaagggagttggccaaagcgagagacagatttggttttatcctcctcacttgctaaaaactatcagattggagatgaactagcagtcacctcacctatggaaggtttgctgacgacaacccattttcaagtggttggttttgcgaattcttcagaagtttggtccaagtccaatttaggaagttcctcaaccggagatggaagtctctacgcttatgcttttgttaatccaaacgtttttaaaagtgcctttaacctgctgcgcatccgttttagtcatcttcgtctgacaaacgctttttccaaagactatcaaaaaagggtaacccaaaaccaagctcatttggataatctacttaaagataatggccagaagcgttatgatgacctccaaaatcagtatgaccttgccttaaaaaatggcagagcagcacttgcaaaggaaacagtgaaactagctgcgagtgaggagaacttaacttttttagaaggctctgctttacaagaagctaagcatcagattgaacaaggcaaacaagcattagccaaggaggaaaagcagttagagcaggtgcaggctacaaaagataagctagaaaaacccagttacctgacttataatcgctcgaccctaccaggaggagaaggatatcatacttatgcaacttcaacgacctccatttcaaatgttggaaatatttttcctgttgttctttatctcgtagctgctctagtagcctttaccaccatgacacgttatgttgatgaagaaagaacaagctctggtctattaaaagccattggttattctaacaaggatatcagtttaaagtttcttatctatgggcttttagccagttttttagggacaactttaggtattattgggggaacttacctcttatctaccttgatttcagagatcttaacaggagctttgactattggaaagactcacctttatagttattggttttataatggcatagcttacttgctggctatgttatctgctgttttaccagcctacttaattgtcaaaaaggaattattcctcaatgcagctcagttattgctgcccaaacctcctagtaagggggcaaaaatctggttggaacaccttacttttgtctggaaagccctgtcctttactcacaaggtgaccatacgtaatatttttcgctataaacaaagaatgctgatgaccattgtaggcgttgcaggctcagtagcccttttatttgcaggcttagggattcagtcgtcattagccaaagtagttgagcatcaatttggtgatttaacgacttatgatattttggctgtcggttcggccaaagcgacagcgacagagcaaactgacttagctagctatcttaaacaagaacctattacagggtaccaaaaggtatcttatgccagcttaacccttcctgtaaagggattacctgataagcaaagtatttccattttatcaagttcagctacttctcttagtccctattttaatctgctggatagtcaggagcaaaagaaggttcccattccaacctctggtgttttgatttctgagaaattagcctcctattacaaggtaaaaccaggtgatcagttggtattgactgatcggaaaggacagtcttataaagtgacgattaaacaggttattgacatgacagttggccattacctgataatgtctgatacctattttaagaatcattttaaaggattggaggctgctcctgcctatctgattaaggtaaaagacaaagatagcaagcacataaaggagacagccagtgacttgttaaccttaaaagcgattagagcagtttcacaaaacgtcaatcatattaaatctgttcagctagtagtcacctctcttaatcaggtcatgaccctccttgtcttcttgtctattttattagcaatcgttatcctttataacttaacgactattaatattgctgagcgtattcgagaattatccactattaaagttctgggattttacgatcaggaggtcaccttatatatttatcgagaaactatttcgctatccctagtaggcattcttttaggtatctatttaggaaaaggcctgcatacttatatcatgacaatgatttcaactggggatattcaatttggtgtaaaggttgatgcttatgtttatctagtgccaattctagtaatccttagcttgttagcggtattaggtatctgggttaatcgccatttaaaaaaggttgatatgttagaagctttgaaatccatagat

SEQ ID NO: 1912 - protein, 878 aa, Streptococcus pyogenes
MIKKTLWKDILRAIKNSKGRFISLFFLMALGSFALVGLKVTGPDMERTASRYLERHQVMDLTVLASHQFSQADKQELDTLKGAHLEYGHLLDVSLTSNQKSLRLYSVPKKVSKPVLVKGSWPKRETDLVLSSSLAKNYQIGDELAVTSPMEGLLTTTHFQVVGFANSSEVWSKSNLGSSSTGDGSLYAYAFVNPNVFKSAFNLLRIRFSHLRLTNAFSKDYQKRVTQNQAHLDNLLKDNGQKRYDDLQNQYDLALKNGRAALAKETVKLAASEENLTFLEGSALQEAKHQIEQGKQALAKEEKQLEQVQATKDKLEKPSYLTYNRSTLPGGEGYHTYATSTTSISNVGNIFPVVLYLVAALVAFTTMTRYVDEERTSSGLLKAIGYSNKDISLKFLIYGLLASFLGTTLGIIGGTYLLSTLISEILTGALTIGKTHLYSYWFYNGIAYLLAMLSAVLPAYLIVKKELFLNAAQLLLPKPPSKGAKIWLEHLTFVWKALSFTHKVTIRNIFRYKQRMLMTIVGVAGSVALLFAGLGIQSSLAKVVEHQFGDLTTYDILAVGSAKATATEQTDLASYLKQEPITGYQKVSYASLTLPVKGLPDKQSISILSSSATSLSPYFNLLDSQEQKKVPIPTSGVLISEKLASYYKVKPGDQLVLTDRKGQSYKVTIKQVIDMTVGHYLIMSDTYFKNHFKGLEAAPAYLIKVKDKDSKHIKETASDLLTLKAIRAVSQNVNHIKSVQLVVTSLNQVMTLLVFLSILLAIVILYNLTTINIAERIRELSTIKVLGFYDQEVTLYIYRETISLSLVGILLGIYLGKGLHTYIMTMISTGDIQFGVKVDAYVYLVPILVILSLLAVLGIWVNRHLKKVDMLEALKSID

SEQ ID NO: 1913 - DNA, 699 bp, Streptococcus agalactiae
atgtcctatattgaaatgaagcattcctataagcgttatcaaacaggtgaaaccgaaattgttgctaacaatgatattagtttcagtattgaaagaggtgagttggtggttattcttggtgcatccggcgctggcaaatctactgttctcaatatactaggagggatggatagtaatagtgaaggtgaagttttaattgatggtaagaatattgctaattataccatcagggaattgactcgttaccgtagatatgatgtcgggtttgtttttcaattctataacttagtccctaatctaacagcactagagaatgtagaattggcttcagaaattgttccaaaggcattagatgcccaacaggcattagaaaacgtaggtttgggacaccgtatcaatcattttccagcacagctttccggtggcgaacagcaacgcgttgcaatagcacgagctattgccaaaaaacctaaactgttactttgtgatgaacctactggtgctttagattaccaaactggaaaacaagtactagccatcctgcaaaagatggcgcaatcaaaagaaacaactgtgatcattgttactcataatactgccttagcgccaattgcaaatcgcgtgatccatatgcatgattcaaaaatcagtgatattgtaataaacgagaatccaagtgatattcagaacatagaatat

SEQ ID NO: 1914 - protein, 233 aa, Streptococcus agalactiae
MSYIEMKHSYKRYQTGETEIVANNDISFSIERGELVVILGASGAGKSTVLNILGGMDSNSEGEVLIDGKNIANYTIRELTRYRRYDVGFVFQFYNLVPNLTALENVELASEIVPKALDAQQALENVGLGHRINHFPAQLSGGEQQRVAIARAIAKKPKLLLCDEPTGALDYQTGKQVLAILQKMAQSKETTVIIVTHNTALAPIANRVIHMHDSKISDIVINENPSDIQNIEY

SEQ ID NO: 1915 - DNA, 2127 bp, Streptococcus agalactiae
gtgatacctatggcaactacgacaaaaacgtcgaccaaaaaaacaagtaaaaaaaaatcagctactgctaaaaaaaatctagttattgtggagtctcctgcaaaagcaaagactatcgaaaaatacttaggacgtaactataaagttgtagcctcagtaggtcatatccgtgatttaaaaaagtcaagtatgtccattgattttgagaataattacgaaccacaatatattaatattcgtggtaaaggacctctcattaatgatttaaaaaaagaagctaaaaaggctaaaaaagtttacctcgcgagtgacccggaccgtgaaggagaagctatttcctggcatttagcgcatattttagatttagacaaagaagacagaaaccgtgttgttttcaatgaaatcacaaaagatgctgttaaaaatgcttttgtggaacctcgtcagattaacatggatctcgttgatgctcagcaagcacgacgtgttttagatcgcattgttggttattctatctcacctattttatggaaaaaagtaaaaaaaggcctatcagctggacgtgtacaatcagttgctcttaaactaatcattgatcgtgaaaatgagattaaggctttccaaccggaggagtattggactattgacggttcctttaaaaaaggaacacgtaaattcaatgccactttctacggtttagacggaaagaaattcaaattatcgaataatgaagacgtcaaaacagttctaaaacgtattaaaactgatgaattcttagttgaaaaagttgaaaaaaaagagcgtcgtcgtaatgcaccattaccgtatacaacttcttcattgcaacaagatgcagctaataaaatcaattttcgaactcgtaaaaccatgatgattgcgcaacagctgtacgaaggacttagcttaggcacagcaggtcatcaaggtctgattacctatatgcgtactgattctacacgtattagtccgttagcacaaaatgaagcaacagaatttattactaaccgttttggtgcaaattattctaaacatgggaataaagttaaaaatgcttctggagcacaagacgctcacgaagctattcgcccatctagtgttaatcatacacccgaaagtattgctaagtatttagacaaagatcaactaaaactttacactcttatctggaaccgttttattgcaagccaaatgacagcagcagtctttgacacaatgaaagttaatttaacgcaaaatggtgttacttttattgctaatggtagccaagtcaagtttgatggttacatggctgtttataacgatactgacaaaaataaaatgttaccagatatggaggaaggagaaagtgttaaaaaggttaatacgaatcctgaacaacacttcactcaacctcctgcaaggttttcagaagcaagtctcattaaaacacttgaagaaaacggtgtaggtcgtccttcaacttatgccccaacgcttgagactattcaaaaacgttattatgttaagcttgcagctaaacgcttcgaaccaactgaacttggtgaaattgttaatagccttattgtagaatttttcccagatattgttgatgttaccttcactgccgaaatggaagggaaactagacgaagttgagattggtaaagagcagtggcaaaagattatcgatgaattttataaaccatttgaaaaagaacttgcaaaagcagaaactgaaatggagaaaattcaaataaaggatgaacctgctggatttgattgcgagctatgtggatcaccaatggtaataaaactaggacgttatggaaagttttatgcgtgtagcaatttccctgaatgtcataacacaaaagctatcactaaggaaataggtgttatttgtcctatctgtcaaaaaggacaagttattgagcgaaaaacaaaacgcaatcgtatcttttatggctgtgaccgctacccagaatgtgagtttacatcttgggacaaacctattggacgaacttgccccaaatcaaatgatttcttagtggagaaaaaagtacgcggtggtggtaaacaagttgtttgctcaaatgaaaaatgcgactaccaagaagagaaaattaaa

SEQ ID NO: 1916 - protein, 709 aa, Streptococcus agalactiae
MIPMATTTKTSTKKTSKKKSATAKKNLVIVESPAKAKTIEKYLGRNYKVVASVGHIRDLKKSSMSIDFENNYEPQYINIRGKGPLINDLKKEAKKAKKVYLASDPDREGEAISWHLAHILDLDKEDRNRVVFNEITKDAVKNAFVEPRQINMDLVDAQQARRVLDRIVGYSISPILWKKVKKGLSAGRVQSVALKLIIDRENEIKAFQPEEYWTIDGSFKKGTRKFNATFYGLDGKKFKLSNNEDVKTVLKRIKTDEFLVEKVEKKERRRNAPLPYTTSSLQQDAANKINFRTRKTMMIAQQLYEGLSLGTAGHQGLITYMRTDSTRISPLAQNEATEFITNRFGANYSKHGNKVKNASGAQDAHEAIRPSSVNHTPESIAKYLDKDQLKLYTLIWNRFIASQMTAAVFDTMKVNLTQNGVTFIANGSQVKFDGYMAVYNDTDKNKMLPDMEEGESVKKVNTNPEQHFTQPPARFSEASLIKTLEENGVGRPSTYAPTLETIQKRYYVKLAAKRFEPTELGEIVNSLIVEFFPDIVDVTFTAEMEGKLDEVEIGKEQWQKIIDEFYKPFEKELAKAETEMEKIQIKDEPAGFDCELCGSPMVIKLGRYGKFYACSNFPECHNTKAITKEIGVICPICQKGQVIERKTKRNRIFYGCDRYPECEFTSWDKPIGRTCPKSNDFLVEKKVRGGGKQVVCSNEKCDYQEEKIK

SEQ ID NO: 1917 - DNA, 2127 bp, Streptococcus pyogenes
ttgggaacaaaaactacaactaagccaaaaacgggtactaaaaagtccaccactaaaaagaaatcaacagcgaaaaaaaatctcgttattgttgaatcacctgccaaagctaagactattgaaaaatatcttggacgcagttataaagttgttgcttcggtaggacatattcgtgacttaaaaaaatcgtctatgtctattgattttgataataattatgagccacaatacattaatatccgtggtaagggaccccttatcaattctttaaaaaaagaagccaaagctgctaaaaaagtttatttagctagtgacccggatcgtgagggagaggctatttcttggcatttgtcacatatcttaggacttgatcctcaagataataaccgagtggtttttaatgaaattacgaaagatgcagttaaacatgcctttgtggagcctcgtcagattgatatggacttggtagattctcaacaagcacgtcgtgttttggaccgtattgtgggatattccatttcaccaattctttggaaaaaggtcaaaaaaggactttcagcaggacgtgtccagtcggttgctttaaaactcatcattgaccgtgaaaatgacatcaaagcatttgttccaaaggaatactggtctattgatggtctttttaaaaaaggaactaaaaagtttcaagcgactttttacggtattaatggcaaaaaaacaaagcttgacaataacaacgatgtcaaagaggtattagcaaagctaacaaatgaagattttcttgtcagcaaggttgacaagaaagagcgacgtcgtaatgctcccttaccttacacaacatcatctcttcaacaagatgctgctaataaaatcaatttcagaacgcgtaaaaccatgatggtagcccaacaactgtatgaggggattcatttaggagaaaatggaactcaaggtttaattacctatatgcgtacggattctactcgtatcagtccagtagcacaaaacgatgctgctcaatttattatcaatcgctttggagctaattattcaaaacatggtaatcgtgtcaaaaataccagtggtgtccaagatgctcacgaggcgattcgtccatctagtgttaatcatacgccagactctattgccaaataccttaacaaggatcagttaaaactttatacgcttatttggaatcgttttgtggctagccaaatgacagcagctgtttttgataccgtaaaggtgaacttggagcaaaatggcgtgatttttgttgccaatggtagccaaatgaagtttgatggttacatggctgtttacaatgattccgataaaaacaaaatgttacctgagatggcagaaggagaaacggttaaaaaaatatcgacctctccagaacagcactttacgcagccaccagctcgttattctgaagcaactctaattaaaacgctagaagaaaatggtgttggacgtccatcaacttacgctccaaccttagaagtcattcaacgcagatactatgttaaattgtctgctaagcgctttgagccaactgagcttggggaaattgtcaacaagcttattgtcgaatttttcccagatattgtcgatgttgcctttactgccgagatggaaggtaagctagatcaagttgaaatcggagaagaacaatggcaacatgttatcgatcaattctatcaaccctttgtcaaagaattgaataaggctgagtctgaaattgaaaagattcaaatcaaagatgaaccagctggcttcgactgtgatgtttgtggtcacccaatggtcattaagttaggacgttttgggaaattttacgcgtgtagcaacttcccagagtgccgtaatacaaaagccatcactaaagaaattggtgttacttgtccggtttgtcataaaggacaagttatcgagcgtaaaaccaaaaaaaataggatattttatggttgtgatcagtatccagattgtgagtttatctcgtgggatttacctattggacgtgcttgccctaagtcaggtgactatcttattgagaaaaaagttcgtggtggcaaacaagtaatgtgtagcaatgagacctgtgattacaaggaagaaaaaattaaa

SEQ ID NO: 1918 - protein, 709 aa, Streptococcus pyogenes
LGTKTTTKPKTGTKKSTTKKKSTAKKNLVIVESPAKAKTIEKYLGRSYKVVASVGHIRDLKKSSMSIDFDNNYEPQYINIRGKGPLINSLKKEAKAAKKVYLASDPDREGEAISWHLSHILGLDPQDNNRVVFNEITKDAVKHAFVEPRQIDMDLVDSQQARRVLDRIVGYSISPILWKKVKKGLSAGRVQSVALKLIIDRENDIKAFVPKEYWSIDGLFKKGTKKFQATFYGINGKKTKLDNNNDVKEVLAKLTNEDFLVSKVDKKERRRNAPLPYTTSSLQQDAANKINFRTRKTMMVAQQLYEGIHLGENGTQGLITYMRTDSTRISPVAQNDAAQFIINRFGANYSKHGNRVKNTSGVQDAHEAIRPSSVNHTPDSIAKYLNKDQLKLYTLIWNRFVASQMTAAVFDTVKVNLEQNGVIFVANGSQMKFDGYMAVYNDSDKNKMLPEMAEGETVKKISTSPEQHFTQPPARYSEATLIKTLEENGVGRPSTYAPTLEVIQRRYYVKLSAKRFEPTELGEIVNKLIVEFFPDIVDVAFTAEMEGKLDQVEIGEEQWQHVIDQFYQPFVKELNKAESEIEKIQIKDEPAGFDCDVCGHPMVIKLGRFGKFYACSNFPECRNTKAITKEIGVTCPVCHKGQVIERKTKKNRIFYGCDQYPDCEFISWDLPIGRACPKSGDYLIEKKVRGGKQVMCSNETCDYKEEKIK

SEQ ID NO: 1919 - DNA, 840 bp, Streptococcus agalactiae
atgaatcattttgaactatttaagcttaaaaaagctggattaacaaatcttaatatccacaatattatcaactatctcaaaaagaatagtttaacttctctatctgttcgcaatatggccgtagtatcaaaatgtaaaaatcctactttctttatagaaaattataaacagctagaccttaaaaaacttcgacaagaattcaaaaaatttccagttctatcgattttggattctaactatcctttagagttaaaagaaatatataatccaccagttctacttttttatcagggtaatattgaacttctatctaaacctaaattagctgtagtgggggcaagacaggcatctcagataggttgtcagtctgttaaaaagattatcaaggagactaacaatcaatttgttatcgtaagtggtttagcgcgtggcattgatacagcagcacatgttagtgctttaaaaaatggcggcagtagtatagctgttatcgggagtggtttagatgtttattatccaacggagaataagaaacttcaagaatatatgtcatataatcatctcgtattatcagaatattttaccggagaacaacccttgaaatttcatttccccgaacgtaaccgtattattgcagggctgtgtcaaggtattgtggttgccgaagctaagatgagatctggaagtttaattacctgtgaaagagcattagaagagggacgagaagtttttgccattcccggaaatattatcgatggcaaatcagatggatgccaccatcttatccaagaaggagctaaatgcattatttcaggaaaagatatcctttctgaatatcag

SEQ ID NO: 1920 - protein, 280 aa, Streptococcus agalactiae
MNHFELFKLKKAGLTNLNIHNIINYLKKNSLTSLSVRNMAVVSKCKNPTFFIENYKQLDLKKLRQEFKKFPVLSILDSNYPLELKEIYNPPVLLFYQGNIELLSKPKLAVVGARQASQIGCQSVKKIIKETNNQFVIVSGLARGIDTAAHVSALKNGGSSIAVIGSGLDVYYPTENKKLQEYMSYNHLVLSEYFTGEQPLKFHFPERNRIIAGLCQGIVVAEAKMRSGSLITCERALEEGREVFAIPGNIIDGKSDGCHHLIQEGAKCIISGKDILSEYQ

SEQ ID NO: 1921 - DNA, 834 bp, Streptococcus pyogenes
gtgaatcattttgaactttataagctaaagaaagctggactgactaataaaaacattctcaatattcttgactaccaaaaacaccaggaaaaatcgttgtcacttcgagatatggccgttgtttctggttgtaagcatccgtctcactttatagaagcctataagcagttagatattcaaaatttaaaaatggaatttaaacaatttcctagtatttctatcttagataagcattacccaatggcattgaaagaaatatacaatccacctgtcctcttgttttttcagggaaatttagaccttcttgagaaacctaaattagccattgtcggctccagacgctcaagcgataccggagtaaagtctgtccgtaaaattcttaaagaactcgggaaccgttttgtgattgttagcggacttgctcgaggtatcgacactagtgctcatttagcctgccttaaaaatgggggacaaactatcgctattattggaacaggattggatcgcttttaccctaaagaaaatagggagttgcaaactttcttagggaaaaatcatcttgtgctaacagaatacggtccaggagaagaagctttatcttatcactttccagaacggaatcgtattatcgcaggccttagccgaggtattcttgtcgttgaagcaaaaaatcgttcaggttccttgattacttgtcaaattgggatagaagaaggccgagacatttttgctgtcccaggaaacattttggacgggaaatccgaaggttgccttcagttaattaaagagggagcaacatgcgtcacatcgggcatggatatcctttcagagtac

SEQ ID NO: 1922 - protein, 278 aa, Streptococcus pyogenes
VNHFELYKLKKAGLTNKNILNILDYQKHQEKSLSLRDMAVVSGCKHPSHFIEAYKQLDIQNLKMEFKQFPSISILDKHYPMALKEIYNPPVLLFFQGNLDLLEKPKLAIVGSRRSSDTGVKSVRKILKELGNRFVIVSGLARGIDTSAHLACLKNGGQTIAIIGTGLDRFYPKENRELQTFLGKNHLVLTEYGPGEEALSYHFPERNRIIAGLSRGILVVEAKNRSGSLITCQIGIEEGRDIFAVPGNILDGKSEGCLQLIKEGATCVTSGMDILSEY

SEQ ID NO: 1923 - DNA, 1026 bp, Streptococcus agalactiae
atgacaaaaaaacttattattgctatattagcactatgcactatcttaaccacttctcaagctgttttagctaaagaaaaatcacaaactgttaccataaaaaacaactattcggtctatattaaaaaagaaaaaagagacaagccggataataaaaagcaaatcagcgagacacttaaagttcctttaaaacccaaaaaagtagttgtttttgatatgggagctttggatactatcacagctttaggagctgaaaaatctgttattggtatcccgaaggctaaaaatgctctaagtttattgcccaataacgtcaaatctgtttataaagctaagagataccaagacgtaggaagtctcttcgaaccaaactttgaagctattgctcgtatgcaacctgatgtggttttcctaggagcacgtatggcttctgttgataatattgaaaaattaaaggaggctgcacctaaagcagcattagtatatgctggagtcgactcaaaaaaagtatttgacaaaggagttgctgagcgtgtcacaatgttagggaaaatcttcgaccaaaataaaaaggcaaaaacctttaataaagatatcgcacaagctgttcttaaattgcagaaaactattgagaaaaaaggtaaacctacagctctatttgtaatggcaaacagcggtgaacttttaactcaatcaccttctggtcgttttggttggattttctctgtaggtggatttaaagcagtcaatgaaaatgaaaaactaagttcacatggtactcccgtatcttatgaatacatcgctgaaaaaaatcctaactatctctttgttttagatcgtggagcgactattggacaaggagcttcatcaaaagaactttttaataacgatgttattaaagcaactgatgctgtcaaaaacaaacgtgttcatgaggtagatggaaaagattggtatatcaattcaggcggaagccgagtaacactccgtatgattaaagatgtacagaactttgttgataatcgt

SEQ ID NO: 1924 - protein, 342 aa, Streptococcus agalactiae
MTKKLIIAILALCTILTTSQAVLAKEKSQTVTIKNNYSVYIKKEKRDKPDNKKQISETLKVPLKPKKVVVFDMGALDTITALGAEKSVIGIPKAKNALSLLPNNVKSVYKAKRYQDVGSLFEPNFEAIARMQPDVVFLGARMASVDNIEKLKEAAPKAALVYAGVDSKKVFDKGVAERVTMLGKIFDQNKKAKTFNKDIAQAVLKLQKTIEKKGKPTALFVMANSGELLTQSPSGRFGWIFSVGGFKAVNENEKLSSHGTPVSYEYIAEKNPNYLFVLDRGATIGQGASSKELFNNDVIKATDAVKNKRVHEVDGKDWYINSGGSRVTLRMIKDVQNFVDNR

SEQ ID NO: 1925 - DNA, 915 bp, Streptococcus pyogenes
ttgctgtatgggtttggaaaaagaggaaaaaaaatgataaaacgatgtaaaggaattggtctagccttaatggccttctttttggtagcttgtgtgaatcagcaccctaaaacggctaaagagactgaacagcagagaattgtagccacttcggttgctgtggttgatatctgtgaccgtttaaatttagacctcgttggggtttgtgatagtaaattatatacccttcctaaacgctatgatgctgttaagcgtgtgggtttacccatgaatcctgatatagagttgattgcttctttgaaaccaacttggattttgagtcccaattctttacaagaagatttggaacccaagtatcaaaaattggatactgagtatggttttttgaacttacgaagtgttgagggcatgtaccagtccattgatgatttagggaaccttttccaacgtcaacaagaagcaaaagaattgcgccagcaataccaggactattatcgtgctttccaagctaaacgtaaggggaagaaaaagcctaaagtgcttattcttatgggcttgccaggtagttatttggtggcgacgaaccaatcttatgtagggaatcttttggacttggcaggtggtgagaatgtttatcagtcagatgagaaagaatttctatcagctaatcctgaagacatgctggctaaggagcctgacttgattttacgaacagctcatgccattccagacaaggtaaaagtgatgtttgacaaagaatttgctgaaaatgatatttggaaacattttacggcagtcaaggaagggaaagtctatgatttggacaataccctgtttggcatgagtgctaaattgaactacccagaagccttggacaccttaacacagctttttgaccacgtgggagatcatccg

SEQ ID NO: 1926 - protein, 305 aa, Streptococcus pyogenes
LLYGFGKRGKKMIKRCKGIGLALMAFFLVACVNQHPKTAKETEQQRIVATSVAVVDICDRLNLDLVGVCDSKLYTLPKRYDAVKRVGLPMNPDIELIASLKPTWILSPNSLQEDLEPKYQKLDTEYGFLNLRSVEGMYQSIDDLGNLFQRQQEAKELRQQYQDYYRAFQAKRKGKKKPKVLILMGLPGSYLVATNQSYVGNLLDLAGGENVYQSDEKEFLSANPEDMLAKEPDLILRTAHAIPDKVKVMFDKEFAENDIWKHFTAVKEGKVYDLDNTLFGMSAKLNYPEALDTLTQLFDHVGDHP

SEQ ID NO: 1927 - DNA, 759 bp, Streptococcus agalactiae
atgattcaaataaacaatttacataagttctatggccaaaaggaaatattaaaagacattaatatttcgattcctaaaggaaaagtaacagctattttaggtccaaatggatctggaaagagtacattgctgagttgtatcagtcgacttgaaccttatgataatggtgaaattttccttgataaagtaccattagcccactacagttcaaatgacttagccaaaacattagccatattaagacaatctaatcacttaacactcaagataaaggtgagagacttgataggattcggtagatttccttatagtaaaggacggttaagtcaaaaagataaagctgtcatagaatcagttatatcttatatggatttaaacgatatagctgacgagttcattaataacctcagcggaggtcaaattcaaagagcttttatcgcaatgacaatggcacaagatactcaatatatttgcttagatgagccactcaacaatttagatatgaaatatgctgttcaaatgatggatcttatcaaacgatatgcgtatgagtttaataaaactatagtgattattattcacgacatcaattttgcaactcactacgctgacaatgttgtcgctttaaaagaaggacaagtggtgacttgtgggactgtcgaagatgttatgcaagaaaaaatcctttctcatttatttgatatgcctatccgtatcgaaactgttgatggtaaaccaattatccttttttgtacaacg

SEQ ID NO: 1928 - protein, 253 aa, Streptococcus agalactiae
MIQINNLHKFYGQKEILKDINISIPKGKVTAILGPNGSGKSTLLSCISRLEPYDNGEIFLDKVPLAHYSSNDLAKTLAILRQSNHLTLKIKVRDLIGFGRFPYSKGRLSQKDKAVIESVISYMDLNDIADEFINNLSGGQIQRAFIAMTMAQDTQYICLDEPLNNLDMKYAVQMMDLIKRYAYEFNKTIVIIIHDINFATHYADNVVALKEGQVVTCGTVEDVMQEKILSHLFDMPIRIETVDGKPIILFCTT

SEQ ID NO: 1929 - DNA, 780 bp, Streptococcus pyogenes
atgacaacaattagtgctgaagacctcacaattgcctatgaacagcgtaccatcatcgataaattatcgttttatattcctgaaggtaaaattacgaccattattggcgccaatggctgtgggaagtctagtttattaaaagcactgacaagattattaccaccaaaacagggagttgtatatttaaatgggcaaaacattgccacattagaaactaaagaggttgctaaaaaactagctcttttacctcaagttcaagaagcaactaacggcataactgtttacgaattggtttcttacggacgttttccccatcaatcttactttggaaatcttagtccagctgacaaaaaagccattcattgggctatgcaagccaccaatgtcatggcctatgctgatcaacctgttgatgctctttctggggggcaacgtcaaagggtttggcttgcaatggcattagcccaaggcactgatactatttttttagatgagccaactacttatttagatttaaatcatcaactagaaatcctagagctcgttaaatccctaaataaggatgccggcaagactattgttatggttcttcacgacctcaatctttcagcccgctattcggatcatctgattgctatgaaacatggcaagatccattatactggtactatagcagatgttatgacttcacctatcattcaagacatcttccaaatcaaaccggtactggttgatgatcctatccacaactgtcctatagtgctgacttatcagcttcaa

SEQ ID NO: 1930 - protein, 260 aa, Streptococcus pyogenes
MTTISAEDLTIAYEQRTIIDKLSFYIPEGKITTIIGANGCGKSSLLKALTRLLPPKQGVVYLNGQNIATLETKEVAKKLALLPQVQEATNGITVYELVSYGRFPHQSYFGNLSPADKKAIHWAMQATNVMAYADQPVDALSGGQRQRVWLAMALAQGTDTIFLDEPTTYLDLNHQLEILELVKSLNKDAGKTIVMVLHDLNLSARYSDHLIAMKHGKIHYTGTIADVMTSPIIQDIFQIKPVLVDDPIHNCPIVLTYQLQ

SEQ ID NO: 1931 - DNA, 972 bp, Streptococcus agalactiae
atgattaaggatttagagataccaaaattacttattttactgatactactaattgctgctattattttgtttttaatttatggtattccaactgacgcaaatgaatttttgattatctatatcctaaaaacacgttatcaaaaactgattgcattaattttggttggtatctgcattggtagttctagtcttatttttcaaactctaaccaataaccgacttttaactccgtccattattggtttagatagcttatatatccttatccaaacaggattaatgtatttaatcggagctcagcgtgtcataaaattttcatcttttagtagcttcctcctttcattattattaatggttggatttgcttacttattatttacgatactttttcgaaataaaaaacagtctttgtattttgttctattagctggactcatatttaatacattattttcttctatctcatcctttattcaagccattatggaccccaacgattttatgattttacaaaatcagctctttgctagtttcaatgctattaacaccaagatcctttggatttctttcattatcattgtcgttagctttgtcattaattggccttttataaaggaattggatgtcttactattgggtaaagaaaatgcgatatcactcggcatctcatatcaaaagcttactactagattttttttatggttagcattgatggtagctatagcaacagcattagttgggccgattacttttttaggcttacttgtagcacatattacctatcacagttttcatacctttagacatcaaatattagttcctatagccattgttatctgtatctttacacttgtcttagggcagcatctcgttcaaaatctattacacctcactgttcaactaagtgttctcctcaaccttatcgggggaagttattttatattcaccttaatcaaaggaaggaaaaactta

SEQ ID NO: 1932 - protein, 324 aa, Streptococcus agalactiae
MIKDLEIPKLLILLILLIAAIILFLIYGIPTDANEFLIIYILKTRYQKLIALILVGICIGSSSLIFQTLTNNRLLTPSIIGLDSLYILIQTGLMYLIGAQRVIKFSSFSSFLLSLLLMVGFAYLLFTILFRNKKQSLYFVLLAGLIFNTLFSSISSFIQAIMDPNDFMILQNQLFASFNAINTKILWISFIIIVVSFVINWPFIKELDVLLLGKENAISLGISYQKLTTRFFLWLALMVAIATALVGPITFLGLLVAHITYHSFHTFRHQILVPIAIVICIFTLVLGQHLVQNLLHLTVQLSVLLNLIGGSYFIFTLIKGRKNL

SEQ ID NO: 1933 - DNA, 1047 bp, Streptococcus pyogenes
ttgaccacgtgggagatcatccgtaacatgacagcatcagatttacaaagggatcaatccctactggctaaaaaacgtttcagaagtggtctttatctagttcttttaattctcagcctcctatttttggcggttattgccttatcccttggtggtttggcggtttcttatggggcaattgtcaagggactgtttgtggcttatgacccccaagtggctttgatttatgatttgcgttttccaagaattgtcattgctttattagcaggagcagggatagctgtttcgggagttctttttcaagcagtgttgaaaaatcctatttcagaccctgctattatagggatttgtagtggtgctagttttatggttttagtctctagtttacttctgccgcagttgctgctgtatggtccaatcgtatcctttttaggaggcggagtgtctttcctgctgatttatggtttagcatggaagaaagggcttaatcctattcggcttattctaacagggattgctattaatgctttatttatggggttatcaactgctttaaccagctttttcacctcagctagtcccatggtcaatgctcttttagcaggtcatattagtcaaaaaacatgggctgatgtaggggttttattcccttatacattcattggcttgttactagctttgttattgtcaaaaacttgtaaccttcttcttttagatgatcaggtgattcgtcatttaggaatcgatgctacagcgttacggttgggaatttccttggttgctgttttattggcttcggtagccacttcgatcgttggagtggtttctttcctaggcttgattgtccctcatatgagccgcttgctggttggaagtaagcaccaaatcttaattcctttttcagctttgcttggagcctttgtctttttgctagccgatactttaggaagaagtcttgcttacccattggaaattagccctgcgattataatgagtattgtaggcgggccttactttatttacctgctaaggaggtctgatattata

SEQ ID NO: 1934 - protein, 349 aa, Streptococcus pyogenes
LTTWEIIRNMTASDLQRDQSLLAKKRFRSGLYLVLLILSLLFLAVIALSLGGLAVSYGAIVKGLFVAYDPQVALIYDLRFPRIVIALLAGAGIAVSGVLFQAVLKNPISDPAIIGICSGASFMVLVSSLLLPQLLLYGPIVSFLGGGVSFLLIYGLAWKKGLNPIRLILTGIAINALFMGLSTALTSFFTSASPMVNALLAGHISQKTWADVGVLFPYTFIGLLLALLLSKTCNLLLLDDQVIRHLGIDATALRLGISLVAVLLASVATSIVGVVSFLGLIVPHMSRLLVGSKHQILIPFSALLGAFVFLLADTLGRSLAYPLEISPAIIMSIVGGPYFIYLLRRSDII

SEQ ID NO: 1935 - DNA, 99 bp, Streptococcus agalactiae
atgctaattagattaggtacgattaaacctaagaaaggtaaagctcctacgataataatgactagggatgtcataattgaaaccaaaactaaaccaaag

SEQ ID NO: 1936 - protein, 33 aa, Streptococcus agalactiae
MLIRLGTIKPKKGKAPTIIMTRDVIIETKTKPK

SEQ ID NO: 1937 - DNA, 1005 bp, Streptococcus agalactiae
ttgtgctcatttttgaacactttatctttcattttaaggagttttatgaaaaagctattaaccactcctgtaatgggttgtactttggttatactttctctaacgtccctatttgttggtgtgaaatctatcccactggagcaaataacacaccttgatcaatcacaggtagatatttttttaacgagtcgcttaccaagaaccattagtatcctaatatctggtgcaagtttgtcagtctgtggcctgctgatgcaacaactaacccaaaacaagttcgtttcaccgacaacttcagggactatggattgggcgaaattaggagtagttgttacgctgattttctttaaaaatacctctatttttattcaactatgtatagcttcaggttttgccattttaggatcgcttctttttgtaaccattttaaaaatgattacttttaaggataatatttttatacctcttatcggactgatgcttggacaaattgtagcagcagcaacagtatttttaggaacacattttcaagtactacaatctgtcaacagttggcttcaaggtaatttttccatcatgactagccatcgctacgaaattctttacttagcattgccatgtttgtttttagtatatttttttgctcatcagtttaccattgttgggcttggagaaagcttcgctaagaatttaggggttgcttatgaaaagatgatttactttggtttagttttggtttcaattatgacatccctagtcattattatcgtaggagctttacctttcttaggtttaatcgtacctaatctaattagcataactaaaggagatcatatgtcctcaactatcttagagacatcgcttttaggggcttgtatcgtcatgatatgtgatctttttggtcgcttagttatttttccttatgaagtctcaataggagttacgctaggagtattaggtagtgcctttttcctgatttcaattataagaaatgagggaaaatca

SEQ ID NO: 1938 - protein, 335 aa, Streptococcus agalactiae
MCSFLNTLSFILRSFMKKLLTTPVMGCTLVILSLTSLFVGVKSIPLEQITHLDQSQVDIFLTSRLPRTISILISGASLSVCGLLMQQLTQNKFVSPTTSGTMDWAKLGVVVTLIFFKNTSIFIQLCIASGFAILGSLLFVTILKMITFKDNIFIPLIGLMLGQIVAAATVFLGTHFQVLQSVNSWLQGNFSIMTSHRYEILYLALPCLFLVYFFAHQFTIVGLGESFAKNLGVAYEKMIYFGLVLVSIMTSLVIIIVGALPFLGLIVPNLISITKGDHMSSTILETSLLGACIVMICDLFGRLVIFPYEVSIGVTLGVLGSAFFLISIIRNEGKS

SEQ ID NO: 1939 - DNA, 1035 bp, Streptococcus pyogenes
atgctttttatgggtaataagaagaggaggccgctattgaaatctcaaagacaccttttaaggttatatactagcctgatcctgctacttgtaagtcttatgggattagctttgtcccttggagaatctcatctatcttttttggaccttgtccatgtgtttttgggaaaatctagccatgccatatctttcatcgttattaacattcgtctgccaagaattctagctgcttgtctaggaggcggttctcttgctttatcagggctattattacaacgtttaacacgaaatcccttagctgactctggtgtattaggtattactataggagcaggtatctctttggctattgtggtctccttttctttctttgagcaagctcatatcagccattacttgcctttatttgccatgcttggtgctattgtaacaacctttagcgtttattggctatctttgacaaaacaaggacaaattgatcctacacggttaattcttactggtgtagctgttactaccatgctttcaagtctaatggttgctcttgttggtcatattaatcgctacaaagtcgatttggtcatcaattggcttagcggccaattaataggagacgactggcctactctgagtgtcatcgctcctttgttattgtgtttttggctattgacttatagtcaagcccatttccttaatattatgggattagctgataatactgctattgggctaggactccctttaaaccgtaagcgtcgtttgatacttgtcttagcagctggcttaggtgctttgagtgttcttttggttggtaatattagttttatcggcttaatagctggacactttagtacatacttggtagggagtaatcataaaataacaatacccattagtattttaatcggaatgatcctacttcttgttgcagatacagtaggacgagtctatctggttggcagtaatatccagacagggattttagtgtcgcttatcggagccccttattttctttacttaatggcaaaaacaaaa

SEQ ID NO: 1940 - protein, 345 aa, Streptococcus pyogenes
MLFMGNKKRRPLLKSQRHLLRLYTSLILLLVSLMGLALSLGESHLSFLDLVHVFLGKSSHAISFIVINIRLPRILAACLGGGSLALSGLLLQRLTRNPLADSGVLGITIGAGISLAIVVSFSFFEQAHISHYLPLFAMLGAIVTTFSVYWLSLTKQGQIDPTRLILTGVAVTTMLSSLMVALVGHINRYKVDLVINWLSGQLIGDDWPTLSVIAPLLLCFWLLTYSQAHFLNIMGLADNTAIGLGLPLNRKRRLILVLAAGLGALSVLLVGNISFIGLIAGHFSTYLVGSNHKITIPISILIGMILLLVADTVGRVYLVGSNIQTGILVSLIGAPYFLYLMAKTK

SEQ ID NO: 1941 - DNA, 546 bp, Streptococcus agalactiae
atgaccgaaaaagaaaaaatgttagcaggacaatattatcgtccatcagcacctgaactacgcaaggatagagaagttgcactaaaaaatatgcaagcctttaacaatgaagataatagtagcaaacgtaacgtcattttacaaaaatggtttggtgctactgggaagagtatccatatggaacaacgttttgtctgcgattatggttgtaatatttatgttggtgaaaacttctacgccaattttaaccaaactttcttagatgtttgtgaaattcgtattggcgataactgtatgtttggcccaaactgtcaactcctcaccccactccatcctctagatccaatagaaagaaattcaggattagaatacggtgccccaatccaaatcgggaataatgtctggctaggtggaggagtgactattttaccaggtgttgtattaggagataatgtcgtcgttggcgctggaagtgtcgttacgaaatcatttgaaaataacgttgttatagcaggaaaccctgctaagataatcaaaaaattagct

SEQ ID NO: 1942 - protein, 182 aa, Streptococcus agalactiae
MTEKEKMLAGQYYRPSAPELRKDREVALKNMQAFNNEDNSSKRNVILQKWFGATGKSIHMEQRFVCDYGCNIYVGENFYANFNQTFLDVCEIRIGDNCMFGPNCQLLTPLHPLDPIERNSGLEYGAPIQIGNNVWLGGGVTILPGVVLGDNVVVGAGSVVTKSFENNVVIAGNPAKIIKKLA

SEQ ID NO: 1943 - DNA, 564 bp, Streptococcus pyogenes
atgaccacagaatttgacaaaatgactagaggcgaatggtatgatgctaattttgattcggaactgattcaaaaacgcatgatggcacaagacctctgtttcgatttaaaccaattaaagcctagtcgagaagaagaacgctctgccgttttaaaccaactttttggacaatcttttgagggcttggtcctgctcagccctttcatctgtgactatggtaagaacattacttttgggaagaattgctttattaacagcaattgttatttcatggatggggcgaagattgccttgggcgataatgtctttgtaggtccttcgacaggtttttacacggcaaatcaccctctagattataaacgccgcaatgaggggcttgaaaaagctttaccaattaccataggagataatgtctggtttggtgccaatgtcaatgttatgcccggcgttactattggcagtggttgtgtgattgcgtcaggatcagttgttacccatgatattccagtcaattcccttgcggcaggtgttccttgccaagttgtacggaaaattgagcaggag

SEQ ID NO: 1944 - protein, 188 aa, Streptococcus pyogenes
MTTEFDKMTRGEWYDANFDSELIQKRMMAQDLCFDLNQLKPSREEERSAVLNQLFGQSFEGLVLLSPFICDYGKNITFGKNCFINSNCYFMDGAKIALGDNVFVGPSTGFYTANHPLDYKRRNEGLEKALPITIGDNVWFGANVNVMPGVTIGSGCVIASGSVVTHDIPVNSLAAGVPCQVVRKIEQE

SEQ ID NO: 1945 - DNA, 762 bp, Streptococcus agalactiae
atgatggcaacaattaaagaaatcaaagcaattttagagactattgttgatttaaaagacaaacgttggcaagaatatcaaacagattcacgcgcaggtgttcaaaaagcaatccttcaacgaaaaaaaaatattcagtcagatttagacgaagaagcgcgcttagaacaaatgttggtctacgaaaaaaaactttacattgaacatataaaccttattgcaggaatcgatgaagtaggtagaggtcctttagcgggaccagtagtagctgctgctgttattcttccaccaaactgtaaaataaaacatctcaatgactccaaaaaaattccaaagaaaaagcatcaagaaatctatcaaaatattttagatcaagcgttagcagttggtattggtattcaagacagccaatgtattgatgatatcaacatttatgaagctacaaaacatgctatgattgatgcagtttctcatttatctgtggctcctgaacatcttttaattgatgctatggttttagatctatcaattccacaaactaaaattatcaaaggtgatgctaattcactctctattgcagcagcttcaatcgtagctaaagtgaccagagataaaataatgtctgattatgatagcacatatcctggatatgcattttctaaaaatgctggctatggtactaaagagcatttagaaggtttgcaaaaatacggtattactccgatacatcgtaaaagttttgaacctataaaatcaatgttg

SEQ ID NO: 1946 - protein, 254 aa, Streptococcus agalactiae
MMATIKEIKAILETIVDLKDKRWQEYQTDSRAGVQKAILQRKKNIQSDLDEEARLEQMLVYEKKLYIEHINLIAGIDEVGRGPLAGPVVAAAVILPPNCKIKHLNDSKKIPKKKHQEIYQNILDQALAVGIGIQDSQCIDDINIYEATKHAMIDAVSHLSVAPEHLLIDAMVLDLSIPQTKIIKGDANSLSIAAASIVAKVTRDKIMSDYDSTYPGYAFSKNAGYGTKEHLEGLQKYGITPIHRKSFEPIKSML

SEQ ID NO: 1947 - DNA, 789 bp, Streptococcus pyogenes
atgccgactagtattaaagctattaaagaaagcttagaggccgttactagcctcttggaccccctctttcaagaattggcaaccgacactaggtcaggcgtccaaaaagctctaaaaagccgacaaaaggttattcaggccgagttagcagaagaagaacgattagaagccatgctttcttatgaaaaagctctttataaaaaaggttataaagccattgcaggtattgatgaggtgggacgtggtcccttagcaggtcccgttgtggcagcttgtgtgattttacctaagtattgtaaaattaaaggccttaatgattctaaaaaaatccctaaagctaagcatgagaccatttatcaggcagtgaaagaaaaggctttggctatcggtatcggtattattgacaatcagcttattgatgaggtcaatatttatgaagcaaccaaactggccatgctagaagccattaaacagttggagggccaactcacacaaccagattatctcttgattgatgccatgacattggatattgctatttcgcagcagtctattcttaaaggcgatgccaattccttgtctattgcagcagcatcaattgtagctaaggtcaccagagatcagatgatggctaactatgatcgcatttttcctggttatgactttgctaaaaatgcaggctatggcaccaaagaacatttacagggattaaaagcttacggcataacgcctatccatcgtaaaagttttgaacctgttaaatccatgtgctgcgattcaactaatcct

SEQ ID NO: 1948 - protein, 263 aa, Streptococcus pyogenes
MPTSIKAIKESLEAVTSLLDPLFQELATDTRSGVQKALKSRQKVIQAELAEEERLEAMLSYEKALYKKGYKAIAGIDEVGRGPLAGPVVAACVILPKYCKIKGLNDSKKIPKAKHETIYQAVKEKALAIGIGIIDNQLIDEVNIYEATKLAMLEAIKQLEGQLTQPDYLLIDAMTLDIAISQQSILKGDANSLSIAAASIVAKVTRDQMMANYDRIFPGYDFAKNAGYGTKEHLQGLKAYGITPIHRKSFEPVKSMCCDSTNP

SEQ ID NO: 1949 - DNA, 114 bp, Streptococcus agalactiae
ttgattgcccctgttaatgctagctttaatccaactaattcatcttcaaatttgggccacaagataccaggagtgtccaaaatttccagttccttattagatttgagccattgc

SEQ ID NO: 1950 - protein, 38 aa, Streptococcus agalactiae
MIAPVNASFNPTNSSSNLGHKIPGVSKISSSLLDLSHC

SEQ ID NO: 1951 - DNA, 849 bp, Streptococcus agalactiae
atggctactattcaatggttcccaggacacatgtccaaagctcgccgtcaagttcaagaaaatattaagcatgttgattttgttacaattttagtggatgcaaggttacctctttctagtcaaaatccaatgctaaccaaaatcgtcggagacaaacccaaactaatgatcctcaataaagctgatctagcagatcctattcgaactaaagaatggagagatttttatgaatctcaaggtttaaagacattagctattaattctaaagaacaatcaacagttaaaaaagtaaccgacatcgctaaaatattaatgtccgataaaattgctaatctacggggacgtggtattcaaaaagagacacttcgtacgatgattattggaattccgaatgcaggtaaatcgactctaatgaatcgcctagcaggtaaaaaaattgcagtggttggtaataaaccaggtgtcacaaaaggtcagcaatggctcaaatctaataaggaactggaaattttggacactcctggtatcttgtggcccaaatttgaagatgaattagttggattaaagctagcattaacaggggcaatcaaagatcaattattgcctatggatgaggtaacaatatttggattgaattactttaaaacctattatcctgatcgtctcaaagagcgttttaaaagcattaatttagaggatgaagctcctgaaatcatcatggccttaacacaaaaattaggttatcgtgacgattacgatcgcttttataatttatttgtcaaagaagttcgcgatggtaaattaggacgctatacgttagatatcgtcggagaacatgatggcaacaat

SEQ ID NO: 1952 - protein, 283 aa, Streptococcus agalactiae
MATIQWFPGHMSKARRQVQENIKHVDFVTILVDARLPLSSQNPMLTKIVGDKPKLMILNKADLADPIRTKEWRDFYESQGLKTLAINSKEQSTVKKVTDIAKILMSDKIANLRGRGIQKETLRTMIIGIPNAGKSTLMNRLAGKKIAVVGNKPGVTKGQQWLKSNKELEILDTPGILWPKFEDELVGLKLALTGAIKDQLLPMDEVTIFGLNYFKTYYPDRLKERFKSINLEDEAPEIIMALTQKLGYRDDYDRFYNLFVKEVRDGKLGRYTLDIVGEHDGNN

SEQ ID NO: 1953 - DNA, 846 bp, Streptococcus pyogenes
atggcaatgattcaatggtttcctgggcacatgtccaaagccagaagacaggttcaggaaaatgtaaagcatgttgactttgtaactattttagtggatgcacgcttaccactttctagtcaaaatcccatgcttacaaaaattgttggtgataaacctaaattaatgattttaaataaagctgacttggccgatgccactcgtacgaaagagtggaaggcttattatgaaagtcaaggtattaaaacattagccatcaattccaaagaacaatcaacggttaaaaaagtaacagaagcagccaaggaactcatggctgataaaattcaacgcttgcgagagcgcggcattcaaaaagaaaccttgcgaaccatgattattggcattccaaatgctggtaaatctaccttgatgaatcgcttggctggtaagaaaattgctgtagttggcaataaacctggtgtgactaaaggacaacaatggttgaagtccaataaggaattggaaattctagacactcctggtattttatggccaaaatttgaggacgaattggtgggcttaaaattagctttaacaggtgctatcaaggaccaattactaccaatggatgaagtgactatctttggcttgaattactttagggaatactaccctaatcgtttaaccaaacgttttaagaatattcctcttgaggaagaagctcctgaaatcattatgaccttgacacgccaacttggatttaaagacgattatgaccgtttttacactttattcgttaaggaagttcgtgatggtaaattaggtcaatacaccttagatcaggtgggagatatggatgccgac

SEQ ID NO: 1954 - protein, 282 aa, Streptococcus pyogenes
MAMIQWFPGHMSKARRQVQENVKHVDFVTILVDARLPLSSQNPMLTKIVGDKPKLMILNKADLADATRTKEWKAYYESQGIKTLAINSKEQSTVKKVTEAAKELMADKIQRLRERGIQKETLRTMIIGIPNAGKSTLMNRLAGKKIAVVGNKPGVTKGQQWLKSNKELEILDTPGILWPKFEDELVGLKLALTGAIKDQLLPMDEVTIFGLNYFREYYPNRLTKRFKNIPLEEEAPEIIMTLTRQLGFKDDYDRFYTLFVKEVRDGKLGQYTLDQVGDMDAD

SEQ ID NO: 1955 - DNA, 570 bp, Streptococcus agalactiae
atgagaaaacgttcaattttgccaatattagctgtcttatttgttttcatgagtatctttagcgtatattctatttttcgtggtgataaagccaaagaaaaagcaagtgtcataaaacaagcatctcaaacaagtcaaacttcaaaaaaagargtcttacaaaagaagacttatccaaatctaaataaatattcaaatctagaaattcatgtttcatctacgaggcaaacaatgacaataacctcgaatgacaaggtcatctttaaaacgattgtttcaacaggagcaaaagagagccctaccccaaaaggaacttttgtcatagaaccggaacgaggagattttttctataacgcctcatcaaaagaaggagcctattattgggtctcctttaaagaacatggtatttatctctttcatagcgttccgactgatcaacaaggaaatgagattccagaagaagcaaagcaattaggaaaagccgcctcacatggctgtgtgcgtatgtcaagggcggatgcaaaatggttctatgaaaatattcctcaaggaacgactgttaccatcaaa

SEQ ID NO: 1956 - protein, 190 aa, Streptococcus agalactiae
MRKRSILPILAVLFVFMSIFSVYSIFRGDKAKEKASVIKQASQTSQTSKKEVLQKKTYPNLNKYSNLEIHVSSTRQTMTITSNDKVIFKTIVSTGAKESPTPKGTFVIEPERGDFFYNASSKEGAYYWVSFKEHGIYLFHSVPTDQQGNEIPEEAKQLGKAASHGCVRMSRADAKWFYENIPQGTTVTIK

SEQ ID NO: 1957 - DNA, 1482 bp, Streptococcus agalactiae
atggtaacatttttaggaggggtagcccttttaattgttggttatttcacgtacggtagatacattgaaaagaattttcaaattgatgaaaatcgccaaacacctgcagaagcattaagggatggatatgattttgttcctatgccaaaatggaagaatgggatgattgagttattgaacatcgcaggaaccggacctatctttggccctattttaggagcactctatggtccagttgcttatatctggatagtcttaggatgtatttttgcaggggctgttcatgattatatgattggaatgatttctcttagaaataatggtgcatatcttcctgaattagctagtcgctatcttggaaagtcaatgaagcatgtgatcaacattttttcaatgctattacttattttagttgcaaccgtatttgtggtaactccagctaatcttatcctaagtattttaccagctgggacactatctttaccttggataatcggtcttattttcgtttattaccttatttctacagtcttacctattgataaagcacttggtaaagtttatcctgtattctgcgtcatcttaatggttagtacggcagcagttggcttccgtttattaactggtggctttgatatgccaaacttaacttttgaaacctttaaaaatatgcatccagctgggcttgggatattccctgctttattctttaccatttcatgtggagccatctctggtttccatgctacccaagcacctatggtctcaagaacaactgttaatgagagagaagggcgtttcactttctacggcatgatgattgcagaaggagtaattgcgatgatttgggcaggtgcttcaatgagcttgttcaaaggtcaaaatctctatgaaatgattgctgctgggacaccttctgcagttgtcaatcaagtaatgttaatgttactcggtagtgtaattggaactatcgctatcattggtgttattgttctccctgtttcatctggtttatcagctttccgtagcttacgtactatcgttgctgattatatccatgtcaaacaagatactcttccaaaaatctttgctgtaactatcccattatatgttatttcatttgtccttacacacgttgattttaatctcctatggcgttactttaactgggcaaatcaagtaactgctgttattggtttattagttgctacaagatatctcatcctaaaaagacgaaattattgggtaacatttgtaccagctatgttcatgttgtatgcagtagttgtttatattttatctcaaccaattggatttaatatgggcttaggcatcttaacttattcacttgctttagtgttaacaggtattcttgttggacttttctggaaatctggtcaaaaacaattaaaaactgttcatcctgaagcattcctgtttaacgatcatagaccaattaattattacagtagtttagattct

SEQ ID NO: 1958 - protein, 494 aa, Streptococcus agalactiae
MVTFLGGVALLIVGYFTYGRYIEKNFQIDENRQTPAEALRDGYDFVPMPKWKNGMIELLNIAGTGPIFGPILGALYGPVAYIWIVLGCIFAGAVHDYMIGMISLRNNGAYLPELASRYLGKSMKHVINIFSMLLLILVATVFVVTPANLILSILPAGTLSLPWIIGLIFVYYLISTVLPIDKALGKVYPVFCVILMVSTAAVGFRLLTGGFDMPNLTFETFKNMHPAGLGIFPALFFTISCGAISGFHATQAPMVSRTTVNEREGRFTFYGMMIAEGVIAMIWAGASMSLFKGQNLYEMIAAGTPSAVVNQVMLMLLGSVIGTIAIIGVIVLPVSSGLSAFRSLRTIVADYIHVKQDTLPKIFAVTIPLYVISFVLTHVDFNLLWRYFNWANQVTAVIGLLVATRYLILKRRNYWVTFVPAMFMLYAVVVYILSQPIGFNMGLGILTYSLALVLTGILVGLFWKSGQKQLKTVHPEAFLFNDHRPINYYSSLDS

SEQ ID NO: 1959 - DNA, 732 bp, Streptococcus agalactiae
atgaaagttttagtagttgatgatgaaccagttgcacgtaacgaattaatttaccttcttaataagtatgattctaacctcgttatagcagaggcgcatgatatggctactgcattagctattttacttagagaaacttttgatgtagcactgttagatatccatctcagagatgattctgggttgcaattagcagagtatatcaataaaatgcccaaaccaccattattgatatttgcgactgcttatgatcaatatgctattcaggcttttgagcatgatgcgcgtgattatttgttaaaaccctatgattttgataggctaaagcaagctatggatagagtaaaaggagcgctaagtacatctacaattatagagagcgtaacttccggtcctctcttcaagcaacagtatccattgacagtagaagatcgaatctatctggtgtcggcggatgatatccttttgattgaagctatgcaaggaaaactgattatacaaacacctgataaaaattatgaaattgatggctctctacaacaatggcaagataaactaccatcatctcaatttgtacgggtacatcgctcttacattgtgaacattaatgctattaaaacgattgaaccttggtttaaccaaacacttcagttacacctttgtaataaaataacagttcctgttagcagagcaaatgtaaaacccctaaaacaaatgttaggcatatctacc

SEQ ID NO: 1960 - protein, 244 aa, Streptococcus agalactiae
MKVLVVDDEPVARNELIYLLNKYDSNLVIAEAHDMATALAILLRETFDVALLDIHLRDDSGLQLAEYINKMPKPPLLIFATAYDQYAIQAFEHDARDYLLKPYDFDRLKQAMDRVKGALSTSTIIESVTSGPLFKQQYPLTVEDRIYLVSADDILLIEAMQGKLIIQTPDKNYEIDGSLQQWQDKLPSSQFVRVHRSYIVNINAIKTIEPWFNQTLQLHLCNKITVPVSRANVKPLKQMLGIST

SEQ ID NO: 1961 - DNA, 1737 bp, Streptococcus agalactiae
atgacactctttttaattatgatggagcgagcggggttaatcatattattagcctatgcctttgtgcatatcccctttataaaacaaactttgaagcaacccgaattaaaaaaacaccagtatattctgcttatcttatttagcttatttgctattatttctaattttacaggggtagaaattcagtcagatttatctatcattccacaaactcttaatcatatagcagatcaatcatcggttgccaatacacgtgttttaaccattggtgtatcaggtctaatcggtggccccatagtcggtattatagttggtctcttatctgtattcgttaggtatttgcaaggaggattagcccctcatatttatgtcatttcttccttactaattggtttatgctctggattatcaggcaattatcttcgtaaaaattataataaaattcgtgttttagatgcaatggttgttggtttcggtatggaaattctacaaatgatctgtatcctcatttttagtgttgactttaatcaggcgcttcgcttagtatcttttatcagcatgccaatgattttaagtaatactttaggtttaggtatatttatatccattatttcatctactcaaaaattagaagaacatgctaaagcatttcaaacccatcaagtacttgaattagcaaatttaacccttccttaccttagaaagggactgacaacagaatcttgtcaaccagtagctgaaattattcataaacatatggatgtgagtgctgttagcctgactagtcaatcagccattttagcctatgtaggagatggagctgaccatcatcttcctaatactcaaatattaacaaagcttgctaaaagagcaatagatactggtaaagttagtgtcgcaactgataaaagtgaaatcgaatgcgaccataagaattgcccacttagttcagcaattgttattccattacacatccacgatgttatagtgggtactttgaaattatatttttcagacgcacaacatatgacttacgttgaccgtcaattagctgaaggattaggcaatatcttttccactcagttagctttgggacaagctgaggaagcaacaaggttactacaggatgcggaaatgaagtctctccaagcgcaggttaatccgcattttctttttaatgcacttaatactatttatggtttaattcgcatggatagcgaaaaagcaagaaagctcgtccaagattttagcaaggttattcgtgctaatcttcaacgggcaaagcaaaatttaattcctcttcatgatgaattggaacaggttaacgcctatttagcccttgaagaagcaagatttcccaacatggtggcctttaatttagacaaccaaacaaattcagatgacaacttaatgattcctccctttacattgcaggtcttgattgaaaactcttataaacacgcttttaagcatgttaataaaaataaccagctaaaggttactattgcaagaaataatgataggcttcatatcattgtccaagacaatggtattgggattccaaaagaaaaattaataacgcttggaaaaaaaactcaaatttcaaaacaaggttctggtacagctattgagaatctcgttcgtcgcttgaatattatttatgatggacaagcaagtttaaaatttgaatcaaatgattcaggaacttgtgctattgttaatatccccattaaaaat

SEQ ID NO: 1962 - protein, 579 aa, Streptococcus agalactiae
MTLFLIMMERAGLIILLAYAFVHIPFIKQTLKQPELKKHQYILLILFSLFAIISNFTGVEIQSDLSIIPQTLNHIADQSSVANTRVLTIGVSGLIGGPIVGIIVGLLSVFVRYLQGGLAPHIYVISSLLIGLCSGLSGNYLRKNYNKIRVLDAMVVGFGMEILQMICILIFSVDFNQALRLVSFISMPMILSNTLGLGIFISIISSTQKLEEHAKAFQTHQVLELANLTLPYLRKGLTTESCQPVAEIIHKHMDVSAVSLTSQSAILAYVGDGADHHLPNTQILTKLAKRAIDTGKVSVATDKSEIECDHKNCPLSSAIVIPLHIHDVIVGTLKLYFSDAQHMTYVDRQLAEGLGNIFSTQLALGQAEEATRLLQDAEMKSLQAQVNPHFLFNALNTIYGLIRMDSEKARKLVQDFSKVIRANLQRAKQNLIPLHDELEQVNAYLALEEARFPNMVAFNLDNQTNSDDNLMIPPFTLQVLIENSYKHAFKHVNKNNQLKVTIARNNDRLHIIVQDNGIGIPKEKLITLGKKTQISKQGSGTAIENLVRRLNIIYDGQASLKFESNDSGTCAIVNIPIKN

SEQ ID NO: 1963 - DNA, 1725 bp, Streptococcus pyogenes
ttgatgagtgttaaaacattgggaaggtatgtgactaaccactttaagcagggttttttgattaatcgactgatgaaattatatagcctgctaattgtaagttttttcactttagcagctattggcttgagcagttattctattagtagtacttataaaagggtggatgctgaggcgcagatgcgattggaggagactctaggtagattgcagtcacaaaacgatattaccctacgggttttagaccagttggttggccgttcagaagattaccataatctctatcaatacatgacgttaaccccaaaccaatatttttcaaacgtttttgaagactgggaaaaaggaaaagacacggtcctattttctgaagaggtgaggcgtctttttgacttgtaccctgatgtgacttctatgaccctactgctagaggacagtagtgcttatctgtacgccgataaggtcattaagacgggtcgtttgctttatagcaagcctgaaaaagtaaccggaaatgttttagttcgctctattcgaaatccagaatcaggagatgtgacaggtcgtctttacctgacctttgacaaaccaccgactttggtagagacacagcaggatcactatttagctacttttgcttttgattactatggccgcaaactcttccatcaaggaggtcggagatttcctcatttagaggctgaggttaaaaaggctatcaaggcagatcgggcagctgatcttagtaatcttagcaaggcttatcggatgcagtacaatcgctcgggagacctcttggcttatgtggctgtcagaaaatcctatttattagcggaagctgtcaggacagtttttgtgtatggccttgtttctctacttttagcttggctgttattgcagttgctctttagggttttccgaaattatatccagcaggtttctgaaattacggatactgttgaaatggttgcagcaggcgatttgtctttaaccatcgacaacagccacatggaattggaactgtatcatatctcagaagccattaatcagatgttggccagcattaaagcttatattgacgaagtttatgtgttagaggtagagcaacgagatgcccaaatgagagctctgcagtctcaaatcaaccctcattttttatacaacacgttagagtatattcggatgtacgcccttagttgtcaacaagaagaattagcagatgtcatttatgcctttgcgagtctgcttcgcaacaatattagccaagataagatgaccaccttaaaagaagaactggctttttgtgaaaagtacatttacctttatcaaatgcggtatccagatagcttcgcttatcatgtaaaaattgatgagagtgttgctgacttagccattcctaaatttgtcattcaacctctcgttgaaaattattttgtgcatgggattgattatagtcgccatgacaatgcactaagcatcaaggctttagatgagacggatcatctcttgattcaggtgcttgataatggacgtggtattagtcaagagcgcttagcagatatggaaaaaaggcttcaagagcaccaaacaacaggcaatagctctattggtttgcaaaatgtttacctccgtctctttcatcattttcgagacagggtttcttggtccatggctaaggagccaaatggtggctttatcattcaaattaggattagaaaggatgct

SEQ ID NO: 1964 - protein, 575 aa, Streptococcus pyogenes
LMSVKTLGRYVTNHFKQGFLINRLMKLYSLLIVSFFTLAAIGLSSYSISSTYKRVDAEAQMRLEETLGRLQSQNDITLRVLDQLVGRSEDYHNLYQYMTLTPNQYFSNVFEDWEKGKDTVLFSEEVRRLFDLYPDVTSMTLLLEDSSAYLYADKVIKTGRLLYSKPEKVTGNVLVRSIRNPESGDVTGRLYLTFDKPPTLVETQQDHYLATFAFDYYGRKLFHQGGRRFPHLEAEVKKAIKADRAADLSNLSKAYRMQYNRSGDLLAYVAVRKSYLLAEAVRTVFVYGLVSLLLAWLLLQLLFRVFRNYIQQVSEITDTVEMVAAGDLSLTIDNSHMELELYHISEAINQMLASIKAYIDEVYVLEVEQRDAQMRALQSQINPHFLYNTLEYIRMYALSCQQEELADVIYAFASLLRNNISQDKMTTLKEELAFCEKYIYLYQMRYPDSFAYHVKIDESVADLAIPKFVIQPLVENYFVHGIDYSRHDNALSIKALDETDHLLIQVLDNGRGISQERLADMEKRLQEHQTTGNSSIGLQNVYLRLFHHFRDRVSWSMAKEPNGGFIIQIRIRKDA

SEQ ID NO: 1965 - DNA, 123 bp, Streptococcus agalactiae
gtgatgtttaaaggatttaaaaaattgattattattatgggagggataagcttaatgatgattttaacagcatgtgacttagtaaaaaaaatcaccaatgggttcaagaacattgaaaatact

SEQ ID NO: 1966 - protein, 41 aa, Streptococcus agalactiae
MMFKGFKKLIIIMGGISLMMILTACDLVKKITNGFKNIENT

SEQ ID NO: 1967 - DNA, 681 bp, Streptococcus agalactiae
ttgaaacagagcaaccatagatatcatggaccgttaattgagtttgaaatagaatattcatatattaaaatttttccatggattggactatttatatcttgcatagggttatatgcaagtaattttggtgatcctttaggttttataaaattcatattttctgtatgcatttttgttaatttggtctcaataattatttcgcttttttttaaaaaaatatctaattttttaaaaaaaatttcttatattttattatcattagtattcctaacacttattataggttttgattttataggcttggcaatgtttttaaataatagaaattttggacatgttcaatcaatttattatactgagatggcaaaaatgtatattatgataatgttaattatttttattgtattttctggaatatattatttctattatttaccaaaaaatcaggggaaaaaatggaaatttaatcagtggaaattacaaaaaggaaaaaaggaacaattaaaaattaattatggaattatttttggtttagtgatgctttctccagtctttcttgtaggtagtattgaaaatatttttggtttgattggaggtgtattatttacggcaacttttccagctctgattgtcgattccctttatgcagcatattatattcataagcatcccgaatatgag

SEQ ID NO: 1968 - protein, 227 aa, Streptococcus agalactiae
MKQSNHRYHGPLIEFEIEYSYIKIFPWIGLFISCIGLYASNFGDPLGFIKFIFSVCIFVNLVSIIISLFFKKISNFLKKISYILLSLVFLTLIIGFDFIGLAMFLNNRNFGHVQSIYYTEMAKMYIMIMLIIFIVFSGIYYFYYLPKNQGKKWKFNQWKLQKGKKEQLKINYGIIFGLVMLSPVFLVGSIENIFGLIGGVLFTATFPALIVDSLYAAYYIHKHPEYE

SEQ ID NO: 1969 - DNA, 321 bp, Streptococcus agalactiae
ttgaataatgcagcaataaaatcccttaaaaatgaagtccttgaattaaatcccaaaaatgcttttaaaggatggggaaaattaggaagaattgctaaagctggtaaagtattaggttggactgggaaaatagtcaatatagaaactaatgccaaaaaagacttttttgatgataagacttctacactagatcaaaaaatcaaaaactttgctatagattcaggtgtagatgcattgtccggtgcagcaataggaactttggtaggaggacctgtgggaaccgttgttggagcagtgcagggctggcatttgattttgctt

SEQ ID NO: 1970 - protein, 107 aa, Streptococcus agalactiae
MNNAAIKSLKNEVLELNPKNAFKGWGKLGRIAKAGKVLGWTGKIVNIETNAKKDFFDDKTSTLDQKIKNFAIDSGVDALSGAAIGTLVGGPVGTVVGAVQGWHLILL

SEQ ID NO: 1971 - DNA, 102 bp, Streptococcus agalactiae
atggaattcaatgcggaatcctcaacagtcttttgtggactaacagaagttcaggatgtcgtttcggcaggccttaactattctcagaaggttttggaaatt

SEQ ID NO: 1972 - protein, 34 aa, Streptococcus agalactiae
MEFNAESSTVFCGLTEVQDVVSAGLNYSQKVLEI

SEQ ID NO: 1973 - DNA, 531 bp, Streptococcus agalactiae
atgggaaatgataatgtaactataaaactagaacatcgggttaaaacatcagcagatttatcagattatgtatacaaatatgagagggcttatacagatgctttaaataatggtgatgacataaaagaagcaagtgaaagtactaaaaaagagttaaatcaactaattgatagaactgatttaacttatagtgacggtatgtatgacaaagagactggtattgcagctattgctgtaaaagataaaaatactggtgagacttatatagcttatgcgggtactaataaggatgctgatggggcaaccgactttatttcagatgcaaatatcggtgctaataactctgcttatttaaaacgattaggagacaaagctactagcttttatgatcgtgttcaaagtaatggcgataatattactgtcacaacaggtcattcttatggtgactttctcgcttctagagtggcaattgagctaattccattctttattaactttagaaaagttaatgattcatttcacttttgttat

SEQ ID NO: 1974 - protein, 177 aa, Streptococcus agalactiae
MGNDNVTIKLEHRVKTSADLSDYVYKYERAYTDALNNGDDIKEASESTKKELNQLIDRTDLTYSDGMYDKETGIAAIAVKDKNTGETYIAYAGTNKDADGATDFISDANIGANNSAYLKRLGDKATSFYDRVQSNGDNITVTTGHSYGDFLASRVAIELIPFFINFRKVNDSFHFCY

SEQ ID NO: 1975 - DNA, 144 bp, Streptococcus agalactiae
atgagagataaatttaaaatatctgatattaaggaagcagatattacttttacaaaaagtggaaaaaataattttgactatacactaaggataaaaactaaaaacaagagatactatttgggtgagacctatagttttagaaaa

SEQ ID NO: 1976 - protein, 48 aa, Streptococcus agalactiae
MRDKFKISDIKEADITFTKSGKNNFDYTLRIKTKNKRYYLGETYSFRK

SEQ ID NO: 1977 - DNA, 549 bp, Streptococcus agalactiae
atgaaaaaacaaaaactattactgcttattggaggcttattaataatgataatgatgacagcatgtaaggattcaaaaatcccagaaaaccgcacaaaggaagagtaccaagctgaacaaaattttaaaccgttttttgagtttttagcacaaaaagataaagatttgagcaaaatacaaaaatacttactattagtatcggattcaggtgatgcattagatttagaatatttctatagtattcaagatttaaaaaaaaataaggatttagggaagtttgaaacaagaaaaagtcaaatagaaaagccgggtggctataatgagttagaaaataaagaggtcccatttgaatattttaaaaataatatagtttatccaaaaggaaaaccgaatattacatttgatgactttattatcggagcaatggatactaaagaattaaaagaattaaaaaaattaaaagtaaaaagttatttattaaaacatccggaaactgagttgaaagatataacatatgaattgccgacacagtcgaagcttattaaaaaa

SEQ ID NO: 1978 - protein, 183 aa, Streptococcus agalactiae
MKKQKLLLLIGGLLIMIMMTACKDSKIPENRTKEEYQAEQNFKPFFEFLAQKDKDLSKIQKYLLLVSDSGDALDLEYFYSIQDLKKNKDLGKFETRKSQIEKPGGYNELENKEVPFEYFKNNIVYPKGKPNITFDDFIIGAMDTKELKELKKLKVKSYLLKHPETELKDITYELPTQSKLIKK

SEQ ID NO: 1979 - DNA, 447 bp, Streptococcus agalactiae
ttgacagaacaacaaattgaatatatcaataatcgaagtgaaatagcagggcatttagaagctattgtttcagaaatctatttaatagaagaatctggtaaaatagaatcatggtttgttactattcctgatatgaatagttttgtggcagaaacaaatatggatagagaacagattttattcttacttgactcggctcacaaatatcatatttatttcttatttggtggtttagcatcataccttatgactaatatctcagatgttccaaaagctattagaacacaggcacagtatgttctcttaggaatgagagttatggatcagtcagtattaccgaaatcatataattcaaaagaaccttatttgaaaccagatatgatttatattcatgatagaagacaagaaagaatgcttaaaatcactcaagaaatagaaatggagcat

SEQ ID NO: 1980 - protein, 149 aa, Streptococcus agalactiae
MTEQQIEYINNRSEIAGHLEAIVSEIYLIEESGKIESWFVTIPDMNSFVAETNMDREQILFLLDSAHKYHIYFLFGGLASYLMTNISDVPKAIRTQAQYVLLGMRVMDQSVLPKSYNSKEPYLKPDMIYIHDRRQERMLKITQEIEMEH

SEQ ID NO: 1981 - DNA, 258 bp, Streptococcus agalactiae
atgggtaatggtggcgattggaaaaataagccgggctatcaaaccacacacgaggcaaaaacaggctacgccatctcatttagccccggccaagctggtgctgatagaacttacggccacgtggccatcgtcgaagacgttaaggaagacggatctatcccgatctccgaatcaaatgtcctaggacttggcaccatctcctaccgcaccttcagtgcagcagaagcagcacaattgacttatgtagttggggagaag

SEQ ID NO: 1982 - protein, 86 aa, Streptococcus agalactiae
MGNGGDWKNKPGYQTTHEAKTGYAISFSPGQAGADRTYGHVAIVEDVKEDGSIPISESNVLGLGTISYRTFSAAEAAQLTYVVGEK

SEQ ID NO: 1983 - DNA, 1623 bp, Streptococcus pyogenes
atgaagaaaaggaaattgttagcagtaacactattaagtaccatactcttaaacagtgcagtgccattagttgttgctgatacctccttgcgtaatagcacatcatccactgatcagcctactacagcagatactgatacggatgacgagagtgaaacaccaaaaaaagacaaaaaaagcaaggaaacagcgtcgcagcacgacacccaaaaagaccataagccatcacacactcacccaacccccccttcaaatgatactaagcagaccgatcaggcatcatctgaagctactgacaaaccaaataaagacaaaaacgacaccaagcaaccagacagcagtgatcaatccaccccatctcccaaagaccagtcgtctcaaaaagagtcacaaaacaaagacggccgacctaccccatcacctgatcagcaaaaagatcagacacctgataaaacaccagaaaaatcagctgataaaacccctgaaaaaggaccagaaaaagcaactgataaaacaccagagccaaatcgtgacgctccaaaacccatccaacctcctttagcagctgctcctgtctttataccttggagagaaagtgacaaagacctgagcaagctaaaaccaagcagtcgctcatcagcggcttacgtgagacactggacaggtgactctgcctacactcacaacctgttgtcacgccgttatgggattactgctgaacagctagatggttttttgaacagtctaggtattcactatgataaagaacgcttaaacggaaagcgtttattagaatgggaaaaactaacaggactagacgttcgagctatcgtagctattgcaatggcagaaagctcactaggtactcagggagttgctaaagaaaaaggagccaatatgtttggttatggcgcctttgacttcaacccaaacaatgccaaaaaatacagcgatgaggttgctattcgtcacatggtagaagacaccatcattgccaacaaaaaccaaacctttgaaagacaagacctcaaagcaaaaaaatggtcactaggccagttggataccttgattgatggtggggtttactttacagatacaagtggcagtgggcaaagacgagcagatatcatgaccaaactagaccaatggatagatgatcatggaagcacacctgagattccagaacatctcaagataacttccgggacacaatttagcgaagtgcccgtaggttataaaagaagtcagccacaaaacgttttgacctacaagtcagagacctacagctttggccaatgcacttggtacgcctataatcgtgtcaaagagctaggttatcaagtcgacaggtacatgggtaacggtggcgactggcagcgcaagccaggttttgtgaccacccataaacctaaagtgggctatgtcgtctcatttgcaccaggccaagcaggagcagatgcaacctatggtcacgttgctgttgtagagcaaatcaaagaagatggttctatcttaatttcagagtcaaatgttatgggactaggcaccatttcctatcggacgttcacagctgagcaggctagtttgttgacctatgtcgtaggggacaaactcccaagacca

SEQ ID NO: 1984 - protein, 541 aa, Streptococcus pyogenes
MKKRKLLAVTLLSTILLNSAVPLVVADTSLRNSTSSTDQPTTADTDTDDESETPKKDKKSKETASQHDTQKDHKPSHTHPTPPSNDTKQTDQASSEATDKPNKDKNDTKQPDSSDQSTPSPKDQSSQKESQNKDGRPTPSPDQQKDQTPDKTPEKSADKTPEKGPEKATDKTPEPNRDAPKPIQPPLAAAPVFIPWRESDKDLSKLKPSSRSSAAYVRHWTGDSAYTHNLLSRRYGITAEQLDGFLNSLGIHYDKERLNGKRLLEWEKLTGLDVRAIVAIAMAESSLGTQGVAKEKGANMFGYGAFDFNPNNAKKYSDEVAIRHMVEDTIIANKNQTFERQDLKAKKWSLGQLDTLIDGGVYFTDTSGSGQRRADIMTKLDQWIDDHGSTPEIPEHLKITSGTQFSEVPVGYKRSQPQNVLTYKSETYSFGQCTWYAYNRVKELGYQVDRYMGNGGDWQRKPGFVTTHKPKVGYVVSFAPGQAGADATYGHVAVVEQIKEDGSILISESNVMGLGTISYRTFTAEQASLLTYVVGDKLPRP

SEQ ID NO: 1985 - DNA, 807 bp, Streptococcus agalactiae
gtggtgccaagccaacctcaagtgacagcaacacctcagaaatctgaagttgtgacaccagccattacgagtggcattgatttgccagatgttgccatacctacggcaatggctagcgcagcttatgtcaaacactggataggcaatgatgcttatacacacaatctattgtctcaccgttacggcattactgccgcacagcttgatggattcttacagtcgacaggtatcacatacgatagcagtcgcatcgacggtcaaaaaatcttagaccgagagaaatcatctggtctggatgcgcgtgcaatcattgccattgctatcgcagaaagttcgcttggtacacaaggcgttgccacagcaccaggtgctaatatgtttggttttggggcagttgacaacaatacaactaacgctcaaaactttagtgatgacaaggctgtcattaaaatgacgcaggaaaccatcatccaaaaccaaaacaccagctttgccattcaagaccaaaaagcacaattcttgtcaactggcaacttgaatgtagcggctcgaggtggggtttacttcacggatgctagcggttctggtaaacgtcgtgcggccattatggagagcattgacaagtggattgacgcgcatggcggaatttctgagatttcaaaggaactgctcaacacgtcgtccgtcgctatgatggcagtcccaacgagttactctgtttcaagagctaatcaagcgggcaactatgtggcaggcacttacccttggggccaaagaacttggctaccagtttggaccatttatggg

SEQ ID NO: 1986 - protein, 269 aa, Streptococcus agalactiae
MVPSQPQVTATPQKSEVVTPAITSGIDLPDVAIPTAMASAAYVKHWIGNDAYTHNLLSHRYGITAAQLDGFLQSTGITYDSSRIDGQKILDREKSSGLDARAIIAIAIAESSLGTQGVATAPGANMFGFGAVDNNTTNAQNFSDDKAVIKMTQETIIQNQNTSFAIQDQKAQFLSTGNLNVAARGGVYFTDASGSGKRRAAIMESIDKWIDAHGGISEISKELLNTSSVAMMAVPTSYSVSRANQAGNYVAGTYPWGQRTWLPVWTIYG

SEQ ID NO: 1987 - DNA, 1509 bp, Streptococcus pyogenes
atgaataaaaacaaactattaagagttgccatgctactaagtctcttagccccgacagcagaaagcatgacagtgctggctcaagatgtaatgcttgagacgcataaagcaactacaaatgaaaccagtgattcttcttcaaaagaggaaaataataaaaatgcagcacctacaacatcagataaaactgaccaaggtccccttgatgcttctgcagaaacaaactctaatagtcttgttaacgcggatgataaaaaaagaagcgattctagtcagtctgctataggctcttcggacaacaaggcagaagcagaaaaccaggtagatgataaatcaactgatcattcgaaatcaactgatcattcgaaaccaactgaccagcccaaaccatcaccatctaaagttgatacggcacctgcttcttcattgtcgaaacaactgccagaggcaagaactcctattcagtcgttgtccccttacgtatcagatttagatttgagtgagatagatatcccttctgtcaacacatacgcggcatatgtagagcattggagtggtaaaaatgcctatacccaccatcttttatctcgccgttatggtattaaagctgaccagattgatagttacttaaaatcaacaggcattgcctatgacagcacacgtattaatggtgagaagctattgcaatgggaaaagaaaagtgggctggatgttcgagctatcgtagctattgcgatgtctgagagttctttaggaactcaagggattgcaactttgcttggagctaatatgtttggctatgcagcttttgatctagatccgactcaagcaagtaagtttaatgatgatagtgctattgtcaaaatgacacaagacaccattattaaaaacaaaaatagcaattttgcacttcaagatttaaaagcggctaagttttcacgaggtcaattaaactttgcaagtgacgggggtgtttattttactgatactactggtagtggtaaacgtcgcgcacaaattatggaagacctggataagtggattgatgaccatggtggcacaccagccattccagccgaattgaaagtgcagtcatcagctagttttgcatctgtgccagcaggttataagctctctaagagttatgatgtcttgggttatcaagcttcgagttatgcttggggacaatgcacttggtatgtgtataatcgcgccaaagaattgggttaccaatttgatccttttatgggaaatggtggagattggaagtataaagtagggtatgccctttcaaagactccaaaagtaggttatgctatttcatttgcaccagggcaagcgggcgctgatggcacttatggccacgtatcaattgtagaagatgttagaaaagatgggtctattcttatttcagagtctaactgtatcggcttaggtaagatttcttatcgtacctttacagctcagcaggctgaacagctaacatatgttattggcaagagtaaaaac

SEQ ID NO: 1988 - protein, 503 aa, Streptococcus pyogenes
MNKNKLLRVAMLLSLLAPTAESMTVLAQDVMLETHKATTNETSDSSSKEENNKNAAPTTSDKTDQGPLDASAETNSNSLVNADDKKRSDSSQSAIGSSDNKAEAENQVDDKSTDHSKSTDHSKPTDQPKPSPSKVDTAPASSLSKQLPEARTPIQSLSPYVSDLDLSEIDIPSVNTYAAYVEHWSGKNAYTHHLLSRRYGIKADQIDSYLKSTGIAYDSTRINGEKLLQWEKKSGLDVRAIVAIAMSESSLGTQGIATLLGANMFGYAAFDLDPTQASKFNDDSAIVKMTQDTIIKNKNSNFALQDLKAAKFSRGQLNFASDGGVYFTDTTGSGKRRAQIMEDLDKWIDDHGGTPAIPAELKVQSSASFASVPAGYKLSKSYDVLGYQASSYAWGQCTWYVYNRAKELGYQFDPFMGNGGDWKYKVGYALSKTPKVGYAISFAPGQAGADGTYGHVSIVEDVRKDGSILISESNCIGLGKISYRTFTAQQAEQLTYVIGKSKN

SEQ ID NO: 1989 - DNA, 426 bp, Streptococcus agalactiae
ttgaaaaaagataaatatattgcattgtgtttgttgtgtgcaattgccacgtcaaacttatcggctgttacggtttttgctcaggatgcacaaactattttgacgcaagctacgactgtaactgatcaaacaattgaaaaagctggagaaaattcatcagctgaggcgacaagcgcttctgagtcagtttcatcagaagcgacgacagtggtacctgaggcaagtctgccttcaactgatctccatgcccaaccagcagatagcaaaacagctcctactgagactgtaattgagggacaaacagaaactaatccgacgactagtccagataaacagttccttcaacaagtgattccaaaggagaaacacaggctgggacgcaaacagatacaagcaaacccgaaactccagctcctagtcagtctg

SEQ ID NO: 1990 - protein, 142 aa, Streptococcus agalactiae
MKKDKYIALCLLCAIATSNLSAVTVFAQDAQTILTQATTVTDQTIEKAGENSSAEATSASESVSSEATTVVPEASLPSTDLHAQPADSKTAPTETVIEGQTETNPTTSPDKQFLQQVIPKEKHRLGRKQIQANPKLQLLVSL

SEQ ID NO: 1991 - DNA, 252 bp, Streptococcus agalactiae
atggataaaatacatactctaggaagtgtcattgaattaaaaaatgatagtcagaaagtcatgattacatcaagatttccgttatatgacaatgaaggtcaattgggatattttgattattctggatgtattttcccaattagtatagttggaaatgaaacttattttttcaatttggaagatatagataaagtcttgtttgaaggttactatgatgaaaatgaagaggagatgcaaaaaatatttttgaaa

SEQ ID NO: 1992 - protein, 84 aa, Streptococcus agalactiae
MDKIHTLGSVIELKNDSQKVMITSRFPLYDNEGQLGYFDYSGCIFPISIVGNETYFFNLEDIDKVLFEGYYDENEEEMQKIFLK

SEQ ID NO: 1993 - DNA, 588 bp, Streptococcus agalactiae
ttgatacatagagagaaatcatatgcagaaatatatcatgacggaaatcaaggttattattataattttgatacaaaaattttttacattaaaagttttgaaacgcctaattatcaaaaagaaaatttagaaaatattaaaaaatattctagtattattacgtttcttgttctcatactcattcctattaataattggtatagaacaatagctaatttaaagttgaatttaattcttgcaataatgtttatcgtaattgcactagtagtagttaacaaattaaacaatatagtttcgaaacaaaagagaaatatcgataatattagttacgagaaaatggaatttgacaaagaaaaaatagcaaatataattgtttctgctgaagaattgtcgaataaactgttatttttattagtaatttcattatttatatccctactcctaataatgttatattttaaatactcagtattgatattttttcctatagcacttatgttactaatattatcaagattgttattagaaaatattgatttttttgaaagaaaaaatgcaataaatgaaataaaaaagcaatataatttt

SEQ ID NO: 1994 - protein, 196 aa, Streptococcus agalactiae
MIHREKSYAEIYHDGNQGYYYNFDTKIFYIKSFETPNYQKENLENIKKYSSIITFLVLILIPINNWYRTIANLKLNLILAIMFIVIALVVVNKLNNIVSKQKRNIDNISYEKMEFDKEKIANIIVSAEELSNKLLFLLVISLFISLLLIMLYFKYSVLIFFPIALMLLILSRLLLENIDFFERKNAINEIKKQYNF

SEQ ID NO: 1995 - DNA, 303 bp, Streptococcus agalactiae
atgaagacaggagcacccgtaataattggtagtgctgcaaaagttgtaggaacggctgcgggtaccgcaacagctggactattaatttcaacaggtgtacttgcaccgcctgctcctgttgttggttctgctgtggactttggtgctacagcagtaataggtgtaggtggatcgatggtgttcgattatgtttatgataataaagatgaaataaatcatattataaaaagagcatcgaaggatacaattaacaatgttagtgatttttttgaattaatgtatgattcaacaggtagtataaat

SEQ ID NO: 1996 - protein, 101 aa, Streptococcus agalactiae
MKTGAPVIIGSAAKVVGTAAGTATAGLLISTGVLAPPAPVVGSAVDFGATAVIGVGGSMVFDYVYDNKDEINHIIKRASKDTINNVSDFFELMYDSTGSIN

SEQ ID NO: 1997 - DNA, 912 bp, Streptococcus agalactiae
atggtaaaagttagtgtaagttctgtaggaactcaagcatcaacagtagctatttctatgtttagtcgtgtatcggctttaaatgatgcaataacaaaactatcatcttttgcagaggctgcaactcttcaagggactgcttattcaaatgcaaaaagctatgctactggaacgttaactccgatgcttcaaggaatgattcttttctctgaaacattgagtgagaaatgtacagaattacaaaccttatatgtctcaatttgtggtgatgaggatttagactctgtcgttttagaatcaaaattagcaagtgatagggcatcattaaagattgctgaagcacttttagagcatcttaacgatgatccagaaccttccaaatctgccataagttctacaaaaagtaatattaaaaaattaaaaaaacgtataaaatctaatcaaaagaaattagacaaccttaatgaatttaacgcccattcagcaacagtatttgcggacatttctaatgcacagtcaactgttaaccaagcactagcggctgtttcaacaggattttctggatataatagtaaaaccggagcttttggaaaaccaacatccggacagatggaatggacaaagacagttaagaagaattggaaagagcgagaagacgccaaagctgaagaactgaaaagtaaaaaggctgaagaaagtaagaaagcttcaaaaattgaaaatactactaaaaaaagtaatgtttcagttgataaaaagaaattaataaaagcggctaatgaagcgtataaattaggagaaattaaaaaagatacctatgaatcaattatcagtggtttaagtaatgcatcggctgccttacttaaagaggtagctaaatcaaaattgactgacacagctcggctattgatg

SEQ ID NO: 1998 - protein, 304 aa, Streptococcus agalactiae
MVKVSVSSVGTQASTVAISMFSRVSALNDAITKLSSFAEAATLQGTAYSNAKSYATGTLTPMLQGMILFSETLSEKCTELQTLYVSICGDEDLDSVVLESKLASDRASLKIAEALLEHLNDDPEPSKSAISSTKSNIKKLKKRIKSNQKKLDNLNEFNAHSATVFADISNAQSTVNQALAAVSTGFSGYNSKTGAFGKPTSGQMEWTKTVKKNWKEREDAKAEELKSKKAEESKKASKIENTTKKSNVSVDKKKLIKAANEAYKLGEIKKDTYESIISGLSNASAALLKEVAKSKLTDTARLLM

SEQ ID NO: 1999 - DNA, 360 bp, Streptococcus agalactiae
atgactgaacgaacattcgaagatattgaacttgacttaaagttattccaaataaagcttgataatgctgagaatagtaaaaggctcttacaaaaattgaaaaacgacgtcatggagttacaaatagagttactagaatcattaaaactcggtgatgcctatttaacagaatcagaagaattagaagagaataatgactttattctaacggtaaatagtgaaacactaagtttagaagaatcctatgacaataggataaacttagtttctaaagagattatggattatgaaaatgcattagataagttgtattatgaaaaacagagtttgatgcaaaaaagtaatgaaagaaaaggaggt

SEQ ID NO: 2000 - protein, 120 aa, Streptococcus agalactiae
MTERTFEDIELDLKLFQIKLDNAENSKRLLQKLKNDVMELQIELLESLKLGDAYLTESEELEENNDFILTVNSETLSLEESYDNRINLVSKEIMDYENALDKLYYEKQSLMQKSNERKGG

SEQ ID NO: 2001 - DNA, 255 bp, Streptococcus agalactiae
atggcaaaaatacaaagtgatgcctccgtcgcatccacctgtgcaactgcaatacaatcaggagccagtggaatcacagcagtaggagctccaactaaggattcaaacagtgattatagtggtaatagcgatgcttcaacttacatcgatggagaggcaagtagtagtagccaaattgctgaaaaaataaatgagttcatagctctcattcattctacggtgaatgagtttgaagctattgaccaaaaaattagc

SEQ ID NO: 2002 - protein, 85 aa, Streptococcus agalactiae
MAKIQSDASVASTCATAIQSGASGITAVGAPTKDSNSDYSGNSDASTYIDGEASSSSQIAEKINEFIALIHSTVNEFEAIDQKIS

SEQ ID NO: 2003 - DNA, 3927 bp, Streptococcus agalactiae
atgaaattcaaatctgggggggctgattatgaaacatcattaactaagaaagttatgtcagcttatcaattttacgaaggctatcctgattttcaccgctcacctcgtattatttatcgttccagtgaagataaaattacagttaatgcgcctggtaatgaacctaataagtctaaagatgaactgttaaaattaattgttcctcctctagtgatgattggagtcagcattcttatttctatttttcgtcctcgtggtatctatatcattgcaacaatgtcaatggctctagtgacgatgattttctctatcactggttactttaaaaatcgtaaacagtataagcaggacttacaagaacgcattgattcctatcatgactatttatctgataagtcaattgaacttcagaagttagctaaagagcaaaagcgtgggcaacactatcattacccaacgattgaaggtttacaggaaatggctgatacttatcaccatcgtatttatgaaaagacaccacttcattttgacttcttgtattatcgcctaggtttgggagaagtaccaacgagctataatattcattattctcaaccagaacgttctgggaaaaaagatcctttagagaacgaaggctataacctctactttaacaatcgttatattaaaaatatgccgattgttgcgaatttatcacatggaccagttggctatataggaccacgaggtttagtattggagcaactccaattgatggttaatcaattagcttttttccattcttaccatgatgttcaatttattactattgttccagaggaagagatggataagtggtcttggatgcgttggttgccacatgaaaccttacaagatgtcaatgttcgtggctttgtttataatcaaagaagccgtgatcaagtgctcaacagtcttaaccaaattttaaaattacgtcgcacacaacgcgaagataaatctgccaaagaagggactttattttctccgcattatgtcgttattgtaactgatgaaaagttaattttagatcacgtcatcatggaattctttacggaagatcctacagaattgggatgttctctcatctttgttcaagatgttatgagttcactttcagaaaatatcaaaaccattattaatattaaagaccgtaatactggtcagttagttatagaagaaggagagcttaaagaaacagattttgaattagatcatttcttagaggattatgacaaggaaaatatttcacgtcgcctagctccgttaaatcacctacaaaatcttaaatcttcaataccagaagcagttacttttatggaaatgtatcaagcagaagaatttgaagatttgcatgttcaagagcgttggataagccatgctccgtataaaagctcagctgttccacttggcttacgtggtcaggatgatattgtttatctaaacctacatgaaaaagctcatggtcctcatggattagttgcaggaacaacgggatcagggaagtcagaaattatacagtcctatatcctttctttagctgttaatttccatccacacgatgtagctttccttctcatagactacaaaggtggggggatggcaaacctctttaaggacctgccacacttacttggcaccatcaccaacttagatggtgcccaatcgatgcgtgctttggtttctattaatgctgaattgaaacgtcgtcaacgtttatttgctaaagctgatgttaatcatattaaccagtatcagaagaaatacaaacttggagaagtttcagaaccaatgcctcatctcttcttaatctccgatgagtttgccgaattgaaatccaaccaacctgagtttatgaaagagcttgtctcaacagcgcgaattgggcgttccctagggattcacttaatcctagcgacccaaaaaccatctggtgtggtagatgaccaaatctggtcaaactcacgcttcaaactagctcttaaagtagcagaccgcggcgactccatggaaatgctccatactccagatgccgccgagattacacaagcaggacgtgcctacctccaagttggtaataatgaagtctatgaactcttccaatcagcatggtcaggagcagattaccaacctgaaaaagacgaccaagggattgaagaccataccatttattccatcaacgaccttggccaatacgaaatcctaaatgatgatctttcaggcttagaccaagccgaaaatattaaagaagtacctacggaattagatgctatcgttgaaaacattcaagctttaaccaaagaaatgggcatctcagacttacctcaaccgtggctaccgcctctaagcaatcagattgcagtaaccgatctccgtaaggagggatcagtagacctctggagcaaggccccatcttacaaagctgttcttggctttatggatataccaagccaacaagcacaagaagtggcttaccacgattttgaagacgatgggcatttgtcaatttttgcaggaccaagtatggggaaatccacagcccttcaaactgtaacaatggacttagcacgtcataatagtccagaatttttaaacctttacctctttgattttggtaccaatggcctcttacctctaagacgtttgccacatgtagcagatttctttaccattgatgatgacgaaaaaatagccaagtttattgcccgtatcaaagttgaaatgtctgatcgtaaaaaagccctcagtcgctacaatgtcgcgacagcaaaactttaccgtcaggtatctggggaaaccatgcctcaaatcctgattgttattgacagttatgaagggctacgggaagctcaaacaccgactaacttagaagcttgtttccaaaatatttcgcgtgatgggtcgtcacttggcatttccttagttatctcagctggtcgtacggcagctttgaggtcgtccttaatggcaaaccttaaagaacgtatcgctcttaaattaacagatgactctgaatcacggacacttgtcggtcgtcaccaacacatcatggaagatattccaggacgtggattaatcaaacgtgatgacattgaagtgttacaagtggctctctcaacagaaggcactgaaacctttgacatcatcaataacatccaaaacgaatctgacgccatgaacagcaaatggactggaccaagaccaaaagcaataccaattgttcccgaagaattaacctttgacgactttatggctacagatagtgttcaagctgacctatcagctaatcgtttaccacttgggcttgaaatggttgacgttgaaagttatagtttagcacttaatcgctttaagcatatgctttacatgtctgattctgacgagtcactcgaagcagttggttcccatatcatcaaggtcttgcttaacgtcccaaattaccataacatgatcatcgattcgcttggcgaatatgaaagctatcaaggtcaggtacgtacttatgtgggttctgatatgattgaagatatggcggatcagttgatctatgagttgcagcaacgtgaaagccaatctgagatagctgaatggtttatcatgattccagattttgaaagctttgtggctaagagcaatatgaagcttgaacaggttcaggcattgcttgacaatggaccacgctatggtttacatctgattcttggatcaagctataactatgttgggactaagatcgatgctgtgcctaaatacgttcgcacaacgacccagtatgtgctggctggcatgaggctcatggatcaaaccttccttgaaaaagtgtataatagtaaggaaatccgtccaaacaaagacgaagcctacattcacgatagaaaaacctatcaaaaattaaaactcaccatagac

SEQ ID NO: 2004 - protein, 1309 aa, Streptococcus agalactiae
MKFKSGGADYETSLTKKVMSAYQFYEGYPDFHRSPRIIYRSSEDKITVNAPGNEPNKSKDELLKLIVPPLVMIGVSILISIFRPRGIYIIATMSMALVTMIFSITGYFKNRKQYKQDLQERIDSYHDYLSDKSIELQKLAKEQKRGQHYHYPTIEGLQEMADTYHHRIYEKTPLHFDFLYYRLGLGEVPTSYNIHYSQPERSGKKDPLENEGYNLYFNNRYIKNMPIVANLSHGPVGYIGPRGLVLEQLQLMVNQLAFFHSYHDVQFITIVPEEEMDKWSWMRWLPHETLQDVNVRGFVYNQRSRDQVLNSLNQILKLRRTQREDKSAKEGTLFSPHYVVIVTDEKLILDHVIMEFFTEDPTELGCSLIFVQDVMSSLSENIKTIINIKDRNTGQLVIEEGELKETDFELDHFLEDYDKENISRRLAPLNHLQNLKSSIPEAVTFMEMYQAEEFEDLHVQERWISHAPYKSSAVPLGLRGQDDIVYLNLHEKAHGPHGLVAGTTGSGKSEIIQSYILSLAVNFHPHDVAFLLIDYKGGGMANLFKDLPHLLGTITNLDGAQSMRALVSINAELKRRQRLFAKADVNHINQYQKKYKLGEVSEPMPHLFLISDEFAELKSNQPEFMKELVSTARIGRSLGIHLILATQKPSGVVDDQIWSNSRFKLALKVADRGDSMEMLHTPDAAEITQAGRAYLQVGNNEVYELFQSAWSGADYQPEKDDQGIEDHTIYSINDLGQYEILNDDLSGLDQAENIKEVPTELDAIVENIQALTKEMGISDLPQPWLPPLSNQIAVTDLRKEGSVDLWSKAPSYKAVLGFMDIPSQQAQEVAYHDFEDDGHLSIFAGPSMGKSTALQTVTMDLARHNSPEFLNLYLFDFGTNGLLPLRRLPHVADFFTIDDDEKIAKFIARIKVEMSDRKKALSRYNVATAKLYRQVSGETMPQILIVIDSYEGLREAQTPTNLEACFQNISRDGSSLGISLVISAGRTAALRSSLMANLKERIALKLTDDSESRTLVGRHQHIMEDIPGRGLIKRDDIEVLQVALSTEGTETFDIINNIQNESDAMNSKWTGPRPKAIPIVPEELTFDDFMATDSVQADLSANRLPLGLEMVDVESYSLALNRFKHMLYMSDSDESLEAVGSHIIKVLLNVPNYHNMIIDSLGEYESYQGQVRTYVGSDMIEDMADQLIYELQQRESQSEIAEWFIMIPDFESFVAKSNMKLEQVQALLDNGPRYGLHLILGSSYNYVGTKIDAVPKYVRTTTQYVLAGMRLMDQTFLEKVYNSKEIRPNKDEAYIHDRKTYQKLKLTID

SEQ ID NO: 2005 - DNA, 93 bp, Streptococcus agalactiae
gtgcagcagttacctttaagtttaggtgatgagattagcttccaaggaacaattgttaagcttttcccagatgaaattcaaatctgggggggc

SEQ ID NO: 2006 - protein, 31 aa, Streptococcus agalactiae
MQQLPLSLGDEISFQGTIVKLFPDEIQIWGG

SEQ ID NO: 2007 - DNA, 126 bp, Streptococcus agalactiae
atgaaatttactgacaaagacaaagccttatctaaatccaagacattcaaggctaatcgtaatttttcagataaagtttcttttttaaagctttcaaaaaatagagcgtgcgcttctgtctggaat

SEQ ID NO: 2008 - protein, 42 aa, Streptococcus agalactiae
MKFTDKDKALSKSKTFKANRNFSDKVSFLKLSKNRACASVWN

SEQ ID NO: 2009 - DNA, 1272 bp, Streptococcus agalactiae
atggaaacagattcgtttgtatttgaagaacaagactttcaatttgaaaaaggaccagatttttggcagttatctcttaagcgttcaaaagtaggaactcaaaatctgcaacaactgcaattgttagaaattcaccattctttgttgatgcctatgacaactgcaattgatgcagataccattcaatttcaattccagacagaagcgcacgctctattttttgaaagctttaaaaaagaaactttatctgaaaaattacgattagccttgaatgtcttggatttagataaggctttgtctttgtcagtaaatttcattttgcatccctctaatctatttttaacaaaaaatgcaactgctaaaatagcttatcgtagccttcctgggattatgagacctgagaaatttggtccagaagagtttttatatcaattcaaatgttttgtctttgcattattgacgcaacatgactatatagagttgtataatggtgctatttctgttattgaagtatcagatttcctaaaaagcatttatcatgcagaaactattcaggctgttagagacatcattactattgattatgagcagcaagtagaagtagaaactcatacgttagcaaaagtatcaagggcaaaatataagctttataaatacataagtgtttggctaggagctttatctacaatactcttgattccgctagtatatctggtttttattcacaatccattcaaagaaaaaatgttggcagcggatacttcatttattaaagttgattataatcaagtgattaatcgactagaacatgtaaaagtaagtaagttaccttatacacagaagtacgagttggcctattcctatattaatggaatgtcattttctgaagaacagcgtgaagttattttaaacaatgttacgctcaagactgatgagctctatcttgattattggattaatattggccgtggtttagatgatgatgctattgatgctgccaaacgtttagacgattctgaccttgttatttatgctattgttcagaaaatggatcaggttagaaaagacaatagtttatctggtaaagatcgtgaacaaaaactttctgagctacaaacagactatgataaatattggaaagaccgtaagacagccttaacagatgaggaatccaaatcgaaaaatagcaataatcattcgacaaattccaacaaagagtcatctgaatcatcaagtactacagcaagtacatcttctaaaactaaaagtagg

SEQ ID NO: 2010 - protein, 424 aa, Streptococcus agalactiae
METDSFVFEEQDFQFEKGPDFWQLSLKRSKVGTQNLQQLQLLEIHHSLLMPMTTAIDADTIQFQFQTEAHALFFESFKKETLSEKLRLALNVLDLDKALSLSVNFILHPSNLFLTKNATAKIAYRSLPGIMRPEKFGPEEFLYQFKCFVFALLTQHDYIELYNGAISVIEVSDFLKSIYHAETIQAVRDIITIDYEQQVEVETHTLAKVSRAKYKLYKYISVWLGALSTILLIPLVYLVFIHNPFKEKMLAADTSFIKVDYNQVINRLEHVKVSKLPYTQKYELAYSYINGMSFSEEQREVILNNVTLKTDELYLDYWINIGRGLDDDAIDAAKRLDDSDLVIYAIVQKMDQVRKDNSLSGKDREQKLSELQTDYDKYWKDRKTALTDEESKSKNSNNHSTNSNKESSESSSTTASTSSKTKSR

SEQ ID NO: 2011 - DNA, 483 bp, Streptococcus agalactiae
gtgaggttgttgatgaagttgaaacgatttttagcctgtctactaatattatcctgtatgagtcaaacatcagtattttctgatgggttaaagaataatgatattcattttgatacaaaacgtttagaatcagattcacaaaaaaattctggttttcaaactgaattaactaaagatttatttaaaaaagaagaccttaaaaaattggataaaaaccgtcaatctaaagtctcactccagaaaaagcagtctaagcaactgtttcaatattcaaataaaggacaatctgataggaaaaaacgtatcaaacaattattttctgaagaaagtaatcaatttaaatttgttacaagaacagaagaaccgactgtttcggctgatattggtcatataattatatacctggttctcattagtttggtactaatattagcttctataatgacttttaaaataaaggacaaaaaggatgaatacacatat

SEQ ID NO: 2012 - protein, 161 aa, Streptococcus agalactiae
MRLLMKLKRFLACLLILSCMSQTSVFSDGLKNNDIHFDTKRLESDSQKNSGFQTELTKDLFKKEDLKKLDKNRQSKVSLQKKQSKQLFQYSNKGQSDRKKRIKQLFSEESNQFKFVTRTEEPTVSADIGHIIIYLVLISLVLILASIMTFKIKDKKDEYTY

SEQ ID NO: 2013 - DNA, 126 bp, Streptococcus agalactiae
atgttatcagaagcttctaaagattttttcagtgattcgttagcagtaatggaactactagactggttaacgagggctggaaagatattttggaaattagttgcagaatctaaaagatttttttgg

SEQ ID NO: 2014 - protein, 42 aa, Streptococcus agalactiae
MLSEASKDFFSDSLAVMELLDWLTRAGKIFWKLVAESKRFFW

SEQ ID NO: 2015 - DNA, 3042 bp, Streptococcus agalactiae
ttgttgaaaataaaatatattttaggaagaattatgaaaagaaataactttagaatactttggtatattatagctgttgctctctttttagtagctattgctggccttaatcttaagcttcaaggcgatcatgcaaaagagaataaaacaacacagtcagctactaacactaaactaaatatagcattagtcaacgaagatcaaaatgtatctaatggtaaagaaagttataatttaggagctagttatattaagtctatcgaacgtgataatagtcaaaattggtcagttgttagtcgaggtactgctcaaaatggattagacaaaggtgattatcaattaatggttatcatccctaataacttttctcaaaaacttcttgatgtcaataaagcaaatgcagagcaaacaactatctcttataaggttaatgccaaggggaatttagcattagagaaaaaggcaactgaaaaagagaaagatattgtttcagagttaaatagccacttagtaaatatgtacatggcaagtattttaagtaacttatatacagctcaagaaaatgtacaggccatggtaaatgttcagtcaggtaatatctcaaattaccaaaaaaatcttttagattctgcaactaatttccaaaatatctttccagccctcgttaaccagtctagtagttccattactgctaacgaatcactgaaaaaatctttagaagcttctgataacatgtttaatgatttggtgacaacccagacaaatactggaaaagatttatcaagcttaatagaacagcgccatcaagatagcatttcgtatgaagcgttttcgacctcattactagaaatgaataacgagttattagagaagcaattatctgatattatcacacaagcacaaaaagaccaagaaacattatcatcacaactcaatagtattatgggtgatgataacaatcataatcataaagaaaactcatcagcttatctaaatgttgcaaggcaaaaaatccaagaactatctgaagcactcaagtcacaagataacattgctaaagatcaaagtgaacaactagataaaattgttagagagggactagcaagttactttgctaagaataataaagataatattactttattagaattattgaagagtcattctactaatgagaagactttgaaagattttaaagctaaggtagcagatttcacaaattctctcatttcaagcattccttcactaaacctttcggagttgcacttaacccaagaagaagaaaaagccattcagtttacatcttctgattcggaaatcattaaaaaagtaagcaacgaaagaactctgtatttaaatactaatttattgaatcgtctttttgaagctaggaaaaatagagatgaagctaaaaataaagttaatcaattaaaattgtcatctagttctactcgaactggtgagcagatagtttctgttgaatcaaataatccagattacagggtagatacctggacggttaatggtaagcaaacaagaaccttggaccccagccaaaacaataatattattatcaatagcagttatcaaagggaatcatctaactctagtattacgaaaccaagctatacaatcactatcgggaatcagaaacaaattgtacaaaatgatgacggtaaaatccaacggtcttactttgaggcagaggcaacgtatcaacgaactctacaagaagtaaatgatgcatataacaccactcacggattagtagctaaatactacattatttctgatggcgaagaaccgcaaaatttatttgatcaatttttaaatcaaagtgttaacgatacgatggttgatctggtcaaaaatggtataactaagtatttgatggatgaaaacactgctgatgcgcaacagaaagttaaagatgtcatggaggaagttgaaaatagtcaagatgaattggcggatcaaatggcaaaagtaactgagacaaatgtacgactaacagatgcaatcaaaaaacagcttgaaacccttcaatcaattaacatgaaggtccaaaacatcacacaggatcaatctaaagtaaacgactcacagaaaacaactgatcaacaattatctgatttgaagaaccagctagatgggctaatgacctctgcagcgggcgtaaaagatatgtccaaatctaatagtcaagaggcggaccaagttaatcaaatattcacatcattcaataaagatgttcaagatgctaaaaattcgggcaacaaactttcgacggatgcaaccgatttaatggctaacttccaaaaagaattggccaataatggtgatttcgtagcttctttctctaaagtttttaatactgcttataaaaatggagtgccaaatgatattctccttaatttcttatcacgacctgtcgctgaatcagcgtctgcagttagggcaactgaaaatacttatcgcccattcacttggatactattattagaagttgttagcctatttacagcatatatctttgcgactcaaaaccttattaagaaattgacagataggtataatgtcaaccgctggcttcaaacagactttttaaatgtcattgtcatttcaggcctctctcttgttattggtttagcactgggagttatctcaagcagaagtcttcatgtcatgcctgaatatgtaccatcttggttcctagttatgactctgtttagttttttattaattcatagtcagtatttctttattaaaaattttaaagcagttggtatgggtttagctttgtttatgattattagttttgtgtatctatcaaatgccgtaggcacagtagcgactgttagtggacttccaaaattactaaaagctattaatccactatctatccttgaaaatcaattatcatcttattttgataatgtgacaactggatttattttccttatcttagtacttcttgtggatgttgcttttattatcatgaatatttttatcaccttaaattttgaagctaaagtaaaagag

SEQ ID NO: 2016 - protein, 1014 aa, Streptococcus agalactiae
MLKIKYILGRIMKRNNFRILWYIIAVALFLVAIAGLNLKLQGDHAKENKTTQSATNTKLNIALVNEDQNVSNGKESYNLGASYIKSIERDNSQNWSVVSRGTAQNGLDKGDYQLMVIIPNNFSQKLLDVNKANAEQTTISYKVNAKGNLALEKKATEKEKDIVSELNSHLVNMYMASILSNLYTAQENVQAMVNVQSGNISNYQKNLLDSATNFQNIFPALVNQSSSSITANESLKKSLEASDNMFNDLVTTQTNTGKDLSSLIEQRHQDSISYEAFSTSLLEMNNELLEKQLSDIITQAQKDQETLSSQLNSIMGDDNNHNHKENSSAYLNVARQKIQELSEALKSQDNIAKDQSEQLDKIVREGLASYFAKNNKDNITLLELLKSHSTNEKTLKDFKAKVADFTNSLISSIPSLNLSELHLTQEEEKAIQFTSSDSEIIKKVSNERTLYLNTNLLNRLFEARKNRDEAKNKVNQLKLSSSSTRTGEQIVSVESNNPDYRVDTWTVNGKQTRTLDPSQNNNIIINSSYQRESSNSSITKPSYTITIGNQKQIVQNDDGKIQRSYFEAEATYQRTLQEVNDAYNTTHGLVAKYYIISDGEEPQNLFDQFLNQSVNDTMVDLVKNGITKYLMDENTADAQQKVKDVMEEVENSQDELADQMAKVTETNVRLTDAIKKQLETLQSINMKVQNITQDQSKVNDSQKTTDQQLSDLKNQLDGLMTSAAGVKDMSKSNSQEADQVNQIFTSFNKDVQDAKNSGNKLSTDATDLMANFQKELANNGDFVASFSKVFNTAYKNGVPNDILLNFLSRPVAESASAVRATENTYRPFTWILLLEVVSLFTAYIFATQNLIKKLTDRYNVNRWLQTDFLNVIVISGLSLVIGLALGVISSRSLHVMPEYVPSWFLVMTLFSFLLIHSQYFFIKNFKAVGMGLALFMIISFVYLSNAVGTVATVSGLPKLLKAINPLSILENQLSSYFDNVTTGFIFLILVLLVDVAFIIMNIFITLNFEAKVKE

SEQ ID NO: 2017 - DNA, 2271 bp, Streptococcus pyogenes
atgttagaagaattgaaaacacttattaaaaatccaaaattaatgattacaatgattggtgtggccctagtgcctgccttatataatttatcctttctaggctcaatgtgggatccttatggtcgggtcaatgaccttcccattgctgttgttaatcatgataagcctgcaaagagagctgataagtcattgacaattgggaatgatatggtggacaagatgtctaaaagtaaagatttagagtatcattttgtctcagctaagcaagctcaagagggacttaaagaaggtgattattatatggttattactttacccgaagatctttctcaacgggcagcaaccttattaaatcccgaaccccaaaaattaactatccgttaccaaacgagtaaaggacatggaatggtcgctgctaagatgggggaaacagcgatggctaagctgaaagagtctgtttcgcaaaacattacgaagacttatacctcagcagtttttagcagtatgacagacctccaatcaggattaaaagaagcctcagctggaagtcaagcacttgcttcaggagcgaagactgctcaggcggggagtcaaacactttcgacgaacttagcagccttaacgggtgctagccaacagtttcaacaaggtactggtcgattgacatcaggtttgactacctatacagatggtgtcaaccaagtcaagaatgggttaggaacattatcaacggacatccccaattatctgaatggggtttctaggttatcccagggagcttctcagcttaatcagggtctttcacagttgacacaagcaacaacactttctgacgagaaagctaagggaattcaatccttaattgtaggactaccagtcctaaatcaaggcattcagcaactaaatacagagctatcaacattgcaaccccctaaccttaatgctgatgagttaggtaatagcttaggagctatcgctcaagctgccaaacaagtcattgctgaagagactgccgctcagaatgaagaattatcggctctccaagctactagcgtttaccaatcattaactgctgaacaacaaggagagttagctgcggccctcagtcaatctgataaaagtcagaccgtatctgcagcccaaactattttaagttctgttcaaactttgtcaacaagtttacagtctctctctcaagaagatcagtcaaaacagttggagcaacttaaggaagctgttgcacagattgctaatcaatccaatcaagctttgccgggagcaagttctgctttaactgaattatcaacgggattagcaaaggtaaatggtagcttaaatcaacaagttctaccaggaagtaatcaattgacaacaggattagcacaattaaacaggtataatactgccattggttctggggtaataaaactctcagaaggtgccaatgccttgtcatccaagtccggagaattactagatggtagccatcaattatcagaaggtgctactaaactagctgatggtagttctcaattgagtcagggtggtcatcaattaacgagcggattgactgaattatcaacaggattgtcaaccttaaatggttccttagccaaagcctctcagcagttatcgcttgtttctgtgactgataaaaatgctaaagctgtcgcaaaacctcttgtgttaaatgagaaagacaaagatggtgttaagacgaatgggatcgggatggcaccttatatgattgctgtttctctaatggttgtggccctttcaaccaacgtcatttttgctaattctttatctggtcgtccggtcaaagataaatgggattgggctaaacaaaaatttgttattaatggttttatttcgactatgggatccattgttctctacttagctattcaattattagggtttgaagcccgttatggtatggaaaccttaggatttattatgctaagtggttggacgtttatggctcttgtcacagctttggtcggttgggatgatcgatatggctcttttgcttctttggtcatgttattgcttcaggttggctcttcaggtggctcttaccccattgagttaagtggagcattcttccaaaagttacatcctttcttaccaatgacttatgtggtatctggtttacgacaaaccatttcattatcaggtcatattggagtagaagtgaaagtcttaactggtttcttactggcatttatggtattagcactactcatttatcgtcccaagaaaacagtc

SEQ ID NO: 2018 - protein, 757 aa, Streptococcus pyogenes
MLEELKTLIKNPKLMITMIGVALVPALYNLSFLGSMWDPYGRVNDLPIAVVNHDKPAKRADKSLTIGNDMVDKMSKSKDLEYHFVSAKQAQEGLKEGDYYMVITLPEDLSQRAATLLNPEPQKLTIRYQTSKGHGMVAAKMGETAMAKLKESVSQNITKTYTSAVFSSMTDLQSGLKEASAGSQALASGAKTAQAGSQTLSTNLAALTGASQQFQQGTGRLTSGLTTYTDGVNQVKNGLGTLSTDIPNYLNGVSRLSQGASQLNQGLSQLTQATTLSDEKAKGIQSLIVGLPVLNQGIQQLNTELSTLQPPNLNADELGNSLGAIAQAAKQVIAEETAAQNEELSALQATSVYQSLTAEQQGELAAALSQSDKSQTVSAAQTILSSVQTLSTSLQSLSQEDQSKQLEQLKEAVAQIANQSNQALPGASSALTELSTGLAKVNGSLNQQVLPGSNQLTTGLAQLNRYNTAIGSGVIKLSEGANALSSKSGELLDGSHQLSEGATKLADGSSQLSQGGHQLTSGLTELSTGLSTLNGSLAKASQQLSLVSVTDKNAKAVAKPLVLNEKDKDGVKTNGIGMAPYMIAVSLMVVALSTNVIFANSLSGRPVKDKWDWAKQKFVINGFISTMGSIVLYLAIQLLGFEARYGMETLGFIMLSGWTFMALVTALVGWDDRYGSFASLVMLLLQVGSSGGSYPIELSGAFFQKLHPFLPMTYVVSGLRQTISLSGHIGVEVKVLTGFLLAFMVLALLIYRPKKTV

SEQ ID NO: 2019 - DNA, 288 bp, Streptococcus agalactiae
atggcacaaattaaattaacaccagaagaacttcgctcatcagcacaaaagtacacagctggttctcaacaagtaacagaagttcttaatttgcttactcaagagcaagcagttattgacgaaaattgggatggatctacttttgattcttttgaagcacaattcaatgaattatctccaaaaattacagaatttgctcaattactcgaagatattaaccagcaattattaaaagttgcagatatcattgagcagacggatgcagatattgcttctcaaattagtgga

SEQ ID NO: 2020 - protein, 96 aa, Streptococcus agalactiae
MAQIKLTPEELRSSAQKYTAGSQQVTEVLNLLTQEQAVIDENWDGSTFDSFEAQFNELSPKITEFAQLLEDINQQLLKVADIIEQTDADIASQISG

SEQ ID NO: 2021 - DNA, 780 bp, Streptococcus agalactiae
atgattccagatagtagttttaaagtgctatcagatatggcatataatattgaaaaatccaaagcagaaagtaatggacaccttcaaattatagaaggtagtcaaattattgatttccatcaaaaacgctcttttatggtattagaggttaatgatgatatcaataatggtatgcaggctatggcatgtcagtctttggatgaaagtaatcatattgttatagcatattcaggaacgaacgcttttaataagaaagatatcttaacagatatcgattcagttgtattggggaagaacaataaattgctaacttgtccttcaagtattaccctgagagaggatggcatttctctgccttgtaaaaatccaagtcaaattacaacatctaaactatttgcacaaaaaattaagatgaactatcctgatgcaaccctctggttaacaggccattctctaggtggttatttggccatgattgtggcttcagaaatgagattatcagcgcgtgtttttaattcccctagtcccattaacaatatgtctgaagcagccacatcctatgtaatttcacatccagagaagtatcatagttaccgtattaataaagattacattggtaattttggtattaatagttcagatgataaattaggtatttctaaaagagtcaatgctaagaagcaacatggtttttataaaaagattttctttcacgaattgacacgatttcgattaaatcaacaaggacagattgttgatatagatgaaaataaacaggat

SEQ ID NO: 2022 - protein, 260 aa, Streptococcus agalactiae
MIPDSSFKVLSDMAYNIEKSKAESNGHLQIIEGSQIIDFHQKRSFMVLEVNDDINNGMQAMACQSLDESNHIVIAYSGTNAFNKKDILTDIDSVVLGKNNKLLTCPSSITLREDGISLPCKNPSQITTSKLFAQKIKMNYPDATLWLTGHSLGGYLAMIVASEMRLSARVFNSPSPINNMSEAATSYVISHPEKYHSYRINKDYIGNFGINSSDDKLGISKRVNAKKQHGFYKKIFFHELTRFRLNQQGQIVDIDENKQD

SEQ ID NO: 2023 - DNA, 3180 bp, Streptococcus agalactiae
atgccaaagcgcacagacatacgtaaaattatggttatcggttctggcccgattgtgattggacaagcagcagagtttgactattctggtacacaagcctgtctctctttaaaagaggagggataccaagttgttttggtcaattcgaatccagctactatcatgacagataaagatattgctgataaagtttatattgaacctattaccttggagtttgtcacaagaattctcaggaaggaaagacctgatgctctccttccaactcttggaggtcaaactggattgaatatggctatggctctatcaaaaaatggtatcctagaagaattgaatgttgaactattagggaccaaattatcagccattgataaagctgaagatcgtgatttatttaaacagttgatggaagaactcaatcaacctattccagaatctgagattgttaattcggtagaagaagctattcaatttgcagagcaaatcgggtatccattaattgttcgtcctgcctttactttaggaggtacaggtggaggcatgtgcgataatcaagaacaattggttgacatcacgacgaaggggttaaagttatcgcctgtgacacagtgccttattgaacgttcaattgctggctttaaagagattgaatacgaagttatgcgtgatgcagcagataacgctcttgttgtttgtaatatggagaattttgatcctgttggtatccatacaggggactctatagtttttgcacccgcacaaacgttatctgatgtggaaaatcagttattacgagatgcgagtttagatattataagagctttgaaaattgaaggaggatgcaatgttcaactagcccttgatccgaatagttttaaatactatgtcattgaagttaatccaagagtatcaagatcttctgctttagcttcaaaagctactggatatccaattgctaaattagcagctaagatagctgttggtttgacactagatgaggtaattaatcctattacaaaaacgacttacgctatgtttgaacctgctttagattacgtagtcgcaaaaatgccgagatttccttttgataaatttgaaagtggcgatagaaaattgggaacacagatgaaagctacaggcgaagtcatggcaataggacggaatatagaagaatctttgttgaaagcttgtcgttcactagaaataggtgtcgatcacattaaaatagcagatttagataatgtatcagatgatgttttattagaaaaaataagaaaggcagaagatgatcgcttattttatctagcagaagctttacgtagacattatagtattgaaaaattagcaagtttgactagcattgattctttcttccttgataagttaagagtgattgtagagttagaagatctattatctaaaaacagactggatatcaatattctcaaaaaggttaaaaataaaggtttttcagataaagctatagcgagtttatggcaaataaacgaagatcaagttcgtaacatgcgaaaagaagcaggaattcttccagtttataagatggttgatacatgtgcgtctgagtttgattcagcaacgccctacttttattcgacttatgccgtagaaaacgagtcattgatatcagataaagcctctattttggttttaggatcgggcccaatccgaattggacagggagttgaatttgattatgcaacggttcattctgttaaagccatcagagagtctggttttgaagcgattatcatgaactctaatccagagacggtctcaacggatttctctatttcagataagctttactttgaacctttgacttttgaagatgttatgaatgttattgacttagaaaaacctgaaggggtcatcttacaattcggtggtcagactgctattaatctagcaaaagatttaaacaaggcaggggttaaaatactaggcacacaattagaagatttggatcgtgctgaaaatagaaaacaatttgaagccactttacaagctctaaatatccctcaaccaccaggttttaccgccactacggaggaagaggcagttaatgcagcgcaaaagattggttatcccgtgttggttagaccatcatatgttcttggtggacgagctatgaagatagttgaaaacgaagaagatttacgtcattatatgacaaccgcggtaaaggcaagcccagatcatccagtgcttatagatgcataccttataggtaaagagtgtgaggttgatgctatatccgatggtcagaatatactgattcctggaataatggaacatatagagcgatctggtgttcattcaggagattccatggctgtatatcctcctcaaacattgtctgagaccattatcgaaactattgtagattatacaaaacgcttagcaattggattaaactgtatcggtatgatgaatattcagtttgtaatcaaggatcagaaagtatatgttattgaagttaatcctcgtgctagtagaacacttccattcttatcaaaagtaactcacattcctatggcccaagtagcaacaaaagttatcttaggagataaactctgcaattttacatatggttatgatctctatccagcttcagatatggtccacattaaagcccctgtctttagttttaccaaacttgctaaagtagatagtttattaggtcctgaaatgaaatcaacaggcgaagtgatgggatcagatattaatcttcagaaagccttgtataaagcctttgaagcagcatatctccatatgccagactatggtaacattgtttttacagtagatgatacagataaagaagaagctttagaacttgcaaaagtctatcaaagtattggttatcgtatttatgctacccaagggactgcaatttattttgatgctaatggtttagagacagttttagtaggtaagttaggagagaacgatcgaaatcatattcctgatttaattaaaaatggtaagattcaagcagttatcaacacagttggacaaaataacattgataaccatgatgctctcatcatcagacgttctgcaattgaacaaggagttcctctatttacatctttagatactgcacatgcaatgttcaaagttcttgaaagcagagcatttacattaaaagtactagat

SEQ ID NO: 2024 - protein, 1060 aa, Streptococcus agalactiae
MPKRTDIRKIMVIGSGPIVIGQAAEFDYSGTQACLSLKEEGYQVVLVNSNPATIMTDKDIADKVYIEPITLEFVTRILRKERPDALLPTLGGQTGLNMAMALSKNGILEELNVELLGTKLSAIDKAEDRDLFKQLMEELNQPIPESEIVNSVEEAIQFAEQIGYPLIVRPAFTLGGTGGGMCDNQEQLVDITTKGLKLSPVTQCLIERSIAGFKEIEYEVMRDAADNALVVCNMENFDPVGIHTGDSIVFAPAQTLSDVENQLLRDASLDIIRALKIEGGCNVQLALDPNSFKYYVIEVNPRVSRSSALASKATGYPIAKLAAKIAVGLTLDEVINPITKTTYAMFEPALDYVVAKMPRFPFDKFESGDRKLGTQMKATGEVMAIGRNIEESLLKACRSLEIGVDHIKIADLDNVSDDVLLEKIRKAEDDRLFYLAEALRRHYSIEKLASLTSIDSFFLDKLRVIVELEDLLSKNRLDINILKKVKNKGFSDKAIASLWQINEDQVRNMRKEAGILPVYKMVDTCASEFDSATPYFYSTYAVENESLISDKASILVLGSGPIRIGQGVEFDYATVHSVKAIRESGFEAIIMNSNPETVSTDFSISDKLYFEPLTFEDVMNVIDLEKPEGVILQFGGQTAINLAKDLNKAGVKILGTQLEDLDRAENRKQFEATLQALNIPQPPGFTATTEEEAVNAAQKIGYPVLVRPSYVLGGRAMKIVENEEDLRHYMTTAVKASPDHPVLIDAYLIGKECEVDAISDGQNILIPGIMEHIERSGVHSGDSMAVYPPQTLSETIIETIVDYTKRLAIGLNCIGMMNIQFVIKDQKVYVIEVNPRASRTLPFLSKVTHIPMAQVATKVILGDKLCNFTYGYDLYPASDMVHIKAPVFSFTKLAKVDSLLGPEMKSTGEVMGSDINLQKALYKAFEAAYLHMPDYGNIVFTVDDTDKEEALELAKVYQSIGYRIYATQGTAIYFDANGLETVLVGKLGENDRNHIPDLIKNGKIQAVINTVGQNNIDNHDALIIRRSAIEQGVPLFTSLDTAHAMFKVLESRAFTLKVLD

SEQ ID NO: 2025 - DNA, 3072 bp, Streptococcus pyogenes
ttggctctaaaagaagaaggctacaaagtcatacttgttaattcaaatcctgcaacgattatgacagataaagaaatcgctgataaggtatatattgagcctttgactcttgaatttgttaatcgtatcattcgaaaagaaaggccagatgccatactgccaaccttaggtggccaaacgggcctcaatatggcaatggcgttatctaaagctggtattcttgatgatttagagattgaattgttaggtactaagttatctgcgattgatcaggcagaagacagagaccttttcaaacaattaatgcaagaactagaccaacccattccagaatctacaattgttaaaacagttgatgaagctgttacatttgctagagatatcggttatccagtcattgtgcgcccagcttttactcttggtggaactggtggaggaatatgtagtagtgaagaagaactttgtgaaattactgaaaacggcctaaagttatcaccagtcacacagtgtttgattgaacgctcaattgctggcttcaaagaaattgaatacgaagtaatgcgagatagtgctgataacgcgctggttgtttgtaatatggaaaactttgatcccgtagggattcacacaggagattctattgtatttgcaccaacacagaccctttctgatattgaaaatcaaatgttacgtgatgctagtttaaaaataattcgagctctgaaaattgaaggtggctgtaacgtccagttagcactagatccttatagtttcaaatattatgttattgaagtaaatcctagagtgtctcgttcctctgcccttgcttcaaaagcaacaggttatcccattgccaaattggctgcaaagattgctgttggcctaacacttgatgaaatgattaaccctatcacaggcactacttacgctatgtttgaacctgcccttgattacgttgttgctaaaattccgcgttttccgtttgataaatttgaacatggtgaacgccaactgggaactcaaatgaaagcaacaggtgaagtcatggctattggccgtaatttggaagagtccttactaaaagcctgtcgttctttagaaattggtgtttgccataatgagatgacaagtttaagtaacattagtgatgaagagttagtgactaaagtgattaaagctcaagatgatcgacttttttacttgtcagaagcaatacgacgaggttatagtatcgaagaacttgagagcttgaccaagattgatttatttttcttggataaattacttcatattgttgaaatagagcaagaattacaaatgcatgttgaccatttggaaagcctcaaaaaagcaaagcgttatggattttcagatcaaaaaattgcagaaatttggcaaaaggatgaaagtgatatcagagcgatgagacattctcatagcctgtatcctgtctataaaatggtagatacttgtgcagctgaatttgatgctaaaaccccttatttttattcaacatatgagttggaaaatgaatctgttcagtcgaataaagaatcaattttagttttaggttcaggccctattcgtattggtcaaggggttgaatttgactacgcaacggttcattctgttaaagccatccaaaaagctggctatgaagccattatcatgaattcaaatccggagactgtatctacagatttttcggtatcagataaattatattttgaaccgttaacctttgaagacgtcatgaatgtgatagatttagagcagcctaagggagtaatagttcagtttggaggacaaactgctattaacttagcacaagcactttctgaggcgggtgttacaatattaggaacacaagtagaggatttggatagggctgaagacagagatttatttgaaaaggcgttgaaagagcttggaatcccacaaccacaaggtcaaacggcaactaatgaagaagaagctttagaggcagctaaaaaaattggttttccagtcttagttagaccttcttacgtacttggtggccgggctatggaaattgttgaaaacaaagaagatcttagagaatatataagaacagcggttaaagcaagtcctgaacatcctatcttagtggactcttatattttcggtaaggagtgtgaagtggatgccatttcagatggaaaatcagtcttaattcctggtattatggagcacatcgaaagagcaggtgttcattcaggagattcaatggcagtttatccgccacagcaattatctaagcaaattcaagaaacaatagctgagtatactaaacgtttagccattgggttaaattgtattggtatgatgaatgttcaatttgttattaaaaatgaacaagtttatgttattgaagtgaatccacgcgctagtcgtaccgtacctttcttatcaaaagtaacaggtattccgatggctcagattgctactaagttgattttaggtcaaacattaaaggatctaggatatgaagatggtctttatccccaaagtccactggtgcatatcaaagcgcctgtgttttcatttacaaagttggcacaggttgatagtcttttaggtcctgaaatgaaatcaactggagaagtaatgggttcggatactagtcttgaaaaagcactttataaagcgtttgaagccaataattctcatttatcagaatttggtcaaattgtctttactatagcagatgatagtaaggcagaagctctaagtctagcaagacgatttaaggcgattggctatcaaattatggctactcaaggtacagcagcttactttgctgagcaaggcttaagcgcgtgtttagttggaaaaattggtgatgctgccaatgacatcccgacactcgtgcgacatggtcacgttcaggcaattgttaatacagttggaattaaacgcacagctgataaagacggacagatgattagaagttcagctattgaacaaggagttcctttatttacagctttagataccgcaaaagctatgttaacggttttagaaagcagatgctttaacatcgaagcgata

SEQ ID NO: 2026 - protein, 1024 aa, Streptococcus pyogenes
LALKEEGYKVILVNSNPATIMTDKEIADKVYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPALDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQELQMHVDHLESLKKAKRYGFSDQKIAEIWQKDESDIRAMRHSHSLYPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQALSEAGVTILGTQVEDLDRAEDRDLFEKALKELGIPQPQGQTATNEEEALEAAKKIGFPVLVRPSYVLGGRAMEIVENKEDLREYIRTAVKASPEHPILVDSYIFGKECEVDAISDGKSVLIPGIMEHIERAGVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSPLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMIRSSAIEQGVPLFTALDTAKAMLTVLESRCFNIEAI

SEQ ID NO: 2027 - DNA, 1074 bp, Streptococcus agalactiae
atgaagcgtctattattactggaagatggtagtgtgtttgagggtgaggctttcggagcggatgtagaaacaagtggtgaaatcgtttttagtacaggaatgacagggtatcaagaatctataacagatcaatcttacaacggtcaaattattacttttacttatcctcttattggaaattatgggataaatcgagacgattacgaatctattagaccaacatgtaagggagtagttatttatgaatgggcagagtatccaagtaactggcgtcaacagatgacacttgatgaatttttaaaattaaaaggaatacctggaatttcaggtatagatactcgagcattaacaaaaattattcgaaaacatggaacaatgaaagcttgtttaataaacgagggaaattctattcatgaagcactagaaaaccttcaaaaaagtgttcttttaaatgatcaaattgaacaagtatcaaccaaattagcttatgcttcgcctggagttggcaaaaatattgtattagttgactttggtttaaaacattctattctaagagaactgtcacaacgtcaatgtcatattacagtcgttcctcatactacgacagcgcaagaaatcttaaatctcaatccagatggagtactcttatctaacggccctgggaacccagaacaattaccgaatgctttacaaatgatccaagaaattcaaggtaaaattccaatttttggtatttgtatgggacatcaactatttgctaaagctaatggtgcaaagacttataaaatgacttttggtcatcgaggttttaatcatgctgttcgtcatttgcaaacaggacaggttgattttacaagtcaaaatcatggttatgctgtctcgagagaagatttccctgaggctctcttcattacacatgaagagattaatgataaaactgtcgaaggtgttcgacataaatactatcctgccttttcagtgcagtttcacccagatgcagcaccagggccgcatgatacatcttatctttttgatgaatttattaatatgattgatgatttccagcaaaaaagc

SEQ ID NO: 2028 - protein, 358 aa, Streptococcus agalactiae
MKRLLLLEDGSVFEGEAFGADVETSGEIVFSTGMTGYQESITDQSYNGQIITFTYPLIGNYGINRDDYESIRPTCKGVVIYEWAEYPSNWRQQMTLDEFLKLKGIPGISGIDTRALTKIIRKHGTMKACLINEGNSIHEALENLQKSVLLNDQIEQVSTKLAYASPGVGKNIVLVDFGLKHSILRELSQRQCHITVVPHTTTAQEILNLNPDGVLLSNGPGNPEQLPNALQMIQEIQGKIPIFGICMGHQLFAKANGAKTYKMTFGHRGFNHAVRHLQTGQVDFTSQNHGYAVSREDFPEALFITHEEINDKTVEGVRHKYYPAFSVQFHPDAAPGPHDTSYLFDEFINMIDDFQQKS

SEQ ID NO: 2029 - DNA, 1080 bp, Streptococcus pyogenes
atgacaaaacgattacttattttagaagacggcactatttttgaaggagaaccctttggtgctgatattgatgtgactggtgaaattgtctttaatacaggaatgacaggctaccaagaatccatcactgaccaatcctacaatgggcaaattttaacctttacctatcctttgattggaaattatgggattaatcgagatgactatgagtccatttcacccacctgtaaaggggttgttgtgtctgaagtcagtcggttggcaagtaattggcgcaagcaaatgacgctagatgcgttcttgaaaataaaagggattccagggatttcgggaattgatacgagagctttgaccaaaattattcggcaacacggtaccatgaaagctacgatggcagatgatggagatagtatccagcatttaaaagatcaactgcgtgcaacagtcttaccgactaacaccattgaacaagtgtcaactaaaacagcttatcctgcaccagggatcgggaaaaatattgtattggttgattttggtttaaaacattctattttaagagaattttctaaaagacaatgtaatatcaccgttgtccctttcaacatcactgcagaagaagtgctccaactaaatccggatggcttgatgctatctaatggcccaggaaacccagaagatttgccagaggctttagacatgattcgtggggtacaaggtaagattcctatttttggtatttgtatgggacatcaactctttagtctagcaaatggtgctaagacttgtaaaatgacctttggtcatcgtggctttaaccatgccgttagagaaattgcaacgggaagaattgattttaccagtcaaaaccatggttatgccgttgaacgtagtagtctacctgatactttaatggttacgcatgaagacattaacgataagacggtcgaaggagtgaaacatagagattttccagctttttcagtccaatttcaccctgatgcggctccaggacctcatgatgccagctacttatttgacgaatttttggaaatgattgattcttggagatgtacgagtaaa

SEQ ID NO: 2030 - protein, 360 aa, Streptococcus pyogenes
MTKRLLILEDGTIFEGEPFGADIDVTGEIVFNTGMTGYQESITDQSYNGQILTFTYPLIGNYGINRDDYESISPTCKGVVVSEVSRLASNWRKQMTLDAFLKIKGIPGISGIDTRALTKIIRQHGTMKATMADDGDSIQHLKDQLRATVLPTNTIEQVSTKTAYPAPGIGKNIVLVDFGLKHSILREFSKRQCNITVVPFNITAEEVLQLNPDGLMLSNGPGNPEDLPEALDMIRGVQGKIPIFGICMGHQLFSLANGAKTCKMTFGHRGFNHAVREIATGRIDFTSQNHGYAVERSSLPDTLMVTHEDINDKTVEGVKHRDFPAFSVQFHPDAAPGPHDASYLFDEFLEMIDSWRCTSK

SEQ ID NO: 2031 - DNA, 921 bp, Streptococcus agalactiae
atgaatcatcaaacacaaacactttcattagaacattttgtcagtttagaagaattatcaaatcaagaagttatgtctttgataaagagaagtatcgaagttaaagaaaatcctagcaacattggttttgataaagattactatgtgtcaaatctcttttttgagaattcaacaagaacacataagtcatttgaaatggcagaactcaaattaggattaaaaacaattgaatttaatgctgatacaagttctgttaataaaggagaaaccctttatgacactatcttaacaatgagtgctctaggattggacgtttgtgtcattaggcatcctgatattgactattataaagaattgattgctagtccgaacattcattcagctattgtcaatgggggtgatggctcaggccaacatccaagccaatcacttttggatttggtaactatttacgaagaatttggatacttcaaagggctaaaaattgcgattgtaggagatttaactcactcacgggtagctaaatctaacatgcaagtgctaaaacgattaggagctgaaattttcttttctggacccaaagaatggtatagtagtcaattcgatgaatatgggcaatatttaccaatagatcagttagttgatcaaattgatgtccttatgcttttacgtgttcaacacgaacgtcatgatggtaaaggggtgttttcaaaagaaagctatcatcaacaatttggtcttacaaaagaacgctataaacatttaagggatacagcaattattatgcacccagcacccgtcaatagggatgtagagattgctagcgatttggtagaagcagataaggctcgaatagtgaaacagatgagtaatggcgtctatgcaaggatagctatcttagaagcagtgctcaatagcaga

SEQ ID NO: 2032 - protein, 307 aa, Streptococcus agalactiae
MNHQTQTLSLEHFVSLEELSNQEVMSLIKRSIEVKENPSNIGFDKDYYVSNLFFENSTRTHKSFEMAELKLGLKTIEFNADTSSVNKGETLYDTILTMSALGLDVCVIRHPDIDYYKELIASPNIHSAIVNGGDGSGQHPSQSLLDLVTIYEEFGYFKGLKIAIVGDLTHSRVAKSNMQVLKRLGAEIFFSGPKEWYSSQFDEYGQYLPIDQLVDQIDVLMLLRVQHERHDGKGVFSKESYHQQFGLTKERYKHLRDTAIIMHPAPVNRDVEIASDLVEADKARIVKQMSNGVYARIAILEAVLNSR

SEQ ID NO: 2033 - DNA, 987 bp, Streptococcus pyogenes
ttgttgttagaccacttacatagtcatcagtcgttagtgataaaggggataatcatgtcagttgtaaataatcgcgttgcacttaccaatttagtttcaatggaagcattaaccaccgaagaagttttaggtcttatcaaccgtggttcagaatataaggctggtaaagttgttatttcggatcatcaaaaggatcttgttgccaatttattctttgaaaactccacccgaacccataagtcttttgaagtggctgagaagaaactcggcttgacagttcttgatttcaatgctgatgcaagtgcggttaacaagggagaaagtttgtatgatactgtgttaaccatgagtgcacttggaacagacatctgtgtgattcgtcacccagaagatgattattacaaggaattagtagaaagtccaactattacagcttccattgtcaatggaggagatggttctggacaacacccgagtcaatgtttacttgacttattaaccatctatgaagaatttggacgctttgaaggcttaaagattgcgatcgctggtgacttaactcactctagggtggcaaagtccaacatgcaaatcctcaaaagattaggagcagagctttatttctatggacctgaagaatggtattcagaagcctttaatgcttacggcacttatattgctattgaccagattattaaggaattggatgttcttatgttgctgcgtgtacagcacgaacgtcatgacggccatcagagtttttcaaaagaaggttaccatcaagcgtttggattgacacaggaacgttaccaacaattaaaagattctgctattattatgcatccagctccagttaatcgggatgtggaaattgcagatagtttggtggaagctcctaaagcgagaattgtatctcagatggctaatggtgtctttgttcgcatggctattattgaagccattttgaatggtagaaataaaaactca

SEQ ID NO: 2034 - protein, 329 aa, Streptococcus pyogenes
LLLDHLHSHQSLVIKGIIMSVVNNRVALTNLVSMEALTTEEVLGLINRGSEYKAGKVVISDHQKDLVANLFFENSTRTHKSFEVAEKKLGLTVLDFNADASAVNKGESLYDTVLTMSALGTDICVIRHPEDDYYKELVESPTITASIVNGGDGSGQHPSQCLLDLLTIYEEFGRFEGLKIAIAGDLTHSRVAKSNMQILKRLGAELYFYGPEEWYSEAFNAYGTYIAIDQIIKELDVLMLLRVQHERHDGHQSFSKEGYHQAFGLTQERYQQLKDSAIIMHPAPVNRDVEIADSLVEAPKARIVSQMANGVFVRMAIIEAILNGRNKNS

SEQ ID NO: 2035 - DNA, 1314 bp, Streptococcus agalactiae
ttggcaaagttagagaggacagatatgtatatcattaaaaacggattgattatcgaccctcaaagtggttttaatcaagtatcagacatgctgattgatcaaggaaaaattaaacaaatatcgaaagaaattgatattaaaggcattccaatcattgatgcaagcaataaaattgtagctccaggattagtcgatattcatgtacattttcgtgagcctggacagacacataaagaaaatatccatacaggggccctatcagctgcagtaggtggttttacgacagttcttatgatggccaatactaacccaacgatttctagcccagaaattgtaaaacaagttaaggagagtgcagcaaaagaagcaattaagattgaaacagttgctacaattactaaatctctgaatggtaaagatttagttaatttcgaagaactattagaggctggagttgctggattctcagacgatggtattcctttgacagatactaaggttttgcaagaagctatgaacttagctagaaaacatgatgttgtcctatcgttacatgaagaagatccatcgttaaatggtgtccttggtatcaacgaacatattgctcagaaaatttatcatgtctgtggagctagtggtcttgctgaatattcaatgattgcgcgagatgctatgattgcttaccaaacacaggcgaaagtccatatccagcatttgtcaagttcagaatcagtagaagtagttgattttgcgcagaagcttggtgctaacttaacagcagaagtaaccccccaacatttttcaaagacagagaacttacttttaactaagggtgctaatgcaaaattaaacccaccactgcgacttgaaaaggatagacaagccctcattgatggacttaaaagtggtgttatttcaattattgcaagtgaccacgctccccatcatattatggagaaagcagcagataatattagtcaagcgccctctggtatgactggcttagagacatcattagccttagggattacttatttagtatctactaaagaactctcaatgattgactttttggcaaaaatgacatgtaatcctgcacagttatatggatttgatgcaggttatctcagagaaggtggacctgcagatatcgttatttttgatcaagctgaagagagaataataaaggcagaatttgcctccaaatccagcaactctccttttatcggtgataaattgaagggagttattcactacacaatttgcaatggtgaaatagtctatcaaaaagatagccacgcagcgacattggta

SEQ ID NO: 2036 - protein, 438 aa, Streptococcus agalactiae
MAKLERTDMYIIKNGLIIDPQSGFNQVSDMLIDQGKIKQISKEIDIKGIPIIDASNKIVAPGLVDIHVHFREPGQTHKENIHTGALSAAVGGFTTVLMMANTNPTISSPEIVKQVKESAAKEAIKIETVATITKSLNGKDLVNFEELLEAGVAGFSDDGIPLTDTKVLQEAMNLARKHDVVLSLHEEDPSLNGVLGINEHIAQKIYHVCGASGLAEYSMIARDAMIAYQTQAKVHIQHLSSSESVEVVDFAQKLGANLTAEVTPQHFSKTENLLLTKGANAKLNPPLRLEKDRQALIDGLKSGVISIIASDHAPHHIMEKAADNISQAPSGMTGLETSLALGITYLVSTKELSMIDFLAKMTCNPAQLYGFDAGYLREGGPADIVIFDQAEERIIKAEFASKSSNSPFIGDKLKGVIHYTICNGEIVYQKDSHAATLV

SEQ ID NO: 2037 - DNA, 1266 bp, Streptococcus pyogenes
atgatactcatcaaaaatggacgcgttatggacccgaaatcgcagagagatcaagtggcagatgtcttgattgatggtaaacagattgtaaagatagcttcagctattgaatgccaagaagctcaagtgattgatgctagtggtcttattgttgccccgggtttggtcgatattcatgtgcattttagagaacccggtcaaacgcacaaagaagatattcacacgggagccttggcagcagcagcaggtggtgtgactacggttgtcatgatggctaataccaatcctgtcatttcagatgtcgaaactttacaggaagtgctagctagcgcagctaaagaaaagattcatatttacaccaatgccagtgtcacccaagcctttaatggaaaagacgtgactgattttaaagctttgttggaagcaggagcagtaagcttttcagatgatggtattcccttagaaagttctaaagttttaaaagaagcctttgatttggctaatgccaaccaaactttcatttctttgcatgaggaagatcctcagttaaatggggttcttggttttaatgaaggtattgctgaggagcattttcatttttgtggggcaactggtgtagcagaatatagtatgattgcaagagatgtcatgattgcttatgacaggcaagctcatgttcatatccaacatttatctaaagcagaatcggttcaagtagtggcttttgctcagcagttgggtgctaaggtaactgctgaagtgtccccacaacatttttcaacaactgaagatctcttattgatcgcaggtaccagcgccaagatgaatcctccccttcgtacacaaagagatcgcttagctgtcatagaaggcttgaaatcgggtgttatcacagtcattgccactgatcatgctcctcatcacaaggatgaaaaaactgtggatgatatgactaaagccccatctggtatgacaggacttgaaacttctttgtcattaggtttgacgcatttggttgaaccaggtcatcttacacttatgtcactattagaaaaaatgacgcttaatccagctttgctttatggttttgatgcgggttatttggcagaaaatggtccagcagatttggttatttttgcagacaagcaagaacgtctgatcactgagaattttgcttctaaagctagtaattccccatttattggtaacaaactcaaaggtgtcgtgaaatacactattgcagacggagaggttgtttaccctaat

SEQ ID NO: 2038 - protein, 422 aa, Streptococcus pyogenes
MILIKNGRVMDPKSQRDQVADVLIDGKQIVKIASAIECQEAQVIDASGLIVAPGLVDIHVHFREPGQTHKEDIHTGALAAAAGGVTTVVMMANTNPVISDVETLQEVLASAAKEKIHIYTNASVTQAFNGKDVTDFKALLEAGAVSFSDDGIPLESSKVLKEAFDLANANQTFISLHEEDPQLNGVLGFNEGIAEEHFHFCGATGVAEYSMIARDVMIAYDRQAHVHIQHLSKAESVQVVAFAQQLGAKVTAEVSPQHFSTTEDLLLIAGTSAKMNPPLRTQRDRLAVIEGLKSGVITVIATDHAPHHKDEKTVDDMTKAPSGMTGLETSLSLGLTHLVEPGHLTLMSLLEKMTLNPALLYGFDAGYLAENGPADLVIFADKQERLITENFASKASNSPFIGNKLKGVVKYTIADGEVVYPN

SEQ ID NO: 2039 - DNA, 627 bp, Streptococcus agalactiae
atggatttagcaagacagattgccatggaactattagatattcaagctgtttacttaagaccccaacaaccctttacttgggcttcgggggtcaaatcgccaatttacactgataatcgtgtaaccttatcgtatcctgagacaaggacactgattgaaaatggttttgttaaacaaatacagaaacatttcccaaacgttgatatcatagcagggacagcgactgcaggcataccacatggcgctattatagctgataagatgaacttgccctttgcctatatacgatcgaaggcaaaggatcatggtgtggggaatcaaatcgagggacgtgtttactcaggccaaaaaatggttatcattgaagatttgatttcaacaggaggatctgttttagaggctgttacggctgcgcagagtcaaggtattgaggttttaggggtagtagcgatatttacatatcaattagctaaggctgaacaagcatttcgtgaagctgatattcctttggtgactttgacggattacaatcaattaattaaagttgctaaagttaatggatatattacagctgaccaactggtattactgaaaaaatttaaagaagatcaaatgaattggcaaagt

SEQ ID NO: 2040 - protein, 209 aa, Streptococcus agalactiae
MDLARQIAMELLDIQAVYLRPQQPFTWASGVKSPIYTDNRVTLSYPETRTLIENGFVKQIQKHFPNVDIIAGTATAGIPHGAIIADKMNLPFAYIRSKAKDHGVGNQIEGRVYSGQKMVIIEDLISTGGSVLEAVTAAQSQGIEVLGVVAIFTYQLAKAEQAFREADIPLVTLTDYNQLIKVAKVNGYITADQLVLLKKFKEDQMNWQS

SEQ ID NO: 2041 - DNA, 627 bp, Streptococcus pyogenes
atgacactagcaagccaaattgcaactcaattacttgatattaaagctgtttatttaaagcctgaagacccttttacgtgggcatctggcattaaatcacctatttacactgataatcgtgtcaccctttcttatcctaagactcgtgatttaattgagaatgggtttgtggaaactatcaaggctcatttcccagaagttgaggtcatcgctggtacagctacagcaggtattcctcacggtgccattatagcagataaaatgactcttccttttgcttatattcgcagtaagccaaaagatcatggagcaggcaaccagattgaggggcgtgtgcttaaaggccaaaaaatggttatcattgaagatttgatttcaacaggtggttcggtactagatgcagccgcagcagccagtcgtgagggagctgacgttctgggagttgttgcgattttcacttatgagttaccaaaagctagtcagaattttaaagaagctggtatcaagttgattacgctttctaattatactgagctaattgcagttgcaaagttgcaaggctatattactaatgatggtttacatttacttaaaaaatttaaagaagaccaggtaaactggcaacaa

SEQ ID NO: 2042 - protein, 209 aa, Streptococcus pyogenes
MTLASQIATQLLDIKAVYLKPEDPFTWASGIKSPIYTDNRVTLSYPKTRDLIENGFVETIKAHFPEVEVIAGTATAGIPHGAIIADKMTLPFAYIRSKPKDHGAGNQIEGRVLKGQKMVIIEDLISTGGSVLDAAAAASREGADVLGVVAIFTYELPKASQNFKEAGIKLITLSNYTELIAVAKLQGYITNDGLHLLKKFKEDQVNWQQ

SEQ ID NO: 2043 - DNA, 753 bp, Streptococcus agalactiae
ttgtgtcatactggtacatttccaacaattattatttctatagagaggaattatatgttagaaaaatgccctatcattgccttagatttttctgatttggcttctgtaacaacttttttagaacattttccaaaagaagaattgctttttgtcaaaataggaatggagctttattattccgaaggtccctcaattattagatatattaaatccttaggacatcgcatttttttggatttaaaattacatgatatccctaatacagttcgatcatctatgtctgtcttagccaaattaggcattgatatgactaatgtgcatgctgcaggaggagtcgaaatgatgaaagcagctagagaaggtttggggaagggtccaatactattagcagtgacacaattaacctcgacttcacaagaacaaatgcaggtggatcaacatattaacttaagtgtagttgattcggtttgccattatgctcaaaaagctcaagaagcaggcttagatggagtagtcgcatcggctcaagagggaatgcaaatcaagaaacagactaacgaacatttcatttgcttaacgcctggtatcagacctccacaaaccaatcagttagatgatcaaaaaagaacgatgactcctgagcaagcacgtatagttggggctgattatatcgttgtgggaagacctataacgaaagcagaaaatccatatcaagcatatctagagataaaagaagaatggaatcgtattaaa

SEQ ID NO: 2044 - protein, 251 aa, Streptococcus agalactiae
MCHTGTFPTIIISIERNYMLEKCPIIALDFSDLASVTTFLEHFPKEELLFVKIGMELYYSEGPSIIRYIKSLGHRIFLDLKLHDIPNTVRSSMSVLAKLGIDMTNVHAAGGVEMMKAAREGLGKGPILLAVTQLTSTSQEQMQVDQHINLSVVDSVCHYAQKAQEAGLDGVVASAQEGMQIKKQTNEHFICLTPGIRPPQTNQLDDQKRTMTPEQARIVGADYIVVGRPITKAENPYQAYLEIKEEWNRIK

SEQ ID NO: 2045 - DNA, 690 bp, Streptococcus pyogenes
atgaaagaagaacgcccaattattgctttagacttttcatcatttgaggagactaaagcatttttagacttatttccagcagaagaaaaactatacgtgaaaattggtatggaattatattatgcgcaaggaccagatattgttcggtatatcaaatcgttagggcataatgtatttttggatttaaaattacatgatattccaaatactgttcgtgctgctatggcagttcttaaagaattagatattgatatggcaactgttcatgcagctggtggtgtagagatgctaaaagcagctcgagaaggactaggtcaaggccctaccttaattgcggtaacgcagctaacttcaaccagtgaagaccaaatgcgtggtgatcaaaatattcaaacgagtcttttagagtctgttttgcattacagcaagggggcagctaaagctcagctagatggggcggtttgttcggcacaagaagtagaagctatcaaggcggtgacgcctacgggatttacttgcttaactcctggcattcgtcctaaaggcagtaatattggcgatcaaaaacgagtgatgactccaaaccaagcaagacgcattggaagtgattatattgtggtagggcgaccaattacccaggcaaaagacccagtggctgcttaccaagccataaaagctgagtgggcaggc

SEQ ID NO: 2046 - protein, 230 aa, Streptococcus pyogenes
MKEERPIIALDFSSFEETKAFLDLFPAEEKLYVKIGMELYYAQGPDIVRYIKSLGHNVFLDLKLHDIPNTVRAAMAVLKELDIDMATVHAAGGVEMLKAAREGLGQGPTLIAVTQLTSTSEDQMRGDQNIQTSLLESVLHYSKGAAKAQLDGAVCSAQEVEAIKAVTPTGFTCLTPGIRPKGSNIGDQKRVMTPNQARRIGSDYIVVGRPITQAKDPVAAYQAIKAEWAG

SEQ ID NO: 2047 - DNA, 1230 bp, Streptococcus agalactiae
atgcaaaatgatatgagcgttgttcttagagcaggtaaattactgattgaaagcggagcagaagtctatcgtgtcgaagacacaatgaagcattttgctaaggctcttcagatagaaaattttgaagcttatgtggttagtagcagtattatcgcttccgggattaaccgctatggtaaacaagaagctaaagtatgcaatacagatggtgtaacagcaaatttaggtagacttgaagctgttaataacctttctaggcaaattgctaaacaagacttagtatctccagaagaaattgtaaagcagttagacttaattgaacatcaaaaagattatagtttacttgttactttaatttcttatttttgtggagcgggtagtttttctttagccttaggtagttccttattagattcattttccgctgctgtaacaggcttaattttaggatattttctgaatttgatggaaagtcgtatacatacaggatttcttttgaccattctaggtagttctgtagtggctttaagtgctaatttattatatttttcaggattaggtgagcatcgtagcattattatattaggggcactaatggttatggtgccaggggctgcctttgttaattcggtgagagaattttcacagaataatttttcaacaggtttagctttgattatgtctgctttactcatttgtatttctatatcagcaggtgtggctattacaattgaaattattccgtttgcagaacaaatgacaggttctttttctggtgttcctaataccatccttgagattatcatcagaacactaatggccggtttagggacgatagccttctctattctctaccatgttccaaaacgttatttccttgacttaggtatactaggagcaatatcttggatgctctacctgatcttatggcaacaatttcacatggatgctatagccgtattttttccagggcttttcatcacttatttttcacggctattagctgctaaacgtaagtgtcctgccactgtctttttagcgacaagtatgtttcctcttattccaggacttagcttctatagagctgtttactttttattgacgggagcagatgccgtagcaatggaatattttagatcctgttttgtaacagcttttacaattgctatagcaatcagtattgtacagcagattcctctatcgttctttattagacgtaaaatgataaaa

SEQ ID NO: 2048 - protein, 410 aa, Streptococcus agalactiae
MQNDMSVVLRAGKLLIESGAEVYRVEDTMKHFAKALQIENFEAYVVSSSIIASGINRYGKQEAKVCNTDGVTANLGRLEAVNNLSRQIAKQDLVSPEEIVKQLDLIEHQKDYSLLVTLISYFCGAGSFSLALGSSLLDSFSAAVTGLILGYFLNLMESRIHTGFLLTILGSSVVALSANLLYFSGLGEHRSIIILGALMVMVPGAAFVNSVREFSQNNFSTGLALIMSALLICISISAGVAITIEIIPFAEQMTGSFSGVPNTILEIIIRTLMAGLGTIAFSILYHVPKRYFLDLGILGAISWMLYLILWQQFHMDAIAVFFPGLFITYFSRLLAAKRKCPATVFLATSMFPLIPGLSFYRAVYFLLTGADAVAMEYFRSCFVTAFTIAIAISIVQQIPLSFFIRRKMIK

SEQ ID NO: 2049 - DNA, 879 bp, Streptococcus agalactiae
ttgaacgatgttatcaatattgtctatcatgttgaaaatcaagatttagtaagatattccggtgattatactaattttgaatcagtctatgcaatgaaaaaggctcaattagaagcagcctatgaacgtcaacaaaaggaaatagctgatttacaagattttgttaatcgtaataaagcacgcgtcgcaacacgtaatatggcaatgtctcgtcaaaagaaactagacaaaatggatattattgagttacaagcagagaaaccaaagccaagtttcgaatttaaagaatctcgcacaccaggacgttttattttccaagctaaagatcttcaaattggatatgatcgtgctttaacaaaacctctaaacctaacatttgaacgtaatcaaaaaatagctattgttggagcaaatgggataggaaaaacaacattacttaagagtttactaggtattatcccccctatttctggtaatgttgaacgaggtgattttattgatttaggttattttgaacaagaagtacccggaggaaatcgccaaactccactcgaagcagtatgggatgcttttcctgctttgaaccaagcagaggttagggcagctcttgctcgttgtggtttaacttcaaagcatattgaaagtcagattcaggtgttatctggtggggagcaatcaaaggtcagattttgcttattaatgaatcgcgaaaataatgtccttgtacttgacgaaccaaccaatcatttagatgtagatgctaaagatgagttaaaacgtgctttaaaagcttataagggatcaatcttgatggtatgtcatgaaccggacttttatgaaggatggatggatgatgtttgggactttaaccaacttagt

SEQ ID NO: 2050 - protein, 293 aa, Streptococcus agalactiae
MNDVINIVYHVENQDLVRYSGDYTNFESVYAMKKAQLEAAYERQQKEIADLQDFVNRNKARVATRNMAMSRQKKLDKMDIIELQAEKPKPSFEFKESRTPGRFIFQAKDLQIGYDRALTKPLNLTFERNQKIAIVGANGIGKTTLLKSLLGIIPPISGNVERGDFIDLGYFEQEVPGGNRQTPLEAVWDAFPALNQAEVRAALARCGLTSKHIESQIQVLSGGEQSKVRFCLLMNRENNVLVLDEPTNHLDVDAKDELKRALKAYKGSILMVCHEPDFYEGWMDDVWDFNQLS

SEQ ID NO: 2051 - DNA, 1578 bp, Streptococcus pyogenes
ttgacggcttttttgatgacagttaaggaagaaacgatgagtattttagaagttaagcagttgagtcacggttttggggatcgggctatttttgaaaatgtgtcatttcgcctcttaaaaggcgaacatattggactagttggggcaaatggtgaaggaaaatcaacctttatgagtatagtcacaggacatttacagcctgacgaaggaaaagtagagtggtcgaagtatgtcactgcaggttacctggatcaacatacagtgttggaatcaggacaaaccgttcgtgatgtcttgcgaactgcttttgatgagttatttaagaccgagaatcgtattaatgagatttacgcgtcaatggcagatgataaagctgatattgctgttttgatggaagaagtaggtgagcttcaagatcgtttagaaagtcgtgatttctatactttggatgctaagattgatgaagtagcgcgtgcgcttggtgttatggattttggaatggagtcagatgttacatccttatcaggtgggcaacgaacaaaggttttattagccaaattactattagaaaaacctgatattctgctattagatgaaccaactaaccatttggatgctgagcatattgaatggttaaaacgctatttacaacattatgaaaatgcttttgtgttgatttcgcatgatatttctttcttaaatgatgtgattaatattgtttatcatgttgaaaatcaaagtttagttcgctatactggggattattaccaatttcaagctgtttatgagatgaaacaatctcaacttgaagcagcctatgaacgtcaacaaaaagagattgctaacttgcaggattttgtcaaccgaaataaggctcgggtagcgacacgtaacatggcaatgtctcgccaaaaaaaacttgataagatggatataattgaacttcaagctgagaaaccaaaaccaaattttgaatttaagcaagctagaactcccagtcgattcatttttcaaacaaaaaatcttgtgattggttatgattacccattgaccaaagaacccttaaatataacgtttgaaagaaatcaaaaaattgctattgttggggccaacggtattggaaaatctactttgctaaaaagtttattaggtgttattgagcctttagaaggtcatattgtcacaggggattttttagaagttggctactttgaacaagaagtgacaggtgttaaccgacaaactccgctagaagtagtttgggatgcttttcctgccttaaatcaggcagaagttcgagcggcactagctcgttgcggactaacatcaaaacatatcgaaagtcaaattcaagtactttcgggtggtgaacaagcaaaagttcgtttttgtttgttgatgaatcgtgaaaataacgtgcttattttagacgaaccaacaaatcatcttgatattgatgctaaaaatgagctcaaacgtgctttaaaagcatataagggttctattttaatggtttgtcatgaacctgatttctacaatgggtgggtaaccgatacttgggattttagtaagttaacc

SEQ ID NO: 2052 - protein, 526 aa, Streptococcus pyogenes
LTAFLMTVKEETMSILEVKQLSHGFGDRAIFENVSFRLLKGEHIGLVGANGEGKSTFMSIVTGHLQPDEGKVEWSKYVTAGYLDQHTVLESGQTVRDVLRTAFDELFKTENRINEIYASMADDKADIAVLMEEVGELQDRLESRDFYTLDAKIDEVARALGVMDFGMESDVTSLSGGQRTKVLLAKLLLEKPDILLLDEPTNHLDAEHIEWLKRYLQHYENAFVLISHDISFLNDVINIVYHVENQSLVRYTGDYYQFQAVYEMKQSQLEAAYERQQKEIANLQDFVNRNKARVATRNMAMSRQKKLDKMDIIELQAEKPKPNFEFKQARTPSRFIFQTKNLVIGYDYPLTKEPLNITFERNQKIAIVGANGIGKSTLLKSLLGVIEPLEGHIVTGDFLEVGYFEQEVTGVNRQTPLEVVWDAFPALNQAEVRAALARCGLTSKHIESQIQVLSGGEQAKVRFCLLMNRENNVLILDEPTNHLDIDAKNELKRALKAYKGSILMVCHEPDFYNGWVTDTWDFSKLT

SEQ ID NO: 2053 - DNA, 246 bp, Streptococcus agalactiae
ttgacgctgtctggttgtgctaattggattgataaaggtcaatcaatcaccagcgttggttcaaccgccttacagccacttgtagaagctgcagcagatgagtttggtaagacaaacctcggtaagactatcaatgtccaaggaggaggctcaggaacaggcttatcacaagtacagtctggagctgttcaaattggtaatagcgacttatttgcagaagaaaaagaggtattgatgctaagaaat

SEQ ID NO: 2054 - protein, 82 aa, Streptococcus agalactiae
MTLSGCANWIDKGQSITSVGSTALQPLVEAAADEFGKTNLGKTINVQGGGSGTGLSQVQSGAVQIGNSDLFAEEKEVLMLRN

SEQ ID NO: 2055 - DNA, 567 bp, Streptococcus agalactiae
ttgaaagaccatcaagtcgcagtagctggattagctgttattgttaataaaaaagttaatgttaaaaatctaaccacccaccaacttcgtgatatttttgcaggaaaaatcaagaattggaaagaagtgggaggacaagatttagatatttccatcatcaatcgagcagcaagttctggatcccgtgcaaccttcgataatactattatgggaaatgttgctcctattcaaagccaagaacaagattcaaatggtatggtgaaatcaattgtttctcaaacacctggtgcgatttcatacctcgcttttgcatacgttgataaatctgtcggaacattaaaactaaatggttttgcgccaacagctaaaaatgttactaccgacaactggaaactttggtcatatgaacatatgtatacaaaaggtaatgaaacaggtctaacaaaagaattcttagactacatgaaaagtgataaagttcaaagtagtatcgtacaacatatgggatatatctctattaacgacatgaaagttgttaaagatgctgaaggtaaagtaaccccaaaa

SEQ ID NO: 2056 - protein, 189 aa, Streptococcus agalactiae
MKDHQVAVAGLAVIVNKKVNVKNLTTHQLRDIFAGKIKNWKEVGGQDLDISIINRAASSGSRATFDNTIMGNVAPIQSQEQDSNGMVKSIVSQTPGAISYLAFAYVDKSVGTLKLNGFAPTAKNVTTDNWKLWSYEHMYTKGNETGLTKEFLDYMKSDKVQSSIVQHMGYISINDMKVVKDAEGKVTPK

SEQ ID NO: 2057 - DNA, 933 bp, Streptococcus agalactiae
ttgatcctaggaggaattatgaaaaatcaagaattagctaaaaaattaacatctccttcaaaaaactctcgattagaaaaatttggtaaaggaataacttttctttcgcttgccctaatcgtcttcattgttgcgatgattttgatttttgttgctcaaaaaggactatctacattttttgttgatggcgttaaattaacagacttcttatttaatacaaaatgggaaccaagtgctaagtcatttggtgcttttccaatgatagctggatcatttattgttactattctatcagctatcattgctacaccatttgctatcggtgctgccgtatttatgactgaaatctcacctaaatatggttctaaaattttacaacctgcagttgaattactagttgggattccttctgttgtttacggttttattggtttacagattattgttcccttcgttcgctctatttttgggggaacaggttttggcattttatctggggtctgtgtcctcttcgtcatgattctaccaactgttactttcatgacagtagatagccttagagctgtgccacgtcactataaagaagcaagtttagccatgggggcaactcgttggcaaacaatttggcgtgttatattaaacgctgcacgtccaggaattttcactgcaattgtttttggtatggcacgtgcatttggtgaagctctagcaattcagatggttgtcggaaactctgcaattttaccaacgtcattgacaacaccagcagcaacattaacgtctgttctaacaatgggtattggtaatactgtaatgggaactgtacaaaacaatgtcctctggtcgctagccttagtacttttaattatgagtttagcatttaatacagttattaagttaattacaagggaaggaaagaaaaactatgaacgc

SEQ ID NO: 2058 - protein, 311 aa, Streptococcus agalactiae
MILGGIMKNQELAKKLTSPSKNSRLEKFGKGITFLSLALIVFIVAMILIFVAQKGLSTFFVDGVKLTDFLFNTKWEPSAKSFGAFPMIAGSFIVTILSAIIATPFAIGAAVFMTEISPKYGSKILQPAVELLVGIPSVVYGFIGLQIIVPFVRSIFGGTGFGILSGVCVLFVMILPTVTFMTVDSLRAVPRHYKEASLAMGATRWQTIWRVILNAARPGIFTAIVFGMARAFGEALAIQMVVGNSAILPTSLTTPAATLTSVLTMGIGNTVMGTVQNNVLWSLALVLLIMSLAFNTVIKLITREGKKNYER

SEQ ID NO: 2059 - DNA, 147 bp, Streptococcus agalactiae
ttgtataattgtattccaataccgcctcctgcttcatatgatgatgatttcccagttaaaaatgaccaagatacgtgtggcaatccgcgaacaagaataaaaattaaaagagaggcgaggattgtaacgatgatagctgcaatacta

SEQ ID NO: 2060 - protein, 49 aa, Streptococcus agalactiae
MYNCIPIPPPASYDDDFPVKNDQDTCGNPRTRIKIKREARIVTMIAAIL

SEQ ID NO: 2061 - DNA, 885 bp, Streptococcus agalactiae
atgaacgctaaaaaggctgacaaattagcaactacaatactctatagtattgcagctatcatcgttacaatcctcgcctctcttttaatttttattcttgttcgcggattgccacacgtatcttggtcatttttaactgggaaatcatcatcatatgaagcaggaggcggtattggaatacaattatacaattcctttttcctacttattgttactctgattatttctattcctctatctttaggagctggaatatacctctcagaatatgctaaaaaaggacgtttaacaaactttgttagaacatgtatcgaaattttgtcatctcttccttctgttgtagttggtctgtttggttacctaatcttcgttgttcaatttcaatatggcttctcaattatctcaggtgccttagcacttactgtttttaacttaccccaaatgacacgtagtgttgaagatagccttcaaaatgtacaccacacacagcgtgaagcaggattggccctaggtatttctcgttgggaaacggtcatttacgtcgttgtccctgaagctctgccaagtattgtaactggtgttgtgctagcttcaggacgtattttcggtgaggcagcagcacttatttatacagctggtcaatctgctccagcacttgattggtcaaattggaacgtccttagtgttacaagtccaatctcaattttccgtcaagcagaaactttagctgttcatatttggaaagttaatagcgaagggacaatccctgatgcaacacaagtatctgccggtagcgccgcagtcttattggttgttattcttattttcaacctttcagctcgctcgatcggtaagaaacttcattcgaaattaacctcgtctaat

SEQ ID NO: 2062 - protein, 295 aa, Streptococcus agalactiae
MNAKKADKLATTILYSIAAIIVTILASLLIFILVRGLPHVSWSFLTGKSSSYEAGGGIGIQLYNSFFLLIVTLIISIPLSLGAGIYLSEYAKKGRLTNFVRTCIEILSSLPSVVVGLFGYLIFVVQFQYGFSIISGALALTVFNLPQMTRSVEDSLQNVHHTQREAGLALGISRWETVIYVVVPEALPSIVTGVVLASGRIFGEAAALIYTAGQSAPALDWSNWNVLSVTSPISIFRQAETLAVHIWKVNSEGTIPDATQVSAGSAAVLLVVILIFNLSARSIGKKLHSKLTSSN

SEQ ID NO: 2063 - DNA, 801 bp, Streptococcus agalactiae
atggcagaatataattgggacgaacgccatatcattaccttccctgaagaaaattcagctctcaccacaaaagatttacacgtttactacggtgagaaagaagctatcaagggaattgatatgcaatttgaaaaaaataaaattacagccttaatcggcccatctggatgtggaaaatcaacatatcttcgtagcttaaatcgtatgaatgatacgattgatattgcacgcgtgactggacaaatcatgtatgaaggaattgatgttaacgctcaagatatcaatgtttacgagatgcgaaaacatatcggaatggttttccaacgtccaaacccgtttgcaaaatcaatttataaaaacattacctttgcatatgagcgtgctggtgtaaaagataaaaaattcttagatgaagttgtcgaaacctcactaaaacaagctgctctatgggatcaagtaaaagatgaccttcataaatcagcattcactttatctggcggtcaacagcagcgattatgtattgcacgtgctatcgcagttaaaccagaaattctcttaatggatgaacctgcttcagcactcgatccgattgcaactatgcaactagaagagacaatgtttgaactcaagaaaaattacactataattatcgtaacacataatatgcaacaagcagcacgtgctagtgattatactgcatttttctatcttggagacttaatcgaatacgataaaacgaataacattttccaaaatgctaaatgtcaatctactagcgattatgtttctggtcgatttgga

SEQ ID NO: 2064 - protein, 267 aa, Streptococcus agalactiae
MAEYNWDERHIITFPEENSALTTKDLHVYYGEKEAIKGIDMQFEKNKITALIGPSGCGKSTYLRSLNRMNDTIDIARVTGQIMYEGIDVNAQDINVYEMRKHIGMVFQRPNPFAKSIYKNITFAYERAGVKDKKFLDEVVETSLKQAALWDQVKDDLHKSAFTLSGGQQQRLCIARAIAVKPEILLMDEPASALDPIATMQLEETMFELKKNYTIIIVTHNMQQAARASDYTAFFYLGDLIEYDKTNNIFQNAKCQSTSDYVSGRFG

SEQ ID NO: 2065 - DNA, 756 bp, Streptococcus agalactiae
atgacacaacctattttacaagtcagtgatttgtctgtttactataataagaaaaaagctttaaaagaagtctcaatggacttctatcctaatgaaattacagccttaattggtccgtctggttctggaaagtcaacactcttacgagctattaaccgtatgggagacttaaatcctgaagtcactctaacaggagcagtgatgtataacggacataatgtttatagcccgcgcactgataccgtagaacttcgtaaagaaattgggatggtttttcagcagcctaatccatttcctatgtcagtatttgaaaatgttgtttatggtcttagactcaaaggaataaaagacaaagctacgttagatgaagccgtagagacttcattgaagggcgcgtctatctgggacgaggtcaaagatagattacacgactctgctcttggtttatctggtggtcaacaacaacgtgtttgtattgccagaacccttgctaccaagcctaaaattatccttctagatgagccaacctctgcacttgacccaatttctgctggtaaaattgaagagactttacatggtctaaaagatcaatataccatgttacttgttacacgttctatgcagcaagcctcacgtatttctgatcgtacaggtttcttcttagacggtaacttaattgaatatggcaatacaaaagaaatgtttatgaatcctaaacataaagaaactgaagattacattacaggtaaattcggt

SEQ ID NO: 2066 - protein, 252 aa, Streptococcus agalactiae
MTQPILQVSDLSVYYNKKKALKEVSMDFYPNEITALIGPSGSGKSTLLRAINRMGDLNPEVTLTGAVMYNGHNVYSPRTDTVELRKEIGMVFQQPNPFPMSVFENVVYGLRLKGIKDKATLDEAVETSLKGASIWDEVKDRLHDSALGLSGGQQQRVCIARTLATKPKIILLDEPTSALDPISAGKIEETLHGLKDQYTMLLVTRSMQQASRISDRTGFFLDGNLIEYGNTKEMFMNPKHKETEDYITGKFG

SEQ ID NO: 2067 - DNA, 759 bp, Streptococcus pyogenes
atgatgacagaacctattttacagatcagagacctttctgtttactacaatcaaaagaaaacgttaaaagatgtctctttggacctttatccaaatgaaataacagctttaattggtccttctggatctgggaaatcaacgctcttgcgttctatcaaccgtatgaatgatttgaatcctgaagtaaccattacaggctctatcgtctataacggacacaatatttatagtccaaggacagatacggttgatttacgcaaagaaattggtatggtattccaacaacccaacccatttccgatgtctatttatgagaacgtggtttacggccttcgcttaaaaggtatcagagataaatcaatcttagaccatgctgttgaaagctctcttaaaggggcttccatttggaatgaagtcaaagatcgtttacatgattctgcggttggcttatcaggcggacagcaacagagagtttgcatagctagagttcttgctaccagccccagaataatccttttagatgaacctacctcagctcttgatcctatctcagctgggaaaattgaagaaacattattgttattaaaaaaagattatacactggctattgtgacccgctcaatgcagcaagcctcacgtttatcagatcgaacaggttttttcttggagggtgacttacttgagtgtggtcctacaaaagccatgtttatgaatcctaagcgcaaagaaaccgaagactatatttctggtaaatttggt

SEQ ID NO: 2068 - protein, 253 aa, Streptococcus pyogenes
MMTEPILQIRDLSVYYNQKKTLKDVSLDLYPNEITALIGPSGSGKSTLLRSINRMNDLNPEVTITGSIVYNGHNIYSPRTDTVDLRKEIGMVFQQPNPFPMSIYENVVYGLRLKGIRDKSILDHAVESSLKGASIWNEVKDRLHDSAVGLSGGQQQRVCIARVLATSPRIILLDEPTSALDPISAGKIEETLLLLKKDYTLAIVTRSMQQASRLSDRTGFFLEGDLLECGPTKAMFMNPKRKETEDYISGKFG

SEQ ID NO: 2069 - DNA, 651 bp, Streptococcus agalactiae
atgttaagatcaaaatttgatgaagaattagataaactgcataaccaattctatgcaatgggaattgaagctatcggacaaatcaaaaaaacagttcgtgcttttgtcagtcatgatcgagagttagctaaagaagtgatagaagatgatgtaacgcttaacaactttgaaacgaagttagagaaaaaatcattggaaattattgcactccagcagcctgtatcacaagacttacgcaccgttattaccgttttaaaagctactagtgatgttgagcgtatgggagaccatgcagcagcagttgcaaaagcaaccatccgtatgaagggcgaggaaagaatcccagcagtagaattagaaatcaataatatgggaaaagcagttaaaaacatgcttgaagaagccttaacagcttatatcaatggtgatgatgaaaaagcttacgaagtagcagcaatggatgaaatagttgatgattacttccgtgatatccaaaaaatggtagttgaaacaattcaaaagcatcctgacgtagcatttgccgccaaagaatacttccaagtattgatgcacttggagcgaattggagattatggcaaaaatatctgtgaatggattgtttatttaaaaactggaaaaattatcgagtta

SEQ ID NO: 2070 - protein, 217 aa, Streptococcus agalactiae
MLRSKFDEELDKLHNQFYAMGIEAIGQIKKTVRAFVSHDRELAKEVIEDDVTLNNFETKLEKKSLEIIALQQPVSQDLRTVITVLKATSDVERMGDHAAAVAKATIRMKGEERIPAVELEINNMGKAVKNMLEEALTAYINGDDEKAYEVAAMDEIVDDYFRDIQKMVVETIQKHPDVAFAAKEYFQVLMHLERIGDYGKNICEWIVYLKTGKIIEL

SEQ ID NO: 2071 - DNA, 2547 bp, Streptococcus agalactiae
atgaaaactgtagaacattttgttaccaaatttgtccctgaaaactataaccttttcttggatattaatcgtcaaactaaaaccttttcaggtaacgttgctgtgtctggcgaagccttagataacaatatctcttttcaccaaaaagggttaaccattaaatctgtcttattagataatcaaccattagatttccaactagatgaagacaatgaagctatgcatattcaattgcatgaaactggtagcatggtattagtctttgaattcagcggtcacattaccgataatatgacaggtatgtatccatcttactatacagttaatggcatcaaaaaagaggttatctccacacaatttgaaagtcattttgctcgtgaagtattcccaagtattgacgaaccagaagcaaaagcaacctttgatttgagcctaaaattcgatcaaaaagaaggagagattgctctttcaaatatgccggaaatcaatgctgaacaacgtcaagaaacaggtttatggacatttgacaccacacctaaaatgtcctcatatttattagcttttgccttgggggaattgcatggtaaaacaacacataccaaaaacggcactcttgttggctcatatgccacaaaagcccatcagttaaatgaattagatttttctttagatatcgttgtgcgtgttattgagttttatgaggactactttggtgtacgttatcctattcctcagtcactccacgttgctctacctgatttttctgctggagctatggaaaattggggattagtaacatatcgtgaagtctatcttttagtagatgagaactctagtgtttccagccgtcagcaagtagcattagttgtagcacatgaaatagctcaccagtggtttggtaacctcgttactatgaaatggtgggatgatttatggttaaatgaatcatttgctaatatgatggaatatgtatcaattgattatattgaaccaaaacttaatatatttgaagactttcaaacaggtggtctaccattagctcttaagcgtgatgccacagatggcgtccaatctgttcacgttgaggtcaatcatcctgatgaaattaacacactttttgatccagctatcgtttatgcaaaaggtagccgcctcatgcacatgttacgtcgctggttaggcgatacagattttgccgcaggactaaaaatttattttgaaaaacatcaatatcaaaatactattggtcgtgacctttggaatgcactttctcaaacctcaggaaaagatgttgcagctttcatggattcttggttagagcaaccaggataccctgtgatggcagccaaaatagaagaagatgagctcattttaactcaaaaacaattctttattggtgaacacgaagataagtctcgcttgtggcaaattcctcttaatagtaattgggaaggaatcccagagatattaaccgaggaaacggtagtaatccccaattttagtcagttagctgaaaagaacaaagaaaatggtgcactgcgtttcaatactgaaaatactgcacattacattactaactatcaaggtcaactcttagagcatatcatttctgatcttcctcttatggataacatttctaaactacaaattgtacaagaacgtcatttacttgctgaaagtggtatgatttcatatagtagtttaatacctttagtctctcttttgagccaagagacatcatatcttgttaactctgctattaagagtgttattgatggtttatccttattcgtccaggaagatagccaagatgaattcgactttaaagaatttgttaataaattatcagcatttaattttaatagacttggctttgaaaaaagagaaggagaaggagatgatagcgaaatggtccgtcatctatccctaagccttgctctctactcagataatgaacatgctattgaagaagctcaccatatttttaaagcccacgaaaataatatcgctgctataccagctgcaattcgcctgttagttcttaccaatgaaatgaagcatttcgaatccaaagaacttagccacttgttattagagacttatagtactactaccgatgggaatttcaaacgacaactagcgagtgctttatctcatactacagatagcaagacactcaagaaattattgtcagattggaaaaataaagatattgtgaaaccacaagacttagctatgagttggtatgctactttccttaaaaattcttttacacaagaaagtgtctgggagtgggcccaagaaaactgggaatggatcaaagcaactctaggtggtgatatgagttttgataaatttgtgatttatccctcaagtagtttcaaaacagaagaacgccttgaacaatataaaaactttttcgagcctcaattaagcgatatggcgattagccgtaatatttcaatgggaattaaagaaatttctgctcgtgtccttttaatcacgaagcaaaaagaagaagttatcaatactatcaaaaaatatatc

SEQ ID NO: 2072 - protein, 849 aa, Streptococcus agalactiae
MKTVEHFVTKFVPENYNLFLDINRQTKTFSGNVAVSGEALDNNISFHQKGLTIKSVLLDNQPLDFQLDEDNEAMHIQLHETGSMVLVFEFSGHITDNMTGMYPSYYTVNGIKKEVISTQFESHFAREVFPSIDEPEAKATFDLSLKFDQKEGEIALSNMPEINAEQRQETGLWTFDTTPKMSSYLLAFALGELHGKTTHTKNGTLVGSYATKAHQLNELDFSLDIVVRVIEFYEDYFGVRYPIPQSLHVALPDFSAGAMENWGLVTYREVYLLVDENSSVSSRQQVALVVAHEIAHQWFGNLVTMKWWDDLWLNESFANMMEYVSIDYIEPKLNIFEDFQTGGLPLALKRDATDGVQSVHVEVNHPDEINTLFDPAIVYAKGSRLMHMLRRWLGDTDFAAGLKIYFEKHQYQNTIGRDLWNALSQTSGKDVAAFMDSWLEQPGYPVMAAKIEEDELILTQKQFFIGEHEDKSRLWQIPLNSNWEGIPEILTEETVVIPNFSQLAEKNKENGALRFNTENTAHYITNYQGQLLEHIISDLPLMDNISKLQIVQERHLLAESGMISYSSLIPLVSLLSQETSYLVNSAIKSVIDGLSLFVQEDSQDEFDFKEFVNKLSAFNFNRLGFEKREGEGDDSEMVRHLSLSLALYSDNEHAIEEAHHIFKAHENNIAAIPAAIRLLVLTNEMKHFESKELSHLLLETYSTTTDGNFKRQLASALSHTTDSKTLKKLLSDWKNKDIVKPQDLAMSWYATFLKNSFTQESVWEWAQENWEWIKATLGGDMSFDKFVIYPSSSFKTEERLEQYKNFFEPQLSDMAISRNISMGIKEISARVLLITKQKEEVINTIKKYI

SEQ ID NO: 2073 - DNA, 2595 bp, Streptococcus pyogenes
atgatacttaggtatcatctgttgatctattatgatttgttattagaattaaggagttatatgaagacagtagaacatctcatcgaaacatttgtgcctgaaaattataacatctttttagatattaatcgtcagactaaaacatttacggggaatgttgcgattaatggtgaagctttagataatcatgtggctttccaccaaaaagatttggacattaagtctattttgctcgataatgaagctgttatttatcaagtggataacgacaatgaagttgtgcgtgttgaattacctgaaacaggaatgatgacgcttgtcattgaattttcaggtagcattacagataatatgacaggtatttacccttcatattacactaaaaatggtgagaaaaaagaagtcatttcaactcagtttgaaagccattttgcacgtgaagctttcccatgtatcgatgaaccacaagcaaaagctacttttgatttaagcttgacctttgatcaagaaattggtgagatagcgttatcgaatatgccagaagtcaatattgaccgtcgcgaggagactggtctttggacatttgatacgacactaagaatgtcatcttacttgctagcgtttgcgctaggagaacttcatggaaagactgtagaaagcaaaaaaggaacaactgttggtgtgtatgcgacaacagcgcatcctcttagctcgcttgatttttcattggatattgcagttcgtgttatcaacttttatgaagactattttggagtacattacccaatcccgcaatctcttaatattgcgcttccagatttttcatctggtgctatggaaaattggggtttaatcacttatcgtgaaatttatttattagtagatgaaaattcgactgttcaaagccgacaacaagttgcacttgtaatcgcccacgagatagcacaccaatggtttggaaacttggttacaatgaaatggtgggacgatctgtggttaaatgagagttttgccaacatgatggaatatgtctctatcgaggctattgagccgtcttggaaaataatagaagatttccaaacaggcggtattcctcttgctttaaaacgtgatgctactgatggtgttcaatcagtgcatgttgaagtcaatcatccagatgagataaatacattgtttgatcctgctattgtctatgcaaaaggtagtcgtttgatgcatatgttacgccgttttattggtgatcgtgattttgccattggcttacatcactactttgaaaaatatcaatatcgaaatactgtcgggcgtgatttatggaatattttatcagatacttcaggcaaagacgtagctgcttttatggatgcttggcttgaacaaccaggttatccagttttaacagctcgccttgaaaacgatcaattgattttgagtcaaaaacaattttttattggaaaaggtgaagaaaaaggtcgcctttggccgattcctttaaacactaattggcatggccttcctgaaactttgacagaggcagaaatggtcattccaaactttagtcaattggcagcagaaaatgaaggagctctacgtttcaatattgataatacagctcattacattacagactaccaaggatcattattagatgccttagtcactgaacttgcccaacttgataatacttctgctttacaagttattcaagaacgtcgtttattggcagatagtggcttgatttcctatgctgaattggttgacttaattgctcaattggacgattctaagtcttatatggtagcagaagcggttcaacaagtggtctctggtttgaaacgcttcattgatgaaggaagcttagcagaaaaatcctttaatcgcttggtaaccaccatctatcaagaagactttaatcagcatggttttgagaaaaaagctgacgaatcagatgaagatgagatggtacgtcaggttgccttgggccgcttgtggctagcagaaaatcagacgattattgacggattgagaactatttttgaagcatatcaaaacaatattgcaagtattccagcagctgttcgtcgcttggttttagccaaccaaatgaaatattttgaaacagatagcttggttgatatttattttgagacttatgtagcaactactgataataatttacgcagtgatttaacggttgcttttagtcaaacaaaacaaccaactactattagacgtattcttgttagtttaaaagataaagatattattaaacctcaggatttatcttattggtacaatgctttgcttggacaaagctttactcaagatatcatttgggaatgggctagagaaaattgggattggattaaatctgcacttggtggagatatgagctttgataaatttgttatttatccagcaagtaactttaaaacaccaaaacatctagcagaatataaatctttctttgaacctaagctagatgatatggctattagccgtaatattaccatgggaattaatgaaattgaagcacgtgttgctttgattactaaagaaaaagaagcagttattgcagctctcagtcattac

SEQ ID NO: 2074 - protein, 865 aa, Streptococcus pyogenes
MILRYHLLIYYDLLLELRSYMKTVEHLIETFVPENYNIFLDINRQTKTFTGNVAINGEALDNHVAFHQKDLDIKSILLDNEAVIYQVDNDNEVVRVELPETGMMTLVIEFSGSITDNMTGIYPSYYTKNGEKKEVISTQFESHFAREAFPCIDEPQAKATFDLSLTFDQEIGEIALSNMPEVNIDRREETGLWTFDTTLRMSSYLLAFALGELHGKTVESKKGTTVGVYATTAHPLSSLDFSLDIAVRVINFYEDYFGVHYPIPQSLNIALPDFSSGAMENWGLITYREIYLLVDENSTVQSRQQVALVIAHEIAHQWFGNLVTMKWWDDLWLNESFANMMEYVSIEAIEPSWKIIEDFQTGGIPLALKRDATDGVQSVHVEVNHPDEINTLFDPAIVYAKGSRLMHMLRRFIGDRDFAIGLHHYFEKYQYRNTVGRDLWNILSDTSGKDVAAFMDAWLEQPGYPVLTARLENDQLILSQKQFFIGKGEEKGRLWPIPLNTNWHGLPETLTEAEMVIPNFSQLAAENEGALRFNIDNTAHYITDYQGSLLDALVTELAQLDNTSALQVIQERRLLADSGLISYAELVDLIAQLDDSKSYMVAEAVQQVVSGLKRFIDEGSLAEKSFNRLVTTIYQEDFNQHGFEKKADESDEDEMVRQVALGRLWLAENQTIIDGLRTIFEAYQNNIASIPAAVRRLVLANQMKYFETDSLVDIYFETYVATTDNNLRSDLTVAFSQTKQPTTIRRILVSLKDKDIIKPQDLSYWYNALLGQSFTQDIIWEWARENWDWIKSALGGDMSFDKFVIYPASNFKTPKHLAEYKSFFEPKLDDMAISRNITMGINEIEARVALITKEKEAVIAALSHY

SEQ ID NO: 2075 - DNA, 678 bp, Streptococcus agalactiae
atgataaaaattttattaattgaagatgacttgagtctttccaattccgtttttgatttccttgatgactttgccgatgtcatgcaaatttttgatggagaagagggtctttacgaagccgaaagtggagtctatgatctgattcttctagatctcatgttacctgaaaaaaacggcttccaagtgttgaaagagctacgtgaaaaaggtattacaacccctgtattaataatgaccgctaaagaaagcattgatgataagggacaaggtttcgacttaggtgctgatgattatctaacaaaacctttttacctagaagaactaaaaatgcgaattcaggctcttttaaagcgttctggaaaatttaatgataacagcctaatttatggtgatattcgcgtagacatgtctactaactcaacctttgttaatcaaacagaagttgagctcttaggtaaagagtttgatcttttagtctatttccttcaaaatcaaaatgttatcttaccgaaatctcaaatctttgatcgtatttggggatttgatagtgatacaacgatttcagttgtagaagtctatgtctctaaggttcggaaaaaattaaaaggaacacttttttcagaaaaccttcaaactttgcgtagtgtaggatatattttaaagcatgtcgaaaccgat

SEQ ID NO: 2076 - protein, 226 aa, Streptococcus agalactiae
MIKILLIEDDLSLSNSVFDFLDDFADVMQIFDGEEGLYEAESGVYDLILLDLMLPEKNGFQVLKELREKGITTPVLIMTAKESIDDKGQGFDLGADDYLTKPFYLEELKMRIQALLKRSGKFNDNSLIYGDIRVDMSTNSTFVNQTEVELLGKEFDLLVYFLQNQNVILPKSQIFDRIWGFDSDTTISVVEVYVSKVRKKLKGTLFSENLQTLRSVGYILKHVETD

SEQ ID NO: 2077 - DNA, 672 bp, Streptococcus pyogenes
atgataaaaatattattagtagaagatgacttgagcttatcaaattccatttttgattttttagatgattttgcagacgtcatgcaagtttttgatggcgatgaaggtttatacgaagcagaaagtggtatttatgatttgattttgttagaccttatgttgccggagaaaaatggctttcaagtcttaaaagaattgcgagaaaaagatattaaaattcctgtattgatcatgacagctaaagagggtttagatgataaaggccacggatttgaattaggtgctgatgattatctgacaaagccgttctatttagaagagttaaaaatgcgaattcaagcactgttaaaaagaacagggaaatttgcagataaaaatattagttttggcaatttagtggttgacttagctcgaaaagaggtgaaggttgaagggaaagtagttgaattacttggcaaagaatttgatttgttggtgtatcttttgcaaaatcaaaacgttattttaccaaagacacaaatttttgatcgtttatggggattcgatagtgatactacgatttcggttgttgaagtttacatttctaaaataaggaaaaaattaaaaggtacctgttttgttaacaggcttcaaactttaagaagcgtaggatatattctaaaaaacaatgaa

SEQ ID NO: 2078 - protein, 224 aa, Streptococcus pyogenes
MIKILLVEDDLSLSNSIFDFLDDFADVMQVFDGDEGLYEAESGIYDLILLDLMLPEKNGFQVLKELREKDIKIPVLIMTAKEGLDDKGHGFELGADDYLTKPFYLEELKMRIQALLKRTGKFADKNISFGNLVVDLARKEVKVEGKVVELLGKEFDLLVYLLQNQNVILPKTQIFDRLWGFDSDTTISVVEVYISKIRKKLKGTCFVNRLQTLRSVGYILKNNE

SEQ ID NO: 2079 - DNA, 1311 bp, Streptococcus agalactiae
atgtcgaaaccgattaagataagtaaattcaaaaaaaatgtctcagatagtcattttatccattttttcacagtttttagtggtatttttctggttatgactgttatcatcctccaagtcatgcgctatggtgtttattcttctgttgatagtagtttaaagtatatcagtacccatcctaaaaattacatcaatatggttatgtcacgtactgctgcctacctagataactccaatatcgcaagtgtcaagttaaaacccggcggtcagacagtagctaatactgatattattctttttacatcagaagaagaagtcattaactattttgacgcattttcaaactatcagtttttaaaacctaataaaaaaaatctaggtggcattagtgaattaactttaaccaacatctttggtcaagatgagacatatcatgctgtcaccgtaaaagttaataaccctgcttatcctaatgtgacttacatgacagctattgttaatattgatcaattagtaaatgctaaagaacgctatgaaaaaattattatatttgtcatgactactttttggattatttcaattggagcaagtatctacttagctaaatgggcacaaaaaccgattatagaaaactacgaaagacagaaggcttttgtcgaaaatgctagccacgagctgcgtactcccctagctgtcttacaaaatcgcctagaaacgctattcagaaaaccgaatgccaccattttagaaaatagtgaaaatatcgcttcaagtctagatgaagtacgaaatatgcgtattttaaccactaatcttttaaacttagcaagacgtgatgatggaatcaaaccagaattagctgttattaagcctacactttttgatagtatctttgagaattatgatctaatcacccaagagaatggtaaaaattttactggacataatatgatccaagatagtttcaaaacagataagacactgctaaaacaactcatgactattttatttgataatgctataaaatatactgacaatgatggtagcattgactttaccatatctgaaactgataagtatctctttttagaaatcgctgataatggaccaggaatttcagaggaggataaagtcagaatttttgatcgtttttaccgtgttgacaaagcaagaacacgacaacaaggagggtttggcctcggcctttctttagctcaacaaatcgttaactcactgcgaggtaatattacagtaattgataataaacctagaggcagtatttttaagataaaactaccaaaagtaaaaggt

SEQ ID NO: 2080 - protein, 437 aa, Streptococcus agalactiae
MSKPIKISKFKKNVSDSHFIHFFTVFSGIFLVMTVIILQVMRYGVYSSVDSSLKYISTHPKNYINMVMSRTAAYLDNSNIASVKLKPGGQTVANTDIILFTSEEEVINYFDAFSNYQFLKPNKKNLGGISELTLTNIFGQDETYHAVTVKVNNPAYPNVTYMTAIVNIDQLVNAKERYEKIIIFVMTTFWIISIGASIYLAKWAQKPIIENYERQKAFVENASHELRTPLAVLQNRLETLFRKPNATILENSENIASSLDEVRNMRILTTNLLNLARRDDGIKPELAVIKPTLFDSIFENYDLITQENGKNFTGHNMIQDSFKTDKTLLKQLMTILFDNAIKYTDNDGSIDFTISETDKYLFLEIADNGPGISEEDKVRIFDRFYRVDKARTRQQGGFGLGLSLAQQIVNSLRGNITVIDNKPRGSIFKIKLPKVKG

SEQ ID NO: 2081 - DNA, 1308 bp, Streptococcus pyogenes
atgaataaattaaaaaaagagattttatcagataactataaccacttttttcatttttttgcggtttttacaggtatttttgtcattatgactattattatcttacagattatgcggtttggcgtttattcgtcagttgacagtagtttagtttctgttagtaataatgcaagtagctatgctaatcgtacgatggctagaatatcttctttttactttgatactgaaaataacattattaaggcgctgcctgattcagatagttctaagttattaggaacgcctgcagctaatacagatatcattttgtttagtgctaatggaacaattttaaatgcttttgatgcgttttctaactatcaaaattttcatttagataaacgccggttggggagtattgaaaccaccagtttaatgaatttttatggacaagaagaaaaataccatacgataactgtaggggttcatatcaaaaattatcctgcagttgcctatatgatggcagtagtaaatgtggaacaattagaccgcgctaatgaacgttatgagcgcattattattatagttatgagtgttttttggctaatttctattttagcaagtatttatttagccaagtggagcagaaaacctattttagaaagctatgaaaaacaaaaaatgtttgttgaaaatgctagtcatgaattaaggacccctttggcggtcttacagaatcgtctggaatcgctttttcgtaagcccaacgaaacgatattagaaaatagtgagcatctcgcttctagtttagacgaggttcgcaacatgcgcatcttaacaactaatttattaaatttagcaagacgagatgatggcattaatccacagtggactcatttagatacagatttttttaatgctatttttgagaattatgaactagttgctaaagaatatggaaaaatattttattttcagaaccaagtcaatagatcgttaagaatggataaggctttactaaaacaattaataacgattttatttgacaatgctattaaatatacagataaaaatggtattattgaaattatagtgaaaacaacggacaaaaatttattaatttctgttattgataatggtccagggataacagatgaagaaaagaaaaagatttttgatcgtttttatcgagttgacaaagctagaacacggcaaacaggtggatttggcttggggttggctttagctcagcaaatcgtgatgtctttaaaaggaaatattacagtaaaggataatgatcctaaaggtagtatttttgaagtcaaacta

SEQ ID NO: 2082 - protein, 436 aa, Streptococcus pyogenes
MNKLKKEILSDNYNHFFHFFAVFTGIFVIMTIIILQIMRFGVYSSVDSSLVSVSNNASSYANRTMARISSFYFDTENNIIKALPDSDSSKLLGTPAANTDIILFSANGTILNAFDAFSNYQNFHLDKRRLGSIETTSLMNFYGQEEKYHTITVGVHIKNYPAVAYMMAVVNVEQLDRANERYERIIIIVMSVFWLISILASIYLAKWSRKPILESYEKQKMFVENASHELRTPLAVLQNRLESLFRKPNETILENSEHLASSLDEVRNMRILTTNLLNLARRDDGINPQWTHLDTDFFNAIFENYELVAKEYGKIFYFQNQVNRSLRMDKALLKQLITILFDNAIKYTDKNGIIEIIVKTTDKNLLISVIDNGPGITDEEKKKIFDRFYRVDKARTRQTGGFGLGLALAQQIVMSLKGNITVKDNDPKGSIFEVKL

SEQ ID NO: 2083 - DNA, 330 bp, Streptococcus agalactiae
atggaaattgaaaaaacaaatcgtatgaatgccctttttgagttttatgcggcattattaacagataaacaaatgaattatatcgagttatactacgccgatgactacagccttgctgaaatagctgaagaatccggtgttagccgacaagctgtctatgataatatcaaacgaactgaaaaaattcttgaggcgtacgaaatgaaactacatatgtattcagattatattgtccgtagtcagatttttgatgacattctagaaaaatataccgatgatgcctttttacaagaaaaaatttccattctaagtagcattgataatagagat

SEQ ID NO: 2084 - protein, 110 aa, Streptococcus agalactiae
MEIEKTNRMNALFEFYAALLTDKQMNYIELYYADDYSLAEIAEESGVSRQAVYDNIKRTEKILEAYEMKLHMYSDYIVRSQIFDDILEKYTDDAFLQEKISILSSIDNRD

SEQ ID NO: 2085 - DNA, 339 bp, Streptococcus pyogenes
atgaacattatggaaattgaaaaaacaaacaggatgaatgccctttttgaattttatgcagctttgctaacagataaacaaatgaattatattgaactgtattatgccgatgattatagcttagctgagattgctgatgaatttggtgtcagtcgtcaggctgtctatgataatattaagcgtacggaaaaaattttagagacttatgagatgaaacttcatatgtattcggattatgttgttcgaagtgaaatctttgacgacatgattgctcactaccctcatgatgagtatttgcaagaaaaaatttccattctaaccagtattgacaatagagag

SEQ ID NO: 2086 - protein, 113 aa, Streptococcus pyogenes
MNIMEIEKTNRMNALFEFYAALLTDKQMNYIELYYADDYSLAEIADEFGVSRQAVYDNIKRTEKILETYEMKLHMYSDYVVRSEIFDDMIAHYPHDEYLQEKISILTSIDNRE

SEQ ID NO: 2087 - DNA, 1563 bp, Streptococcus agalactiae
atggctttcgaaagtttaacagagcgcctgcaaggagtttttaaaaatattcgtggtaagaaaaagttatctgaaaaagatgtgcaagaagtcaccaaggagattcgtctagctcttttagaagctgacgttgctcttccagttgttaaaacctttattaaacatgttcgtgaacgtgctgttggacatgaaatcattgatacactagatcctacgcaacaaattgttaagattgtcaatgaagagctaacagatttattaggggctgagacctctgaaattgaaaaatcccctaaaattccaaccatcattatgatggttggtctacaaggtgctggtaaaacaacttttgccggtaagttagcaaacaaactaatcaaagaagacaatgctcgtcctatgatgatagcagctgatatttatcgaccagctgctattgatcagttaaaaacccttggtagccagattaatgttcctgtctttgatatgggaactaaccattcagcagttgagattgtcactaaaggtttagaacaggctcgtgaaaatcgtaatgactatgttcttattgatacagccggacgcctacaaattgatgcaacccttatgcaggaattgcatgatgtcaaagccatagctcaacctaatgaaatactccttgtcgttgacagcatgattggacaggaagctgcaaatgtcgctgaagaatttaaccgtcagctcagcattagtggtgttgttctgacaaagattgacggtgatacacgcggtggtgctgccctttcagtacgcgaaattactggaaaaccaattaaatttacagggacaggggaaaaaatcactgatattgaaactttccatcccgatcgtatggcaagccgtatattggggatgggagacctgctaacacttattgagcgcgctagtcaagaatacgacgaaaaacgttcaatggaattagcggagaaaatgcgtgaaaacacctttgacttcaacgattttattgatcaattagatcaagttcaaaatatggggccaatggaagatctccttaaaatgcttccaggaatggctaacaatccagcaatgaaaaacttcaaagtggatgaaaacgaaattgctcgcaaaagagccattgtgtcatcaatgactccagaagagagagaaaatccagatctcctcaatccaagtcgtagacgtcgtattgctgctggatcaggtaatactttcgttgatgttaataaattcattaaagattttaaccaggcaaaacaaatgatgcaaggcgtgatgtccggtgatatgaataaaatgatgaaaaaaatgggaattgatcctaataacctccctaaagatatgcctggaatggacggaatggatatgtctaatttagaaggtatgatggggcaaaatggcatgcctgacttatctagtttaggtggcgatatggacttcagccaaatgtttggtggtggcttaaaaggaaaagtaggagcctttgcagctaaacaatcaatgaaacgtatggctaataaaatgaagaaagctaagaagaaacgcaaa

SEQ ID NO: 2088 - protein, 521 aa, Streptococcus agalactiae
MAFESLTERLQGVFKNIRGKKKLSEKDVQEVTKEIRLALLEADVALPVVKTFIKHVRERAVGHEIIDTLDPTQQIVKIVNEELTDLLGAETSEIEKSPKIPTIIMMVGLQGAGKTTFAGKLANKLIKEDNARPMMIAADIYRPAAIDQLKTLGSQINVPVFDMGTNHSAVEIVTKGLEQARENRNDYVLIDTAGRLQIDATLMQELHDVKAIAQPNEILLVVDSMIGQEAANVAEEFNRQLSISGVVLTKIDGDTRGGAALSVREITGKPIKFTGTGEKITDIETFHPDRMASRILGMGDLLTLIERASQEYDEKRSMELAEKMRENTFDFNDFIDQLDQVQNMGPMEDLLKMLPGMANNPAMKNFKVDENEIARKRAIVSSMTPEERENPDLLNPSRRRRIAAGSGNTFVDVNKFIKDFNQAKQMMQGVMSGDMNKMMKKMGIDPNNLPKDMPGMDGMDMSNLEGMMGQNGMPDLSSLGGDMDFSQMFGGGLKGKVGAFAAKQSMKRMANKMKKAKKKRK

SEQ ID NO: 2089 - DNA, 1563 bp, Streptococcus pyogenes
ttgactatggcttttgaaagcttaacccaacgtttgcaagatgtgtttaaacacattcgcggtaaaaagaaattatcagaatcagatgttcaagaagtgacaaaagagattcgtctagctcttttagaagccgatgtcgctttaccagttgttaaaacctttattaagcgcgtacgtgagcgcgctattggccatgagattattgatactcttgatccaacacaacaaattcttaagattgttaatgaagaattaacgagtattttaggctcagaaactgcagagattgataaatctccaaaaattccaactattatcatgatggtcggtttgcaaggggctggtaaaacaacttttgcaggaaaactcgctaataaattaattaaagaagaaaacgcgcgaccactgatgattgctgccgatatttaccgtccagcggccattgatcagttaaaaacactggggcaacaaatcaatgtacctgtttttgatatggggacagaccactcagcagtcgatattgtcagaaaaggtttggaacaagctcgtgaaaaccacaatgactatgtcttgattgatactgcgggtcgcttgcaaattgatgaaaaactgatgggagagctgcgcgatgtcaaggctttagcacaaccaaatgaaattcttttggttgtagatagcatgattggtcaagaagctgccaatgtagcctacgagtttaatcatcagttgagcatcacaggggttgtgttaacaaagattgatggtgatacacgtggaggtgcggcgctatctgtccgtgaaatcactgggaaaccaattaaatttacaggtattggtgaaaaaatcacagatattgaaacatttcacccagaccgcatgtccagtcggattttgggaatgggggatttgcttaccctcattgaaaaagctagccaggaatatgatgagaaaaaatccttagagttagctgaaaaaatgcgtgaaaacacctttgatttcaatgattttattgaacagttagatcaagtgcaaaatatggggcctatggaagacctcttgaaaatgattccaggaatggctggtaacccagctttggccaatatcaaagttgacgaaaaccaaattgctcgcaaacgtgctattgtctcttcaatgacacccgctgaacgtgaaaatcctgacttactaaacccgagtcgtcgccgtcgtattgcagctggttccgggaacagctttgtagataataaatttatcaaagactttaaccaagccaaaagcatgatgcaaggggttatgtcgggcgatatgtctaaaatgatgaaagatatgggtattaatcccaataatcttcctaaaaacatgcctgctggtatgccagatatgtcttccttagaaggaatgatgggacaaggtggtatgcctgatttatctggccttggtggtgatatggatatgagtcaactatttggtaaagggtttaaaggaaaaattggccaatttgccatgaaacaggccatgaaacggcaggctaacaaactaaaaaaagcaaagaaaaaacgaaaa

SEQ ID NO: 2090 - protein, 521 aa, Streptococcus pyogenes
LTMAFESLTQRLQDVFKHIRGKKKLSESDVQEVTKEIRLALLEADVALPVVKTFIKRVRERAIGHEIIDTLDPTQQILKIVNEELTSILGSETAEIDKSPKIPTIIMMVGLQGAGKTTFAGKLANKLIKEENARPLMIAADIYRPAAIDQLKTLGQQINVPVFDMGTDHSAVDIVRKGLEQARENHNDYVLIDTAGRLQIDEKLMGELRDVKALAQPNEILLVVDSMIGQEAANVAYEFNHQLSITGVVLTKIDGDTRGGAALSVREITGKPIKFTGIGEKITDIETFHPDRMSSRILGMGDLLTLIEKASQEYDEKKSLELAEKMRENTFDFNDFIEQLDQVQNMGPMEDLLKMIPGMAGNPALANIKVDENQIARKRAIVSSMTPAERENPDLLNPSRRRRIAAGSGNSFVDNKFIKDFNQAKSMMQGVMSGDMSKMMKDMGINPNNLPKNMPAGMPDMSSLEGMMGQGGMPDLSGLGGDMDMSQLFGKGFKGKIGQFAMKQAMKRQANKLKKAKKKRK

SEQ ID NO: 2091 - DNA, 720 bp, Streptococcus agalactiae
ttgtctgctataatagacaaaaaggtggtgatatttatgtatttagcattaatcggtgatatcattaattcaaaacagatacttgaacgtgaaactttccaacagtcttttcagcaactaatgaccgaactatctgatgtatatggtgaagagctgatttctccattcactattacagctggtgatgaatttcaagctttattgaaaccatcaaaaaaggtatttcaaattattgaccatattcaactagctctaaaacctgttaatgtaaggttcggcctcggtacaggaaacattataacatccatcaattcaaatgaaagtatcggtgctgatggtcctgcctactggcatgctcgctcagctattaatcatatacatgataaaaatgattatggaacagttcaagtagctatttgccttgatgatgaagaccaaaaccttgaattaacactaaatagtctcatttcagctggtgattttatcaagtcaaaatggactacaaaccattttcaaatgcttgagcacttaatacttcaagataattatcaagaacaatttcaacatcaaaagttagcccaactggaaaatattgaacctagtgcgctgactaaacgccttaaagcaagcggtctgaagatttacttaagaacgagaacacaggcagccgatctattagttaaaagttgcactcaaactaaagggggaagctatgatttc

SEQ ID NO: 2092 - protein, 240 aa, Streptococcus agalactiae
MSAIIDKKVVIFMYLALIGDIINSKQILERETFQQSFQQLMTELSDVYGEELISPFTITAGDEFQALLKPSKKVFQIIDHIQLALKPVNVRFGLGTGNIITSINSNESIGADGPAYWHARSAINHIHDKNDYGTVQVAICLDDEDQNLELTLNSLISAGDFIKSKWTTNHFQMLEHLILQDNYQEQFQHQKLAQLENIEPSALTKRLKASGLKIYLRTRTQAADLLVKSCTQTKGGSYDF

SEQ ID NO: 2093 - DNA, 663 bp, Streptococcus pyogenes
atgacatatatagcgcttattggagatattatccagtccaaacaattgacggatcgttccaaagttcaaaaaactttagcagcttatttagacgacctcaacaaaacctttgctccttatattatttctaaattatccctaacgttgggagatgaatttcaaggactttttcaggtggatactcctattttccatctgattgatttgattaatcatcacatggatatccctattcgatttggagtaggagtaggttctattctaacagacatcaatcctgatattagtattggggctgatggacctgcttattggcatgctcgtgaggctattcgttatattcatcaaaaaaatgattatggtaatactacattagctcttcggactggtcatcacaaccaggatgatgtattaaacagtttactagcagctggagatgctattaaagccaactggcgagctagtcaatgggaaatttttgacacgcttttagatttgggcatttatgaggaatactttgatcaacaacgactaggaaagcaattatctcttagctctagcgctttgtcaaaacgtctaaaaagtagtcatgttaaaatttatctgagaacacggcagagtgcgctaaactgtctcaaacaaatcaaggaggaaactgatgat

SEQ ID NO: 2094 - protein, 221 aa, Streptococcus pyogenes
MTYIALIGDIIQSKQLTDRSKVQKTLAAYLDDLNKTFAPYIISKLSLTLGDEFQGLFQVDTPIFHLIDLINHHMDIPIRFGVGVGSILTDINPDISIGADGPAYWHAREAIRYIHQKNDYGNTTLALRTGHHNQDDVLNSLLAAGDAIKANWRASQWEIFDTLLDLGIYEEYFDQQRLGKQLSLSSSALSKRLKSSHVKIYLRTRQSALNCLKQIKEETDD

SEQ ID NO: 2095 - DNA, 114 bp, Streptococcus agalactiae
ttgaaatttattaaagaaaattttaaacacaatattaatgggtttggtgataatgataaaaaccagagctatgacaataaagtgcttgataggcaaaagccaatgattaggcgg

SEQ ID NO: 2096 - protein, 38 aa, Streptococcus agalactiae
MKFIKENFKHNINGFGDNDKNQSYDNKVLDRQKPMIRR

SEQ ID NO: 2097 - DNA, 771 bp, Streptococcus agalactiae
atgatttctgattttttaagggataatccaatcctaactttattattttgtgcacattttttagctgactttcagtggcaaagtcaatccttagcagatagtaaatcacatagttggaggggactctggagacatctcttgattgttttcctccccctagcagctttaatgatattgataccagaaactactttgttaaatttaagcatatggggaagtcatattgttattgatagtataaagaaattgagttacccttgggtagaggaagggcatttccaaaaagcagcttttattatagaccaactagcccactatacttgcattatcgttttttaccatgcgcttcctacatatttaccgcctaatcattggcttttgcctatcaagcactttattgtcatagctctggtttttatcattatcaccaaacccattaatattgtgtttaaaattttctttaataaatttcaagctaaagaattatcatcattattaacacaagaaaaaacaaaaataatgaaagaaaaatctgaagatcatgaagaaacaattgaaggagcaggagctatgattggtaatttagagcgtctaattatggctatattactaatctcaggacagtatgctgctataggtcttgtttttactgcaaaatccattgcacgttacgataaaatttctaaaagtcaggtttttgccgaatattatttaattggatcattgttctcaattataagtgttttgataactcattggttacttttggta

SEQ ID NO: 2098 - protein, 257 aa, Streptococcus agalactiae
MISDFLRDNPILTLLFCAHFLADFQWQSQSLADSKSHSWRGLWRHLLIVFLPLAALMILIPETTLLNLSIWGSHIVIDSIKKLSYPWVEEGHFQKAAFIIDQLAHYTCIIVFYHALPTYLPPNHWLLPIKHFIVIALVFIIITKPINIVFKIFFNKFQAKELSSLLTQEKTKIMKEKSEDHEETIEGAGAMIGNLERLIMAILLISGQYAAIGLVFTAKSIARYDKISKSQVFAEYYLIGSLFSIISVLITHWLLLV

SEQ ID NO: 2099 - DNA, 714 bp, Streptococcus pyogenes
atgattaatggtgtctctcactacctagctcaaacccctacacttaccctgtttctcatttgtcatgtgttatcagactaccagttacaaagtcagcaagtagctgatttaaaagaaaaacatttgacttatttaggttaccacttgattggagttagcattcccctaatttgtttaaccctcattatcccacaagcatggttgatgagcctattggttatgataagtcacgcgcttattgactggctaaagccaaagatggctaactctctaaaatggaaaagagagtggatttttctgctggatcaatgcttacatatcgctattagttcatttgctgggctaaggttagcaggggtgaccttgcctaattggcttccgatatctattttgatgaccgttttatttatcctactcattaccaaaccaactaatattgtctttaaactctttttcatcaaataccagcctgaccaaggagaaaaaatggacacgatcataggagcgggggctaccataggaattctagagagaattgttattggggtgtgtatgatcatggggcaatttgcttcaataggtctggtctttaccgctaaatctattgctcgctataataaaatttcggaaagtccagcttttgcagaatactacctaattggttctttatttagtattctcagtgtttttatcgcagcatggatttgtttcttc

SEQ ID NO: 2100 - protein, 238 aa, Streptococcus pyogenes
MINGVSHYLAQTPTLTLFLICHVLSDYQLQSQQVADLKEKHLTYLGYHLIGVSIPLICLTLIIPQAWLMSLLVMISHALIDWLKPKMANSLKWKREWIFLLDQCLHIAISSFAGLRLAGVTLPNWLPISILMTVLFILLITKPTNIVFKLFFIKYQPDQGEKMDTIIGAGATIGILERIVIGVCMIMGQFASIGLVFTAKSIARYNKISESPAFAEYYLIGSLFSILSVFIAAWICFF

SEQ ID NO: 2101 - DNA, 1659 bp, Streptococcus agalactiae
atgtctagttttaatagaaaaaaacttaagtttttgggtatatctttggcgactctaacagccaccacagttaccctggttgcctgtggtaatgagtcaaagaactctggagataataaagttattaattggtatattcctactgaaatcagtacattggacatttcaaagaatacagatgcttattcaaacttagctataggtaattcaggcagcaatttacttagaattgataaagagggcaaaccaaaacccgatttagctaaaaaagtatccgtttcttctgatggtcttacttatactgctacacttcgtgataatttaaaatggtcagatggaagcaaactaagcgctgaagattttgtttacacatggcggagaatagttgatcctaaaactgcatctgaatatgcttacttggcgacagaatcgcaccttttaaatgctgataagattaattctggagatattaaagatttaaataaacttggtgtaacagctaaaggcaatcaagtgacctttaaattgacaagtccatgccctcaatttaaatattatttagccttctctaattttatgcctcaaaaacaatcgtatgttgaaaaagttggtaaagattatggtacaacatcaaaaaatcaaatttactcaggtccttaccttgttaaggattggaatggttcaaatggtaaatttaaattagtcaaaaataaatattattgggattctaaacatgttaaaacaaatagtgtcatagttcaaactatcaaaaaaccagatactgcagttcaaatgtacaagcaaggtcagattgattttgctgaaatatcaggaacttctgctatttatcaagctaataaaaataataaagatgtagtagatgcgtctgatgcacgtactacatatattatttataaccaaactggttcggttaaagcattgacaaatcagaaaattaggcaagctttgaatttagcgactgatcgtaaaggtgttgttaaagcggcagttgatacaggttcaactcctgctgaatctctggtccctaaaaaattagccaaattacctaatggtgaggatctttccaagtatactgccccaggttatacgtataatacaagtaaagctcaaaaactttttaaagaaggtcttgctgaggttggtcagtcatctctcaagttaacaatcacagctgattcggactctccagcagctaaaaatgctgttgactatgtgaaatctacatgggagagtgctttgcctggtctaactgttgaagaaaaatttgttactttcaagcaacgccttgaagatgcaaaaaatgaaaattttgatgtcgtgctcttctcatggggaggagattatccagaaggatcaactttctatgggttattcacgactaattctgcgtataattatggtaaattttcttctaaagagtatgacaatgcctatcaaaaggcaattactactgacgccttgaaaccaggagatgccgctaatgattacaaaactgctgaaaaagctttatttgatcaatcatattataacccagtttattacctagggaaaaaaggactccaaaattctaaattaaaggggttggtaagaaattcaactggtttgaatgttgattttacttatgcttataagacagaa

SEQ ID NO: 2102 - protein, 553 aa, Streptococcus agalactiae
MSSFNRKKLKFLGISLATLTATTVTLVACGNESKNSGDNKVINWYIPTEISTLDISKNTDAYSNLAIGNSGSNLLRIDKEGKPKPDLAKKVSVSSDGLTYTATLRDNLKWSDGSKLSAEDFVYTWRRIVDPKTASEYAYLATESHLLNADKINSGDIKDLNKLGVTAKGNQVTFKLTSPCPQFKYYLAFSNFMPQKQSYVEKVGKDYGTTSKNQIYSGPYLVKDWNGSNGKFKLVKNKYYWDSKHVKTNSVIVQTIKKPDTAVQMYKQGQIDFAEISGTSAIYQANKNNKDVVDASDARTTYIIYNQTGSVKALTNQKIRQALNLATDRKGVVKAAVDTGSTPAESLVPKKLAKLPNGEDLSKYTAPGYTYNTSKAQKLFKEGLAEVGQSSLKLTITADSDSPAAKNAVDYVKSTWESALPGLTVEEKFVTFKQRLEDAKNENFDVVLFSWGGDYPEGSTFYGLFTTNSAYNYGKFSSKEYDNAYQKAITTDALKPGDAANDYKTAEKALFDQSYYNPVYYLGKKGLQNSKLKGLVRNSTGLNVDFTYAYKTE

SEQ ID NO: 2103 - DNA, 1068 bp, Streptococcus agalactiae
atgaaacgtgaattactactcgaaaaaatcgatgaactaaaagaaattatgccttggtatgttctagaatattatcaatcaaagctttctgttccttatagtttcacaacactctacgaatatttaaaagaatatagacgttttcttgaatggttattggattctggtgttgctaattgtcatcacattgcagaaattgagctttcagttttagaaaaccttactaaaaaagatatggaagcttttatactatatttacgagaacgccctttattaaatgctaacacaaggcaaaatggggtgtctcaaaccaccattaacagaactctatctgccttatctagtcttttcaaataccttactgaagaggttgagaatgctgacggggagccttacttttatcgcaatgtcatgaaaaaagtctcaaccaaaaagaaaaaggaaactttagcttctcgggcagaaaatattaaacaaaagttatttttgggcaatgaaacgatagaattcttagagtatatagattgtgaatatcaaaacaaactttccaaacgtgctttagcttttttcaacaaaaataaagagagagatttagctattattgctttgctactagcttcaggagtgcgtctatctgaggcagtaaacttagatttaaaggatattaaccttaatgtaatggttattgatgtcacacgaaaaggggggaaaagggactctgtcaatgtcgctagctttgcgaagccctaccttgctaattatttagacatccgtaaaaatagatacaaagcagaaaatcaggacattgctctatttttatcagaataccgtggggtgccaaatcgtattgatgcttcaagtgtagagaaaatggttgctaagtattcccaggattttaaggttcgtgtaacacctcataaactaaggcatactcttgctactaggctatatgatgctacaaaatctcaagtattagttagccaccaactaggtcatgcttccactcaagttactgacctatatacccatattgttaacgatgaacaaaagaacgctttagataaacta

SEQ ID NO: 2104 - protein, 356 aa, Streptococcus agalactiae
MKRELLLEKIDELKEIMPWYVLEYYQSKLSVPYSFTTLYEYLKEYRRFLEWLLDSGVANCHHIAEIELSVLENLTKKDMEAFILYLRERPLLNANTRQNGVSQTTINRTLSALSSLFKYLTEEVENADGEPYFYRNVMKKVSTKKKKETLASRAENIKQKLFLGNETIEFLEYIDCEYQNKLSKRALAFFNKNKERDLAIIALLLASGVRLSEAVNLDLKDINLNVMVIDVTRKGGKRDSVNVASFAKPYLANYLDIRKNRYKAENQDIALFLSEYRGVPNRIDASSVEKMVAKYSQDFKVRVTPHKLRHTLATRLYDATKSQVLVSHQLGHASTQVTDLYTHIVNDEQKNALDKL

SEQ ID NO: 2105 - DNA, 1104 bp, Streptococcus pyogenes
ttgaaaaaattgttattgttaaggaattatgatgatatgagacgcgaattattactagaaaaaattgaaacctacaaggctatcatgccctggtatgttttagattattaccaatccaaattagctgttccatacagctttaccaccttatatgagtatttaaaagaatacaaacgcttttttgattggctgatggatgctgatttaacgcaggcgccaaagattgctgatattgacttgagcacgcttgagcaccttaccaagaaggatttagaggcctttgtgctttatttgcgggaacgaccttctctcaacacctattccaccaaagaggggctttctcaaaccactattaatcggaccttgtctgccttatcaagcctttacaagtacttgactgaagaggttgaaaatgaccaaggggagccttatttttatcggaatgttatgaaaaaagtgtcaacaaaaaagaaaaaagaaaccctggcttccagagcggaaaatattaagcagaaactgtttttaggtgatgaaactctagctttcttggattatgtggataaggaatatgagcaaaaattgtctaatcgtgccaaatcttctttccgtaaaaataaggagagggatttggctattattgctctactacttgcttctggtgttcgtttgtctgaagcagtgaatcttgatttaaaagatgtcaatctaaatatgatgattatcgaagttattcgcaaaggcggaaaacgtgattcagtcaatgtagcaggttttgcgaaaggttatttggagtcttatttagctgttcgtcagagacgttacaaggctgaaaaacaggatcttgctttctttttaacagaataccgtggcgttccaaatcgaatggatgcttctagtatagaaaagatggttggcaagtactctgaggattttaaaattcgtgtgactcctcacaaattgcgtcatacgctagcgacaagactatatgatgctactaaatctcaggtgttagttagtcatcaattaggccattcctctactcaagtcacggatctttatacccatattgtcaatgatgagcaaaaaaatgctttagataacctt

SEQ ID NO: 2106 - protein, 368 aa, Streptococcus pyogenes
LKKLLLLRNYDDMRRELLLEKIETYKAIMPWYVLDYYQSKLAVPYSFTTLYEYLKEYKRFFDWLMDADLTQAPKIADIDLSTLEHLTKKDLEAFVLYLRERPSLNTYSTKEGLSQTTINRTLSALSSLYKYLTEEVENDQGEPYFYRNVMKKVSTKKKKETLASRAENIKQKLFLGDETLAFLDYVDKEYEQKLSNRAKSSFRKNKERDLAIIALLLASGVRLSEAVNLDLKDVNLNMMIIEVIRKGGKRDSVNVAGFAKGYLESYLAVRQRRYKAEKQDLAFFLTEYRGVPNRMDASSIEKMVGKYSEDFKIRVTPHKLRHTLATRLYDATKSQVLVSHQLGHSSTQVTDLYTHIVNDEQKNALDNL

SEQ ID NO: 2107 - DNA, 936 bp, Streptococcus agalactiae
atgatacgccagtttttaagagaacacttgatttggtatattttatatatcatgatgtttgtcctattttttattagtttctatctatatcatttaccaatgccctatttgtttaattccttaggtttaaatgttattgttttactaggaattagtatttggcaatacagtcgttacaggaaaaaaatgttacatctcaaatattttaatagtagtcaggacccctctttcgaacttcaaccgagtgattacgcttattttaatattattacacaattagaagctagagaagcgcaaaaagtttctgaaacaattgaacaaaccaatcatgttgcacttatgataaagatgtggtcgcaccaaatgaaagttccattggcagctatttcattaatggcccagacaaatcatctcgatcctaaggaagttgaacaacaattattgaaattgcaacattatcttgaaacgttgttagcatttttgaaatttagacaatatcgtgacgattttcgttttgaagctgttagccttagagaagtagtagtagaaattataaaatcgtataaggttatttgtctatccaaaagcttatctatcataattgaaggcgataatatctggaaaacagacaaaaagtggttaacttttgctctttcacaggtgctagataatgccataaaatattctaatcctgagtcaaagataataataagcataggagaagagagtattagaatacaagactacggtatcggcatactcgaagaagatatccctagactttttgaagatggctttacgggttacaacggtcatgagcaccaaaaggcaacaggcatggggttatatatgacaaaagaagtcttatctagtctgaatttgtccatttcggtggatagcaaaattaattatgggactgctgtttctatacataaa

SEQ ID NO: 2108 - protein, 312 aa, Streptococcus agalactiae
MIRQFLREHLIWYILYIMMFVLFFISFYLYHLPMPYLFNSLGLNVIVLLGISIWQYSRYRKKMLHLKYFNSSQDPSFELQPSDYAYFNIITQLEAREAQKVSETIEQTNHVALMIKMWSHQMKVPLAAISLMAQTNHLDPKEVEQQLLKLQHYLETLLAFLKFRQYRDDFRFEAVSLREVVVEIIKSYKVICLSKSLSIIIEGDNIWKTDKKWLTFALSQVLDNAIKYSNPESKIIISIGEESIRIQDYGIGILEEDIPRLFEDGFTGYNGHEHQKATGMGLYMTKEVLSSLNLSISVDSKINYGTAVSIHK

SEQ ID NO: 2109 - DNA, 1500 bp, Streptococcus pyogenes
atggaaaatcagaaacaaaaacagaagaaatataaaaattcgttaccaaaacgactatctaatatcttttttgttctttttttctgcattttctctgcctttacactgattgcctatagttcaacaaactatttcttattgaagaaagaaaagcagtcagtctttcaagctgtaaatattgttagagttcgtctttctgaggtggactctaattttacattagagaacttagcagaagttttgtacaaaaacgataaaacacatctgagaattgatgacagaaagggcagtcgagtcattaggagtgagcgcgatatcacaaatactctagatgcgaatcaagatatttatgtctataacattgataaacagatgatttttaccacagataacgaagaatcatctcctggcttgcatggtcctatcggtcgtgtgtatcacgaccatatcgaagatcagtatcgtgggttttccatgacacaaaaggtatattctaatcggactggaaaatttgtgggctatgttcaagtctttcatgatttaggcaattattatgtcattagagcaagactgctgttttggctactagttgttgagttatttggcacaagcttagcctatttaatcatcttaattactacgcggcgctttttgaagcctttacacaatttacatgaagtgatgcgtaatatctctgaaaatcctaataatttaaacctgcgctcagatatttcgtcaggagatgaaatcgaagaattgtctgttatctttgacaatatgttagacaaattggagacacatactaagttgcaatcacgttttattagtgatgtcagccatgaattacgaacaccggttgcgattattaaagggcatattggtctcttacaacgttggggtaaagatgacagtgatattcttgaagaaagcttgacagcaacagcgcatgaggctgaccgtatggcaatcatgattaatgatatgttagacatgattcgcgtacaaggctcatttgagggacatcaaaatgatatgacagttttggaagattctattgaaactgttgttggtaattttagagttttaagagaagattttatctttacatggcagtcagaaaatccaaaaacgatagcccgtatttataaaaatcattttgagcaggctttgatgattctgattgacaatgctgtgaagtattcccgtaaagaaaagaaaatcgcgattaacctttcagtgactggcaaacaagaagctattgttagagttcaagataaaggcgaaggaatttctaaagaagatattgaacatatctttgaacgcttttatagaacggataaatcacgtaatcgaacaagtacccaggctggattagggattggcttgtctattctcaagcaaattgtagatgggtatcatttacagatgaaggttgaaagtgaattaaatgaaggttcagtgtttatcttacatattcctttggcccagtctaaagagagt

SEQ ID NO: 2110 - protein, 500 aa, Streptococcus pyogenes
MENQKQKQKKYKNSLPKRLSNIFFVLFFCIFSAFTLIAYSSTNYFLLKKEKQSVFQAVNIVRVRLSEVDSNFTLENLAEVLYKNDKTHLRIDDRKGSRVIRSERDITNTLDANQDIYVYNIDKQMIFTTDNEESSPGLHGPIGRVYHDHIEDQYRGFSMTQKVYSNRTGKFVGYVQVFHDLGNYYVIRARLLFWLLVVELFGTSLAYLIILITTRRFLKPLHNLHEVMRNISENPNNLNLRSDISSGDEIEELSVIFDNMLDKLETHTKLQSRFISDVSHELRTPVAIIKGHIGLLQRWGKDDSDILEESLTATAHEADRMAIMINDMLDMIRVQGSFEGHQNDMTVLEDSIETVVGNFRVLREDFIFTWQSENPKTIARIYKNHFEQALMILIDNAVKYSRKEKKIAINLSVTGKQEAIVRVQDKGEGISKEDIEHIFERFYRTDKSRNRTSTQAGLGIGLSILKQIVDGYHLQMKVESELNEGSVFILHIPLAQSKES

SEQ ID NO: 2111 - DNA, 666 bp, Streptococcus agalactiae
atgtcacaagagcaaggaaaaatttatattgtagaagatgatatgacgattgtgtcacttttaaaagatcatttatcagctagctatcatgtctctagtgtcagcaattttcgtgatgtgaaacaagaaattatcgcatttcaacccgatttgatactaatggatattacgttaccctattttaatggtttttactggactgcagaattgcgtaagtttttaacaattcctattattttcatttcatctagtaatgatgaaatggatatggttatggcattaaatatggggggtgatgactttatttcaaaaccattctctctagctgtattagatgctaagctaactgctattttaaggagaagtcaacaatttatccaacaggaattaacttttgggggatttacgttgacaagagaagggttattgtctagccaagataaagaggttattttatcgccaacagaaaataaaatcctatctatcttgctcatgcatcctaaacaagtagtctcaaaagagtctctattagagaaactttgggaaaatgatagttttattgatcaaaatacacttaatgttaatatgacacgcttacgtaaaaaaattgtcccaataggttttgattacattcatacagtgagaggagttgggtatttactacaa

SEQ ID NO: 2112 - protein, 222 aa, Streptococcus agalactiae
MSQEQGKIYIVEDDMTIVSLLKDHLSASYHVSSVSNFRDVKQEIIAFQPDLILMDITLPYFNGFYWTAELRKFLTIPIIFISSSNDEMDMVMALNMGGDDFISKPFSLAVLDAKLTAILRRSQQFIQQELTFGGFTLTREGLLSSQDKEVILSPTENKILSILLMHPKQVVSKESLLEKLWENDSFIDQNTLNVNMTRLRKKIVPIGFDYIHTVRGVGYLLQ

SEQ ID NO: 2113 - DNA, 1962 bp, Streptococcus agalactiae
gtgaataatatgttttatctcaaaatagcctggcataatttaaaacattctatagaccagtacataccattcctcttagccagtttattactttattcattgacttgttctacgctactaatcttaatgagtgctgttggaagagatatggggacagcggcaacggttctttttcttggagtgattgttttgtcaatctttgcggtagtcatggaacattatagctacaatatcttgatgaaacagcgtagtagtgaatttggactgtataacattttggggatgaataaacgtcaagttgcgcgtgtagctagtctagagctgtttattatttatatatttcttatttctataggaagtctgtttagtgctttttttgctaaatttatttatttaatttttgtcaacattattaactatcatgcactaaatcttagtttaagtttatggccatttattatttgtatcgttatatttacaggtatttttctgactttagaagttccagttattcgacatgttcatttatcatccccattaagtctttttagaaagaaacaacagggagaaaaagaaccaaaaggtaatcttatacttgcaattttagcgttagtagctatcgccatcgcttatacaatggctcttacttcaggtaaagcacctgcattagctgttatctatcgtttcttctttgcagtacttttagttattgctggtacttatcttttttatattagttttatgacatggtacttaaaaaggttgcgtcaaaacaagcattattattataaatctgagcattttgtatcaacttcgcaaatgatttttcgaatgaagcaaaatgcagtagggttagcaagtatcactttattagctgttatggctctagttactattgctacaacagtctcactttattcaaatacacaaaatgttgttaccggactatttccaaaatcagtaagtttatcaatagataattcaaaaggtgacgcgaaaaatatatttgaagaaaagattttgaagaaactaggtaagtcatctaaggaagctatcacttataatcagacaatgatttcgatgccagttagtcaatcaagtgaacttaatatcacatctaaaaacgtcaaacatgttgatatcacaaaaacgggttttatgtacctaattactcagaatgatttccgtcgtttaggtcaccaattaccaaaattaaaagataaccaagtggcttactttgttcaaaaaggtgatagccgtttgaaaaaaataaatctattgggaaataaatttgacgttgtaaaaaatttaaaagaggcttatgtcccagagactacaaatacttacaacccgggtttgattatatttgcaaacaacaaacaaattgacaatattagaaaagcatatttaccttatactaagaacatcaatacttttccaaaaacctttaaggcatatttggatttgaatagtcaagagataaattcaatttctaaaaacgacataatagaggtagatggtaagtatgttggaaatattagcactaaacagagttttctaaaagaaggttatcaaatgtttggtgggttattatttactggatttctgttaggtataagctttttgctaggtatagctctaattgtttactataagcaatactcagaaggtcatgaagataagagatcttatcgtatcttacaagaagtaggtatgagcaaaaaattagttaaacggactattaattctcaaattatgattttcttcttccaacctttagtggtagcagttattcactttggagttgctattccaatgctaaaacagatgcttttggtatttggggtgcttaactcaacaatcgtatatgtagtaagtggtttgacagtacttgcgatttctataatttactttatcatttaccgtataactagtcgaacttattatcatattattgaacgc

SEQ ID NO: 2114 - protein, 654 aa, Streptococcus agalactiae
MNNMFYLKIAWHNLKHSIDQYIPFLLASLLLYSLTCSTLLILMSAVGRDMGTAATVLFLGVIVLSIFAVVMEHYSYNILMKQRSSEFGLYNILGMNKRQVARVASLELFIIYIFLISIGSLFSAFFAKFIYLIFVNIINYHALNLSLSLWPFIICIVIFTGIFLTLEVPVIRHVHLSSPLSLFRKKQQGEKEPKGNLILAILALVAIAIAYTMALTSGKAPALAVIYRFFFAVLLVIAGTYLFYISFMTWYLKRLRQNKHYYYKSEHFVSTSQMIFRMKQNAVGLASITLLAVMALVTIATTVSLYSNTQNVVTGLFPKSVSLSIDNSKGDAKNIFEEKILKKLGKSSKEAITYNQTMISMPVSQSSELNITSKNVKHVDITKTGFMYLITQNDFRRLGHQLPKLKDNQVAYFVQKGDSRLKKINLLGNKFDVVKNLKEAYVPETTNTYNPGLIIFANNKQIDNIRKAYLPYTKNINTFPKTFKAYLDLNSQEINSISKNDIIEVDGKYVGNISTKQSFLKEGYQMFGGLLFTGFLLGISFLLGIALIVYYKQYSEGHEDKRSYRILQEVGMSKKLVKRTINSQIMIFFFQPLVVAVIHFGVAIPMLKQMLLVFGVLNSTIVYVVSGLTVLAISIIYFIIYRITSRTYYHIIER

SEQ ID NO: 2115 - DNA, 1905 bp, Streptococcus pyogenes
atgatttggtcaattacaaaatctaacattaaaaaaaatttttcgttatatcgtatctattttctagctacgattggtttattaagtatttttatagcttttctaaattttatctcagataaaatcattacagaaaaaattggggatagtggtcaagctctagttatcgctaatgggtcattgatttttttgattgtatttttggtggtattcttaatttacttcaataatttctttgtaaaaaaacgtagtcaagagcttggagtcttagcaatactagggttttcaaaaagagaattaacaaaattactaactttagaaaatcttgttattctagttctgagttacttggtaagtttattgctgggaccgactttatattttttagctgtactggcaattactcatctattgaatttaacaatggaagttcagtggtttattacagttaatgagattatagagtctttaggaatattagtcgtagtttttctgattaatgtcatcacaaatggacttatcattagtaaacagtctttgattgaatttgttaatttctcaagaaaggctgagaaaaaaattaagataagaaaagtcagagctattattgctatcactgcattgctattgtcatatattttatgtttggcgacagtgttttcatccacacgaaatatgctattaagcatagggatggtaccggtttctctattgataattgtcttagttgttttaggaacagtgttcaccatcagatatggattggcttttgtagtttcgttgttaaaagaaaataaaaaaaggttataccgtcctctgtctaatatcatctatcccaaatttaactatcgtattgcaacaaaaaataaattattaacagtcttgggaggtcttttaacagtaaccgtttcagttgccggaatgatggtaatgctctatgcttattctcttaatgggatagagaggttgactccatctgccatagaatataatgttgaatcagaaaacggtcaagtcaatgttacaactattttagagaacgaccaagtgagcttggttgatgtcggcctgttgcgattgaatactatcccagaggtgactatcacagactctgggcaaacaataccttattttgatataattaactacagtgactacaaagagttaatgaaagctcaaggcagaacaaattctattgaaggtagtaagtcactcccattgttaataaattattatccaacagaaattagccttggaaaaacctttaacttaggaaatgcatatgatgttactgtaaaacaagtatcaacgaataatgtttttagtttttctacaagtgtcacgaccctggttgtttctgataaattatatgctaaacttagttctcgttttccagagaaagaaatgacaattaggacttttaatggaacttcgattaggtcaagtgaagcattttacaatcagtttagtatggttcctgatgttatcagtagttatagtaaggaacacacagtaaagactgctaatattgcgacttatatctttataactttcctatccatactctttattatttgtacaggtagtattctgtactttacaagcctcatcgaaatcatggaaaataaagaagaatatggctatctaagtaagctaggttatagtaaaaaaatgattcatcggattcttcgatatgaaacaggtatacttttccttattcctgtattcattgggattgtaaatggtggtatgttgcttatttactataaatatttattcatggatacattggtagcaggcaatatcataatgttatctttattgctttgtctgcttttcttcttgataatatatggcacattttatgtattgacattgcggttagtgacatccataatcaaaaat

SEQ ID NO: 2116 - protein, 635 aa, Streptococcus pyogenes
MIWSITKSNIKKNFSLYRIYFLATIGLLSIFIAFLNFISDKIITEKIGDSGQALVIANGSLIFLIVFLVVFLIYFNNFFVKKRSQELGVLAILGFSKRELTKLLTLENLVILVLSYLVSLLLGPTLYFLAVLAITHLLNLTMEVQWFITVNEIIESLGILVVVFLINVITNGLIISKQSLIEFVNFSRKAEKKIKIRKVRAIIAITALLLSYILCLATVFSSTRNMLLSIGMVPVSLLIIVLVVLGTVFTIRYGLAFVVSLLKENKKRLYRPLSNIIYPKFNYRIATKNKLLTVLGGLLTVTVSVAGMMVMLYAYSLNGIERLTPSAIEYNVESENGQVNVTTILENDQVSLVDVGLLRLNTIPEVTITDSGQTIPYFDIINYSDYKELMKAQGRTNSIEGSKSLPLLINYYPTEISLGKTFNLGNAYDVTVKQVSTNNVFSFSTSVTTLVVSDKLYAKLSSRFPEKEMTIRTFNGTSIRSSEAFYNQFSMVPDVISSYSKEHTVKTANIATYIFITFLSILFIICTGSILYFTSLIEIMENKEEYGYLSKLGYSKKMIHRILRYETGILFLIPVFIGIVNGGMLLIYYKYLFMDTLVAGNIIMLSLLLCLLFFLIIYGTFYVLTLRLVTSIIKN

SEQ ID NO: 2117 - DNA, 750 bp, Streptococcus agalactiae
atgttattagaaatcaatcacttagaaaaagtttttcgtacacgtttttcaaaagaagagacaagggctctacaagacgtcgattttaaagttgaacaaggggaattcattgctattatgggagagtctggttcgggaaaaacaactctgctaaatattttagctactttagaaaaaccgacaaatggacaagtgattttaaatggggaagatattacgaaaattaaagaggcaaaattagcgagttttcgtttgaaaaatcttggtttcgtctttcaggacttcaaccttttggatactctctctgtaagagataatatctatcttcctttagttcttgatcgtaaacgttacaaagaaatggatcatcgtttgtcagaattatcttctcatctgagaattgatgacttattagataagagacctttcgagctctctggtgggcaaaagcaacgtgtagcgattgctcgtagtttgataaccaaccctcaaattttattagcagatgaaccaacagcagcgttagattaccgtaattcagaagacttgctgaatttatttgaaactattaacttggatggacaaactattttgatggtaacccattcagcaaatgctgctagtcatgccaaacgcgttttatttatcaaagatggacgtatttttcaccaactttatcgtggtaataagaataatagcgaattcaataaagatatttctttaacaatgtctgccatattagggggtgaa

SEQ ID NO: 2118 - protein, 250 aa, Streptococcus agalactiae
MLLEINHLEKVFRTRFSKEETRALQDVDFKVEQGEFIAIMGESGSGKTTLLNILATLEKPTNGQVILNGEDITKIKEAKLASFRLKNLGFVFQDFNLLDTLSVRDNIYLPLVLDRKRYKEMDHRLSELSSHLRIDDLLDKRPFELSGGQKQRVAIARSLITNPQILLADEPTAALDYRNSEDLLNLFETINLDGQTILMVTHSANAASHAKRVLFIKDGRIFHQLYRGNKNNSEFNKDISLTMSAILGGE

SEQ ID NO: 2119 - DNA, 672 bp, Streptococcus pyogenes
ttgttaaaccttaaagatattcgaaaaagctatcatcttggaactgaagaatttgcgattttaaaaggaatcgatttagaagttaacgagggtgactttttagccatcatgggaccatcaggttcgggaaagtcaacattgatgaatatcattgggtgtttagataagcctggctctggctcatatgccattgaaggcagagacgtgtcatccttatctgataatgaacttgctgatttgcgtaatcaaaaaatcggctttgtttttcaaaattttaacctgatgcccaagctaacagcttgtcaaaatgtcgaattacccttgacttatatgaatgttcctaaaaaagagcgtcgcaaacgagccctagagatgttaaagctagtaggactagaagaacgtagtgaatttaaaccgatggagctatctggtgggcaaaaacagcgtgtagcgattgcaagagctttagtcactaacccgagttttatccttggtgatgagccaacaggtgcactagacacaaaaaccagcgtccaaatcatggacctatttaaacaattcaatgataacggcaaaacgattattatcatcacacacgagcctgaagtagctgccctatgcaaaaagacggtgatcctaagagatggtaatatagaacattccgatatagag

SEQ ID NO: 2120 - protein, 224 aa, Streptococcus pyogenes
LLNLKDIRKSYHLGTEEFAILKGIDLEVNEGDFLAIMGPSGSGKSTLMNIIGCLDKPGSGSYAIEGRDVSSLSDNELADLRNQKIGFVFQNFNLMPKLTACQNVELPLTYMNVPKKERRKRALEMLKLVGLEERSEFKPMELSGGQKQRVAIARALVTNPSFILGDEPTGALDTKTSVQIMDLFKQFNDNGKTIIIITHEPEVAALCKKTVILRDGNIEHSDIE

SEQ ID NO: 2121 - DNA, 960 bp, Streptococcus agalactiae
atgcggcgaaaaatagttttactttttgtagttccaatgcttatagttttaggaattttaggagtggtagttcattattatggttcagcattaaatatttatctattacctcctagtagcgaacgttatggacgtgttattttagatcgtgttgaacagcgtggtttgtattcgcaaggtcgtcaatggcaaattataagacaacgatcagaaaaaaagttgaaaacgtcaaaatcttaccaagagagtcgcaacattgtacaggaagcagtacggtatggaggcggtaaacatagtcaaatattatccaaagagactgtacgaagagataccctagatagtcgatatccagaatatcgaagattaaacgaagacattctcttaattactattccttctataagtaagttagataaacgatctattagccattatagtggtaaattacaaaatatattgatggaaaaaagttataagggactcattttagacttatcgaataatactggcggcaatatgatccctatgattgggggggtagcctctattttaccaaatgataccctatttcattatactgataagtatggaaataagaaaacaatcacgatgaaaaatataccgctagaagcattaaaaatatctaggaaaacaatcaatactaagcatgttccaatcgctattataactaatcataaaactgctagttcggcagaaatgacttttttatcatttaaaggattacctaatgttaaaagctttggtcaagctacagcaggatatacgactgttaatgaaactttcatgctttacgacggtgctagattagctttaactacaggaatagttagtgatcgacaaggatataaatacgagaacacccctatcttaccagatcaagtaaccagccttcctttacaagagtcacagtcttggttaaagagtagaatcaatcaaaat

SEQ ID NO: 2122 - protein, 320 aa, Streptococcus agalactiae
MRRKIVLLFVVPMLIVLGILGVVVHYYGSALNIYLLPPSSERYGRVILDRVEQRGLYSQGRQWQIIRQRSEKKLKTSKSYQESRNIVQEAVRYGGGKHSQILSKETVRRDTLDSRYPEYRRLNEDILLITIPSISKLDKRSISHYSGKLQNILMEKSYKGLILDLSNNTGGNMIPMIGGVASILPNDTLFHYTDKYGNKKTITMKNIPLEALKISRKTINTKHVPIAIITNHKTASSAEMTFLSFKGLPNVKSFGQATAGYTTVNETFMLYDGARLALTTGIVSDRQGYKYENTPILPDQVTSLPLQESQSWLKSRINQN

SEQ ID NO: 2123 - DNA, 171 bp, Streptococcus agalactiae
atggccaagacaagtaaaaaattgacaaaatctttagggcctattggtaaattaatttcaataatccctgacacaactgaacttattggaaaagcaattgataattctcgtccaattattgaaaaagaacttgaccgtcgtcatgaaaaaaaaacagacttatactcagct

SEQ ID NO: 2124 - protein, 57 aa, Streptococcus agalactiae
MAKTSKKLTKSLGPIGKLISIIPDTTELIGKAIDNSRPIIEKELDRRHEKKTDLYSA

SEQ ID NO: 2125 - DNA, 480 bp, Streptococcus pyogenes
atgccaaagagaataagaaaagctctaggagtagttgggaaactgatgtcaattgttcctgacactactgaaattattggaaaaacgattgataacagtcgaccaattatcgaaaaacgtatggaacaaaaacatgaaaaagagatgcaattacgcacgataaatgatgtgattaatcttcctgttgatcaggcacaagctcatttggaacaacttggctttgtagtagccactatacctgctaagcctcataaaaaatggcttcatagtaatctcaatgaagtggttgctatgtctccaaaatctggtaaatataagataggaagcctgatcaaactctactacattactgttgatgttttggaaaaaagtcaagacttattagaccaagaaaacttgcggactgtggaacgcaatcaaaaaatcgctgatacttttgagtctgtcaaacacattcgatttccttttaaaaaatggcgt

SEQ ID NO: 2126 - protein, 160 aa, Streptococcus pyogenes
MPKRIRKALGVVGKLMSIVPDTTEIIGKTIDNSRPIIEKRMEQKHEKEMQLRTINDVINLPVDQAQAHLEQLGFVVATIPAKPHKKWLHSNLNEVVAMSPKSGKYKIGSLIKLYYITVDVLEKSQDLLDQENLRTVERNQKIADTFESVKHIRFPFKKWR

SEQ ID NO: 2127 - DNA, 345 bp, Streptococcus agalactiae
atgaaaaaaaaacagacttatactcagcttgataatgtagtacaccttgatatcaatgatgcgcaagtttacttagagcaacgccattttaatgtatcaaggattgttgctgaaccaaattcaaagtgggcaaccctacatcctaatcaagttgtgaatatgtcgcctaaagctggtagggtcagaatcggttcattagtgaagttgtactatattacagaggatatccttgaagaaagtaagacactacttttatctaaatccgaaaaaagtaaagcacgacaacaacggttaacagaagtattgagtacccctagtcaattactcaaaaaaaatcgaaataaa

SEQ ID NO: 2128 - protein, 115 aa, Streptococcus agalactiae
MKKKQTYTQLDNVVHLDINDAQVYLEQRHFNVSRIVAEPNSKWATLHPNQVVNMSPKAGRVRIGSLVKLYYITEDILEESKTLLLSKSEKSKARQQRLTEVLSTPSQLLKKNRNK

SEQ ID NO: 2129 - DNA, 846 bp, Streptococcus agalactiae
atgaaaatcaaaaagctattagggttaacgacaacagtagtaatttcagcacttattttaggagcctgtggtcagtctaaaaatgaagacgccaaagtcgttagagttggaacaatggtaaagagtaaaactgaaaaagctcgttgggataaaatcgaagaattagttaagaaaaaaggcgttaagctaaaatttacggaattcacagattatacacaacctaataaagctttagaaagtgatgagattgatattaatgctttccagcattataattacttaaacaattggaataaagcaaataagaccaatcttgtttccgttgctgagacatactttacttcctttagattatactctggtactaagaacggtaaaggtaaataccaaacagtttctgaaattccaaataaagcaactattactatcccaaacgatgcagttaacgaaagtcgctctctctacttgttacaatcagcaggcttgctaaaattgaaagtatcaggtgatgcattagcaacaatgtcagatgttgtttccaatcctaaatctttagatttaaaagaagtagatgcagcacagaccgcacgttctttggattccacagatgcagcagttattaataatgattttgtgacagaagcaggaataaatcctaaatcagctatttttattgaaccaaaaagtaaaaatgcaaaacaatggtacaaccttttagttgctcaaaaaggttggcaagacaaatcaaaagctaaagccattaaagaagttgtgaaagcttaccatacagatgcggttaaaaaagttatcgaaaaaacatctcaaggtttagatcaacctgtttgg

SEQ ID NO: 2130 - protein, 282 aa, Streptococcus agalactiae
MKIKKLLGLTTTVVISALILGACGQSKNEDAKVVRVGTMVKSKTEKARWDKIEELVKKKGVKLKFTEFTDYTQPNKALESDEIDINAFQHYNYLNNWNKANKTNLVSVAETYFTSFRLYSGTKNGKGKYQTVSEIPNKATITIPNDAVNESRSLYLLQSAGLLKLKVSGDALATMSDVVSNPKSLDLKEVDAAQTARSLDSTDAAVINNDFVTEAGINPKSAIFIEPKSKNAKQWYNLLVAQKGWQDKSKAKAIKEVVKAYHTDAVKKVIEKTSQGLDQPVW

SEQ ID NO: 2131 - DNA, 789 bp, Streptococcus pyogenes
ttggttgcttgttctgaaaaacaagatgataaaaacactttaactattggggtgatgacaaaaacagaatctgatcaagcgagatgggataaagttgaagaattattgaaaaaagacaatatcactttgaagtacaaagaatttacagattactcgcaacctaataaggcagttgctaatggtgaagtcgatattaatgccttccaacactataatttcttaaataactggaataaggaaaataaggaacatttggtggccattgctgatacctatatcagcccaattaaccttttctctggaaccagtcaagatggaaaggctaaatacaaatcagtagctgatctgccaaatggtactcaaattgcagtaccaaatgatgcgaccaatgaaagccgtgccctctatgtgctgcaatcagctggcctcattaaattgaatgtgtctggtgatcaattagcaaccattgccaatatctcagagaacaaaaagaaattagatatcaaggaattagatgctagccaaacggcacgtgctttagtatctgctgatgcagctgttgtcaataatagttacgctgttcctgcaaaaattgactacaaaacctctcttttcaaagaaaaagcagatgacaattcaaaacagtggattaacattattgcaggtcaaaaagattgggaaaaatcagagaaggctgatgctattaaaaaactcatcaaggcctaccaaactgatgaggtgaagaaagtcgtggaaaaaacttcaaatggtatagatgtatccgtatgg

SEQ ID NO: 2132 - protein, 263 aa, Streptococcus pyogenes
LVACSEKQDDKNTLTIGVMTKTESDQARWDKVEELLKKDNITLKYKEFTDYSQPNKAVANGEVDINAFQHYNFLNNWNKENKEHLVAIADTYISPINLFSGTSQDGKAKYKSVADLPNGTQIAVPNDATNESRALYVLQSAGLIKLNVSGDQLATIANISENKKKLDIKELDASQTARALVSADAAVVNNSYAVPAKIDYKTSLFKEKADDNSKQWINIIAGQKDWEKSEKADAIKKLIKAYQTDEVKKVVEKTSNGIDVSVW

SEQ ID NO: 2133 - DNA, 756 bp, Streptococcus agalactiae
atgaatggagtaaatatgcactataaagaattacttgagtcatccgaaaaagcttatttggaaactaatcggtataaacattttaagaatataatcatttcagagcgttatttttcaaactatattagctacaaaataatgcctacagtaagtgagtttttacaggatatgatctatttagcagatgaacaaaaagattatcagtctgattttgcttttgtattttttgaggaaaatgctgaattgagcagtgaattacagagaactttatcacaacaaggctttgaatcagagaaacatatcatatttacaaattcattaaatcatcttaaactttttgaaaaagaatttgatgacatcacatttactaaacttaatgaaaattacctagaaaaatacctaaagttcaaatataaacaaagtatagtttacggagaaatttacgctaagcaaatgtataatgataatcgtgttaatcttttaaataataatgctaaagtttacctagctattaaagataatcaaattattggagatgtaacagcttgggactatggtgaatacgtggaaatagatgatttttatgtccaagagtcctacagaggacaaggaattggtacgcgcctacaatttgatgcaagtagggggtttaagaaagttatcttaatttcagaagaagaaaacagaaaaatgtatgagcaccaaggttatgaggaagtcgcctattattggaccgctttacggagccctcgaaag

SEQ ID NO: 2134 - protein, 252 aa, Streptococcus agalactiae
MNGVNMHYKELLESSEKAYLETNRYKHFKNIIISERYFSNYISYKIMPTVSEFLQDMIYLADEQKDYQSDFAFVFFEENAELSSELQRTLSQQGFESEKHIIFTNSLNHLKLFEKEFDDITFTKLNENYLEKYLKFKYKQSIVYGEIYAKQMYNDNRVNLLNNNAKVYLAIKDNQIIGDVTAWDYGEYVEIDDFYVQESYRGQGIGTRLQFDASRGFKKVILISEEENRKMYEHQGYEEVAYYWTALRSPRK

SEQ ID NO: 2135 - DNA, 1332 bp, Streptococcus agalactiae
atgtctcaatcttacattaatgttatcggcgctggtttggctggttctgaagcagcttatcaaattgctaaacgtggaataccagttaagctttatgaaatgcgtggggttaaatcaacccctcaacataaaacagataattttgcagaattagtatgttccaattcattccgcggtgattctctaacaaatgcagttggtcttttaaaagaagaaatgcgtcgtttggattctatcattatgagaaatggggaggcacatcgagttccagcaggtggagccatggccgttgatagagaaggttattctgaagctgttactgaggaaatccataaacatccattaatcgaagtaattcgtgatgaaatcacagatatccctggagatgctattacagttatcgctacaggaccattaacaagtgatagtctggcagctaaaatccatgaacttaatggtggtgatggtttttatttttacgatgccgccgctccaattgtcgataaaaatacgattgacataaataaagtttaccttaagtctaggtatgacaaaggtgaagcagcttatctaaattgtccaatgaccaaagaagaatttatggcttttcatgaagctttaactacagctgaggaagcaccactaaattcttttgagaaagaaaaatacttcgaaggttgtatgcctatcgaagtgatggctaagcgtggtattaaaacgatgctttatggtccaatgaaaccagttggtttggagtatcctgaggactacaaaggaccgcgagatggtgaatttaaaacaccatatgctgttgttcaattacgtcaagataatgctgcaggctctctttataacatagttggtttccaaactcatcttaagtggggagaacaaaaacgtgtatttcaaatgattcctggtcttgaaaatgctgaatttgtccggtatggtgttatgcatcgcaattcttatatggattcaccaaatcttttaaaccaaacctttgctacacgtaagaacccaaatcttttctttgctggacaaatgaccggtgttgaaggttatgtagaatcggcagcaagtggtcttgtagcgggaatcaatgctgtccgtcgcttcaatggggagagtgaagtagttttcccacaaactactgctattggtgcactgccacattatattacacatacagacagcaaacatttccaaccaatgaatgttaactttggtatcatcaaagaattagaaggtccacgaattcgtgataagaaagagcgttatgaagctattgctacacgagctttgaaagatttagaaaaatttctcaactat

SEQ ID NO: 2136 - protein, 444 aa, Streptococcus agalactiae
MSQSYINVIGAGLAGSEAAYQIAKRGIPVKLYEMRGVKSTPQHKTDNFAELVCSNSFRGDSLTNAVGLLKEEMRRLDSIIMRNGEAHRVPAGGAMAVDREGYSEAVTEEIHKHPLIEVIRDEITDIPGDAITVIATGPLTSDSLAAKIHELNGGDGFYFYDAAAPIVDKNTIDINKVYLKSRYDKGEAAYLNCPMTKEEFMAFHEALTTAEEAPLNSFEKEKYFEGCMPIEVMAKRGIKTMLYGPMKPVGLEYPEDYKGPRDGEFKTPYAVVQLRQDNAAGSLYNIVGFQTHLKWGEQKRVFQMIPGLENAEFVRYGVMHRNSYMDSPNLLNQTFATRKNPNLFFAGQMTGVEGYVESAASGLVAGINAVRRFNGESEVVFPQTTAIGALPHYITHTDSKHFQPMNVNFGIIKELEGPRIRDKKERYEAIATRALKDLEKFLNY

SEQ ID NO: 2137 - DNA, 1494 bp, Streptococcus pyogenes
ttgaaaagggttcccgtagaaagagacaaacgcttagtctctttctttttctttcttctcatttctgttataataagtcaggtaactacattagaaagatttgtgggtctgtcatctaagagatgtcattcccgaagaggtattagtgacttgtctcaatcaactgcaacttatattaatgttattggagctgggctagctggttctgaagctgcctatcagattgctaagcgcggtatccccgttaaattgtatgaaatgcgtggtgtcaaagcaacaccgcaacataaaaccactaattttgccgaattggtctgttccaactcatttcgtggtgatagcttaaccaatgcagtcggtcttctcaaagaagaaatgcggcgattagactccattattatgcgtaatggtgaagctaaccgcgtacctgctgggggagcaatggctgttgaccgtgaggggtatgcagagagtgtcactgcagagttggaaaatcatcctctcattgaggtcattcgtggtgaaattacagaaatccctgacgatgctatcacggttatcgcgacgggaccgctgacttcggatgccctggcagaaaaaattcacgcgctaaatggtggcgacggattctatttttacgatgcagcagcgcctatcattgataaatctaccattgatatgagcaaggtttaccttaaatctcgctacgataaaggcgaagctgcttacctcaactgccctatgaccaaagaagaattcatggctttccatgaagctctgacaaccgcagaagaagccccgctgaatgcctttgaaaaagaaaagtattttgaaggctgtatgccgattgaagttatggctaaacgtggcattaaaaccatgctttatggacctatgaaacccgttggattggaatatccagatgactatacaggtcctcgcgatggagaatttaaaacgccatatgccgtcgtgcaattgcgtcaagataatgcagctggaagcctttataatatcgttggtttccaaacccatctcaaatggggtgagcaaaaacgcgttttccaaatgattccagggcttgaaaatgctgagtttgtccgctacggcgtcatgcatcgcaattcctatatggattcaccaaatcttttaaccgaaaccttccaatctcggagcaatccaaaccttttctttgcaggtcagatgactggagttgaaggttatgtcgaatcagctgcttcaggtttagtagcaggaatcaatgctgctcgtttgttcaaaagagaagaagcacttatttttcctcagacaacagctattgggagtttgcctcattatgtgactcatgccgacagtaagcatttccaaccaatgaacgtcaactttggcatcatcaaagagttagaaggcccacgcattcgtgacaaaaaagaacgttatgaagctattgctagtcgtgctttggcagatttagacacctgcttagcgtcgctt

SEQ ID NO: 2138 - protein, 498 aa, Streptococcus pyogenes
LKRVPVERDKRLVSFFFFLLISVIISQVTTLERFVGLSSKRCHSRRGISDLSQSTATYINVIGAGLAGSEAAYQIAKRGIPVKLYEMRGVKATPQHKTTNFAELVCSNSFRGDSLTNAVGLLKEEMRRLDSIIMRNGEANRVPAGGAMAVDREGYAESVTAELENHPLIEVIRGEITEIPDDAITVIATGPLTSDALAEKIHALNGGDGFYFYDAAAPIIDKSTIDMSKVYLKSRYDKGEAAYLNCPMTKEEFMAFHEALTTAEEAPLNAFEKEKYFEGCMPIEVMAKRGIKTMLYGPMKPVGLEYPDDYTGPRDGEFKTPYAVVQLRQDNAAGSLYNIVGFQTHLKWGEQKRVFQMIPGLENAEFVRYGVMHRNSYMDSPNLLTETFQSRSNPNLFFAGQMTGVEGYVESAASGLVAGINAARLFKREEALIFPQTTAIGSLPHYVTHADSKHFQPMNVNFGIIKELEGPRIRDKKERYEAIASRALADLDTCLASL

SEQ ID NO: 2139 - DNA, 696 bp, Streptococcus agalactiae
ttgttaccagcatatattaaaattcacgacgctattaaaaaggaaatcgataaagggacttggaagattgggcagcggttacctagcgaaagagatttagcggatgattatagtgtaagtcgtatgacacttcgccaatcaattacattgttagttgaagaaggtattttggagagacgagttggtagtggcacctatgttgctagtcatcgtgttcaagaaaaaatgcggggaacaactagttttacagaaattgtcaattctcaagggcgtaagccatccagtaaactaatctcatttcaaagaaaactagcaaatgaaaccgaaattcaaaaattaaatttatcacagtcagattatgtggttcgtatggaaagggtacgttatgctgataaggtaccgttggtttatgaggtagcctctataccagagaatttaattaaaggttttgaacaatcagaggttacagaacatttctttaaaaccttaacagagaatggctacgaaattgggaaaagccaacaaactatatatgctagaaatgctagtgaacgtgttgcttcgcatttagaagttaacgcaggccatgctattttggcattgacacaagtttcatactttactgatggtaagccttttgaatatgttcatgggcaatatgttggagatcgttttgagttttatttagagaataac

SEQ ID NO: 2140 - protein, 232 aa, Streptococcus agalactiae
MLPAYIKIHDAIKKEIDKGTWKIGQRLPSERDLADDYSVSRMTLRQSITLLVEEGILERRVGSGTYVASHRVQEKMRGTTSFTEIVNSQGRKPSSKLISFQRKLANETEIQKLNLSQSDYVVRMERVRYADKVPLVYEVASIPENLIKGFEQSEVTEHFFKTLTENGYEIGKSQQTIYARNASERVASHLEVNAGHAILALTQVSYFTDGKPFEYVHGQYVGDRFEFYLENN

SEQ ID NO: 2141 - DNA, 1560 bp, Streptococcus agalactiae
atgactgatatttctatattgaatgatatccaaaaaattatcgttctagattacggtagtcaatataaccagcttatcgcacgtcgtatccgtgaatttggtgtattttctgagttaaaatcacataaaattacggctgatgaaattcgcgatattaatcctattggtatcgtactttcaggtggtccaaattccgtatacgctgatggcgcttttggaatcgatgaagaaatttttgaattaggaattccaatcttaggaatttgttatggcatgcaactgattacccataaactcggtggtaaggttcttcctgcgggagaagctggtcatcgtgagtatggtcaatcagcacttcgcctacgctcagaatcagcactctttgctggcactcctcaagaacaacttgttttgatgagccatggtgatgctgtcactgaaattcctgagggtttccatctcgttggtgactctgttgactgtccatttgctgcaatggaaaatactgaaaaacaattttatggtatccaattccaccccgaagttcgtcactcagtatatggcaatgatatccttaaaaattttgctgttaatatctgtggcgcacgtggtgattggtcaatggataacttcattgatatggaaattgcaaaaatacgtgaaactgtaggcgatcgtaaagtacttcttggactatctggcggtgttgattcatctgttgtcggagtactcctacaacgtgctatcggtgatcaattaacatgtatttttgtagatcatggtttattacgtaaaaatgaaggtgaccaagttatggatatgcttggtggtaaatttggacttaatattatccgtgttgatgcttcaaaacgcttcctagatcttctttctggtgttgaagatcccgagagaaaacgaaaaatcatcggaaatgagttcgtgtacgtttttgatgatgaggcaagtaaacttaaaggcgttgatttccttgctcaaggtaccctctacacagatattattgaatctgggacagaaacagcccaaacaatcaagtcacaccataatgttggtggattgccagaagatatgcaatttgaattgattgagccacttaacacattattcaaagatgaggttcgcgctcttggtactgcacttggaatgcctgatgaagttgtatggcgtcaaccattccctgggcctggtcttgctattcgcgttatgggtgaaattaccgaagaaaaacttgaaacagtccgcgaatcagatgctattcttcgtgaagaaatcgctaaagctggtctagatcgtgacgtatggcagtatttcacagttaatactggcgtacgttctgtcggtgttatgggagatggtcgtacttatgactatacaattgctatccgtgcaattacttcaattgatggcatgacagctgactttgcgcaacttccttgggatgtacttaagaaaatttcgacacgtattgttaacgaagttgatcacgttaaccgtattgtttatgatattacaagtaaaccacctgcaactgttgagtgggaa

SEQ ID NO: 2142 - protein, 520 aa, Streptococcus agalactiae
MTDISILNDIQKIIVLDYGSQYNQLIARRIREFGVFSELKSHKITADEIRDINPIGIVLSGGPNSVYADGAFGIDEEIFELGIPILGICYGMQLITHKLGGKVLPAGEAGHREYGQSALRLRSESALFAGTPQEQLVLMSHGDAVTEIPEGFHLVGDSVDCPFAAMENTEKQFYGIQFHPEVRHSVYGNDILKNFAVNICGARGDWSMDNFIDMEIAKIRETVGDRKVLLGLSGGVDSSVVGVLLQRAIGDQLTCIFVDHGLLRKNEGDQVMDMLGGKFGLNIIRVDASKRFLDLLSGVEDPERKRKIIGNEFVYVFDDEASKLKGVDFLAQGTLYTDIIESGTETAQTIKSHHNVGGLPEDMQFELIEPLNTLFKDEVRALGTALGMPDEVVWRQPFPGPGLAIRVMGEITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 2143 - DNA, 1560 bp, Streptococcus pyogenes
atgactgaaatttcaattttgaatgatgttcaaaaaattatcgttcttgattatggtagccagtacaatcagcttattgctagacgtattcgagagtttggtgttttctccgaactaaaaagccataaaatcaccgctcaagaacttcgtgagatcaatcccataggtatcgttttatcaggagggcctaactctgtttacgctgataacgcctttggcattgaccctgaaatctttgaactagggattccgattcttggtatctgttacggtatgcaattaatcacccataaattaggtggtaaagttgttcctgctggacaagctggtaatcgtgaatacggtcagtcaacccttcatcttcgtgaaacgtcaaaattattttcaggcacacctcaagaacaactcgttttgatgagccatggtgatgctgttactgaaattccagaaggtttccaccttgttggagactcaaatgactgtccctatgcagctattgaaaatactgagaaaaacctttacggtattcagttccacccagaagtgagacactctgtttatggaaatgacattcttaaaaactttgctatatcaatttgtggcgcgcgtggtgattggtcaatggataattttattgacatggaaattgctaaaattcgtgaaactgtaggcgatcgtaaagttcttctaggtctttctggtggagttgattcttcagttgttggtgttctacttcaaaaagctatcggtgaccaattaacttgtattttcgttgatcacggtcttcttcgtaaagacgagggcgatcaagttatgggaatgcttgggggcaaatttggcctaaatattatccgtgtggatgcttcaaaacgtttcttagaccttcttgcagacgttgaagatcctgagaaaaaacgtaaaattattggtaatgaatttgtctatgtttttgatgatgaagccagcaaattaaaaggtgttgacttccttgcccaaggaacactttatactgatatcattgagtcaggaacagaaactgctcaaaccatcaaatcacatcacaatgtgggtggtctccccgaagacatgcagtttgaattgattgagcccttaaacactcttttcaaagatgaagttcgagcgcttggaatcgctcttggaatgcctgaagaaattgtttggcgccaaccatttccaggtcctggacttgctatccgtgtcatgggagcaattactgaagaaaaacttgaaaccgttcgcgaatcagacgctatccttcgtgaagaaattgctaaggctggacttgatcgtgacgtgtggcaatactttacagttaacacaggtgtccgttctgtaggcgtcatgggagatggtcgtacttatgattataccatcgccattcgtgctattacgtctattgatggtatgacagctgactttgctcaacttccttgggatgtcttgaaaaaaatctcaacacgtatcgtaaatgaagttgaccacgttaaccgtatcgtctacgacatcacaagtaaaccacccgcaacagttgaatgggaa

SEQ ID NO: 2144 - protein, 520 aa, Streptococcus pyogenes
MTEISILNDVQKIIVLDYGSQYNQLIARRIREFGVFSELKSHKITAQELREINPIGIVLSGGPNSVYADNAFGIDPEIFELGIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEIAKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGAITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 2145 - DNA, 348 bp, Streptococcus agalactiae
gtgcaatcggcaacacctgtaggagcttcaaacgtttattatttgacaggtttcactacacaaggatcaaccaaagctaaagctttccatgatcattacgttaaggcatatggtgaagaaccatccatgttctcggctttatcatacgacgctgtgtatatggcagctaaatctgctaaaggagctaaaacttcaattgatattaaaaaagctttagctaagctgaaagattttaaaggtgtgacagggaaaatgtctattgataaaaatcacaatgttgttaaatcagcttacgttgtcaaattagaggatggaaaaacaagtagcgttaacattatttcagcaaaa

SEQ ID NO: 2146 - protein, 116 aa, Streptococcus agalactiae
MQSATPVGASNVYYLTGFTTQGSTKAKAFHDHYVKAYGEEPSMFSALSYDAVYMAAKSAKGAKTSIDIKKALAKLKDFKGVTGKMSIDKNHNVVKSAYVVKLEDGKTSSVNIISAK

SEQ ID NO: 2147 - DNA, 867 bp, Streptococcus agalactiae
atgcttcaacagctcgttaatggacttatcttaggatccatatatgctttacttgccttaggatatactatggtatatggcattattaagctgattaattttgctcatggggacatctatatgatgggcgctttcatgggctattatttgattaatcatcttcatcttaattttttcctagctttattaattgcaatgctggggtctgctttcctaggtgttgtaattgaatatttagcttatcgtccactgagaaaatcaactagaattgccgcgttaattacagctattggtgtttcttttcttttggagtacgggatggtataccttgttggagcggatactagggcatttccgcaagccattcatactgttaaatataatttaggaccgataactataaccaatgttcagctcatcattttaggtattgcgctattactaatgcttactttacagttcatcgttcaaaaaactaaaatggggaaagctatgagagctttatcagtggatagcgatgccgcacaattgatgggaattaatgttaaccgtaccattagttttacatttgcgctggggtctgctttagctggagcaggtggagtactgattgggctttattataattctgttcaacctcttatgggggtaactccagggttgaaagcatttgttgcagctgtcttaggtggtattggtatcattccgggagcggctatcggtggttttgttattggcattttagaaactttagcgactgcacttggtgtgtcagattttcgagatggtatcgtttatgctattttaattctcattttcttgatccgtccagcaggaattcttggaaaaaatattaaggagaaggtc

SEQ ID NO: 2148 - protein, 289 aa, Streptococcus agalactiae
MLQQLVNGLILGSIYALLALGYTMVYGIIKLINFAHGDIYMMGAFMGYYLINHLHLNFFLALLIAMLGSAFLGVVIEYLAYRPLRKSTRIAALITAIGVSFLLEYGMVYLVGADTRAFPQAIHTVKYNLGPITITNVQLIILGIALLLMLTLQFIVQKTKMGKAMRALSVDSDAAQLMGINVNRTISFTFALGSALAGAGGVLIGLYYNSVQPLMGVTPGLKAFVAAVLGGIGIIPGAAIGGFVIGILETLATALGVSDFRDGIVYAILILIFLIRPAGILGKNIKEKV

SEQ ID NO: 2149 - DNA, 1089 bp, Streptococcus pyogenes
gtggttcaattcataaggaggaaggtcatgtctaaaaatgcgcaaaaaattgctgtaccattgatttctgtcttgctaggatttttacttggcgctattattatggttatctttggttatgatcctatctgggggtatgaaggtttattccaaattgcctttggtagtgttaaaaatattggagaaatattccgttcaatggggccattgattttaatagcgcttggctttactgttgctagccgtgcaggcttctttaacgttggtttgtctggacaggctttagctggatggatttcagcaggttggtttgcactcttaaatccagatatgcctcgtccattattgattcttatgacagctcttatcggaatgattgctggtggtattgctggagctattccagggatacttcgtgcttatcttggtacaagtgaagttatcgttacgattatgatgaactacatcattttatatgtcggaaatgctattgttcaacgtggttatcctgagagtgtcaaacaaagtattgattcaactattcaagttagtgataatgctagttatcaaacgcattggttatcagccctaactaataactctcgtattaatattggtattttctttgccattattgccattgccctaatctggttcttgcttaacaaaactactttaggttttgagattcgttcagttggtctcaacccacatgcttcagaatacgcagggatgtcatcaaaacgtactatcattttatcaatgattatctctggagctcttgcaggtcttggaggagtagttgaaggtctaggaacctttgaaaatgtttttgtacaaggatcttctttagcagttggttttgacggtatggcagttagcttattagcagcaaattcaccgcttggaatatttttctcatcattcctatttggtgtcttaaatattggtgctccaggaatgaatattgcaggcattccaccagaacttgttaaagtagtaactgcatcaatcattttctttgttggttcacattacctcattgaacgttacattattcgccctaaaaaattagtgaaaggtggtaaa

SEQ ID NO: 2150 - protein, 363 aa, Streptococcus pyogenes
VVQFIRRKVMSKNAQKIAVPLISVLLGFLLGAIIMVIFGYDPIWGYEGLFQIAFGSVKNIGEIFRSMGPLILIALGFTVASRAGFFNVGLSGQALAGWISAGWFALLNPDMPRPLLILMTALIGMIAGGIAGAIPGILRAYLGTSEVIVTIMMNYIILYVGNAIVQRGYPESVKQSIDSTIQVSDNASYQTHWLSALTNNSRINIGIFFAIIAIALIWFLLNKTTLGFEIRSVGLNPHASEYAGMSSKRTIILSMIISGALAGLGGVVEGLGTFENVFVQGSSLAVGFDGMAVSLLAANSPLGIFFSSFLFGVLNIGAPGMNIAGIPPELVKVVTASIIFFVGSHYLIERYIIRPKKLVKGGK

SEQ ID NO: 2151 - DNA, 951 bp, Streptococcus agalactiae
atgaaagaaaatatgaaatcaattttatcttggttagctatagtagtgttagattatctcttgattagcgtgctaatatctatgggtatatttaacctctatcatattcaaattattgaaacaattgggattaatgttattttagcagttggtttgaacctaattgtaggttgttcgggacagttttcactaggacatgcaggtttcatggctattggcgcttatgcagttgctattatcggcgttaaaatgccaacttatgtaggttttttgatagctatacttgttggaactcttgttgcaggaggtattgccttaggtgtaggaattcctactttgagactaaaaggtgattatttagctatagctactttaggtgttgctgagattatccgtattttgttggttaatggaggtgatattacgaatggtgctgcgggtatcatggggattccgccttttacaacctggtctttagtttatggggtggcagttgtgagccttatccttgcaatgaattttttgcgtagtcccttagggcgtaatacaattgctatacgagaagatgaaattgcagcagagtctatgggtgtggatacaacaaaagtgaaagtaattgtttttgtttttggagctattttagcttctatcgctggtagtttacaggctggctacgttggaactgttatgccaaaagacttttcatttatgatgtctgtcaatgttttaattattgttgttttaggtggtttaggttcaatgacagggacagttttagcagcaattttattaggattattgaatatgttactacaagactacgcttctgttcgaatgattatctatgctttagccctgattttaattatgatttttagacctagcggtttattaggaacgaaagagttaactctatctcatctatttcgtaagacgagtaagggaggcaat

SEQ ID NO: 2152 - protein, 317 aa, Streptococcus agalactiae
MKENMKSILSWLAIVVLDYLLISVLISMGIFNLYHIQIIETIGINVILAVGLNLIVGCSGQFSLGHAGFMAIGAYAVAIIGVKMPTYVGFLIAILVGTLVAGGIALGVGIPTLRLKGDYLAIATLGVAEIIRILLVNGGDITNGAAGIMGIPPFTTWSLVYGVAVVSLILAMNFLRSPLGRNTIAIREDEIAAESMGVDTTKVKVIVFVFGAILASIAGSLQAGYVGTVMPKDFSFMMSVNVLIIVVLGGLGSMTGTVLAAILLGLLNMLLQDYASVRMIIYALALILIMIFRPSGLLGTKELTLSHLFRKTSKGGN

SEQ ID NO: 2153 - DNA, 762 bp, Streptococcus agalactiae
atggcacttcttgaagtaaaaaatttaagtaaacatttcggtggcctaactgctgtaggtgatgtttcgatgaaattacataaaggtgaattaattggcttaatcggccccaacggtgcgggtaagacaacgctttttaatctcttaacaggagtataccttcctagtaaagggacaatatcaattgatggtaagatattaaatgggaggaaaccagctaaaatagcttctttaggtttaggtagaacttttcaaaatatccgactttttaaaaatatgactgttttagacaatgtactagtaggactcagtaatcatcacttatcacatcctattgctagttttttacgattacccaaatactatcatagtgaaaaagccttaaggaaaaaggcactggagctattagagatttttggtttgaaagcatatcaagatgctcttgctaagaacctcccttatggaaaacaacggcgtttagaaattgttcgtgctttagcaacagaaccaaaaatattgtttttggatgagcccgcggcaggaatgaatcctcaagaaactgcagaattgacgcagttaattagtcaaataaagagtgattttgatattactattatgctgattgaacatgatatgaacttggttatgcaagtaacagagagaatttatgtattggaatatggtcgtctgattgctcacgggacacctgaagaaattaaaaataataaacgtgttatagaagcatacttggggggtgagcta

SEQ ID NO: 2154 - protein, 254 aa, Streptococcus agalactiae
MALLEVKNLSKHFGGLTAVGDVSMKLHKGELIGLIGPNGAGKTTLFNLLTGVYLPSKGTISIDGKILNGRKPAKIASLGLGRTFQNIRLFKNMTVLDNVLVGLSNHHLSHPIASFLRLPKYYHSEKALRKKALELLEIFGLKAYQDALAKNLPYGKQRRLEIVRALATEPKILFLDEPAAGMNPQETAELTQLISQIKSDFDITIMLIEHDMNLVMQVTERIYVLEYGRLIAHGTPEEIKNNKRVIEAYLGGEL

SEQ ID NO: 2155 - DNA, 708 bp, Streptococcus agalactiae
atgaccatgttgaaagtagaaaatctatctattcactatggtgttattcaagcggtgaatgatgtctcgtttgaagttaaccaaggtgaggttgtaaccttaattggagccaatggtgcaggaaagacatcaattttgaggacaatttctggtttagtaagaccaagtcagggttctatttcttttatggggaaacctatacataagttagcagctagaaaaattgttggcaatggtttagctcaggttccagaagggcgccacgttttctcaagtttgtctgttatggaaaatttagaaatgggagcctttcttcaaaaggatcgtgaacaaaatcaaaaaatgttaaaaaaagtgtttgatcgttttcctcgcttagaagaacgtaaaaaccaagatgcagcaaccttatcaggtggtgagcagcaaatgctcgctatggggcgtgcattgatgagtcgtcctaaattattacttttagatgaaccgtcaatgggcctagctccaatttttattcaagaaatttttaatatcattgaagacatcaaaaaacaagggactacagttcttttagttgaacaaaatgcaaataaagctctgacgattgctgataaagcatatgttctagagactgggaaggttgttttatcagggacaggtaaggaattactagtttcagatcaagttcgtaaagcttacttaggtgga

SEQ ID NO: 2156 - protein, 236 aa, Streptococcus agalactiae
MTMLKVENLSIHYGVIQAVNDVSFEVNQGEVVTLIGANGAGKTSILRTISGLVRPSQGSISFMGKPIHKLAARKIVGNGLAQVPEGRHVFSSLSVMENLEMGAFLQKDREQNQKMLKKVFDRFPRLEERKNQDAATLSGGEQQMLAMGRALMSRPKLLLLDEPSMGLAPIFIQEIFNIIEDIKKQGTTVLLVEQNANKALTIADKAYVLETGKVVLSGTGKELLVSDQVRKAYLGG

SEQ ID NO: 2157 - DNA, 807 bp, Streptococcus pyogenes
ttgaacgccgtttcgatgccgatacttacaccactggagcaaaccaaatgcagattgcggaggtctcaaatgtctaactcaattattgaaatcaaaaatctcaaaaaatcttacggcagcaatgaagtactcaaagatatctccctttctgttaacaagggagaagtgatttccattatcggttcttctggttctggaaaatcaaccctcctgcgctcgatcaatcttttggaagagccaagtgccggtcaaatcctctttcatggtgaagatgtccttgctgaacactacaacttgactcactaccgtgaaaaactaggcatggttttccaatcctttaacttgtttgaaaacctaaatgtattggaaaatgctatcgtcgctcaaaccaccgtcctcaaaagagaccgtgcacaagccgaacaaatcgctaaagaaaacctcaatgcggttggtatgacagaacaatactggcaagccaaaccaaaacaattatcaggggggcaaaaacaacgggttgccattgccagagccttatctgtcaatccagaagccatgctctttgatgaaccaacatcagctcttgatcctgaaatggttggtgaggtccttaaaaccatgcaagacttggcaaaatcagggttgaccatgattattgttacccatgaaatggaatttgctcgtgatgtttctgaccgtatcatcttcatggataagggattgattactgaagaaggaagtcctcaacaaattttcgagaatcctacacaagatcgtaccaaagaatttttacaacgcttcttaaaa

SEQ ID NO: 2158 - protein, 269 aa, Streptococcus pyogenes
LNAVSMPILTPLEQTKCRLRRSQMSNSIIEIKNLKKSYGSNEVLKDISLSVNKGEVISIIGSSGSGKSTLLRSINLLEEPSAGQILFHGEDVLAEHYNLTHYREKLGMVFQSFNLFENLNVLENAIVAQTTVLKRDRAQAEQIAKENLNAVGMTEQYWQAKPKQLSGGQKQRVAIARALSVNPEAMLFDEPTSALDPEMVGEVLKTMQDLAKSGLTMIIVTHEMEFARDVSDRIIFMDKGLITEEGSPQQIFENPTQDRTKEFLQRFLK

SEQ ID NO: 2159 - DNA, 657 bp, Streptococcus agalactiae
atgccagtgaaagattttatgacaaaaaaattagtttatgtctctccagatactacagttgcagaagctgctgatttattgagagaacaccacttaaggcgtttgccagttgttgaaaatgatcagctagtggggttagtgacagaagggacaatggcagaagcacaaccttctaaagcaaccagtctttctatatatgagatgaactatcttcttaataagacaaaaattcgagatattatgattaaagatattgtgactgtttcacagtatgctagccttgaggacgctatttatttgatgatgtctcgaaagatcggtgttttaccagtagttgataatggacaactttatgggattgtcacggatagggatgtttttaaagccttccttgaaattgcggggtatggtcaagaaagttatcgcttggttatattagctgatgaggggataggggtactatcaaaagtcctaaatcgtctttctagtgcaaatttaagtgttaaacgtttagtcattattgaacgaaaagcaggtaagaaagcggtcgagatacaactagaaggatacgctgacaaggatgttttaaaacaagaactagtatttgatgatgttattgtggaaactttagaaaagaccatgaaaaaaccactttct

SEQ ID NO: 2160 - protein, 219 aa, Streptococcus agalactiae
MPVKDFMTKKLVYVSPDTTVAEAADLLREHHLRRLPVVENDQLVGLVTEGTMAEAQPSKATSLSIYEMNYLLNKTKIRDIMIKDIVTVSQYASLEDAIYLMMSRKIGVLPVVDNGQLYGIVTDRDVFKAFLEIAGYGQESYRLVILADEGIGVLSKVLNRLSSANLSVKRLVIIERKAGKKAVEIQLEGYADKDVLKQELVFDDVIVETLEKTMKKPLS

SEQ ID NO: 2161 - DNA, 1479 bp, Streptococcus pyogenes
atgtcaaattgggacactaaatttttgaaaaaaggctacacttttgacgatgtcttgcttattccggcagagagtcatgttcttccaaatgaagttgatttaaagacaaaactcgcagacaatttgacattaaatattcctattattacagcagctatggatacggttactggtagtaaaatggctattgcaattgcgcgtgcgggtggtttaggtgttattcataaaaacatgtctattactgagcaagcagaagaagttcgcaaggtaaaacgttctgaaaatggtgtcatcattgatccattcttcttaacacctgaacacaaggtttcagaagctgaagaattaatgcagcgctaccgtatcagtggtgtgccaattgttgaaactttagcaaaccgtaagttggtcggtatcattactaatcgtgatatgcgttttatttctgattacaatgcaccaatctctgaacatatgactagtgagcacctcgttacggctgctgttggtacagatcttgaaactgcagaacgtattcttcatgaacaccgtattgaaaaacttcctttggttgataatagcggtcgtctgtctggtttaatcactatcaaagatattgaaaaagtaatcgaattcccacatgctgctaaagatgaatttggtcgtcttctggtcgctgctgcggtaggtgttacctcagatacttttgagcgtgccgaggccttgtttgaagctggtgcagatgcgattgttattgacacagctcatggtcattcggctggtgttcttcgtaaaattgctgaaattcgtgctcatttcccaaatcgtactttgattgctggaaatattgccactgctgaaggtgcgcgtgctctttatgatgcaggtgttgatgttgttaaagtgggtattggtcccggatctatctgtaccactcgtgtggttgcaggtgtcggtgttcctcaagtgactgctatttacgatgctgctgctgttgctcgtgaatatggcaaaacgattattgctgatggtggtatcaagtattctggcgatattgttaaggctcttgcagccggcggtaatgctgttatgcttggatcaatgtttgcaggtactgatgaagctccaggtgaaactgaaatctaccaaggccgtaagttcaaaacttatcgtggaatgggttccattgcagctatgaagaaaggatcaagcgatcgttacttccaaggttccgtcaatgaagctaataagctagttccagaaggtattgaaggccgtgttgcttataaaggagctgcttcagatattgtcttccaaatgttaggtggtatccgctcaggtatgggctatgttggcgcaggtgacattcaagaattacatgaaaatgctcaatttgttgaaatgtcaggtgcaggcttgattgaaagtcatccacatgatgtccaaatcacaaatgaagcaccaaactattctgtgcac

SEQ ID NO: 2162 - protein, 493 aa, Streptococcus pyogenes
MSNWDTKFLKKGYTFDDVLLIPAESHVLPNEVDLKTKLADNLTLNIPIITAAMDTVTGSKMAIAIARAGGLGVIHKNMSITEQAEEVRKVKRSENGVIIDPFFLTPEHKVSEAEELMQRYRISGVPIVETLANRKLVGIITNRDMRFISDYNAPISEHMTSEHLVTAAVGTDLETAERILHEHRIEKLPLVDNSGRLSGLITIKDIEKVIEFPHAAKDEFGRLLVAAAVGVTSDTFERAEALFEAGADAIVIDTAHGHSAGVLRKIAEIRAHFPNRTLIAGNIATAEGARALYDAGVDVVKVGIGPGSICTTRVVAGVGVPQVTAIYDAAAVAREYGKTIIADGGIKYSGDIVKALAAGGNAVMLGSMFAGTDEAPGETEIYQGRKFKTYRGMGSIAAMKKGSSDRYFQGSVNEANKLVPEGIEGRVAYKGAASDIVFQMLGGIRSGMGYVGAGDIQELHENAQFVEMSGAGLIESHPHDVQITNEAPNYSVH

SEQ ID NO: 2163 - DNA, 141 bp, Streptococcus agalactiae
gtgtttagcagtttcgatagctgtcttagaatccatcagtttggcaaagatgaagttacagaaggcgacattgaaggtgagaaggacctttccaccaatccgtccaataaccgtgtccatttcaagccaggagttcagctc

SEQ ID NO: 2164 - protein, 47 aa, Streptococcus agalactiae
MFSSFDSCLRIHQFGKDEVTEGDIEGEKDLSTNPSNNRVHFKPGVQL

SEQ ID NO: 2165 - DNA, 669 bp, Streptococcus agalactiae
gtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatc

SEQ ID NO: 2166 - protein, 223 aa, Streptococcus agalactiae
MKFKKRRKSTLPPIPKAIKEGRRYEDFIEHMNQSELNSWLEMDTVIGRIGGKVLLTFNVAFCNFIFAKLMDSKTAIETAKHIQVIKRTLYDNKRDFFELFPVILTDNGGEFARVDDIEIDVCGQSQLFFCDPNRSDQKARIEKNHTLVRDILPKGTSFDNLTQEDINLALSHINSVKRQALNGKTAYELFSFTYGKDIASILGIEEITAEDVCQSPKLLKDKI

SEQ ID NO: 2167 - DNA, 564 bp, Streptococcus agalactiae
atgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatgggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgat

SEQ ID NO: 2168 - protein, 188 aa, Streptococcus agalactiae
MSLSIMTKHKHLTLLDRNDIQSGLDRGETFKAIGLNLLKHPTTIAKEVKRNKQLRESTKDCLDCPLLRKAPYVCNGCPKRRINCGYKKTFYLAKQAQRNYEKLLVESREGIPLNKETFWKIDRVLSNGGQEGPTYLSYPQNQRSRSEFFNRLSTHQERLPIHHTNRPTQSCEVQKKAKEHTPSYSKSD

SEQ ID NO: 2169 - DNA, 681 bp, Streptococcus agalactiae
ttgataaattttgatagaatagtagtaattataaataaaggatgtaccatgaaaaaaggactaatgatttcttttgagggcccagatggtgcgggtaaaacaaccgttttagaagctgttttacccttgctcagagaaaaattatcacaagatattctcaccaccagagagcctggtggcgtaactatttcagaagaaattcgtcatattattttagatgttaaacacacgcaaatggataaaaaaacagagctattgctttacatggctgctcgacgccaacatctagtggaaaaggtactcccagctctagaagaagggaaaatagtcctaatggatcgttttattgatagttctgttgcctatcagggatcaggaagaggattagataagtcacatataaaatggcttaatgactatgcgactgatagtcataaacctgatttaactttatattttgatgttccttctgaagtaggtttagagcgtattcaaaaaagtgttcaaagggaggtaaatcgtctagatctcgagcaattagatatgcatcaacgcgtccgtcaaggttaccttgaattggcggattcggagccaaaccgcattgtgacgattgatgcctcccaacagctagatgaagtaatagctgagacattctctattattttagatcgtatcaaccaa

SEQ ID NO: 2170 - protein, 227 aa, Streptococcus agalactiae
MINFDRIVVIINKGCTMKKGLMISFEGPDGAGKTTVLEAVLPLLREKLSQDILTTREPGGVTISEEIRHIILDVKHTQMDKKTELLLYMAARRQHLVEKVLPALEEGKIVLMDRFIDSSVAYQGSGRGLDKSHIKWLNDYATDSHKPDLTLYFDVPSEVGLERIQKSVQREVNRLDLEQLDMHQRVRQGYLELADSEPNRIVTIDASQQLDEVIAETFSIILDRINQ

SEQ ID NO: 2171 - DNA, 696 bp, Streptococcus pyogenes
atgccagtgctttttagctcattttttgataaaatagaactactaaaaagtgaaggaaataagatgatcacaggaaaactcataaccgttgaaggtccagatggcgcagggaaaacgactgttttagagcaactcattccactgttaaaacaaaaagtggctcaggatatcttgacaacaagagagcctggaggtgttgccatttcagaacacattagagaacttattttagacatcaaccatactgctatggaccctaaaacagaactcttactttatattgcggctcgaaggcagcatttggtggaaaaggtactaccagctcttgaagcaggccagttggtttttattgatcgtttcatcgatagttcagtagcttatcaaggtgcgggacgcggtttgatcaaagcagacattcagtggctcaacgagttcgcaacagatggtttagagcctgacttgaccctttattttgatgttccttctgaaattggtttagcacggattaacgcgaaccaacaaagagaagtcaatcgtttagatttggaaacaatagagatacatcaacgagtacgaaaaggatacctagccttagctaaggagcatccaaaacgtattgtcacaattgatgcgactaaaccattgaaagaagttgtctctgtcgctttggaacatgtcttagccttgcttttagcc

SEQ ID NO: 2172 - protein, 232 aa, Streptococcus pyogenes
MPVLFSSFFDKIELLKSEGNKMITGKLITVEGPDGAGKTTVLEQLIPLLKQKVAQDILTTREPGGVAISEHIRELILDINHTAMDPKTELLLYIAARRQHLVEKVLPALEAGQLVFIDRFIDSSVAYQGAGRGLIKADIQWLNEFATDGLEPDLTLYFDVPSEIGLARINANQQREVNRLDLETIEIHQRVRKGYLALAKEHPKRIVTIDATKPLKEVVSVALEHVLALLLA

SEQ ID NO: 2173 - DNA, 861 bp, Streptococcus agalactiae
atggatttaaagcgaacacaacccaaattgctggaaaagtttaatactattttacagtcagataggatgagtcatgcctatcttttttcgggaaattttgcaagtctagatatggcactttatttagcacaaagtcagttctgtgaaaagcgccagagtggtttaccatgtcaagagtgtagagcctgtcgtttaatcgctaatggggaattttcagatgttaaaatcatagaaccacaggggcaacttattaagacagagactataaaagagctgactaaagatttttcaagatcaggtttcgaagggaaatcacaggtctttatcatcaaagattgcgaaaaaatgcatgtcaatgcagccaacagtcttttgaaatttattgaagaacctcaaagttcatcttatgtcatcttattgactaatgatgaaaacaatgttttgccaacaattaagagtagaacgcaaatttttcgttttccaaaacaattggacatgttggttcatcaagctgaacaagcaggattgctaaaatcacaagctagcttattagctcaagtagcagacgatcctaaacatttagaaatattgttgactaacaaaaagttattagattacttgaatttaagtcaacagtttgtgacgactttggcaaaagataggcaaactgcttatttagaagtatctcgcttgacatcgcaagttgtagataaaaatgatcaggcatttgtttttcaatggctgacaataatgctggctaaagaaggccaactttatgatttagaaaatacttatagagctcagcaaatgtggaagagcaatgttagttttcaaaatagtttagagtatatggtgctttct

SEQ ID NO: 2174 - protein, 287 aa, Streptococcus agalactiae
MDLKRTQPKLLEKFNTILQSDRMSHAYLFSGNFASLDMALYLAQSQFCEKRQSGLPCQECRACRLIANGEFSDVKIIEPQGQLIKTETIKELTKDFSRSGFEGKSQVFIIKDCEKMHVNAANSLLKFIEEPQSSSYVILLTNDENNVLPTIKSRTQIFRFPKQLDMLVHQAEQAGLLKSQASLLAQVADDPKHLEILLTNKKLLDYLNLSQQFVTTLAKDRQTAYLEVSRLTSQVVDKNDQAFVFQWLTIMLAKEGQLYDLENTYRAQQMWKSNVSFQNSLEYMVLS

SEQ ID NO: 2175 - DNA, 873 bp, Streptococcus pyogenes
atggatttagcgcaaaaagctcctaacgtttatcaagcttttcagacaattttaaagaaagaccgtctgaatcatgcttatcttttttcgggtgattttgctaatgaagaaatggctctttttttagctaaggtcatcttttgtgaacagaaaaaggatcagacgccctgcgggcattgtcgctcttgtcaattgattgaacaaggagattttgccgatgtgacggtattggaaccaacagggcaagtgattaaaacggatgtggtcaaagaaatgatggctaacttttctcagacaggatatgaaaacaaacgacaagtttttattatcaaagattgtgacaaaatgcatatcaatgccgctaatagcttgctaaaatacattgaggagcctcagggagaagcttacatatttttattgaccaatgatgataacaaagtgcttccgaccattaaaagtcggacacaggtttttcagtttcctaaaaacgaagcctatctttaccaattggcacaagaaaagggattattaaaccatcaggctaagctagtagccaaacttgccacaaacaccagtcatctagaacgtctgttgcaaacgagcaagcttttagaactgataactcaagcagagcgttttgtatctatttggctgaaagatcagttgcaggcatatttagcgttgaaccgtctggtacagttagcaactgaaaaagaagaacaagatttagttttgacccttttgaccttgctcttggcaagagagcgtgcgcaaacgcctttgacacaattggaggctgtctatcaggctaggctcatgtggcagagcaatgttaattttcaaaacacattagaatatatggtgatgtcagaa

SEQ ID NO: 2176 - protein, 291 aa, Streptococcus pyogenes
MDLAQKAPNVYQAFQTILKKDRLNHAYLFSGDFANEEMALFLAKVIFCEQKKDQTPCGHCRSCQLIEQGDFADVTVLEPTGQVIKTDVVKEMMANFSQTGYENKRQVFIIKDCDKMHINAANSLLKYIEEPQGEAYIFLLTNDDNKVLPTIKSRTQVFQFPKNEAYLYQLAQEKGLLNHQAKLVAKLATNTSHLERLLQTSKLLELITQAERFVSIWLKDQLQAYLALNRLVQLATEKEEQDLVLTLLTLLLARERAQTPLTQLEAVYQARLMWQSNVNFQNTLEYMVMSE

SEQ ID NO: 2177 - DNA, 324 bp, Streptococcus agalactiae
atggataaaaaagacttgtttgatgcctttgatgatttttcacaaaatttattagttgggttgtctgaaattgagactatgaaaaaacaaatccaaaaattattggaggagaatactgttctacgcattgaaaatggtaaacttcgtgagcgtctgagcgttattgaagcagaaacagaaactgcagttaaaaattctaaacaaggaagagaattactcgaaggcatttacaatgatggctttcacatttgtaatactttctatggtcaacgtcgtgaaaatgacgaagaatgtgctttttgtattgaattattatatagagat

SEQ ID NO: 2178 - protein, 108 aa, Streptococcus agalactiae
MDKKDLFDAFDDFSQNLLVGLSEIETMKKQIQKLLEENTVLRIENGKLRERLSVIEAETETAVKNSKQGRELLEGIYNDGFHICNTFYGQRRENDEECAFCIELLYRD

SEQ ID NO: 2179 - DNA, 321 bp, Streptococcus pyogenes
gtgaataaaaaagaattattcgatgcttttgatggattttcccaaaatttaatggttactttagctgaaattgaagccatgaaaaaacaagtccaatcactagtagaagaaaacacgattcttcgcctagaaaatacaaaactacgggaacgtttgagtcacctagaacatgaaacggtagctaaaaatccttccaaacaaaggaaggatcacttagagggaatttatgatgaagggtttcatatctgcaattttttctatggacaacgtcgtgaaaatgatgaagaatgtatgttttgcagagaattattagatagaaag

SEQ ID NO: 2180 - protein, 107 aa, Streptococcus pyogenes
VNKKELFDAFDGFSQNLMVTLAEIEAMKKQVQSLVEENTILRLENTKLRERLSHLEHETVAKNPSKQRKDHLEGIYDEGFHICNFFYGQRRENDEECMFCRELLDRK

SEQ ID NO: 2181 - DNA, 870 bp, Streptococcus agalactiae
ttgatggaaatgcaagttcaaaaaagttttaaatcaaatatacattacggaacactctatctagtcccaactccaattggtaatctagatgatatgacttttcgtgccattaggattttaagagaagttgattttatttgtgcagaggatacacgaaatacgggacttttactcaagcactttgatattactactaaacaaattagttttcacgaacacaatgcttacgataaaatctctgggttaattgatttgttaaaagaagggaaatctttagcccaagtatctgatgcaggaatgccctctatttctgacccaggacatgaccttgtcaaggctgctattgaaggggatatcccagttgtatctataccaggagctagcgctggtattactgctctcatcgcttcaggtttagctccacaacctcatattttttatggcttcttacctcgtaagaaaggtcaacaaataactttctttgaaacaaagcaagattaccctgaaacacaaatcttttatgagtcaccgtttcgagtctctgatacgctaaaacacatgaaagagatttacggagatcgccaagttgttttagtacgcgaattgacgaaactctatgaagagtatcaaagaggaaccattagtcaacttttagagcatattgaaaaggtccctctcaaaggtgaatgcttaattattgttgatggtaagagagataccgagcgagtgaaagacagtagccaacaagatccactagtattagtaaaagaatatatcgctaatggtgataaaactaatcaagcgataaaaaaagtagcaaaagaatttaatctcaatagacaagaactctatgctagtttccatgattta

SEQ ID NO: 2182 - protein, 290 aa, Streptococcus agalactiae
MMEMQVQKSFKSNIHYGTLYLVPTPIGNLDDMTFRAIRILREVDFICAEDTRNTGLLLKHFDITTKQISFHEHNAYDKISGLIDLLKEGKSLAQVSDAGMPSISDPGHDLVKAAIEGDIPVVSIPGASAGITALIASGLAPQPHIFYGFLPRKKGQQITFFETKQDYPETQIFYESPFRVSDTLKHMKEIYGDRQVVLVRELTKLYEEYQRGTISQLLEHIEKVPLKGECLIIVDGKRDTERVKDSSQQDPLVLVKEYIANGDKTNQAIKKVAKEFNLNRQELYASFHDL

SEQ ID NO: 2183 - DNA, 861 bp, Streptococcus pyogenes
atgcaggttcaaaaaagttttaaagacaaaaaaacaagcggaaccttgtatttggttccaaccccaattggcaatctgcaggacatgacctttagagcagtggcaacgttaaaagaggttgattttatttgtgcagaagacacaagaaacacaggtcttttgctaaaacactttgatattgctaccaagcaaatcagctttcatgagcacaacgcctatgagaagattcctgatttaattgatttattaatatcaggacggtcactagctcaggtgtctgatgcaggaatgccatcgatttctgatcctgggcatgatttggtcaaggctgctattgatagtgatatcgcagtcgttgctttaccaggtgcctcagcagggattacagctttgattgctagtggactggctcctcaaccccatgttttttatgggtttttacccagaaaagcagggcaacaaaaggctttctttgaggacaaacaccattacccagagacacaaatgttttatgaatcaccctatcgcatcaaagataccctgaccaatatgttggcttgttatggtgatcgtcaagtggtgcttgtcagagaattaaccaagctttttgaggagtaccaacgggggtcgatttcagaaatcttgtcctaccttgaggaaacacccctcaaaggggagtgtctgctgattgtggctggagcccaagcagacagtgaggttgagctgacagctgatgttgacttagtgtctctagtgcaaaaagaaattcaagcaggagccaagccaaatcaggctattaaaacaattgctaaagcttaccaggtaaatcgccaagagctttaccaacaatttcatgactta

SEQ ID NO: 2184 - protein, 287 aa, Streptococcus pyogenes
MQVQKSFKDKKTSGTLYLVPTPIGNLQDMTFRAVATLKEVDFICAEDTRNTGLLLKHFDIATKQISFHEHNAYEKIPDLIDLLISGRSLAQVSDAGMPSISDPGHDLVKAAIDSDIAVVALPGASAGITALIASGLAPQPHVFYGFLPRKAGQQKAFFEDKHHYPETQMFYESPYRIKDTLTNMLACYGDRQVVLVRELTKLFEEYQRGSISEILSYLEETPLKGECLLIVAGAQADSEVELTADVDLVSLVQKEIQAGAKPNQAIKTIAKAYQVNRQELYQQFHDL

SEQ ID NO: 2185 - DNA, 633 bp, Streptococcus agalactiae
atgattttgagggaattttgtgcagagaatttaacagacttaaccagattagataaagctattatttcacgtgtcgagctttgtgataaccttgctgtcggaggcactactcctagctacggtgttatcaaagaagctaatcaatatttacatgaaaaaggtattagtgtcgctgttatgattcgtccccgtggaggaaattttgtatacaatgatttagaattacgtattatggaagaggatatcctacgtgctgttgagttagaatcagatgctcttgttttgggaatattaacttcaaataatcatattgatactgaagccattgaacaacttctacctgctacccaaggtttgccacttgtttttcatatggcatttgatgttatcccgaaatctgaccaaaaaaaatcaatagatcaattagttgctttaggctttacaaggattctcctacatggttcatctaatggcgaaccaattatagaaaatatcaaacatatcaaagcattagttgaatatgctaataatcgtattgaaattatggttggcggcggtgtgactgctgaaaactatcaatatatttgccaagaaactggggttaaacaagcccatggtactagaataactcaa

SEQ ID NO: 2186 - protein, 211 aa, Streptococcus agalactiae
MILREFCAENLTDLTRLDKAIISRVELCDNLAVGGTTPSYGVIKEANQYLHEKGISVAVMIRPRGGNFVYNDLELRIMEEDILRAVELESDALVLGILTSNNHIDTEAIEQLLPATQGLPLVFHMAFDVIPKSDQKKSIDQLVALGFTRILLHGSSNGEPIIENIKHIKALVEYANNRIEIMVGGGVTAENYQYICQETGVKQAHGTRITQ

SEQ ID NO: 2187 - DNA, 627 bp, Streptococcus pyogenes
atgattaaagaattttgtgctgagaacctcacactactgccaacccttgatgctggtcaaatcagtcgtgtggaactctgtgataacctagctgtcggagggaccacgccatcttatggcgtcatcaaagaagcctgtcagctcttacacgataaaaagattagcgtagcgaccatgattcgacctcgcggtggcgattttgtctataacgacctcgaactaaaagctatggaagaagatatcttaaaagctgttgaagctggctcagatgcgctagtcttaggcttgctgaccacagaaaatcaactggataccgacgctatcgagcaattactgcctgctacacaaggcttgccactggttttccacatggcttttgaccggattccgactgatcaccagcaccaagcgcttgaccaactgattgattatggctttgtgcgtgtgctaactcatggctcacctgaagctactcctattacagacaatgtggaacagcttaaaagtcttgtgacctatgccaataaacgcattgaaatcatgattgggggaggcatcactgctgagaattgccaaagcttgagtcaactcactggaacggccattgttcacgggactaaaatcatt

SEQ ID NO: 2188 - protein, 209 aa, Streptococcus pyogenes
MIKEFCAENLTLLPTLDAGQISRVELCDNLAVGGTTPSYGVIKEACQLLHDKKISVATMIRPRGGDFVYNDLELKAMEEDILKAVEAGSDALVLGLLTTENQLDTDAIEQLLPATQGLPLVFHMAFDRIPTDHQHQALDQLIDYGFVRVLTHGSPEATPITDNVEQLKSLVTYANKRIEIMIGGGITAENCQSLSQLTGTAIVHGTKII

SEQ ID NO: 2189 - DNA, 351 bp, Streptococcus agalactiae
atgacaatttataatttttctgcaggtcctgcagtcttaccaaaaccagtgcttgtaaaagcccaatctgaactccttaattatcaagggtctagtatgagtgttttggaggtatcgcaccgctccaaagagtttgatgatattatcaaaggtgctgagcgttacttaagagatttgatgggaattccggataattataaagtaatctttttacaaggtggtgcatccttacagtttagtatgattcccttgaatattgccagagggcgtaaagcttactatcatgttgctggttcgtggggggaaaaaagcttatacagaggctgtaaaactatcaaaaacaattccttt

SEQ ID NO: 2190 - protein, 117 aa, Streptococcus agalactiae
MTIYNFSAGPAVLPKPVLVKAQSELLNYQGSSMSVLEVSHRSKEFDDIIKGAERYLRDLMGIPDNYKVIFLQGGASLQFSMIPLNIARGRKAYYHVAGSWGEKSLYRGCKTIKNNSF

SEQ ID NO: 2191 - DNA, 90 bp, Streptococcus agalactiae
atgaagctaatagaattggttcaaaaggaattgtttttgatagttttacagcctctgtataagcttttttccccccacgaaccagcaaca

SEQ ID NO: 2192 - protein, 30 aa, Streptococcus agalactiae
MKLIELVQKELFLIVLQPLYKLFSPHEPAT

SEQ ID NO: 2193 - DNA, 642 bp, Streptococcus agalactiae
gtgacaacaaataataccattgaaggaacatcgctttatgatattcctaaaactaatgaagtgcctgttattgcggatatgtcttctaatatattagctgtaaaatataaagtagaagattttgcaatgatttatgcaggagctcaaaaaaatattggacctgctggtgtaacggtagttattatccgtgaagatatgattaatgaggaaccaactttatcatcaatgttggattataagattcagtcagatgctggttctctttataatacgccgcctgcttacagtatttacattgctaaattagtctttgaatgggtgaaaagtctaggtggtgttgatgctatggaaaaagctaatcgtgaaaaatcaggacttctctatgattatattgattcctcagaattttatagtaatcctgtcagagataaaaagagtcgttctctatgtaacattcctttcataactattaataaagatttagatgaaaaatttgtaaaggaagcgacagaacgtggatttaaaaatattaaaggacatcgttcggtaggtggtatgagagctagcctttataatgcctttcctaaacaaggtgtcatcgaattaattgattttatgaaaacatttgaagcagaaaataca

SEQ ID NO: 2194 - protein, 214 aa, Streptococcus agalactiae
MTTNNTIEGTSLYDIPKTNEVPVIADMSSNILAVKYKVEDFAMIYAGAQKNIGPAGVTVVIIREDMINEEPTLSSMLDYKIQSDAGSLYNTPPAYSIYIAKLVFEWVKSLGGVDAMEKANREKSGLLYDYIDSSEFYSNPVRDKKSRSLCNIPFITINKDLDEKFVKEATERGFKNIKGHRSVGGMRASLYNAFPKQGVIELIDFMKTFEAENT

SEQ ID NO: 2195 - DNA, 558 bp, Streptococcus agalactiae
gtgggtaatataatgcaaatcagattagcttttccaaatgaaattgaccaaattatgcttcttattgaggaagcgcgtgccgaaattgctaaaacaggaagtgatcaatggcaaaaagaagatggataccctaatcgtaacgatattattgatgatatcttgaacggttatgcttgggttggtattgaagatgggatgctagcgacttatgcggctgtcattgatggtcatgaagaggtttatgatgctatttatgagggaaaatggctccatgataaccatcgctatcttacatttcatcgtattgcgatctcaaatcaatttcgtggtagaggactagcacagacattccttcaagggttaattgaaggtcataaaggacctgattttcgttgcgatactcatgaaaaaaatgtcactatgcagcatattctaaataaattaggctatcaatattgtggtaaagtacctctagatggggtacgattggcttatcagaagataaaagaaaagggagaaacgagcatctatcgtgagattgatgaaagaaatcccatg

SEQ ID NO: 2196 - protein, 186 aa, Streptococcus agalactiae
MGNIMQIRLAFPNEIDQIMLLIEEARAEIAKTGSDQWQKEDGYPNRNDIIDDILNGYAWVGIEDGMLATYAAVIDGHEEVYDAIYEGKWLHDNHRYLTFHRIAISNQFRGRGLAQTFLQGLIEGHKGPDFRCDTHEKNVTMQHILNKLGYQYCGKVPLDGVRLAYQKIKEKGETSIYREIDERNPM

SEQ ID NO: 2197 - DNA, 99 bp, Streptococcus agalactiae
gtgagattgatgaaagaaatcccatgtaagaaaaaaagaaaggggttattttggtcaatgatgactaaagagataaccttagtgaaaaagaatggtttt

SEQ ID NO: 2198 - protein, 33 aa, Streptococcus agalactiae
MRLMKEIPCKKKRKGLFWSMMTKEITLVKKNGF

SEQ ID NO: 2199 - DNA, 1179 bp, Streptococcus agalactiae
atggtttttagtgtcaaaacatttaataatattaatcaaattggtttacaagagttagggaatcgtttccagattgatggggatatgtcagaaaatcctgatgcctatattattcgtagtcaaaatttgcataatcaggatttcccaagtaacctcaaagctattgctagggcgggtgcaggaacaaataatattcctattgaagaggcaagtgcacagggaatagtcgtgtttaataccccaggtgcaaatgctaatgctgtaaaagaagcggtcattgctgccttattactttcagctcgtgattatttaggagctaaccgatgggttaatactctaactggaacagatattcccaaacaaattgaagcaggaaagaaagcttttgctggtaatgaaattgcaggaaaaaaattgggagttatcggccttggtgccattggagctagaattgcgaatgatgctagacgcttaggaatgacagttcttggttatgatccctatgtttcaattgaaacagcttggaatatttcaagccatgttcaaagggttaaagagattaaggatatttttgaaacttgtgactatatcacaattcatgttcccttaacaaatgaaactaagcatacttttgatgcgaaagctttttcaatcatgaaaaaaggaactacgattatcaactttgctcgtgcagaattagtcaataaccaagagctatttgaagcgatagaaactggtgttgtcaagcgctatattactgattttggagacaaagaattattaaaccaaaaaggaattacagtctttcctcatgtaggcggatcaacagatgaggcagagctaaattgtgctattatggcaagtcaaaccattcgttgttttatggagacaggagaaatcactaattcagttaatttccccaatgtacatcaaattcaaaccgcaccatttcgtattactttaattaacaagaatgttcctaacattgtggctaaaatttcaactgctgtatcagagttaggtataaatattgataacattattaaccgttcaaagggtgactacgcctacacactaatagatttagatgaaacggataataacaagatttctactttaattgaagaatttgaaggtgatgagaatatcgtccgtgtacgtttaattgcaaaacaacaa

SEQ ID NO: 2200 - protein, 393 aa, Streptococcus agalactiae
MVFSVKTFNNINQIGLQELGNRFQIDGDMSENPDAYIIRSQNLHNQDFPSNLKAIARAGAGTNNIPIEEASAQGIVVFNTPGANANAVKEAVIAALLLSARDYLGANRWVNTLTGTDIPKQIEAGKKAFAGNEIAGKKLGVIGLGAIGARIANDARRLGMTVLGYDPYVSIETAWNISSHVQRVKEIKDIFETCDYITIHVPLTNETKHTFDAKAFSIMKKGTTIINFARAELVNNQELFEAIETGVVKRYITDFGDKELLNQKGITVFPHVGGSTDEAELNCAIMASQTIRCFMETGEITNSVNFPNVHQIQTAPFRITLINKNVPNIVAKISTAVSELGINIDNIINRSKGDYAYTLIDLDETDNNKISTLIEEFEGDENIVRVRLIAKQQ

SEQ ID NO: 2201 - DNA, 474 bp, Streptococcus agalactiae
atgttatatcaagaattctatcagtcccctcttggagaaattcgccttctagcagacaatctaggtttatcagggctttattttgttgggcaaaaatatgatatgctagcagtcaaccaagaggaaattgttaatatgtcaaattcctatactttacttggtaagaagtggttagatgcttatttttcacagcaaaatttacctagtattccattatcattgagagggacagcatttcagacgagagtatggcaggaattacagaaaatcccttttggagataccaaaacttatggagaattagcgaaagagctaaattgtcaatctgcacaggctgttggaggagcaataggtaaaaattctatttctctaattataccttgtcaccgtgttttaggaagatatggtcaattaactggttatgctggtggcttagaaagaaaatcttggttattagaatacgaaaaggagaaa

SEQ ID NO: 2202 - protein, 158 aa, Streptococcus agalactiae
MLYQEFYQSPLGEIRLLADNLGLSGLYFVGQKYDMLAVNQEEIVNMSNSYTLLGKKWLDAYFSQQNLPSIPLSLRGTAFQTRVWQELQKIPFGDTKTYGELAKELNCQSAQAVGGAIGKNSISLIIPCHRVLGRYGQLTGYAGGLERKSWLLEYEKEK

SEQ ID NO: 2203 - DNA, 354 bp, Streptococcus agalactiae
atgtatacgttttatgaataccccaaatgtaccacttgtcgttcagcaaaaaaagagttaactgaactcggcttgacttttgaagcgattgatataaaaagcaatcctcccaaagtttcgttattaaaagaattgttagagaattcgccttatgaccttaaaaagtttttcaatacttcaggaaattcttacagagaattaggcttaaaagataaatttgatgatttaactcttgaccaagctttggacttattggcatcggatggaatgcttattaagcgtccattgctagttaaagataataaaattcttcagattggctaccgtactaagtataaagacctcaacttagta

SEQ ID NO: 2204 - protein, 118 aa, Streptococcus agalactiae
MYTFYEYPKCTTCRSAKKELTELGLTFEAIDIKSNPPKVSLLKELLENSPYDLKKFFNTSGNSYRELGLKDKFDDLTLDQALDLLASDGMLIKRPLLVKDNKILQIGYRTKYKDLNLV

SEQ ID NO: 2205 - DNA, 306 bp, Streptococcus pyogenes
atggctgaattaaagcaactggttagtgactttgaagccattgacatcaaagctaatccacccaaagctcaggacctcaaacattggatggaaacatctggttataccatcaaaaatttctttaataccagtggtaacagctaccgcgaattgggacttaaagataaaatagaccagcttagccttgataaagctgctgaacttttagccacagatggtatgttgattaaacggcctattttgattaaggacggtaacgtcttacaagttggctatcgcaagccatatcaagagttggatttagga

SEQ ID NO: 2206 - protein, 102 aa, Streptococcus pyogenes
MAELKQLVSDFEAIDIKANPPKAQDLKHWMETSGYTIKNFFNTSGNSYRELGLKDKIDQLSLDKAAELLATDGMLIKRPILIKDGNVLQVGYRKPYQELDLG

SEQ ID NO: 2207 - DNA, 825 bp, Streptococcus agalactiae
atgaaactcatttcatggaatattgattccctcaatgcggcattaacaagtgaatcaacacgtgctttaatgtcacgccaagttattgatactttagttgctgaagatgccgacatcattgcgattcaagaaactaaactgtctgccaaaggacctactaaaaaacatttggaagtacttgaaacttacttcccagaatatgatttggtttggcgatcatcagtcgaacctgctcgtaagggctatgctggtacaatgttcttatatcgtaaagggttaaatcctattgttagcttccctgaaatcgatgctcctactacaatggataatgaaggtcgcattattactctcgaattggaaaactgctatatcacacaggtctatactccaaatgcaggtgatggcctaaagcgcttagctgaccgtcaaatatgggatattaaatatgctgagtatttagcaacattggatagtcaaaaacctgttctagcaacaggtgactataacgtagcccacaaggaaatagacctagctaatcctagcagtaatcgtcgttctgctggattcacagctgaagagcgccaaggctttacaaatctactagccaaaggttttacagatacttttcgttaccttcatggcgatgttccaaatgtttatagctggtgggcacaacgaagtcgtacatccaaaatcaacaatacagggtggagaattgattattggctaacaagtaaccgtgtcgcagataaaattaccaagtcagaaatgattcattctggtgatcgtcaagatcatacaccaattattttggagattgaacta

SEQ ID NO: 2208 - protein, 275 aa, Streptococcus agalactiae
MKLISWNIDSLNAALTSESTRALMSRQVIDTLVAEDADIIAIQETKLSAKGPTKKHLEVLETYFPEYDLVWRSSVEPARKGYAGTMFLYRKGLNPIVSFPEIDAPTTMDNEGRIITLELENCYITQVYTPNAGDGLKRLADRQIWDIKYAEYLATLDSQKPVLATGDYNVAHKEIDLANPSSNRRSAGFTAEERQGFTNLLAKGFTDTFRYLHGDVPNVYSWWAQRSRTSKINNTGWRIDYWLTSNRVADKITKSEMIHSGDRQDHTPIILEIEL

SEQ ID NO: 2209 - DNA, 825 bp, Streptococcus pyogenes
atgaaactgatttcatggaacattgattccttaaatgctgctctcacaggagagtcccctcgtgcgcttttatcacgcgctgttttagacactttagtcgctcaagatgcggatattattgccatccaagaaactaaattatctgctaaggggcctaccaaaaaacatatcgagaccctacttagttactttccaaactatttgcatgtgtggcgttcttcagttgagcctgctaggaaaggctatgctggcaccatgttcctgtacaaaaacacgttaaaccctgtcattacttttccagaaattggtgccccaacaacaatggatgctgagggccgtatcattaccctagaatttgaagactttttcgtcacacaggtttacacgcctaatgctggtgatggccttagacgtttagatgaccgtcaaatttgggaccacaaatacgctgattatttgactgaactggatgctcaaaagcctgttttggctacgggagattacaacgttgcccataaagagattgatttggcaaatccaaacagcaatcgacgttctcctggttttaccgacgaagaacgtcaaggctttactaacctattagcaagaggctttacagatacttttcgtcacgtgcacggcgatattcctcatgtttatacctggtgggcacaacgtagcaaaaccagcaaaatcaataataccggttggagaattgactattggctagcttcaaaccgacttgtggataaggttaagcgttctgaaatgatttcttctggggaacgccaagaccatacgccaattttactagatattgatctc

SEQ ID NO: 2210 - protein, 275 aa, Streptococcus pyogenes
MKLISWNIDSLNAALTGESPRALLSRAVLDTLVAQDADIIAIQETKLSAKGPTKKHIETLLSYFPNYLHVWRSSVEPARKGYAGTMFLYKNTLNPVITFPEIGAPTTMDAEGRIITLEFEDFFVTQVYTPNAGDGLRRLDDRQIWDHKYADYLTELDAQKPVLATGDYNVAHKEIDLANPNSNRRSPGFTDEERQGFTNLLARGFTDTFRHVHGDIPHVYTWWAQRSKTSKINNTGWRIDYWLASNRLVDKVKRSEMISSGERQDHTPILLDIDL

SEQ ID NO: 2211 - DNA, 900 bp, Streptococcus agalactiae
ttgttggcttctttatttatcgtccgtttgtcaaaatcgctttcgctaaggaggagcaatatgaaaaaattacttagatggcttcctcctgtacttttcattattatccttataggaatgactatcttaggtaagtcctatatcaataaagtaacagctcacaaaataaaactctataactctcgaatgactcctactattttaattccaggatccagtgctactcaagaacgatttaacagcatgttagcacagctcaaccaaatgggagaaaaacatagcgttttaaagttaactgtcaaaaaagacaatagcattatctacaatggacaaattagcggcaatgaccacaaaccctacattgtcattggatttgaaaataatgaagatggttatagtaacatcaaaaaacaaacaaaatggctacagattgctatgaatgatcttcagaagaaatataaatttaaacgttttaacgctatcggtcattcaaatggtggcttatcatggactattttcctagaagattattacgactctgatgaatttgatatgaaatcattgttaacaatgggaacaccttttaactttgaagaaagtaacacctcaaatcatactcaaatgcttaaagatttaatcagtaataaaggaaatattccatcaagtctcatggtatacaatttggcaggaactaattcatatgatggtgataaaattgttccatttgctagtgtggagactggtaaatatattttccaagaaaccgctaaacactatacccaactaacagtaactggtaataatgctacacattctgacttgcctgataatcctgaagttatccaatatgtcgcagaaaaaattcttaaaaatgagaaaggtaaattaccaaaacctcac

SEQ ID NO: 2212 - protein, 300 aa, Streptococcus agalactiae
MLASLFIVRLSKSLSLRRSNMKKLLRWLPPVLFIIILIGMTILGKSYINKVTAHKIKLYNSRMTPTILIPGSSATQERFNSMLAQLNQMGEKHSVLKLTVKKDNSIIYNGQISGNDHKPYIVIGFENNEDGYSNIKKQTKWLQIAMNDLQKKYKFKRFNAIGHSNGGLSWTIFLEDYYDSDEFDMKSLLTMGTPFNFEESNTSNHTQMLKDLISNKGNIPSSLMVYNLAGTNSYDGDKIVPFASVETGKYIFQETAKHYTQLTVTGNNATHSDLPDNPEVIQYVAEKILKNEKGKLPKPH

SEQ ID NO: 2213 - DNA, 1215 bp, Streptococcus agalactiae
atgcacagcactatttataaatgtcatcattgccgttatctaatttataaaagttttaaagatatctttccttttgctctcattttttcttggattgaaatccttcaaaaactcgttatatcagatgattcttttttagctcaaacaacaaagtccagtatttataaaaacgagtggttatatacggtttccaatactctttatgatttatctcatttactaatctactttatggctagttattttgtggctagtttagtatggagagacttatctaaccaaactaaagaaagtttttctgcaagtttacttggctttgccactgtttggttgcttctaacttcagttgttccaggtacagattatcactatcctagccaacccatttggcttatgctggctttgatttcgtatctttttatctttttaactcgactgcttcaaaatcgacatcatattttccagtatagtatgttagctatactactattaatctcttctattttgtcacatatcttatatcgttatcctaatattgatttagaataccttatacaaaatcacttttctcaatggctgggtgatgggccacatcaattaattcctattatgctttggtctatcttagctatttttctaaccttatcaggtctttttgtaccagatattttatttcgtccttactcctatttttcagtagttagcgaaaatttaaatgctgccttgagccaacatacagataaaatcccttatctgtataccttttatactgttaaaaatagctttgctatgtttggcggtattggaatcctattatccttatttttagcagttttatatgaaagtagaaaactacaatcgaagaattactataaattgacattactgaccttaactcctcttatttttgatcaaaatttaccatttttagtaggtctacctgtcattttacaaccaatattattcattccgatggtattaacaactatctttgcagaggcttttggagctcttatgctctacctaaaatttgtcgaccctgcagtttatactgtcccaagtggtacacctagtctactatttggctttcttgcttcaaatggggattggcgttaccttccagtcactgcaattattctagttgttggcttctttatttatcgtccgtttgtcaaaatcgctttcgctaaggaggagcaatatgaaaaaattact

SEQ ID NO: 2214 - protein, 405 aa, Streptococcus agalactiae
MHSTIYKCHHCRYLIYKSFKDIFPFALIFSWIEILQKLVISDDSFLAQTTKSSIYKNEWLYTVSNTLYDLSHLLIYFMASYFVASLVWRDLSNQTKESFSASLLGFATVWLLLTSVVPGTDYHYPSQPIWLMLALISYLFIFLTRLLQNRHHIFQYSMLAILLLISSILSHILYRYPNIDLEYLIQNHFSQWLGDGPHQLIPIMLWSILAIFLTLSGLFVPDILFRPYSYFSVVSENLNAALSQHTDKIPYLYTFYTVKNSFAMFGGIGILLSLFLAVLYESRKLQSKNYYKLTLLTLTPLIFDQNLPFLVGLPVILQPILFIPMVLTTIFAEAFGALMLYLKFVDPAVYTVPSGTPSLLFGFLASNGDWRYLPVTAIILVVGFFIYRPFVKIAFAKEEQYEKIT

SEQ ID NO: 2215 - DNA, 1302 bp, Streptococcus pyogenes
atggcaaaaatgaatatgcaaaacatcatcaagccaatcatgacatttgtgaatatgcgcggcatcattgccttaaaagacggtatgttagccattttacctttgaccgttgtggggagtcttttcctgattgctgggcagattcctttccaaggggttaatgatgccattgctagtgtgtttggtgctgactggacagaaccctttatgcaggtttaccatggaacatttgctattatggggttgatttcctgttttgcaattggctattcttatgctaaaaactcaggtgttgaacctctcccttcaggggttctatccttgtcagccttctttattttattgagatcatcttatgttccagcagaaggtgaagctattggagatgctatcagtaaggtttggtttggtggtcaagggattattggtgctattgtgattggtttaacggtcggagctgtttacacaacatttatccgtcgtcatatcgtcattaaaatgccagatcaagtgccacaagccatcgccaaacagtttgaagccatgattccagcctttgtgatctttaccttgtcaatgcttgtgtatattattgccaagtcagtaacaggtggtggcacctttattgaaatgatttatgatgtcattcaggtaccgctgcaagggttaacgggttctctttatggcgcactaggtattgccttctttatttcctttctttggtggtttggcgtgcatgggcaatctgtggtcaatggaattgtcactgctcttctcttatcaaatctagatgccaataaggccttgatggcagcaggtgagttatccctagacaagggtgcccatattgtaacccaacaatttttagactctttcttgattctatcaggttctggcattacctttggtttagtggtagctatgatctttgcggctaaatccaaacaatacaaggctttaggcaaggttgcagccttcccagccctctttaatgttaatgaaccagtcgtctttggttttccaattgtgatgaatccagtcatgttcttgccatttatcttggttccggtcttggcagctctcacagtttatggcgccattgctattggtttcatgcagccctttgcaggagtgacccttccgtggtcaacaccagccattatctcagggttcatggttggtggctggcaaggagctattgtgcaaattcttatactcatcatgtcaacgttggtgtacttcccattctttaaaatccaagataatatggcttatcaaaatgaacaagctagtgaagagtca

SEQ ID NO: 2216 - protein, 434 aa, Streptococcus pyogenes
MAKMNMQNIIKPIMTFVNMRGIIALKDGMLAILPLTVVGSLFLIAGQIPFQGVNDAIASVFGADWTEPFMQVYHGTFAIMGLISCFAIGYSYAKNSGVEPLPSGVLSLSAFFILLRSSYVPAEGEAIGDAISKVWFGGQGIIGAIVIGLTVGAVYTTFIRRHIVIKMPDQVPQAIAKQFEAMIPAFVIFTLSMLVYIIAKSVTGGGTFIEMIYDVIQVPLQGLTGSLYGALGIAFFISFLWWFGVHGQSVVNGIVTALLLSNLDANKALMAAGELSLDKGAHIVTQQFLDSFLILSGSGITFGLVVAMIFAAKSKQYKALGKVAAFPALFNVNEPVVFGFPIVMNPVMFLPFILVPVLAALTVYGAIAIGFMQPFAGVTLPWSTPAIISGFMVGGWQGAIVQILILIMSTLVYFPFFKIQDNMAYQNEQASEES

SEQ ID NO: 2217 - DNA, 120 bp, Streptococcus agalactiae
ttgcttaataatttatttagaactgttaggctagctagtgctaatattaatactattttaaaccaatctattagaaaaaaagtgctgagcaagattgcccagtcttatttttgtttgcca

SEQ ID NO: 2218 - protein, 40 aa, Streptococcus agalactiae
MLNNLFRTVRLASANINTILNQSIRKKVLSKIAQSYFCLP

SEQ ID NO: 2219 - DNA, 720 bp, Streptococcus agalactiae
ttgtttgccataaagttagaggaaaatatgtctaaaaagtctcaccgtcaatatcaaatatatgaagggctcaggtgtgcggttgcactctgttttatttcaggttatatcaatgcttttacttatgtaacacaaggaaaacgttttgcaggtgtacaaacagggaatttgttatcttttgctattcatcttagtaataagcattatagtcaagcgcttgcttttttgctacctataatggttttcatgttaggtcaatcgtttacttatttcatgaatcgttgggcgaataaacatcaactgcactggtacctattatctagttttgcgttgacacaggttgctatagtaacaattatattgactcctttcttaccatcgtcgtttactgtggcaggactagccttctttgcttcaatacaagtagatacctttaaatcgctcagaggagcaccttatgctaatatgatgatgactggtaatatcaagaatgctgcttatttattaacaaagggactttacgaaaaaaattctgatattttcttaattgctagaaatacgattattattattggaggatttatctttggtgttgtttgctcgacttatttttcaagtaaactgggcgaatggagcttatcattaatattaattcctcttttatatgtcaacttgctgttaggccatgaattttataacctacaagtagaaaggcactcc

SEQ ID NO: 2220 - protein, 240 aa, Streptococcus agalactiae
MFAIKLEENMSKKSHRQYQIYEGLRCAVALCFISGYINAFTYVTQGKRFAGVQTGNLLSFAIHLSNKHYSQALAFLLPIMVFMLGQSFTYFMNRWANKHQLHWYLLSSFALTQVAIVTIILTPFLPSSFTVAGLAFFASIQVDTFKSLRGAPYANMMMTGNIKNAAYLLTKGLYEKNSDIFLIARNTIIIIGGFIFGVVCSTYFSSKLGEWSLSLILIPLLYVNLLLGHEFYNLQVERHS

SEQ ID NO: 2221 - DNA, 705 bp, Streptococcus pyogenes
atgtcaaaaaagaaacgaaaacactatcaggtttatgagggattacgctgtgctatgacgctttgttttatcagtggctatgtcaatgcctttacctatatgacccaaggaaaacgttttgcaggtgttcagacaggcaaccttttgtcatttgccattcgcttgtcagaacagcaactgaaggaggcactgcaatttttacttcccatgatcgtttttatgcttgggcagtcctttacttatttcatgcaccgctgggccactaaaaaagggctccactggtacttattatcaagtgttatcttaacagggattgcttttggaacggccctattcacgccttttcttccttccaatgttacggtagcagctttagccttttttgcctctattcaggttgatacgtttaaaaccttacgaggagctagctatgctaatgtgatgatgacaggaaatatcaaaaatgccgcctatttactaaccaaaggcttgtacgaaaaaaatcacgaactaacacatatcggacgcaacaccttaatagtcatcttggcttttgctgttggggtggtttgttcgacgttgctttgcatagcttatggcgagtatgctttgatgcctattttaatgcctttactctatgtcaattacctgttggctcaggaattttatcacattcaaaccaaaatcaaaccgattaaaagaact

SEQ ID NO: 2222 - protein, 235 aa, Streptococcus pyogenes
MSKKKRKHYQVYEGLRCAMTLCFISGYVNAFTYMTQGKRFAGVQTGNLLSFAIRLSEQQLKEALQFLLPMIVFMLGQSFTYFMHRWATKKGLHWYLLSSVILTGIAFGTALFTPFLPSNVTVAALAFFASIQVDTFKTLRGASYANVMMTGNIKNAAYLLTKGLYEKNHELTHIGRNTLIVILAFAVGVVCSTLLCIAYGEYALMPILMPLLYVNYLLAQEFYHIQTKIKPIKRT

SEQ ID NO: 2223 - DNA, 873 bp, Streptococcus agalactiae
atggttaatacaaaaacacttctcccctacaaaactatgccggtttggactgcacagtctattccaaaggcatttttagaaaagcataatactaaggaaggcacctgggcaaaactaaccattctaagtggttctttagtattttaccagttatctcctgatggagaggaaatctcgcggcatatttttgatgctagtagtgatattccttttgttgatccacaagtctggcataaagtttcgccgaatagtccagacttaagttgctatctaactttttactgccaaaaagaagattacttccataaaaaatatggtctcacgcgcacacattctgaggttatcgccagtgcacctctcttatctgagaagagtaatatattagaccttgggtgtggtcaagggcgaaactcactttatttatcgctgctgggacatcaagtgacttctgtcgattcaaacggacagagccttgtagctttagaaaatatggcattagaagaagagcttccttacaatataaaaaggtatgatattaatactgctgctattgaagggcactatgattttattttatcaactgtggtatttatgtttttaaatcccgactgcatttctgatattattttacaaatgcaatcacatactcagattggaggatacaatcttatcgtttctgctatggataccgctgaaaatccttgcccgcttccattcccttttaccttcaaagaaggacaattgaaatcttattacaatgactgggaaatcatcaaatataatgaaaatttaggtgaattgcacagggtggatgaaaacggtaatcgcttaaaattacagtttgcgactttattagctcgaaaattaagatca

SEQ ID NO: 2224 - protein, 291 aa, Streptococcus agalactiae
MVNTKTLLPYKTMPVWTAQSIPKAFLEKHNTKEGTWAKLTILSGSLVFYQLSPDGEEISRHIFDASSDIPFVDPQVWHKVSPNSPDLSCYLTFYCQKEDYFHKKYGLTRTHSEVIASAPLLSEKSNILDLGCGQGRNSLYLSLLGHQVTSVDSNGQSLVALENMALEEELPYNIKRYDINTAAIEGHYDFILSTVVFMFLNPDCISDIILQMQSHTQIGGYNLIVSAMDTAENPCPLPFPFTFKEGQLKSYYNDWEIIKYNENLGELHRVDENGNRLKLQFATLLARKLRS

SEQ ID NO: 2225 - DNA, 2046 bp, Streptococcus agalactiae
atgtatcatgataaaaaacacctctcattagggtggcttataggagaaatcatgacagaaaaaaaatcattttacattactaccccaatttattacccatcaggtaaattgcacatcggttctgcctatacaacgatagcatgtgatgttttggcacgttacaaacgcatgatgggctttgatgttcagtatttgactggtcttgatgagcatggtcagaaaattcaacaaaaggctgaagaagcaggcattacaccacaggaatatgttgatggcatggctgaaagtgtcaaaacattatgggaacttttagatatttcctatgacaaattcatccgtacaacagatacttaccatgaagaagcggttgctaaaatttttgaacaattgttggcacaaggggacatctatcttggtgagtataccggatggtattctgtttcagatgaagaattttttactgaaagccaattagcagaagtttatcgtgacgaaaacggtaatatgattggtggtgttgcgccatctggtcatgaagttgaaaaagtttctgaagaatcttatttcttccgcatgagcaaatatgcagatcgtttaaaagcgtactacgctgagcatccagaatttattcagccagatggtcgtatgaatgaaatgcttaaaaactttatagaaccaggtttagaagatttagcagtgtctcgtacaacttacacatggggagttcaggtaccatcaaatccaaaacatgttatttatgtctggattgatgctttgatgaactatatttctgctcttggttatggttggtctgacgatctcagtcaatatcataaattttggccagcagacattcatatgattggtaaagatattcttcgtttccactctatttattggcctatcatgttgatggcgctggatttgccattaccaaaacgtctagttgctcatggttggtttgtgatgcaagatggtaaaatgtctaaatcaaaagggaatgtcgtttatccagaaatgttagtagagcgttttggtcttgatccactccgttattatctcatgcgttcattgcctgttggttcagacggaacttttacgccagaagattatgttggacgtattaactatgaacttgctaatgatttaggaaaccttctcaaccgcactattgctatggttaacaagtatttcgatggagaagtaccaaggtttgctgttgcaactgactttgatgccgatttagcttctgttgcgacagatagtattgaaaactatcataaacaaatggaagcggtggatttcccacgtgcccttgaagctgtatggaatcttatttcacgaactaacaaatatattgatgaaacagcaccgtgggtacttgcaaaagacgaaacagatcgtgataagttagcagctgtaatgagtcatttagttgctagtctacgtgttgttgctcacctcattcaaccgttcatgatggaaacttccgatgccattatggaacaacttggtttaggggcaacattcgatcttgaaaaattgacttttgctgatctaccagaaggtgttcgagttgttgcaaaaggttcaccaattttcccaaggttggatatggaagacgaaattacttatatcaaagaacaaatgaatgctggaaaagcaccagtggaaaaggagtgggttcctgaagaagttgaattgacatcaagcaaaggtcaaatcaagtttgaggattttgacgctgttgaaatccgcgttgcagaagtaattgaagttgagaaagtggaaggttctgataaacttcttcgtttccgtctagatgctggtgatgagggccatcgtcaaatcttatcagggattgcaaaattttacccaaatgaacaagagttagtagggaaaaaactccaaattgttgctaacctcaaaccacgtaaaatgatgaaaaaatatgtcagtcaaggcatgattctctcagcagaacatgatggtaaattgacagtgttgacggtcgattcagcagtggcaaatggatcaattattggt

SEQ ID NO: 2226 - protein, 682 aa, Streptococcus agalactiae
MYHDKKHLSLGWLIGEIMTEKKSFYITTPIYYPSGKLHIGSAYTTIACDVLARYKRMMGFDVQYLTGLDEHGQKIQQKAEEAGITPQEYVDGMAESVKTLWELLDISYDKFIRTTDTYHEEAVAKIFEQLLAQGDIYLGEYTGWYSVSDEEFFTESQLAEVYRDENGNMIGGVAPSGHEVEKVSEESYFFRMSKYADRLKAYYAEHPEFIQPDGRMNEMLKNFIEPGLEDLAVSRTTYTWGVQVPSNPKHVIYVWIDALMNYISALGYGWSDDLSQYHKFWPADIHMIGKDILRFHSIYWPIMLMALDLPLPKRLVAHGWFVMQDGKMSKSKGNVVYPEMLVERFGLDPLRYYLMRSLPVGSDGTFTPEDYVGRINYELANDLGNLLNRTIAMVNKYFDGEVPRFAVATDFDADLASVATDSIENYHKQMEAVDFPRALEAVWNLISRTNKYIDETAPWVLAKDETDRDKLAAVMSHLVASLRVVAHLIQPFMMETSDAIMEQLGLGATFDLEKLTFADLPEGVRVVAKGSPIFPRLDMEDEITYIKEQMNAGKAPVEKEWVPEEVELTSSKGQIKFEDFDAVEIRVAEVIEVEKVEGSDKLLRFRLDAGDEGHRQILSGIAKFYPNEQELVGKKLQIVANLKPRKMMKKYVSQGMILSAEHDGKLTVLTVDSAVANGSIIG

SEQ ID NO: 2227 - DNA, 1998 bp, Streptococcus pyogenes
atgatgaaaaaaccattttacattacgacacccatttattacccatctgggaaattacacattggttctgcctatacaactattgcttgtgatgtcttggcacgctacaagcgcctgatgggccatgaggtcttttacctcacaggactagatgaacacggacaaaagattcaaaccaaggcaaaagaagctggtattacacctcaaacctacgttgataacatggcaaaggatgtcaaagccctttggcaattgctagatatttcctatgacacatttatccggacaacggacgattaccacgaagaggtcgttgctgctgtctttgaaaaattgctggcgcaagatgacatttaccttggcgaatactctggttggtattctgtctctgatgaggaatttttcactgaaagccaattaaaagaagtctttagagatgaagacggtcaggttattggagggattgccccatcaggtcatgaggtcgagtgggtctctgaagaatcctacttcctacgccttagcaaatacgatgatcgtcttgtggccttctttaaagagcgacctgactttatccaaccagatggtcgtatgaatgaaatggtgaaaaactttatcgagccaggcctagaagatttggctgttagccgtactacctttacatggggtgtacctgttccatcagacccaaaacacgtggtttatgtctggatcgatgccctcttaaactacgcgacagctcttggttatcgtcaagctaatcacgctaactttgataagttttggaatggaacggttttccacatggttggaaaagatatcttgcgttttcatagcatctactggccaattttactcatgatgcttgatttaccaatgccagaccgcttaattgcccatggttggtttgtcatgaaagacggtaaaatgtctaaatcaaaaggcaatgtggtctatccagaaatgttagttgagcgctttggacttgatcctcttcgttattacctcatgcgttctttgccagttggttcagacgggacctttacccctgaagattatgtgggtcgtatcaactatgagttagccaacgaccttggcaatttattgaaccgtaccgttgccatgatcaacaagtattttgacggcacggtgccagcttatgttgacaatggaactgcctttgatgctgacttaagtcaactgattgatgctcagctagcagactaccataagcacatggaagcggtggactacccacgcgccttggaggctgtttggaccatcatcgctcgtaccaacaaatacatcgatgaaaccgctccttgggtgctcgctaaagaagatggtgacaaagctcaactagccagtgtcatggcacacttagcagccagcttgcgtctggtcgctcatgtgatccaaccctttatgatggaaacatcagctgctatcatggcccagcttggtttggaacctgtttctgatttgtcaacacttgctctagcagattttcctgccaatacaaaggttgttgccaaagggacaccgattttcccacgtcttgacatggaagctgagattgactacatcaaagcccaaatgggtgacagctcagctatttcccaagaaaaagaatgggtccctgaagaggttgcgctcaaatctgaaaaagacgtcatcacatttgaaacctttgatgctgtggaaatccgtgtggcagaagtcaaggaagtgtcaaaagtggaaggttcagaaaaattgctgcgctttagagtagatgcaggagacgggcaagaccgtcaaatcttgtcaggtattgccaaattttaccccaacgaacaagaattagtgggtaaaaaactacaaattgttgctaacctgaaaccgcgtaaaatgatgaaaaaatacatcagtcaagggatgattctatcagcagagcatggagatcagctaacggtcttaaccgttgattcctctgttccaaatggaagtatcattggc

SEQ ID NO: 2228 - protein, 666 aa, Streptococcus pyogenes
MMKKPFYITTPIYYPSGKLHIGSAYTTIACDVLARYKRLMGHEVFYLTGLDEHGQKIQTKAKEAGITPQTYVDNMAKDVKALWQLLDISYDTFIRTTDDYHEEVVAAVFEKLLAQDDIYLGEYSGWYSVSDEEFFTESQLKEVFRDEDGQVIGGIAPSGHEVEWVSEESYFLRLSKYDDRLVAFFKERPDFIQPDGRMNEMVKNFIEPGLEDLAVSRTTFTWGVPVPSDPKHVVYVWIDALLNYATALGYRQANHANFDKFWNGTVFHMVGKDILRFHSIYWPILLMMLDLPMPDRLIAHGWFVMKDGKMSKSKGNVVYPEMLVERFGLDPLRYYLMRSLPVGSDGTFTPEDYVGRINYELANDLGNLLNRTVAMINKYFDGTVPAYVDNGTAFDADLSQLIDAQLADYHKHMEAVDYPRALEAVWTIIARTNKYIDETAPWVLAKEDGDKAQLASVMAHLAASLRLVAHVIQPFMMETSAAIMAQLGLEPVSDLSTLALADFPANTKVVAKGTPIFPRLDMEAEIDYIKAQMGDSSAISQEKEWVPEEVALKSEKDVITFETFDAVEIRVAEVKEVSKVEGSEKLLRFRVDAGDGQDRQILSGIAKFYPNEQELVGKKLQIVANLKPRKMMKKYISQGMILSAEHGDQLTVLTVDSSVPNGSIIG

SEQ ID NO: 2229 - DNA, 186 bp, Streptococcus agalactiae
gtgcctagtaggagggtaataatagctaatccaactcctgacaaacaaaatcctaaaatcgctggccagaaatcttgtccagatgctacacctaatgctggtggaaaaatgaggttccctgcaccaaagaagataccaaataagagtaatcccgttaaaaagcctttttttaccataagcaaccat

SEQ ID NO: 2230 - protein, 62 aa, Streptococcus agalactiae
MPSRRVIIANPTPDKQNPKIAGQKSCPDATPNAGGKMRFPAPKKIPNKSNPVKKPFFTISNH

SEQ ID NO: 2231 - DNA, 1131 bp, Streptococcus agalactiae
atgtcggaaaaatttagtccgtggttttctttaacatttttagttatactctacctaactattggtccactttttgctattcctagaacagcaacggtttcttttgaaattggggttgctccaattgtagggcatagtccgattgctcttttgtgttttacagcctgtttttttgctgcagcttattatctcgctattagaccaaatggtatattagatagtgttggaaaaatcttaacgcctgtttttgcctttttaattctctctttggttgttgttggagctattgcttatggaaacttggagagtgctaaggcgagtgctgactatgcaggaaaagcgtttggaagtggtgtcttagcaggctataatacacttgatgcacttgcagcagttgctttttgtctagtagcaacagaaacgcttaaaaagtttggttttaaaactaaaaaagaatatttatcaaccatttggattgttggaattgttactagtttagcatttagtattttatatattggcttaggttttttagggaataagtttcctgtcccagctgatattttagctgacccaaatgttaataaaggagcttatgtattatcacaagcatcttataaattatttggaaattttggtcgttatttcttgagtattatggtaacattgacatgctttacaacaacagttgggcttattgtgtcagtatctgaattttttgataagaactttcgttttgggaattataaattatttgctactgtttttactttgattggctttttaattgctaatcttggtttaaatgctgtaattactttttcagttcctgtgctaactttattgtatccgattgttattgttattgtcttaattattttgattaataagtggttgccgctttcaaaaaagggaatgtctttgacaattggtcttgtcactttagtgtcgtttgttgaggttctagcgggacaatggcaagaaaaaacattaactcagttagttggattcctcccctttcatactatttcaatggggtggctagttccaatgttgattggtatagtattttctttggtgctgtcagataaacaaaaaggccaagcatttgatttagagaaatttgaagga

SEQ ID NO: 2232 - protein, 377 aa, Streptococcus agalactiae
MSEKFSPWFSLTFLVILYLTIGPLFAIPRTATVSFEIGVAPIVGHSPIALLCFTACFFAAAYYLAIRPNGILDSVGKILTPVFAFLILSLVVVGAIAYGNLESAKASADYAGKAFGSGVLAGYNTLDALAAVAFCLVATETLKKFGFKTKKEYLSTIWIVGIVTSLAFSILYIGLGFLGNKFPVPADILADPNVNKGAYVLSQASYKLFGNFGRYFLSIMVTLTCFTTTVGLIVSVSEFFDKNFRFGNYKLFATVFTLIGFLIANLGLNAVITFSVPVLTLLYPIVIVIVLIILINKWLPLSKKGMSLTIGLVTLVSFVEVLAGQWQEKTLTQLVGFLPFHTISMGWLVPMLIGIVFSLVLSDKQKGQAFDLEKFEG

SEQ ID NO: 2233 - DNA, 1368 bp, Streptococcus pyogenes
atgaaacaaaaaaatgtatatatcgtcattggattcatgctatttgcgctattttttggagcagcaaacctcatttacccagcttttttaggcatctactcaggtcatcagattctatggtctatcattggtttttgtttaactggtgtctccttgcctttactcggtgtcattgctgttgctaaatctggatcaggcgatgttgaaagtttggcacgccccatctctaaatggtatgcaatcttctattcttccattttgtatttatctattggcccattttttgctattccaagaacaggagccacttctttttcagtcggtatcgctcctatcttaggagataatacaaccaataaagctatttatgctatactattttttggtctgtcctacttccttgctatcaaacctagtaaactagctgaaaatatcggaaaatttttaacgccaacgttgttagttgttatttctattttggttatcgcgtcctttgtccatcctgctggaaattacggtgatgcttttaacgctggggtcggtgttaataatgcctttaaagattttccttttatagcaggattaattcaaggttatggcactatggatgcactagcttctcttgtttttgctattttagtcattgaggctaccaaacaatttggcgctaagacggacaaagaaatgaccaaaataacacttatttctggggctattgccattttgctattagcacttgtctatatctttgtcggtcgtattggagcaacatcacaatcattatttccttttattgatggcagctttacccttcatggtaatccagttaatggcggtcaaatcttaagtcatgcttctcgtttttacctaggtggcatcggacaagcatttctagctgttgtgattttcctggcctgtctaaccacttcaacaggcttaatcacgtcaagtgctgaatacttccataaattagtgcctgctttatctcatattgcttgggcaactatctttactttactatcagctttcttttattttggtggcttatcagtcattatcaactggtcagctcctgttttattccttttatacccattaacagtcgatttaattttccttgttttggcacaaaaatgcttcaataatgatcctattgtctatcgaactacaattggtctaacctttattcctgccatatttgatgcactcctaacactatcacaaatgactggattatttcatttaccagaagccgttgtaacttttttccaaaaaactgttccactagggcaattctcaatgggatggattatctttgctgctattggttttttaatagggcttatactaagtaaaacgaagaaaagc

SEQ ID NO: 2234 - protein, 456 aa, Streptococcus pyogenes
MKQKNVYIVIGFMLFALFFGAANLIYPAFLGIYSGHQILWSIIGFCLTGVSLPLLGVIAVAKSGSGDVESLARPISKWYAIFYSSILYLSIGPFFAIPRTGATSFSVGIAPILGDNTTNKAIYAILFFGLSYFLAIKPSKLAENIGKFLTPTLLVVISILVIASFVHPAGNYGDAFNAGVGVNNAFKDFPFIAGLIQGYGTMDALASLVFAILVIEATKQFGAKTDKEMTKITLISGAIAILLLALVYIFVGRIGATSQSLFPFIDGSFTLHGNPVNGGQILSHASRFYLGGIGQAFLAVVIFLACLTTSTGLITSSAEYFHKLVPALSHIAWATIFTLLSAFFYFGGLSVIINWSAPVLFLLYPLTVDLIFLVLAQKCFNNDPIVYRTTIGLTFIPAIFDALLTLSQMTGLFHLPEAVVTFFQKTVPLGQFSMGWIIFAAIGFLIGLILSKTKKS

SEQ ID NO: 2235 - DNA, 696 bp, Streptococcus agalactiae
gtgatgaacgaagttcttagacaggaaaaaaaatatttaatatcacttgaagattactatcttttatctaagaaattttcccaagtaatgacgctcgattcgcatagttcagacgacggctatactatccgttcgctatactttgattctttagaagatgttgattggcaagaaaaggaagatggtgttgagatacgaagaaagattcgtttgcgcaattatggtagtcaaagcaattttgcgaaattagaaatgaaacaaaaacaaggtgctaatcaaaaaaagcgctctctaaaattaagcaagacagatgctcaagcgctgattaatggtaacaatagtgttttattaaattatccggatacatttgctgcggagtgttattcaaggataacaacgcaactttatcaacctaaaacggttattgagtaccaaagaaaagcttttgttgctaaggaaaacaatatccgaatcacctttgaccaccatataataggtacagaggctagttatgatattttctcagaggatttaaatcaaaattatttattagatccttatcttgttattttagaagttaaatataatggatttttattgtcttatattaaagaactcttagattcggtagatagaagtgaactttcagcgagtaagtattgtttaggaagagctgttagtaaacattatcgtttt

SEQ ID NO: 2236 - protein, 232 aa, Streptococcus agalactiae
MMNEVLRQEKKYLISLEDYYLLSKKFSQVMTLDSHSSDDGYTIRSLYFDSLEDVDWQEKEDGVEIRRKIRLRNYGSQSNFAKLEMKQKQGANQKKRSLKLSKTDAQALINGNNSVLLNYPDTFAAECYSRITTQLYQPKTVIEYQRKAFVAKENNIRITFDHHIIGTEASYDIFSEDLNQNYLLDPYLVILEVKYNGFLLSYIKELLDSVDRSELSASKYCLGRAVSKHYRF

SEQ ID NO: 2237 - DNA, 675 bp, Streptococcus agalactiae
atgaaagacctattacgaaatagtctagagcaaagtggaaatttaagttttcaagatatgattttacatattcttgtagcagctttattgagtgtagttatttatgtttcctatgcttatacgcatagtggaactgcctatagtaaaaagtttaatgtttcattaatgacattgacggtcttgactgcaacagtaatgaccgttattggtaataatgtagccttgtcattgggtatggtcggtgccttgtcagttgttcgttttaggacagccataaaagattcaagagatacagtttatattttttggaccatagttgttggtatctgttgtggtgtcggtgactatgtggtagctgcattaggaagtagcgttatctttatcttattatgggttatgggacgtgttaaaaacgagaatcgtatgttattgattgtgaagtgcgatagaacactagaagttgatttagaaggaattttcttccaatattttgacggaaaagctgttcagcgtgttaaaaattcaacaactaatactattgaaatgattttcgaaatctctagaaaagattacgataagcaactccatgtagataatcagttaactgaaaaagtgtaccaattgggaaatattgattatttcaacattgttagccaaagcgacgaaatcaatggg

SEQ ID NO: 2238 - protein, 225 aa, Streptococcus agalactiae
MKDLLRNSLEQSGNLSFQDMILHILVAALLSVVIYVSYAYTHSGTAYSKKFNVSLMTLTVLTATVMTVIGNNVALSLGMVGALSVVRFRTAIKDSRDTVYIFWTIVVGICCGVGDYVVAALGSSVIFILLWVMGRVKNENRMLLIVKCDRTLEVDLEGIFFQYFDGKAVQRVKNSTTNTIEMIFEISRKDYDKQLHVDNQLTEKVYQLGNIDYFNIVSQSDEING

SEQ ID NO: 2239 - DNA, 1482 bp, Streptococcus agalactiae
ttgattatttcaacattgttagccaaagcgacgaaatcaatgggtagacttatgagagggaaggttatttacggcacaacccttataggtctttttctattcttatttttctatttttggattcctaagcatcacatcgagagaatacatcatcatcgtataaagcaggtagatgcgaagagtgatttaacaggatttaaaacccatttgcccattatcagcattgatacaaagcaacaagttattcctcttgttacaaaagaaggcggaaaatatgtcaaagctagggataatattaatgttgatatcgaattacgggattctccaagtagatcacatcatttatcagaaaagccgagaattaggacaaaagggttaatatcatatagaggaaatacctctcgttactttgataagaagtcattgaaagttaagtttgttactaataagttaaaggaaaagaagcatcgattagcaggaatgcctaaagaatcggagtgggtattgcatggtccctttctagacagaacattattaagaaattatctgagttataatattgctggtgagattatgtcctatgccccaaacgttcgctactgtgagttatttgtcaatggtgagtatcagggagtatatctagcagttgagaatatcgaacaaggtgagcaacgagttcccattgaaaaaagtgataaaaagttgcataaaacaccttatatcgttgcttgggatcgtgaacataaggcaaagcaaaagttagataactatgtacattatacacaccagtctggtatctcagctcttgatgtgaaatatccaggtaaacaaagattgacatcaaaacaattagagtttattaataaggacatcaatcatattgaaaaagtcctttattcttatgatttttcacaatatcctaaatatattgatagagaatcatttgcaaattattttgtcatcaatgaattttttagaaatgtggatgcgggtaaattttcaacctatctatataaagatcttcgtgatagagcaaaactagtagtttgggattttaataatgcttttgataatcaaattgaaggacgtgttgatgaggcagattttaccttgacggatgcaccgtggttcaatatgctcattaaggacaaagcatttatagacctggttgttcatcgctataaagaattacgaaagggagttctagcgacagaatatttatctaattacatagacgagacaaggcattttttaggtccagctattgatcgaaattataaaaaatggggctatgtctttgatttaaagaatactgatccaaggaattatttgattcctactgaacgcaatgtgacaagttatcacaaatcagtagaacaattaaaagattttatcaaaaagcgtggcagatggatggatagaaatattgagaccttgtatcaatatagtgcaccatcgaaaaatactaatactttactggag

SEQ ID NO: 2240 - protein, 494 aa, Streptococcus agalactiae
MIISTLLAKATKSMGRLMRGKVIYGTTLIGLFLFLFFYFWIPKHHIERIHHHRIKQVDAKSDLTGFKTHLPIISIDTKQQVIPLVTKEGGKYVKARDNINVDIELRDSPSRSHHLSEKPRIRTKGLISYRGNTSRYFDKKSLKVKFVTNKLKEKKHRLAGMPKESEWVLHGPFLDRTLLRNYLSYNIAGEIMSYAPNVRYCELFVNGEYQGVYLAVENIEQGEQRVPIEKSDKKLHKTPYIVAWDREHKAKQKLDNYVHYTHQSGISALDVKYPGKQRLTSKQLEFINKDINHIEKVLYSYDFSQYPKYIDRESFANYFVINEFFRNVDAGKFSTYLYKDLRDRAKLVVWDFNNAFDNQIEGRVDEADFTLTDAPWFNMLIKDKAFIDLVVHRYKELRKGVLATEYLSNYIDETRHFLGPAIDRNYKKWGYVFDLKNTDPRNYLIPTERNVTSYHKSVEQLKDFIKKRGRWMDRNIETLYQYSAPSKNTNTLLE

SEQ ID NO: 2241 - DNA, 93 bp, Streptococcus agalactiae
gtggcgaaagatgtattccacgcccttgcattccaatcgtcttgccatgcattgatagtcgctccaaaactaccggatgatataaaagattca

SEQ ID NO: 2242 - protein, 31 aa, Streptococcus agalactiae
MAKDVFHALAFQSSCHALIVAPKLPDDIKDS

SEQ ID NO: 2243 - DNA, 2157 bp, Streptococcus agalactiae
atgaaaaaatatctaagtattgtagcccttttaactattttgtttagctctatttattatttgtattactttgatggtagtttgtatttaccaaagggcttattaaaagaaaatacaagaactaactttgttgttaaaggtgatactgtacttcacaagcccaccaataaaccttttgttgttaaaggagtagacgttgagtcttccttagcgggttatcatcacaacgattttcctattactcaaaaaacgtatcgtgaatggttccatttaatttccaacatgggggcaaatactgtaagagtcaaggtaccgatgaatgttgcattttacgatgccttatatcaccacaacaaagcatcaaagaggccactgtatttgttgcaaggaatacgtatagattcttatcgcaataatgcttctataacagcttttaatgataattatagggggtatttaaaacgagaagcaaaaggcgttgtggatattctccatgggcgtaagcaagtatggaatactgatttgggtagccgtcattatcattatgatcttagtccttgggtacttggttatgtcgtaggggatgattggaatagtggtactgtcgcttatactaatcatcaagagaaaaaaacgcaatataaaggacgttattttaaaacttctgtggcagctaatccatttgaggtcatgctagctcaagtaatggatgaattgacacattatgagacagctaaatatggttggcaacatttgattagtttttcaaactcaccaacaacagacccttttcattatcgaaaaccatttgaggcacaggctcctaaatacgtacaactaaatgtagaaaatattcaagctaattcaaatgttaaagcaggtatgtttgcagcatataaagctattgatttccatcctcgatacaaggattatctattatttgataaagagaatatcagtaaagaagatagacaaaagattaaagaactttctttgtcacagggatacgttaaactgctaaatgcttatcacaaaatccctgttctagtcacgggttatggctattcgacagcgagaggtattgcccaaaaagaaattgataaacgtcctctgccgattaatgaaaaagaacaaggtcagcgtttactagaagattatgaatcttttatatcatccggtagttttggagcgactatcaatgcatggcaagacgattggaatgcaagggcgtggaatacatctttcgccacaaataaacatagtcaattcctatggggggatgcacaagtatttaatcaaggttatggtttattaggctttaaaaacgcaaaacatcattatcaagttgatggtaaaagaggcaaaggagagtggaaacatcctctgatgactagtgcaacaggagatgacttatatgctagcagtgatgaaagctatctctaccttgcgattaaaacaaaacctgaaaaactaaaagaaaaacgattattaccaatagatattacaccaaaatctggtagtagaaaaatgaatggtagtaaggtcacattttctaaatctagtgactttgtattgtctattgatccaaatggcaagtctgaattatttgtccaagagcgctataatgccttaaaagcgaactatcttcgacagcttaacggtaaagatttttatgctttcccaccaaagaagaacagtagtaattttgagcagataaatatggtattgagaaatacaaagattgttgaagacatggaaaaagtaaaagcaacagagaggttcttaccaactcatcctactggtcttctcaaaacaggaacaactgataggcaccaaaaaacatttgattcacaaacagatatttcgtttggaaaggactttatagaggtcagaattccgtggcagttgttgaatttttctgatccatcatctcaaaaaattcacgatgattactttaaacattatggtgtgaaggagttagaaattgagagcattgctttaggattaggtgctaatagcaaagaaaacacactgataaagatggcagattatcgtttgaaaaattgggagagacccgataccaaaacctttttaaaagactcctattatagtattaagaaagaatggtctaaagaaagagagagaacatatggtaca

SEQ ID NO: 2244 - protein, 719 aa, Streptococcus agalactiae
MKKYLSIVALLTILFSSIYYLYYFDGSLYLPKGLLKENTRTNFVVKGDTVLHKPTNKPFVVKGVDVESSLAGYHHNDFPITQKTYREWFHLISNMGANTVRVKVPMNVAFYDALYHHNKASKRPLYLLQGIRIDSYRNNASITAFNDNYRGYLKREAKGVVDILHGRKQVWNTDLGSRHYHYDLSPWVLGYVVGDDWNSGTVAYTNHQEKKTQYKGRYFKTSVAANPFEVMLAQVMDELTHYETAKYGWQHLISFSNSPTTDPFHYRKPFEAQAPKYVQLNVENIQANSNVKAGMFAAYKAIDFHPRYKDYLLFDKENISKEDRQKIKELSLSQGYVKLLNAYHKIPVLVTGYGYSTARGIAQKEIDKRPLPINEKEQGQRLLEDYESFISSGSFGATINAWQDDWNARAWNTSFATNKHSQFLWGDAQVFNQGYGLLGFKNAKHHYQVDGKRGKGEWKHPLMTSATGDDLYASSDESYLYLAIKTKPEKLKEKRLLPIDITPKSGSRKMNGSKVTFSKSSDFVLSIDPNGKSELFVQERYNALKANYLRQLNGKDFYAFPPKKNSSNFEQINMVLRNTKIVEDMEKVKATERFLPTHPTGLLKTGTTDRHQKTFDSQTDISFGKDFIEVRIPWQLLNFSDPSSQKIHDDYFKHYGVKELEIESIALGLGANSKENTLIKMADYRLKNWERPDTKTFLKDSYYSIKKEWSKERERTYGT

SEQ ID NO: 2245 - DNA, 1266 bp, Streptococcus agalactiae
ttgtaccatattttgtttcgcaggaagtctattgtaccagcctataatgaatcaacaaccattgtgagttcgattgattcgttattgcaccttgattatgaagcgtatgaaattatcgttgtggatgacggttccagtgacaatacttcagatgttctcaaggaagagtttgcattaatgaaaatctcgaatacgattgattcaattattgctactcaaacttgtaaagatgtctttcagagacaggttggtaaggttaaactgacactcattgttaaagaaaatggtggcaaaggggatgccttaaatatggggatcaatgctgctaattacgattattttctatgtctagatgcagattctatgttgcaggtagattctttgagtcaaattagcaaatccatacaggtagatccgacggttatagcagtgggagggctcgtccaagttgcccaaggtgttaagattgagcaggggaaagtagcatcttatcgtttgccttggagaattattccttgtgcacaagcacttgagtatgattcatcatttttaggagctcgaatctttttagactatttaagagctaatttaattatttcgggggctttcggtctttttaagaaagaccttgttaaagcggtgggaggatatgacacccagactctaggagaagatatggagttggtgatgaaattacatttcttctgtcgtaataataatattccttatcgtatttgttatgaaacagatgctgtttgttggagtcaagcaccaacgaatttaggggatttacgtaaacagagacgccgatggtatcttggcttgtaccaatgtttaaaaaaatataaaagtatttttgccaattatcgctttggagctgtaggatcaatttcttatatttactatattttatttgaattactgaccccttttatagaatgttttggtattgtcattatatttttgtccttattatttaatcaattaaacatcccattctttatatcattggtgagcctttatatcttttactgtgttttaattacattaagctctttcttacaccgtatttattctcagcaactagtaataggaattttagatattgttaaagtattttatattgctgtttttaggtatcttatcctacatcctgtattaacttttgttaaggttgcaagtgttattggctataaaaataaaaaaatggtttgggggcatattacgagagagaaacaaatgaaggattttgaaacaagtgttact

SEQ ID NO: 2246 - protein, 422 aa, Streptococcus agalactiae
MYHILFRRKSIVPAYNESTTIVSSIDSLLHLDYEAYEIIVVDDGSSDNTSDVLKEEFALMKISNTIDSIIATQTCKDVFQRQVGKVKLTLIVKENGGKGDALNMGINAANYDYFLCLDADSMLQVDSLSQISKSIQVDPTVIAVGGLVQVAQGVKIEQGKVASYRLPWRIIPCAQALEYDSSFLGARIFLDYLRANLIISGAFGLFKKDLVKAVGGYDTQTLGEDMELVMKLHFFCRNNNIPYRICYETDAVCWSQAPTNLGDLRKQRRRWYLGLYQCLKKYKSIFANYRFGAVGSISYIYYILFELLTPFIECFGIVIIFLSLLFNQLNIPFFISLVSLYIFYCVLITLSSFLHRIYSQQLVIGILDIVKVFYIAVFRYLILHPVLTFVKVASVIGYKNKKMVWGHITREKQMKDFETSVT

SEQ ID NO: 2247 - DNA, 1335 bp, Streptococcus pyogenes
ttgacattaccccttatttatattagaatatcgaggtccctgtctttcaaggaaattaaaaaagaaagaggtgtaattgtgcctatttttaaaaaaactttaattgttttatcctttatttttttgatatctatcttgatttatctaaatatgtatctatttggaacatcaactgtaggaatttatggagtaatattaataacctatctagttattaaacttggattatctttcctttatgagccatttaaaggaaagccacatgactataaagttgctgctgtaattccttcttataatgaagatgccgagtcattattagaaactcttaaaagtgtgttagcacagacctatccgttatcagaaatttatattgttgatgatgggagttcaaacacagatgcaatacaattaattgaagagtatgtaaatagagaagtggatatttgtcgaaacgttatcgttcaccgttcccttgtcaataaaggaaaacgccatgctcaagcgtgggcatttgaaagatctgacgctgacgtttttttaaccgtagattcagatacttatatctatccaaatgccttagaagaactcctaaaaagcttcaatgatgagacagtttatgctgcaacaggacatttgaatgctagaaacagacaaactaatctattaacgcgacttacagatatccgttacgataatgcctttggggtggagcgtgctgctcaatcattaacaggtaatattttagtttgctcaggaccattgagtatttatcgacgtgaagtgattattcctaacttagagcgctataaaaatcaaacattcctaggtttacctgttagcattggggatgatcgatgtttaacaaattatgctattgatttaggacgcactgtctaccaatcaacagctagatgtgatactgatgtacctttccaattaaaaagttatttaaagcaacaaaatcgatggaataaatctttttttaaagaatctattatttctgttaaaaaaattctttctaatcccatcgttgccttatggactattttcgaagtcgttatgtttatgatgttgattgtcgcaattgggaatcttttgtttaatcaagctattcaattagaccttattaaactttttgcctttttatccatcatctttatcgttgctttatgtcgtaatgttcattatatgatcaaacatcctgctagttttttgttatctcctctgtatggaatattacacttgtttgtcttacagcccctaaaactttattctttatgcaccattaaaaatacggaatggggaacacgtaaaaaggtcactatttttaaa

SEQ ID NO: 2248 - protein, 445 aa, Streptococcus pyogenes
LTLPLIYIRISRSLSFKEIKKERGVIVPIFKKTLIVLSFIFLISILIYLNMYLFGTSTVGIYGVILITYLVIKLGLSFLYEPFKGKPHDYKVAAVIPSYNEDAESLLETLKSVLAQTYPLSEIYIVDDGSSNTDAIQLIEEYVNREVDICRNVIVHRSLVNKGKRHAQAWAFERSDADVFLTVDSDTYIYPNALEELLKSFNDETVYAATGHLNARNRQTNLLTRLTDIRYDNAFGVERAAQSLTGNILVCSGPLSIYRREVIIPNLERYKNQTFLGLPVSIGDDRCLTNYAIDLGRTVYQSTARCDTDVPFQLKSYLKQQNRWNKSFFKESIISVKKILSNPIVALWTIFEVVMFMMLIVAIGNLLFNQAIQLDLIKLFAFLSIIFIVALCRNVHYMIKHPASFLLSPLYGILHLFVLQPLKLYSLCTIKNTEWGTRKKVTIFK

SEQ ID NO: 2249 - DNA, 498 bp, Streptococcus agalactiae
atggcttgcataatcaggagagcaagattaggagatgaagtcaatttagcttatattcaaacggagagctggaaagctgcttttggtaagatactacctgaggatatcattcaaaaaactacggaaatagaacctgccataacaatgtatcaacagctactacacaaggaggttggtaaggggtatatattggaagtagatagcaatcctcattgtatggcttggtgggataaaagtagagaagatggtatgcttgattatgcagaactcatttgtatacatagtcttaaagaaggttggggaaaaggttatgggtctcaaatgatgaatcatgtactatcagagatacaacaagcaggttataataaagtgatactttgggtatttacagaaaatacacgcgcaaggaaattttacgataggtttggtttttcttttaagggtaaatcaaaaacttattttgaaaaggaagaaatgtgttatgagaagattttgcac

SEQ ID NO: 2250 - protein, 166 aa, Streptococcus agalactiae
MACIIRRARLGDEVNLAYIQTESWKAAFGKILPEDIIQKTTEIEPAITMYQQLLHKEVGKGYILEVDSNPHCMAWWDKSREDGMLDYAELICIHSLKEGWGKGYGSQMMNHVLSEIQQAGYNKVILWVFTENTRARKFYDRFGFSFKGKSKTYFEKEEMCYEKILH

SEQ ID NO: 2251 - DNA, 246 bp, Streptococcus agalactiae
atggagaaaattacgaatgattttgaaaaagttatagctgtgctaaatcaactaagtatttcttatgaattagtggaaaatggacctgttttgttgacggagcaagcagataactttattgtgggaattgaaggagtaagaacaaaaataatgttcttgaccaacaagaaaaagacgaaatattatttactaataatggatgaccagaaactattttatcctatgaaaacaatagtagcctttaga

SEQ ID NO: 2252 - protein, 82 aa, Streptococcus agalactiae
MEKITNDFEKVIAVLNQLSISYELVENGPVLLTEQADNFIVGIEGVRTKIMFLTNKKKTKYYLLIMDDQKLFYPMKTIVAFR

SEQ ID NO: 2253 - DNA, 273 bp, Streptococcus agalactiae
ttgatatatcaatggttaaagacaataaaggagaacaatatgacatttgaagaaattttaccaggtttaaaagcaaagaaaaaatatgtacgtacaggttgggggggcgctgaaaattatgttcagttatttgatacccttgaagttaatgggaaagtactacaggctacaccttattttcttattaatgttactggtgaaggtgaaggtttttccatgtgggcaccaacaccatgtgatgttttagcagaggattggatcgaggtcaatgac

SEQ ID NO: 2254 - protein, 91 aa, Streptococcus agalactiae
MIYQWLKTIKENNMTFEEILPGLKAKKKYVRTGWGGAENYVQLFDTLEVNGKVLQATPYFLINVTGEGEGFSMWAPTPCDVLAEDWIEVND

SEQ ID NO: 2255 - DNA, 264 bp, Streptococcus pyogenes
gtgtctatttcgtcaataaaggagaacaatatgacatttgaagagattttaccaggtttaaaagccaagaaaaaatatgtacgtacaggttggggtggcgctgaaaattatgtgcagttgtttgatacccttgaagtggatgggaaagtactacaggcgacgccttattttctgattcatgttactggtgcaggtgaaggtttttccatgtgggcaccgacaccatgtgatgtgttagcagaggattggattgaggtcaatgac

SEQ ID NO: 2256 - protein, 88 aa, Streptococcus pyogenes
VSISSIKENNMTFEEILPGLKAKKKYVRTGWGGAENYVQLFDTLEVDGKVLQATPYFLIHVTGAGEGFSMWAPTPCDVLAEDWIEVND

SEQ ID NO: 2257 - DNA, 696 bp, Streptococcus agalactiae
atgactaaagttgttttagtgacgggctgtgctagtggaattggttatgcacaggctcaatattttttgaaacaagggtatcaagtatatggtgtggataagtcggataaaccgaacttaaatggtaattttaactttataaagttggatttatcctctgatttatccccactattcacaatggtaccgactgttgatattttgtgtaatactgcaggtattctagatgcctacaagccacttctagaagtaagtgatgaagaactggaacacctatttgatattaattttttcgtgactgttaggctaacacgtcattatcttagacgtatggtggaaaagaagtcaggtattattatcaatatgtgctcaatagcaagttttatagcgggtggcggtggagctgcatatactagttctaaacatgcccttgcgggattcacacgtcaattggctttggattacgcaaaagattgtattcaaatttttggtatagcgccaggtgctgtacaaactgctatgactgctagtgattttgaacctggtggattagcagaatgggtagctagtgagacgccaattggtcgttggactaaaccaagtgaagttgctgaattaactggatttcttgcttcaggaaaagcgagatcaatgcaaggtgaaattgtcaaaattgatggtggctggagtttgaaa

SEQ ID NO: 2258 - protein, 232 aa, Streptococcus agalactiae
MTKVVLVTGCASGIGYAQAQYFLKQGYQVYGVDKSDKPNLNGNFNFIKLDLSSDLSPLFTMVPTVDILCNTAGILDAYKPLLEVSDEELEHLFDINFFVTVRLTRHYLRRMVEKKSGIIINMCSIASFIAGGGGAAYTSSKHALAGFTRQLALDYAKDCIQIFGIAPGAVQTAMTASDFEPGGLAEWVASETPIGRWTKPSEVAELTGFLASGKARSMQGEIVKIDGGWSLK

SEQ ID NO: 2259 - DNA, 705 bp, Streptococcus pyogenes
ttgaggtcaatgactaaagttgttttagtgacgggctgtgctagtgggattggttatgcacaggcccgctattttttgaaacaagggcatcacgtatatggtgtggataagtcggataaaccggacttaagcggtaactttcactttatcaaattggatttatcctctgagttagccccactatttaaagtggtccccagtgttgatattttgtgtaatactgcagggattttagatgcctacaagccacttttagacgtcagtgatgaagaagtggaacacctatttgatattaatttttttgcgacggtgaagttaacacgtcattatcttagacgtatggtggaaaagcagtcaggtgttatcatcaatatgtgctcaatagcaagttttatagcgggtggcggtggtgttgcctatacgagttctaagcatgcccttgcgggattcacgcgccagctggctttggattacgccaaagatcagattcacatttttggtatagcaccaggtgctgtcaaaaccgctatgacggctaacgattttgagcctggtggcttagcagactgggtagctcgtgagacgccaattgggcgttggactaaaccagatgaagttgctgaattaacgggatttcttgcttcaggaaaagcgagatcaatgcaaggcgagattgtcaaaattgacggtggctggactttgaaa

SEQ ID NO: 2260 - protein, 235 aa, Streptococcus pyogenes
LRSMTKVVLVTGCASGIGYAQARYFLKQGHHVYGVDKSDKPDLSGNFHFIKLDLSSELAPLFKVVPSVDILCNTAGILDAYKPLLDVSDEEVEHLFDINFFATVKLTRHYLRRMVEKQSGVIINMCSIASFIAGGGGVAYTSSKHALAGFTRQLALDYAKDQIHIFGIAPGAVKTAMTANDFEPGGLADWVARETPIGRWTKPDEVAELTGFLASGKARSMQGEIVKIDGGWTLK

SEQ ID NO: 2261 - DNA, 240 bp, Streptococcus agalactiae
atgaaggcacaagaattatggaataagtttaaatctttgaatccttcaatcggtgatgagatagacgcatggcaatttggagcagaaccagatcttctggcaaagttagttgtagatgggacaaaaactgcaacggcctctgcctatgatttatatgaattagatgaggaagggttacacaagttggttcatatgatattattttggatagcaatgatgaagctatctgtattattgaaa

SEQ ID NO: 2262 - protein, 80 aa, Streptococcus agalactiae
MKAQELWNKFKSLNPSIGDEIDAWQFGAEPDLLAKLVVDGTKTATASAYDLYELDEEGLHKLVHMILFWIAMMKLSVLLK

SEQ ID NO: 2263 - DNA, 246 bp, Streptococcus agalactiae
ttggatagcaatgatgaagctatctgtattattgaaataactaaagttgatattgtcccttttaaagatgtctctgcagaccatgcttttaaagaaggagaaggagataaaactttagaatggtggagaaaagctcacattgatttctttaaaccttattttgaggagtttggtttaatgtttagtgaggactctaggatagttttagaggaattccaagtggtttacccaaaggagattaacgaa

SEQ ID NO: 2264 - protein, 82 aa, Streptococcus agalactiae
MDSNDEAICIIEITKVDIVPFKDVSADHAFKEGEGDKTLEWWRKAHIDFFKPYFEEFGLMFSEDSRIVLEEFQVVYPKEINE

SEQ ID NO: 2265 - DNA, 954 bp, Streptococcus agalactiae
atgaaattagcggttttggggacaggtatgattgttaaggaagttttgcctgtcttgcagaaaattgaaggtattgatctagttgctatcttatcaacagttagaagtttggagacagctaaagatctagctaaggaatataacatgtctctagctacgagtgaatataaggctgtcttggacaatgaggagattgacacagtctatattggactgccgaatcacttgcattttgactatgctaaggaggcactcttggcaggaaaacatgtcatttgtgagaagccatttacattagaagcaagtcaattagaagaacttgtatctattgccaatactaggcaactaatattactcgaagcaattacaaatcaatatttacctaattttgaccttgtaaaagaacatttaagcaaccttggagatattaaaattgtagaatgtaattattcccaatattcatcgcgttatgatgcctttaaacgtggggaaatagcaccagctttcaatcctgaaatgggtggaggtgcgttgagagaccttaatatttataatttacatttagtaattggactttttggagaacctataacagcacagtatttaccaaatatagagcgtggtattgatacttcaggagttctagtcctagactatgggcactttaaaacagtctgtattggagcaaaagattgtagtgcagaagtaaaatctactattcaaggtgataaggggtctatagcgattttagggccaactaatactatgcctaaaatttcattaactatgaatggacaagaaagtcatgtttatcaattaaatggtgataggcaccgcatgcacgatgaatttgttatttttgaaggtattattagcaatttagattttaagcgtgctgctcaagctttagaacatagtagaacggtgatgaaagttctagatatggtaacgaaa

SEQ ID NO: 2266 - protein, 318 aa, Streptococcus agalactiae
MKLAVLGTGMIVKEVLPVLQKIEGIDLVAILSTVRSLETAKDLAKEYNMSLATSEYKAVLDNEEIDTVYIGLPNHLHFDYAKEALLAGKHVICEKPFTLEASQLEELVSIANTRQLILLEAITNQYLPNFDLVKEHLSNLGDIKIVECNYSQYSSRYDAFKRGEIAPAFNPEMGGGALRDLNIYNLHLVIGLFGEPITAQYLPNIERGIDTSGVLVLDYGHFKTVCIGAKDCSAEVKSTIQGDKGSIAILGPTNTMPKISLTMNGQESHVYQLNGDRHRMHDEFVIFEGIISNLDFKRAAQALEHSRTVMKVLDMVTK

SEQ ID NO: 2267 - DNA, 375 bp, Streptococcus agalactiae
atgatttcatcaattggacaggtaatgctctacgttagcaatgttgaagcatcagcagatttttggaaaaacaaggtgggttttgagcgtgttgaaaaacagacacaaggagattatgtaacctatatagttgcaccgaagttggatagtgaagttagcttcgtcttacatgacaaagcaattatagctcaaatgagtcctgagctagatttagcaactccctctattttatttgaaactactgatattgacagtacatatcaagaattaacagcaaatgaggttatgacaaatcctattgttgatatggggagtatgagagtttttaatttttccgataatgacaataattactttgcaatccgtgaagtaaaa

SEQ ID NO: 2268 - protein, 125 aa, Streptococcus agalactiae
MISSIGQVMLYVSNVEASADFWKNKVGFERVEKQTQGDYVTYIVAPKLDSEVSFVLHDKAIIAQMSPELDLATPSILFETTDIDSTYQELTANEVMTNPIVDMGSMRVFNFSDNDNNYFAIREVK

SEQ ID NO: 2269 - DNA, 411 bp, Streptococcus agalactiae
atggttaaagcactagaaacatacatcgtaacaaatggaaatgggcgacaagcggttgatttttataaagatgtctttcaagcggatttagtgaatatgatgacatgggaagagatggaccccaactgtcttgaagaccgcaaggatttaatcattaatgctcagcttatttttgatggcattcgtcttcaaatctcggatgaaaatccagatttcgtgtatcaagctggtaaaaatgttacagccgctattattgtgggtagcgtagaggaggcgcgtgaaatttatgaaaaattaaagaagagtgcacaagaagttcagttagagttacaagaaactttctggagtcctgcttacgcaaacttagtagaccaatttggtgtgatgtggcaaatttcaacagagttaaac

SEQ ID NO: 2270 - protein, 137 aa, Streptococcus agalactiae
MVKALETYIVTNGNGRQAVDFYKDVFQADLVNMMTWEEMDPNCLEDRKDLIINAQLIFDGIRLQISDENPDFVYQAGKNVTAAIIVGSVEEAREIYEKLKKSAQEVQLELQETFWSPAYANLVDQFGVMWQISTELN

SEQ ID NO: 2271 - DNA, 1377 bp, Streptococcus agalactiae
atgtcaaattatgccattattttagctgcgggtaagggaactcgcatgaaatctgatttaccaaaagttatgcataaagtatctggtattaccatgcttgagcatgttttccgtagtgtgcaagctattgagccaagtaaaattgttactgttattggacataaggcggagcttgtacgtgatgttttaggtgacaaatcagagtttgtaatgcaaacagaacagctaggaactggccatgctgtaatgatggcggaagaagaattagcgacatcaaaaggacatacactagttattgcaggtgatacacccctgattactggagaaagtttaaaaaacttaattgattttcatgtcaatcataaaaacgttgcaacaatcttaacagccgatgctgcaaatccatttggatatggtcgtattatccgtaattcagatgatgaagttactaaaattgtagaacaaaaggatgctaatgactttgagcagcaggttaaagagattaatactggaacttatgtttttgataatcaaagtctatttgaagcacttaaagacattaatacaaataacgctcaaggagagtattatctaactgatgttattggaattttcaaagaagcgggtaaaaaggtaggtgcctataaacttcgtgactttgacgaaagtctaggagttaatgatcgtgtagcacttgcaactgctgaaaaagtgatgcgtcaccgaattgcacgtcaacatatggttaatggggtcacagtggttaatcctgattccgcttatattgatattgatgttgagattggagaagaatctgtaattgagcctaatgtgactttaaaaggacagacgaagattggtaaaggtactttattaaccaatggtagttatttagtagatgctcaagtcggaaatgatgttaccatcactaattcgatggttgaagaatccattatttctgatggagtaaccgtaggcccttatgcgcatattagaccaggaacaagtcttgcaaaaggtgttcatattggtaatttcgttgaagtaaagggttctcaaataggtgagaatacgaaggcaggtcatttaacttatatcggcaatgcagaggtaggttgtgatgttaactttggcgcagggacgattactgtcaattatgatggacaaaataaatttaaaacagaaatcggaagtaatgtctttatcggaagtaattctactctgattgcaccacttgaaattggtgataatgctttaacagcagctggatctaccatcacagataatgttccaattgatagcatagctattggaagaggacgtcaagtcaataaagaaggatatgccaataaaaaaccacatcatccttcacaaaag

SEQ ID NO: 2272 - protein, 459 aa, Streptococcus agalactiae
MSNYAIILAAGKGTRMKSDLPKVMHKVSGITMLEHVFRSVQAIEPSKIVTVIGHKAELVRDVLGDKSEFVMQTEQLGTGHAVMMAEEELATSKGHTLVIAGDTPLITGESLKNLIDFHVNHKNVATILTADAANPFGYGRIIRNSDDEVTKIVEQKDANDFEQQVKEINTGTYVFDNQSLFEALKDINTNNAQGEYYLTDVIGIFKEAGKKVGAYKLRDFDESLGVNDRVALATAEKVMRHRIARQHMVNGVTVVNPDSAYIDIDVEIGEESVIEPNVTLKGQTKIGKGTLLTNGSYLVDAQVGNDVTITNSMVEESIISDGVTVGPYAHIRPGTSLAKGVHIGNFVEVKGSQIGENTKAGHLTYIGNAEVGCDVNFGAGTITVNYDGQNKFKTEIGSNVFIGSNSTLIAPLEIGDNALTAAGSTITDNVPIDSIAIGRGRQVNKEGYANKKPHHPSQK

SEQ ID NO: 2273 - DNA, 1380 bp, Streptococcus pyogenes
atgacaaattatgccattattttagcagcgggcaaagggactcgcatgacttctgatctcccaaaagttcttcataaagtatctggactaaccatgcttgagcatgtttttcgtagtgtaaaagcgattagtcctgaaaaatccgtgacggttattggtcacaaatcagaaatggtacgtgctgtcttagcagatcaatcagcctttgtccatcaaacagagcagttaggaactggccatgccgtgatgatggcagaaacacaactagaaggactagaagggcataccttggtgattgcaggagatactcccttgatcactggagaaagcctgaagagtctgattgattttcatgtgaatcataaaaatgtcgccactattttaacagctacggctcaagatccatttggttatggtcgtattgttcgcaacaaagatggcgaagtgatcaagattgttgagcaaaaagacgccaatgagtatgagcaacaattaaaagaaatcaatacaggaacctatgtgtttgataacaagcgtctctttgaagcgctcaaatgcatcactaccaacaatgctcaaggagagtattacctgactgacgttgtggctatttttagagcaaacaaagaaaaggtaggagcctatatcctgagagacttcaatgaaagtctgggagtaaatgatcgtgtggccttagcaatagctgaaacagtgatgcgtcagcgcattacccaaaaacatatggtcaatggggtgactttccaaaatcctgaaactgtttatattgaaagcgatgttgagattgctccagacgtccttatcgaaggaaatgtgaccttaaaagggcgtacacatatcggctcaggaactgtcttgacgaatggtacttatattgtggattctgaaattggtgataactgtgttgttaccaattcgatgatcgaatcatctgttttagctgcaggagttacggttggcccttacgcccaccttcgaccgggaacgaccttagatagggaagtccatatcggtaactttgtcgaggtcaagggttctcacattggtgaaaaaacaaaggctgggcatctgacttatattggaaacgctcaggttgggtcttcagtcaatgttggggctggaaccatcactgtcaactacgacggccaaaacaaatatgaaacagtcattggagatcacgcttttattgggagcaactcgactctcattgcacctttggaagttggggatcacgctttaacagcagcaggttcaacgatttcaaaaacagttcctatcgatagcattgctattggtcgtagccgccaagtcacaaaagaaggttatgccaagcgcctagcgcatcacccaagtcgaagcaaa

SEQ ID NO: 2274 - protein, 460 aa, Streptococcus pyogenes
MTNYAIILAAGKGTRMTSDLPKVLHKVSGLTMLEHVFRSVKAISPEKSVTVIGHKSEMVRAVLADQSAFVHQTEQLGTGHAVMMAETQLEGLEGHTLVIAGDTPLITGESLKSLIDFHVNHKNVATILTATAQDPFGYGRIVRNKDGEVIKIVEQKDANEYEQQLKEINTGTYVFDNKRLFEALKCITTNNAQGEYYLTDVVAIFRANKEKVGAYILRDFNESLGVNDRVALAIAETVMRQRITQKHMVNGVTFQNPETVYIESDVEIAPDVLIEGNVTLKGRTHIGSGTVLTNGTYIVDSEIGDNCVVTNSMIESSVLAAGVTVGPYAHLRPGTTLDREVHIGNFVEVKGSHIGEKTKAGHLTYIGNAQVGSSVNVGAGTITVNYDGQNKYETVIGDHAFIGSNSTLIAPLEVGDHALTAAGSTISKTVPIDSIAIGRSRQVTKEGYAKRLAHHPSRSK

SEQ ID NO: 2275 - DNA, 552 bp, Streptococcus agalactiae
atggattttgaagaaaaaacaattaatcgtcaaactgtttttgatggacaaattatcaaagtagctgttgatgatgtagagttgccaaatggattgggacaatccaaacgtgaacttgtttttcatggaggagctgttgctactttggcggtaactcctgagcataaaattgttttagtgaaacagtatcgtaaggctattgaaggtatttcttacgaaattccagcagggaaacttgagacgggtgagtcaggttctaaggaagaagctgcccttcgggaattagaagaagagactggctacacagggaatcttgaaattctttatagtttctacactgctattggtttttgtaatgagaaaatcgtcctctatctagctactgatttacaaaaagttgaaaatcctaggccacaagatgatgatgaggtccttgagcttctagagttaagttatgaggattgtatgcaaatggtagaaaaaggcatgattcaagatgcgaaaacgatcattgctttacaatattacggtttaaaaatgggaggtcattct

SEQ ID NO: 2276 - protein, 184 aa, Streptococcus agalactiae
MDFEEKTINRQTVFDGQIIKVAVDDVELPNGLGQSKRELVFHGGAVATLAVTPEHKIVLVKQYRKAIEGISYEIPAGKLETGESGSKEEAALRELEEETGYTGNLEILYSFYTAIGFCNEKIVLYLATDLQKVENPRPQDDDEVLELLELSYEDCMQMVEKGMIQDAKTIIALQYYGLKMGGHS

SEQ ID NO: 2277 - DNA, 552 bp, Streptococcus pyogenes
atgaaatttgaagaaaaaacgcttaagagacaaacagtttttgatggtcatatttttaaagttgttgtggatgatgttgaacttcccaacaatctggggcaatccaagcgagaattaatttttcatcgtggtgccgttgctgttttggctattactcctgaacgtaagattgtccttgtcaaacaataccgtaaggctattgaacgtgtctcatacgagatcccagcgggtaagctagagattggtgaggaaggctcaaagctaaaagctgctgcacgtgagctagaagaagaaacagcctatacggggacattgacgtttttgtatgaattttatacagcgattggtttttgcaacgaaaaaatcacacttttcttagcgacagacctaatacaagttgccaatcccaaacctcaagacgacgatgaagttatcgaggtcttagagttgacatatcaagagtgcatggacttagtcgctcaaggtaaacttgctgacgctaaaacgttgattgctttgcaatactatgccttacattttggaggtgagcag

SEQ ID NO: 2278 - protein, 184 aa, Streptococcus pyogenes
MKFEEKTLKRQTVFDGHIFKVVVDDVELPNNLGQSKRELIFHRGAVAVLAITPERKIVLVKQYRKAIERVSYEIPAGKLEIGEEGSKLKAAARELEEETAYTGTLTFLYEFYTAIGFCNEKITLFLATDLIQVANPKPQDDDEVIEVLELTYQECMDLVAQGKLADAKTLIALQYYALHFGGEQ

SEQ ID NO: 2279 - DNA, 267 bp, Streptococcus agalactiae
atgggaaaaccattgttaacagatgatatgattgaacgttcaaatcgaggtgaaaaagtttcaggtcaaacaatcttagatcaagaaactaaaattatttctacagaagatggcatggagcaactaactgacgagaacggtaaacatatctacaagagtcgccggattgagaatgcaaaacgaaatgaatttcaacgtaagttgaatttagttttattcattttgcttattttgttggctctcttgttttatgcaatttttaaatta

SEQ ID NO: 2280 - protein, 89 aa, Streptococcus agalactiae
MGKPLLTDDMIERSNRGEKVSGQTILDQETKIISTEDGMEQLTDENGKHIYKSRRIENAKRNEFQRKLNLVLFILLILLALLFYAIFKL

SEQ ID NO: 2281 - DNA, 252 bp, Streptococcus pyogenes
gtgatgggaaggccattgttgaccgatgatatcatcgaaaaagcgagacgaatggaaacatttgagccagatgatgctgtaaactttgacacaaaagtaatgacgctaccagaaaaagatgataaagcacgcatttataaaagtcgtcggattgaaaatgccaaacgcagccaattgcaatctaaattaaatgtgattttgatagctgttatgctgttaattgccatcttggtatatgctatcttttatctt

SEQ ID NO: 2282 - protein, 84 aa, Streptococcus pyogenes
VMGRPLLTDDIIEKARRMETFEPDDAVNFDTKVMTLPEKDDKARIYKSRRIENAKRSQLQSKLNVILIAVMLLIAILVYAIFYL

SEQ ID NO: 2283 - DNA, 687 bp, Streptococcus agalactiae
atgaaaattggaattattgcagccatggaggaagagttaaaactccttgtggaaaatcttgaggataaatctcaagagacagtattatcaaatgtatattacagtggacgttatggtgaacatgagcttgttttagtacagtctggtgttgggaaagtcatgtcagcgatgagtgttgctattttagtagaaagctttaaagttgatgctattattaatacaggatcagctggtgcagtagcaacaggattgaatgtaggagacgtcgttgtcgcagatacattagtttatcacgatgtagatttaaccgcctttggttatgactatggacaaatgtcaatgcagccactttattttcattcggataagacttttgtttccacttttgaagcagttttatctaaagaagaaatgattagtaaagttggtttaattgcaactggggatagttttattgctggccaggaaaagattgatgttattaaggggcattttccacaggttttagctgtcgagatggaaggtgcagcaattgcccaagctgctcaagctacaggaaagccctttgtggtggtacgtgctatgagtgatactgcagctcatgatgccaatatcacatttgatgaatttatcattgaagctggtaaacgctctgcccaagtattaatggcatttttgaaagcatta

SEQ ID NO: 2284 - protein, 229 aa, Streptococcus agalactiae
MKIGIIAAMEEELKLLVENLEDKSQETVLSNVYYSGRYGEHELVLVQSGVGKVMSAMSVAILVESFKVDAIINTGSAGAVATGLNVGDVVVADTLVYHDVDLTAFGYDYGQMSMQPLYFHSDKTFVSTFEAVLSKEEMISKVGLIATGDSFIAGQEKIDVIKGHFPQVLAVEMEGAAIAQAAQATGKPFVVVRAMSDTAAHDANITFDEFIIEAGKRSAQVLMAFLKAL

SEQ ID NO: 2285 - DNA, 693 bp, Streptococcus pyogenes
atgaaaataggaattattgctgctatggaggaggagttgtccctgctcttagcaaatcttttggatgctcaagaacatcaggtgctttcaaaaacttactatacgggtcgttttggcaagcatgagctcattttggtacagtcgggtgttggaaaagtgatgtctgctatgacagttgcgatcttggttgagcatttcaaagcccaagctattatcaatacaggatcagcaggggcagtcgcttcacatttagcgatcggagatgtggtggttgcagatcggttagtgtatcatgatgtggatgctactgcatttggttatgcttatggtcaaatggctggtcaaccattatactatgattgtgatccacagtttgtggctatcttcaaacaagtcctaaaacacgaaaagacaaatggccaagttggtttgattgcaacaggagacagttttgttgctggtcaggacaagattgaccagatcaaaacagcttttagcgacgtgttagcagtagaaatggaaggcgcagctattgctcaagcagcacatactgcagggaaacccttcatcgttgttcgtgcgatgagtgataccgcagcgcatgatgccaatattacttttgatcaatttattatagaagctggcaagcgttcggcccagacattaatgacatttttagaaaacttacctgtt

SEQ ID NO: 2286 - protein, 231 aa, Streptococcus pyogenes
MKIGIIAAMEEELSLLLANLLDAQEHQVLSKTYYTGRFGKHELILVQSGVGKVMSAMTVAILVEHFKAQAIINTGSAGAVASHLAIGDVVVADRLVYHDVDATAFGYAYGQMAGQPLYYDCDPQFVAIFKQVLKHEKTNGQVGLIATGDSFVAGQDKIDQIKTAFSDVLAVEMEGAAIAQAAHTAGKPFIVVRAMSDTAAHDANITFDQFIIEAGKRSAQTLMTFLENLPV

SEQ ID NO: 2287 - DNA, 534 bp, Streptococcus agalactiae
gtgtcagaaatgattaaaaaaatgataagtgaacaactgattgttaaagataaagatttaggatattatcttaccaaacaaggtttattagttgtttctgacctttaccgtaaacatcgtctagtagaggtatttttagttaaccatttgcactatactgctgatgatattcatgaagaagcggaagttttagaacatactgtatcaacaacttttgttgatcaattagaaaagttgttagactttccacaattttgtccacacggtgggactattcctaaaaagggagagtttttagtagaaattaaccaaatgacattggaccaaattagtcagcttggcacatatgttatcagtcgtgttcatgatgattttcagctactgaaatacctagaacaacaccgtttgcatatcaacgataccattgaattgacacaaattgacccttatgcaaaaacttatcacatcacctataacgatgaaaatctaacaatccctgagcgtatcgcaagtcaaatatatgtatctgctaca

SEQ ID NO: 2288 - protein, 178 aa, Streptococcus agalactiae
MSEMIKKMISEQLIVKDKDLGYYLTKQGLLVVSDLYRKHRLVEVFLVNHLHYTADDIHEEAEVLEHTVSTTFVDQLEKLLDFPQFCPHGGTIPKKGEFLVEINQMTLDQISQLGTYVISRVHDDFQLLKYLEQHRLHINDTIELTQIDPYAKTYHITYNDENLTIPERIASQIYVSAT

SEQ ID NO: 2289 - DNA, 336 bp, Streptococcus pyogenes
atgacgcctaataaagaagattacttgaaatgtatttatgaaattggagaacaagaacccaagattacaaataaaatggttgcagaaaagatgcacgtttcggcacctgccgtttcagagatgattaaaaaaatgatttcacaaggctggattgtcaaagataaagcaaaaggctatttgctaaaagacaaaggctatgctcttgttgctaacctctaccgcaaactccgcttgattgaggtatttttgattcatcagctgggctataatacccaagaagtgcaccaagaagctgaagtcttagagcacactgtctcagactcctttatcgaccgt

SEQ ID NO: 2290 - protein, 112 aa, Streptococcus pyogenes
MTPNKEDYLKCIYEIGEQEPKITNKMVAEKMHVSAPAVSEMIKKMISQGWIVKDKAKGYLLKDKGYALVANLYRKLRLIEVFLIHQLGYNTQEVHQEAEVLEHTVSDSFIDR

SEQ ID NO: 2291 - DNA, 495 bp, Streptococcus agalactiae
atgaaccttccggttaaattttttgataaatatgtaccagagttagataaaaataatgtacgtgtacaggtcatcggagatactcataaattacctaaggcaacatacgatgcaatgcaacgcgcttgtttgaggacaaaacataattcggggctcgtcttgaattttgcgctaaattatggcggacgttcagaaatcactaatgccattaaggaaattgctcaggatgttttggaagctaagttgaatcctgacgatattacagaggatttagtagcaaatcatttaatgacaaatagcttaccctatctttatagagaccctgatttgattatccgaactagtggagagttacgcttgagtaactttttaccttggcaatcagcttatagtgaattttactttactcccgttttatggccagattttaaaaaagacgaactacataaggccattgtggattataatcaacgccatcgtcgatttggtagtgta

SEQ ID NO: 2292 - protein, 165 aa, Streptococcus agalactiae
MNLPVKFFDKYVPELDKNNVRVQVIGDTHKLPKATYDAMQRACLRTKHNSGLVLNFALNYGGRSEITNAIKEIAQDVLEAKLNPDDITEDLVANHLMTNSLPYLYRDPDLIIRTSGELRLSNFLPWQSAYSEFYFTPVLWPDFKKDELHKAIVDYNQRHRRFGSV

SEQ ID NO: 2293 - DNA, 747 bp, Streptococcus pyogenes
atgtttggattaaaagcgaaatcaacaaaaaaagttttggggagtatcccaaagcatattggaattatcatggatggtaatggacgttgggccaaaaaaagactaaaacctagagtgtttgggcataaagctgggatggatgctttacaagaagtaacgattactgcatctgagttgggggttaaagttctgacagtctatgccttttcgacagaaaactggtccagaccccaagatgaggtgtcttttatcatgaatttaccagtaaccttctttgacaaatatgtgcctgtgcttcatgagaacaatgtaaagattcaaatgattggagagactagtcgtttacctgaagataccttggcagcgctaaatgcagccatcgacaaaacaaaacgtaatacgggtttaattttgaattttgctctcaattatggaggacgtgctgagattaccagtgctgttcgctttattgctcaagatgtcttagatgccaaattaaatccaggagatattacggaggatttgattgctaattacttgatgacagaccatctgccatatctctaccgagaccccgatttgattattcgcaccagtggtgagctgcgtttgagcaatttcttgccttggcaatcagcttacagtgaattttatttcacaccagtcttgtggcctgattttaaaaaggcagagctactaaaggccattgcggattataaccgccgccaacgtcgttttggcaaggtc

SEQ ID NO: 2294 - protein, 249 aa, Streptococcus pyogenes
MFGLKAKSTKKVLGSIPKHIGIIMDGNGRWAKKRLKPRVFGHKAGMDALQEVTITASELGVKVLTVYAFSTENWSRPQDEVSFIMNLPVTFFDKYVPVLHENNVKIQMIGETSRLPEDTLAALNAAIDKTKRNTGLILNFALNYGGRAEITSAVRFIAQDVLDAKLNPGDITEDLIANYLMTDHLPYLYRDPDLIIRTSGELRLSNFLPWQSAYSEFYFTPVLWPDFKKAELLKAIADYNRRQRRFGKV

SEQ ID NO: 2295 - DNA, 792 bp, Streptococcus agalactiae
atgaaagaacgtgttatttggggagctgtcgcgcttgccatatttatcccttttttagtaatgggtggtttgcctttccaatttttagttggacttttagctatgattggtgtttctgaattacttcgtatgcgtcgtttagaaatattttcctttgaaggtgcattagctatgataggagcctttgttttaacagttcctttagatagttatttgtcctttttaccagttgacgctagtttatcagcatacggtattgttatttttatgattttggcaggtactgttttgaacagtaattcttacagttttgaagatgctgcctttccaattgcgtctagtttttatgtgggtattggctttcaaaatctagtcagtgctcgtatggctggaatagataaggtgttgttagctttatttattgtctgggcgactgatatcggtgcttatatgattggtcgtcaatttggacaacgcaaactactaccctcagtgtctccaaataaaacaattgaagggagtctaggagggattgcttcagccattgtggtagctttcttttttatgctttttgataagaccgtctatgcgcctcatagcttcctagtcatgttagttttagtggctatctttagcatttttggtcaatttggagatttagttgaaagtagtattaaacgtcattttggtgttaaagattcgggtaaattgattccgggtcatggggggattttggatcgctttgatagtatgatttttgttttcccaatcatgcacttctttggcttattc

SEQ ID NO: 2296 - protein, 264 aa, Streptococcus agalactiae
MKERVIWGAVALAIFIPFLVMGGLPFQFLVGLLAMIGVSELLRMRRLEIFSFEGALAMIGAFVLTVPLDSYLSFLPVDASLSAYGIVIFMILAGTVLNSNSYSFEDAAFPIASSFYVGIGFQNLVSARMAGIDKVLLALFIVWATDIGAYMIGRQFGQRKLLPSVSPNKTIEGSLGGIASAIVVAFFFMLFDKTVYAPHSFLVMLVLVAIFSIFGQFGDLVESSIKRHFGVKDSGKLIPGHGGILDRFDSMIFVFPIMHFFGLF

SEQ ID NO: 2297 - DNA, 792 bp, Streptococcus pyogenes
atgaaagaacgtgttgtttgggggggagtagcagtagctattttcctaccttttctcataataggaaacctaccattccaattatttgtaggcgttttggccatgattggggtatcagaattactgaaaatgaaaagattagaagtcttttcttttgaaggtgtttttgccatgttagccgcctttgtattggcagttccgatggaccattacctcacttttttaccaattgatgcgaatgttgctttttacagcttaatggtttttttcattttggcaggtactgttttaaatagcagagcttattcatttgatgatgcggcctttccgattgcaactagtttttatgttgggattggttttcaacatttgatcaatgctcgcctgtcaggaattgacaaggtctttttggccttatttatcgtttgggccactgatattggagcatatctgattgggcgtcagtttggtagacgcaaactattgcctacagtttctccaaacaaaaccattgaaggtagtttaggagggatcgcttgtgcagtccttgtgtcttttatctttatggtgattgataggtctgtttatgcgccacatcactttttgaccatgttggttttggtcgctcttttttccatttttgcccaatttggtgatttggttgaaagtgctctcaaacgtcactttggtgtcaaagattcaggtaagcttatcccgggacatggtggtattttagaccgctttgattccatgatttttgtttttcccatcatgcatctctttggtttattt

SEQ ID NO: 2298 - protein, 264 aa, Streptococcus pyogenes
MKERVVWGGVAVAIFLPFLIIGNLPFQLFVGVLAMIGVSELLKMKRLEVFSFEGVFAMLAAFVLAVPMDHYLTFLPIDANVAFYSLMVFFILAGTVLNSRAYSFDDAAFPIATSFYVGIGFQHLINARLSGIDKVFLALFIVWATDIGAYLIGRQFGRRKLLPTVSPNKTIEGSLGGIACAVLVSFIFMVIDRSVYAPHHFLTMLVLVALFSIFAQFGDLVESALKRHFGVKDSGKLIPGHGGILDRFDSMIFVFPIMHLFGLF

SEQ ID NO: 2299 - DNA, 1257 bp, Streptococcus agalactiae
atgctaggaattttaacctttattattatttttggtgtcattgtagttgttcacgaatttgggcatttctattttgcaaagaaatcaggaattcttgttcgtgaatttgctattggtatgggtccaaaaatcttttctcacattgataaagaaggaacaacctatactattcgtatattaccgctaggtggttatgtccgtatggctggttggggtgatgataagactgaaattaagacagggacgccggctagccttactttaaataaagaaggcattgtaactcgtattaatttatcaggaaaacaattagacaatacttctttaccaatcaatgtaacagcttatgatttagaagataaactaactatcacaggattggtcttaagtgagacaaaaacctatagtgttgatcacgatgctactatcattgaggaggatggtactgaaattcgtattgctcccttagatatgcagtatcagaatgcttctgtatgggggcgcttaattaccaattttgcaggtccgatgaataattttattttaggtcttgtagtctttattgcacttgcttttattcaaggaggtgttcaagacttatcaaccaatcaggtccgtgtatcagaaaatggtcctgccgctagtgcaggtttaaaaaataatgatcgtattttacaaatagggtcgcacaaagtttctaactgggaacagttgacagcagcagtagaaaagtcaactaggcatttagaaaaaaaacaaaaacttgcccttaagattaagagcaaagaggtggtgaaaacgatcaacgttaagccacagaaagttgataaatcctacatcatcggcattatgccagctttaaagacaagctttaaagacaaacttttaggtggattaaaactagcatgggaaagtttctttagaattttaaatgaattaaagaaacttattgctcattttagtattaataaattgggaggtccagtagctctctatcaggctagtagccaagctgctaaaaatggtttcgtcacagttctcaacttaatgggattaatctctatcaacttaggtattatgaatctcatccctataccagcccttgacgggggtaagatagtgatgaatattttagaagccattcgtcgcaaaccacttaaacaagaaacagaaacttatattacgctcgctggggtagcagttatgttagtattaatgattgctgtgacctggaacgatatcatgcgagctttcttc

SEQ ID NO: 2300 - protein, 419 aa, Streptococcus agalactiae
MLGILTFIIIFGVIVVVHEFGHFYFAKKSGILVREFAIGMGPKIFSHIDKEGTTYTIRILPLGGYVRMAGWGDDKTEIKTGTPASLTLNKEGIVTRINLSGKQLDNTSLPINVTAYDLEDKLTITGLVLSETKTYSVDHDATIIEEDGTEIRIAPLDMQYQNASVWGRLITNFAGPMNNFILGLVVFIALAFIQGGVQDLSTNQVRVSENGPAASAGLKNNDRILQIGSHKVSNWEQLTAAVEKSTRHLEKKQKLALKIKSKEVVKTINVKPQKVDKSYIIGIMPALKTSFKDKLLGGLKLAWESFFRILNELKKLIAHFSINKLGGPVALYQASSQAAKNGFVTVLNLMGLISINLGIMNLIPIPALDGGKIVMNILEAIRRKPLKQETETYITLAGVAVMLVLMIAVTWNDIMRAFF

SEQ ID NO: 2301 - DNA, 1257 bp, Streptococcus pyogenes
atgttaggaataataacctttattattatttttggtattttagtgattgtccatgaatttggacatttctattttgctaaaaaatcaggcattctagtaagagaatttgccattggaatgggccctaaaattttttctcatgttgaccaaggaggaactctttataccttgaggatgttacccttgggcggttatgtgcgaatggctggttggggtgatgacaaaactgagatcaaaacaggtactccagcaagtttaacccttaatgagcaaggttttgttaagcgcatcaacttgtctcaaagtaagttagacccaacgagtctcccaatgcatgttacaggctatgacttagaagatcagctgagtattactggcttagttttagaagaaaccaagacatataaggtcgctcacgatgctactattgttgaagaagacggtactgagataagaattgctccgcttgatgttcaatatcaaaatgctagtattggcggacgtttaatcaccaattttgcaggtcccatgaataattttattttagggattgtggtttttatcctcttggtctttttacaaggtgggatgccagattttagtagcaatcatgtccgtgttcaagaaaatggagcagcagctaaggctggtcttcgagataatgaccaaattgtcgcaattaatggttacaaggtgactagctggaatgatctcactgaggctgtagaccttgcaacacgggatctaggcccgtcacagaccattaaggtcacctacaagtcacatcagcgcttaaaaacggtggctgtgaaaccacaaaagcatgcaaagacatacacgataggagttaaggcgagtctgaaaacaggatttaaggataagctcttaggcggtctagaattagcttggagtagggcgtttactattttgaatgctttgaaaggattgatcactggctttagtctcaataaattaggtggacctgttgccatgtatgacatgtccaatcaggctgctcaaaacggcttagagtcagtcttatctcttatggcaatgctttcgatcaatttagggatctttaacctgattccgattcctgcacttgatgggggaaaaatcttgatgaatatcattgaagccattcgtcgcaagcctatcaagcaagaaacagaggcctatatcaccctagctggggttgctatcatggtcgtattgatgattgctgtgacatggaatgatatcatgcgcgtctttttc

SEQ ID NO: 2302 - protein, 419 aa, Streptococcus pyogenes
MLGIITFIIIFGILVIVHEFGHFYFAKKSGILVREFAIGMGPKIFSHVDQGGTLYTLRMLPLGGYVRMAGWGDDKTEIKTGTPASLTLNEQGFVKRINLSQSKLDPTSLPMHVTGYDLEDQLSITGLVLEETKTYKVAHDATIVEEDGTEIRIAPLDVQYQNASIGGRLITNFAGPMNNFILGIVVFILLVFLQGGMPDFSSNHVRVQENGAAAKAGLRDNDQIVAINGYKVTSWNDLTEAVDLATRDLGPSQTIKVTYKSHQRLKTVAVKPQKHAKTYTIGVKASLKTGFKDKLLGGLELAWSRAFTILNALKGLITGFSLNKLGGPVAMYDMSNQAAQNGLESVLSLMAMLSINLGIFNLIPIPALDGGKILMNIIEAIRRKPIKQETEAYITLAGVAIMVVLMIAVTWNDIMRVFF

SEQ ID NO: 2303 - DNA, 1851 bp, Streptococcus agalactiae
atgaaacaaagtaaaatgcttattccaacacttcgcgaaatgccaagtgatgctcaggttatcagccatgctcttatggttcgtgcaggatatgtccgccaagtttcggctggaatctatgcttatttgcctctagctaaccgtactattgaaaaatttaaaacaattatgcgtcaagaatttgagaagattggtgcagttgaaatgttagctccagctcttcttacagcagatttatggcgtgaatctgggcgctacgaaacatatggtgaagacctttataaattaaagaatcgtgatcaatcggattttatcttaggaccaactcatgaagagactttcacaactcttgttcgtgatgcagtaaaatcttataagcaattaccactaaacctttatcaaattcagtctaaatatcgtgatgagaagcgtcctcgtaatggacttcttcgaacacgtgaatttatcatgaaagatggatacagcttccacaaagattatgaagaccttgatgtcacttacgaagattaccgtaaagcatatgaagccatcttcacacgtgctggacttgactttaaaggcattataggtgacggaggtgctatgggaggtaaagatagccaagaatttatggcagtaactcccaatcgtacagatttaaatcgttggttagtccttgataaaactattccttctattgatgatattccagaggatgttttagaagaaattaaggtagaactctcggcttggctagtttctggtgaggacactattgcatactctactgaatcaagctatgctgctaaccttgagatggcaacgaatgagtacaaaccatctactaaggctgctacctttgaagaagtaacaaaagtagaaactcctaactgcaaatcaattgatgaggtagctggatttttatcaattgatgaaaatcaaactatcaagacactattgtttattgctgatgaacagcccgtggttgctttactagttggtaacgatcaagtcaatgatgtgaagttaaaaaattatttagcggctgatttcttagagcctgcaagtgaagagcaagcaaaagagatttttggtgcaggttttggttctcttgggccagttaacctacctgactctgttaaaattattgctgatcgtaaagttcaagaccttgctaatgctgtgtctggtgctaaccaagatggttatcattttactggagttaatccagaacgtgatttcacagctgaatacgttgatattcgtgaagtaaaagaaggggagatttctccagacggtaaaggtactctgaaatttgctcgtggtattgaaattggacatatctttaaactaggtacccgttattcagatagtatgggagcgaacatccttgatgaaaatggccgctcaaatcctattgttatggggtgttatggtattggtgttagtcgtattctctcagctgtcattgaacaacatgcccgactttttgtgaataagacaccaaaaggagcttatcgctttgcttgggggattaatttcccagaagaattagccccatttgatgtacatttgattactgtcaatgtcaaagatcaagagtcacaagaccttactgagaaaattgaagctgatttgatgcttaaaggttatgaagtcctgacagacgatcgtaatgaacgtgttggttctaaattctcagacagtgacttaattggacttccaattcgagtaactgttgggaagaaagcttctgaaggtatcgttgaagtgaaaattaaagcaagtggtgatacgattgaggttcacgctgataacttaattgaaactttagagattctaacaaaaaaa

SEQ ID NO: 2304 - protein, 617 aa, Streptococcus agalactiae
MKQSKMLIPTLREMPSDAQVISHALMVRAGYVRQVSAGIYAYLPLANRTIEKFKTIMRQEFEKIGAVEMLAPALLTADLWRESGRYETYGEDLYKLKNRDQSDFILGPTHEETFTTLVRDAVKSYKQLPLNLYQIQSKYRDEKRPRNGLLRTREFIMKDGYSFHKDYEDLDVTYEDYRKAYEAIFTRAGLDFKGIIGDGGAMGGKDSQEFMAVTPNRTDLNRWLVLDKTIPSIDDIPEDVLEEIKVELSAWLVSGEDTIAYSTESSYAANLEMATNEYKPSTKAATFEEVTKVETPNCKSIDEVAGFLSIDENQTIKTLLFIADEQPVVALLVGNDQVNDVKLKNYLAADFLEPASEEQAKEIFGAGFGSLGPVNLPDSVKIIADRKVQDLANAVSGANQDGYHFTGVNPERDFTAEYVDIREVKEGEISPDGKGTLKFARGIEIGHIFKLGTRYSDSMGANILDENGRSNPIVMGCYGIGVSRILSAVIEQHARLFVNKTPKGAYRFAWGINFPEELAPFDVHLITVNVKDQESQDLTEKIEADLMLKGYEVLTDDRNERVGSKFSDSDLIGLPIRVTVGKKASEGIVEVKIKASGDTIEVHADNLIETLEILTKK

SEQ ID NO: 2305 - DNA, 1854 bp, Streptococcus pyogenes
atgaaacaaagtaaactgcttatcccaaccttgcgcgaaatgccaagtgatgcccaggttatcagccacgcgcttatggtgcgtgccggttatgtgcgccaagtttctgctggtatctatgcttatttaccactggcaaatcgtaccattgagaaattcaagaccatcatgcgtgaagagtttgaaaagatcggtgctgttgaaatgttggcgccagctcttttgacagctgatctctggcgtgaatcaggccgttatgagacctatggagaggacctctataagcttaaaaaccgtgataactcagactttatcttgggtccaactcacgaagaaacctttacgactttggtgcgtgatgcggtcaaatcttacaagcaattgcccttaaacctttatcaaattcagtctaagtatcgtgatgaaaaacgtccgcgtaatggcttgcttcgtacccgtgagtttattatgaaagacggctatagtttccatcacaactatgaagatttagatgtgacctacgaagattatcgtcaagcttacgaagctatttttaccagagctggtttagatttcaaagggattattggagatggcggtgccatgggggggaaagattcccaagaatttatggccattacaccagctcgtacggatcttgatcgctgggtggttcttgacaagtctattgcgtcaatggatgatattccaaaagaggtcttagaagatattaaggcagaattggctgcttggatgatttcaggtgaagatactattgcttattcaacagaatcaagctacgctgccaaccttgagatggcaactaacgaatacaaaccgtcctcaaaagtagctgctgaagatgccttggcagaagttgagacaccacattgcaaaacgattgatgaagtggctgcttttctttcagtagatgaaacacaaaccatcaaaaccttgctttttgtggcagataatgaacctgttgttgctttgctagttggaaatgaccatatcaataccgttaaattaaaaaactatctagctgctgattttttagagccagctagtgaagaagaagcccgtgctttctttggtgcaggttttggctcacttgggcctgtcaacttggcacaaggtagtcgtattgtggctgaccgcaaagtgcaaaaccttaccaatgccgttgcaggagctaacaaggatggtttccatatgacaggagtcaatccaggacgtgacttccaggctgaatatgtagatattcgtgaagtcaaagaaggggaaatgtctccggacggtcatggtgttctccagtttgcgcgtggtatcgaagtcggtcatatcttcaagttgggcactcgttattcagacagcatgggagcaacgattcttgatgaaaatggcagaacagttccaattgtgatgggttgttatggtatcggggttagccgcattttgtctgctgtcattgaacagcatgcccgtctctttgtgaacaagacaccaaaaggcgattaccgttatgcttggggtattaacttccctaaagaattagccccatttgacgtgcatttgattacagttaatgtcaaagatcaagtggcccaagacttgacggcgaagttagaagctgacttgatggctaaagggtatgatgtcttgacagatgaccgtaatgaacgcgtcggttcgaaattctctgatagcgatttgattggtttgccaattcgtgtcactgttggtaaaaaagccgctgaaggtatcgtggaaattaaaatcaaggcaacaggtgacagcattgaagttaatgcagaaaacctcatcgaaacccttgaaattttaacaaaagaacac

SEQ ID NO: 2306 - protein, 618 aa, Streptococcus pyogenes
MKQSKLLIPTLREMPSDAQVISHALMVRAGYVRQVSAGIYAYLPLANRTIEKFKTIMREEFEKIGAVEMLAPALLTADLWRESGRYETYGEDLYKLKNRDNSDFILGPTHEETFTTLVRDAVKSYKQLPLNLYQIQSKYRDEKRPRNGLLRTREFIMKDGYSFHHNYEDLDVTYEDYRQAYEAIFTRAGLDFKGIIGDGGAMGGKDSQEFMAITPARTDLDRWVVLDKSIASMDDIPKEVLEDIKAELAAWMISGEDTIAYSTESSYAANLEMATNEYKPSSKVAAEDALAEVETPHCKTIDEVAAFLSVDETQTIKTLLFVADNEPVVALLVGNDHINTVKLKNYLAADFLEPASEEEARAFFGAGFGSLGPVNLAQGSRIVADRKVQNLTNAVAGANKDGFHMTGVNPGRDFQAEYVDIREVKEGEMSPDGHGVLQFARGIEVGHIFKLGTRYSDSMGATILDENGRTVPIVMGCYGIGVSRILSAVIEQHARLFVNKTPKGDYRYAWGINFPKELAPFDVHLITVNVKDQVAQDLTAKLEADLMAKGYDVLTDDRNERVGSKFSDSDLIGLPIRVTVGKKAAEGIVEIKIKATGDSIEVNAENLIETLEILTKEH

SEQ ID NO: 2307 - DNA, 582 bp, Streptococcus agalactiae
atgaaaagtcgaaaaaaagataaattggtattgaggttaacaacaacactattggtttttggtttgggtggggtttggttttataattataaaaatgataatgtcgaaccgacagtcactagtgcatcggatcaaacgacgacttttattcaaacgatttctccaacagctattgaaatttctaagacctatgatttgtatgcgtcagtcttattagcacaagctattttggaatcatccagtggacaatcagatttgtctaaggctcctaattataacctctttggcatcaaaggagaatataaaggtaaatctgtccaaatgcctactttagaagatgatgggaaaggcaatatgactcaaatccaagctccttttcgcgcctatccaaattattctgcttcactatatgattatgctgagttagtatctagtcaaaagtatgcatctgtttggaaatcaaatacctcttcttataaggatgctactgcagctctaacaggtctttatgcgacagatactgcttatgctagtaaattaaaccaaattattgaaacctacagtctagatgcttatgataaa

SEQ ID NO: 2308 - protein, 194 aa, Streptococcus agalactiae
MKSRKKDKLVLRLTTTLLVFGLGGVWFYNYKNDNVEPTVTSASDQTTTFIQTISPTAIEISKTYDLYASVLLAQAILESSSGQSDLSKAPNYNLFGIKGEYKGKSVQMPTLEDDGKGNMTQIQAPFRAYPNYSASLYDYAELVSSQKYASVWKSNTSSYKDATAALTGLYATDTAYASKLNQIIETYSLDAYDK

SEQ ID NO: 2309 - DNA, 705 bp, Streptococcus pyogenes
atgacaaaaaagaaaggtaagcttgtacttatcagtctttttgttctagcagcttgtttaggagcttatagtgcaatgagacaatctcataaaacttcaaacgtgtcagctgagactatcgccagttcttcaacccgacattttattgatgaaattggtccaactgctagtactattggtcaagaacgtgatctttatgcgtctgttatgatagcacaagcgattttagaatcaagtaatggtaaatcaagtctaagtcaagcaccttattataattttttcggtattaagggtgcctataacggttcttctgtgacgatgtcaacttgggaagatgatggtaatggcaatacctatacgattgatcaagcctttagagcttatccaagtattgcagactcccttaatgactacgcggacttgctaagttctagcacttatataggtgctagaaaatcaaacacgctatcgtatcaagatgctacagcagctctaactggcttatacgctacagacaccagttataacttaaaactaaataatattattgcaacctatggtttgacggcttatgatgttgctaatagctcagctcaagaaactggtctagcaacttcgggttatgtttggaatgaatatcgtcgtaattacactgatgcggagaccctagcagttgatgaggcttgggctaaacgcatgacttat

SEQ ID NO: 2310 - protein, 235 aa, Streptococcus pyogenes
MTKKKGKLVLISLFVLAACLGAYSAMRQSHKTSNVSAETIASSSTRHFIDEIGPTASTIGQERDLYASVMIAQAILESSNGKSSLSQAPYYNFFGIKGAYNGSSVTMSTWEDDGNGNTYTIDQAFRAYPSIADSLNDYADLLSSSTYIGARKSNTLSYQDATAALTGLYATDTSYNLKLNNIIATYGLTAYDVANSSAQETGLATSGYVWNEYRRNYTDAETLAVDEAWAKRMTY

SEQ ID NO: 2311 - DNA, 4404 bp, Streptococcus agalactiae
atgtcagaattgttcaagaaacttatggatcagattgaaatgccgcttgaaattaagaattcaagtgttttttcgtctgctgatattatcgaggtaaaggttcattctctatcacgcttatgggaatttcatttttcatttccagaattattgccaattgaggtgtatcgtgaattacaaactcgtttagtgaatagttttgaaaaagcagatataaaggctacttttgatataagagcagaaactattgatttttctgatgatctgctacaggattattatcaacaagctttttgtgaacccttgtgtaatagtgcaagttttaagagttctttttcacaattaaaagttcattacaatggcagtcagatgattatttcagcacctcaatttgtcaataataatcattttcgtcagaatcatttgccgcgtttggaacaacagttttcattgtttggatttggtaaacttgctattgatatggtttctgatgaacaaatgacgcaagacttaaaatcatcatttgaaactaatcgcgagcaattgcttgaaaaagctaaccaagaagctatgcaagccttggaagcacaaaaatcactagaagattcagcgcctccatcagaagaagtgaccccaactcaaaattatgatttcaaagagcgtatcaaacaacgtcaagctggctttgaaaaagcagagattacacccatgattgaggtgacaacagaagaaaatcgtatcgtttttgaaggaatggtttttagtgttgaacgaaaaacaacccgcactggacgtcatatcattaattttaagatgactgattatacctcaagttttgctatgcaaaagtgggctaaagatgatgaagaattgaagaagtacgatatgatttctaaaggttcgtggttgcgagtcagagggaatattgagaacaataactttactaaatctttgacaatgaatgttcaagatatcaaagagattgtgcatcatgaacgtaaagacttaatgccagcagatcaaaaacgtgtggaatttcatgctcataccaatatgtcaacgatggatgctttaccaactgtcgagagcctcattgatactgcagctaagtggggacacccagctattgcaattactgaccatgccaatgttcaaagttttccgcatggctaccacagagcaaaaaaagcaggtataaaagcaatttttggattagaggcaaatattgttgaagataaagtgcctatttcctacaacgaagttgatatgaatttgcacgaagcaacttatgttgtatttgatgtggaaactacaggtctttctgcagctaataatgacctaattcagattgcagcatcaaaaatgttcaagggtaatattattgagcaatttgatgagtttattgacccaggtcatcctctttctgcctttacaactgaattgacaggtattacggataatcatgtcagaggttcaaaacctattttacaagtccttcaggaatttcagaatttttgtcaaggtacggttttagttgcgcataatgcaacctttgacgttggttttatgaatgcgaattatgaacgtcataatctgcctttgatcacacagccggtcattgataccttagaatttgcaagaaatctttatcctgaatataagcgtcatggtttggggcctctaaccaaacgtttccaagttgctttggaacatcatcatatggccaactacgatgctgaagcaacgggtcgcttactctttattttcttaaaagaggcgcgggaaaatcgtgatgtgactaatttgatggagctcaatactaaattggtagctgaagactcttacaaaaaggcacgcataaagcatgcaaccatttatgtccaaaatcaggttggacttaaaaatatatttaagttagttagcctttcaaatgttaaatattttgaaggggtggcaagaattcctaggtcagttttagatgctcacagagaaggtctcttgctaggtactgcctgttctgatggagaagtttttgatgccttgttatcaaatggaattgatgcagcagtgaccctagctaaatattatgattttattgaagtcatgccacctgctatttatcgccccttggtagtacgtgatttaattaaagatgaggtggggattcaacaaattattagagacctaatagaggtcggtcggcgtttagataagcctgttttagctacgggaaatgttcattatattgagcctgaagatgagatttaccgtgagattattgttcgtagtcttggacaaggtgccatgattaataggactataggtcgtggggaggatgctcagccagcgcctttgccaaaagcacatttccgcacaacaaatgagatgttagatgaatttgcctttcttggtaaagatttagcctatgagatcgttgtaaccaatacgaatacttttgcagatcgatttgaagacgttgaagttgtaaaaggggatctctatactccgtttgttgatcgtgctgaagaacgagttgctgaattaacttatgctaaagcattcgaaatatatggtaatcctcttcctgatattattgatttacgtatcgaaaaagagttagcatctatacttggtaatggatttgccgttatctatcttgcttcgcaaatgttggtgcaacgttctaatgaacgtggttatctagtaggatcacgtgggtctgttgggtcgagttttgtagcgaccatgataggaattactgaagttaatccaatgccacctcattatgtttgcccaaattgtcagcattctgaatttatcacagatggttcttgtggttcaggctatgatttaccaaataaaaattgtcctaaatgtggtactttgtacaagaaagatggacaggatattccgtttgaaactttcttaggatttgatggagataaggttcctgatattgatctgaatttctctggagatgatcaaccttctgctcacttagacgttcgtgatatctttggagaagaatatgcttttcgtgcaggaacggtaggtaccgtagctgaaaaaactgcctttggttttgtcaaaggttacgaacgagattacaataaattttataacgatgcagaggtcgaacggttagcgactggtgctgcgggagttaaacgttctacaggtcaacaccccggtggtattgttgttattcctaactatatggatgtttatgattttactccggttcaatatccagcagatgatatgacagctgcttggcagacaactcacttcaatttccatgatattgatgagaatgtcttgaagttagatattctaggacatgatgatcctactatgattcgtaaacttcaggatttatcaggaattgatccatcaaatatccttccagatgatccagacgttatgaagttattttctggtacggaagttttaggagtgacagaagagcaaattggaactcctacaggaatgcttggtattccagagtttggtacgaactttgttcgtggtatggtgaacgaaacccatccaaccacatttgcagaattgttgcaactgtcagggctatcacatggtacggatgtttggttaggtaatgctcaagacttaatcaaggaaggtattgctaccttatcaactgttattggttgtcgtgatgacatcatggtttatttaatgcacgctggcctacaaccaaagatggcctttacaatcatggagcgcgtgcgtaaggggttatggttgaaaatttcagaagatgagcgtaatggttatatccaagcaatgcgtgataataatgtcccggattggtatattgaatcgtgtggaaaaatcaagtatatgttccctaaagcccatgcagcagcctatgttttaatggcattacgtgtggcgtactttaaagtacattatccaatattttattattgtgcttatttttctattcgcgccaaagcttttgaattacgcacaatgagtgctggacttgatgccgttaaggcgcgcatgaaggatatcactgagaagcgtcagcgtaatgaggcgacgaatgtcgaaaatgatctttttacgacattagagttggttaatgaaatgcttgagcgtggctttaaatttgggaaattagatctttatcgtagccatgcgactgactttattattgaagaggatacgctaatccctccatttgttgctatggaaggcttgggagaaaacgttgcaaaacagatagttcgggcacgtgaagatggtgaatttttatcaaaaacagagcttcgtaaacgaggaggagtctcaagtaccttagttgaaaaatttgatgagatgggtattttgggaaatttaccagaagacaatcagttgagtctttttgatgatttcttc

SEQ ID NO: 2312 - protein, 1468 aa, Streptococcus agalactiae
MSELFKKLMDQIEMPLEIKNSSVFSSADIIEVKVHSLSRLWEFHFSFPELLPIEVYRELQTRLVNSFEKADIKATFDIRAETIDFSDDLLQDYYQQAFCEPLCNSASFKSSFSQLKVHYNGSQMIISAPQFVNNNHFRQNHLPRLEQQFSLFGFGKLAIDMVSDEQMTQDLKSSFETNREQLLEKANQEAMQALEAQKSLEDSAPPSEEVTPTQNYDFKERIKQRQAGFEKAEITPMIEVTTEENRIVFEGMVFSVERKTTRTGRHIINFKMTDYTSSFAMQKWAKDDEELKKYDMISKGSWLRVRGNIENNNFTKSLTMNVQDIKEIVHHERKDLMPADQKRVEFHAHTNMSTMDALPTVESLIDTAAKWGHPAIAITDHANVQSFPHGYHRAKKAGIKAIFGLEANIVEDKVPISYNEVDMNLHEATYVVFDVETTGLSAANNDLIQIAASKMFKGNIIEQFDEFIDPGHPLSAFTTELTGITDNHVRGSKPILQVLQEFQNFCQGTVLVAHNATFDVGFMNANYERHNLPLITQPVIDTLEFARNLYPEYKRHGLGPLTKRFQVALEHHHMANYDAEATGRLLFIFLKEARENRDVTNLMELNTKLVAEDSYKKARIKHATIYVQNQVGLKNIFKLVSLSNVKYFEGVARIPRSVLDAHREGLLLGTACSDGEVFDALLSNGIDAAVTLAKYYDFIEVMPPAIYRPLVVRDLIKDEVGIQQIIRDLIEVGRRLDKPVLATGNVHYIEPEDEIYREIIVRSLGQGAMINRTIGRGEDAQPAPLPKAHFRTTNEMLDEFAFLGKDLAYEIVVTNTNTFADRFEDVEVVKGDLYTPFVDRAEERVAELTYAKAFEIYGNPLPDIIDLRIEKELASILGNGFAVIYLASQMLVQRSNERGYLVGSRGSVGSSFVATMIGITEVNPMPPHYVCPNCQHSEFITDGSCGSGYDLPNKNCPKCGTLYKKDGQDIPFETFLGFDGDKVPDIDLNFSGDDQPSAHLDVRDIFGEEYAFRAGTVGTVAEKTAFGFVKGYERDYNKFYNDAEVERLATGAAGVKRSTGQHPGGIVVIPNYMDVYDFTPVQYPADDMTAAWQTTHFNFHDIDENVLKLDILGHDDPTMIRKLQDLSGIDPSNILPDDPDVMKLFSGTEVLGVTEEQIGTPTGMLGIPEFGTNFVRGMVNETHPTTFAELLQLSGLSHGTDVWLGNAQDLIKEGIATLSTVIGCRDDIMVYLMHAGLQPKMAFTIMERVRKGLWLKISEDERNGYIQAMRDNNVPDWYIESCGKIKYMFPKAHAAAYVLMALRVAYFKVHYPIFYYCAYFSIRAKAFELRTMSAGLDAVKARMKDITEKRQRNEATNVENDLFTTLELVNEMLERGFKFGKLDLYRSHATDFIIEEDTLIPPFVAMEGLGENVAKQIVRAREDGEFLSKTELRKRGGVSSTLVEKFDEMGILGNLPEDNQLSLFDDFF

SEQ ID NO: 2313 - DNA, 4395 bp, Streptococcus pyogenes
atgtcagatttattcgctaaattgatggaccagatagaaatgccacttgacatgagacgttcaagtgccttttcatctgctgatattatcgaggtaaaggtacattcggtgtcacgcttgtgggaatttcattttgcctttgcagcggttttaccgattgcaacttatcgtgaattgcatgatcgtttgataagaacttttgaggcggctgacattaaggtaacctttgacatccaagctgctcaggtggattattcagatgatctgcttcaagcttattaccaagaagcttttgagcatgcaccgtgtaatagtgctagttttaaatcttctttctcaaagctcaaagtgacttatgaggatgacaaactcattattgcagcgccaggttttgtgaataacgatcattttagaaacaatcatctgcctaatctggtcaagcaattagaagcctttggctttggcatcttgaccatagatatggtgtcagatcaggaaatgactgagcatttgaccaagaattttgtttccagtcgtcaggctcttgtgaaaaaggctgtgcaggataatttggaagcccaaaaatctcttgaagccatgatgccaccagttgaggaagccacacctgctcctaagtttgactacaaggaacgagcagctaagcgtcaggcagggtttgaaaaagcaaccatcacaccaatgattgagattgagaccgaagaaaaccggattgtctttgagggtatggtttttgacgtggagcgtaaaacgactaggacaggtcgccatatcatcaactttaaaatgacagactatacctcctcgtttgctctccaaaaatgggctaaagacgatgaggagctccgtaaatttgatatgattgctaagggagcttggttacgggtacaagggaatattgagaccaatccttttacgaagagtctcaccatgaatgtccagcaggtcaaagaaattgtccgtcatgagcgcaaagacctgatgccagaagggcaaaagcgggtcgaacttcatgcccacaccaatatgtctaccatggatgccttaccgacagtagaaagcttgattgatacggcagccaagtggggacacaaggcgattgctatcaccgaccatgctaatgtgcaaagttttcctcatggctaccatagggctcgcaaagctgggattaaggctatttttggcctagaagccaatattgttgaggacaaggtgcctatttcttatgaacctgttgatatggatttgcacgaagctacctatgtggtctttgacgtggaaaccacaggtctatctgctatgaataatgacctgattcagattgcggcttccaaaatgtttaaaggaaatattgtagagcagtttgatgaattcattgatcctgggcatcctctttcagcctttaccaccgaattgacaggaattaccgataagcatttgcagggcgccaagccattggttactgtcctaaaagcttttcaggacttttgcaaagatagtatcttggttgcccacaacgccagttttgacgtgggctttatgaacgccaattatgaacgccacgacttgcccaaaatcacacagcctgtgattgataccttagaatttgctagaaacttgtatcctgagtacaagcgtcacggtttgggaccgctcaccaagcgtttccaagtgagtctagaccaccatcatatggccaattacgacgcggaagccacaggacgtcttttgtttatttttctaaaagatgccagagaaaagcatggcatcaaaaatcttttgcaactcaatacagatttggtggctgaggattcttacaaaaaagcgcggattaagcatgcgactatctatgtgcaaaatcaggttggtcttaaaaatatgtttaagttggtcagcctttccaatatcaaatattttgaaggggtgccgcgtattccaagaaccgtcttagatgctcacagagagggtttgttacttggtacagcttgttctgacggcgaggtttttgatgccgttctgactaaaggaattgatgcagcggttgatttggctaggtattatgattttatcgaaatcatgccaccagccatttaccagccattggttgtccgtgaattaatcaaagatcaagcaggtattgagcaggtgattcgtgacctcattgaagtagggaaacgagctaagaaacctgtgcttgccactgggaatgtgcattatctagagcctgaagaagagatttaccgtgaaattattgtgcgtagtcttggtcagggtgccatgattaatagaacaatcggccgtggggaaggggcacagcctgctcctctacctaaagcgcactttagaacaaccaatgaaatgctggatgagtttgcctttcttggaaaagacctcgcttatcaagtagttgtgcaaaatactcaggattttgcggaccgtattgaggaagtggaagtggttaagggcgatctttacaccccgtatattgataaggccgaagagacggttgccgaattaacctatcaaaaagcctttgaaatttatggtaatcctctcccagatattattgatttacgcattgaaaaagagttaacctctatcttggggaacggttttgctgtgatttatctcgcttcccaaatgcttgttaaccggtcaaatgagcgaggctacctagttggttctaggggatctgtagggtctagctttgtcgccaccatgattgggattactgaggttaatcctatgccgcctcactacgtttgcccgtcctgccaacattctgaatttatcacagatgggtcagttggatctggctatgatttgcctaataaaccctgtccgaaatgtggcaccccttatcaaaaagatgggcaagacattccctttgagacctttcttgggtttgatggggataaggtgcccgatattgatttgaacttctctggtgatgaccagcccagtgcccatttggatgtccgagatatttttggtgacgaatacgcctttcgtgctggaacagttggtaccgtagcagaaaaaacagcttatggatttgtcaaaggctatgaacgcgactatggcaagttctatcgtgatgctgaggtggatcgtctagcagcaggtgctgctggtgtgaaacgaacgactgggcagcaccctggggggattgttgttattcctaattacatggatgtttatgattttacccccgtgcaatatccagccgatgatgtaacggcttcttggcagacaactcactttaacttccatgatattgatgaaaacgtcttgaaacttgatatcctagggcatgatgatccgaccatgattcgtaaacttcaggatttatcgggcattgatcctattactattcctgctgatgatccgggagttatggctctcttttctgggacagaggttttgggcgttaccccggaacaaattgggacaccgactggtatgctaggcattccagaatttggaaccaactttgttcgcggcatggttaatgagacgcatccgaccacttttgcggagcttttgcagttgtctggactatctcatggaaccgatgtttggcttggtaatgcacaagatttgattaaagaaggcattgcaaccctaaaaaccgttatcggttgtcgtgacgacatcatggtttacctcatgcacgcaggcttagaaccaaaaatggcctttaccattatggagcgtgtgcgtaagggattatggctaaaaatttctgaggaagaacgtaatggctatattgatgccatgcgagaaaacaatgtgcccgactggtacattgaatcgtgtggaaaaatcaagtacatgttccctaaagcccatgcggcagcttatgttttgatggcccttcgggtggcttatttcaaggtgcaccaccccattatgtattattgtgcttatttctctattcgtgcgaaggcttttgaattaaaaaccatgagtggtggtttagatgctgttaaagcaagaatggaagatattactataaaacgtaaaaataatgaagccaccaatgtggaaaatgacctctttacaaccttggagattgtcaacgaaatgttagaacgcggctttaagtttggcaaattagacctttacaaaagtgatgctatagaattccaaatcaaaggagatacccttatccctccatttatagcgctagaaggtctgggtgaaaacgtggccaagcaaatcgttaaagctcgtcaagaaggcgaattcctctctaaaatggaattgcgtaaacgaggcggggcatcgtcaacgctcgttgagaaaatggatgagatgggtattttaggaaatatgccagaagataatcaattaagtctttttgatgactttttc

SEQ ID NO: 2314 - protein, 1465 aa, Streptococcus pyogenes
MSDLFAKLMDQIEMPLDMRRSSAFSSADIIEVKVHSVSRLWEFHFAFAAVLPIATYRELHDRLIRTFEAADIKVTFDIQAAQVDYSDDLLQAYYQEAFEHAPCNSASFKSSFSKLKVTYEDDKLIIAAPGFVNNDHFRNNHLPNLVKQLEAFGFGILTIDMVSDQEMTEHLTKNFVSSRQALVKKAVQDNLEAQKSLEAMMPPVEEATPAPKFDYKERAAKRQAGFEKATITPMIEIETEENRIVFEGMVFDVERKTTRTGRHIINFKMTDYTSSFALQKWAKDDEELRKFDMIAKGAWLRVQGNIETNPFTKSLTMNVQQVKEIVRHERKDLMPEGQKRVELHAHTNMSTMDALPTVESLIDTAAKWGHKAIAITDHANVQSFPHGYHRARKAGIKAIFGLEANIVEDKVPISYEPVDMDLHEATYVVFDVETTGLSAMNNDLIQIAASKMFKGNIVEQFDEFIDPGHPLSAFTTELTGITDKHLQGAKPLVTVLKAFQDFCKDSILVAHNASFDVGFMNANYERHDLPKITQPVIDTLEFARNLYPEYKRHGLGPLTKRFQVSLDHHHMANYDAEATGRLLFIFLKDAREKHGIKNLLQLNTDLVAEDSYKKARIKHATIYVQNQVGLKNMFKLVSLSNIKYFEGVPRIPRTVLDAHREGLLLGTACSDGEVFDAVLTKGIDAAVDLARYYDFIEIMPPAIYQPLVVRELIKDQAGIEQVIRDLIEVGKRAKKPVLATGNVHYLEPEEEIYREIIVRSLGQGAMINRTIGRGEGAQPAPLPKAHFRTTNEMLDEFAFLGKDLAYQVVVQNTQDFADRIEEVEVVKGDLYTPYIDKAEETVAELTYQKAFEIYGNPLPDIIDLRIEKELTSILGNGFAVIYLASQMLVNRSNERGYLVGSRGSVGSSFVATMIGITEVNPMPPHYVCPSCQHSEFITDGSVGSGYDLPNKPCPKCGTPYQKDGQDIPFETFLGFDGDKVPDIDLNFSGDDQPSAHLDVRDIFGDEYAFRAGTVGTVAEKTAYGFVKGYERDYGKFYRDAEVDRLAAGAAGVKRTTGQHPGGIVVIPNYMDVYDFTPVQYPADDVTASWQTTHFNFHDIDENVLKLDILGHDDPTMIRKLQDLSGIDPITIPADDPGVMALFSGTEVLGVTPEQIGTPTGMLGIPEFGTNFVRGMVNETHPTTFAELLQLSGLSHGTDVWLGNAQDLIKEGIATLKTVIGCRDDIMVYLMHAGLEPKMAFTIMERVRKGLWLKISEEERNGYIDAMRENNVPDWYIESCGKIKYMFPKAHAAAYVLMALRVAYFKVHHPIMYYCAYFSIRAKAFELKTMSGGLDAVKARMEDITIKRKNNEATNVENDLFTTLEIVNEMLERGFKFGKLDLYKSDAIEFQIKGDTLIPPFIALEGLGENVAKQIVKARQEGEFLSKMELRKRGGASSTLVEKMDEMGILGNMPEDNQLSLFDDFF

SEQ ID NO: 2315 - DNA, 435 bp, Streptococcus agalactiae
ttgggagatgaaatgggaaactttaaaaattcagcggttaaatctatggttgtcatgcgaaaagcatttagaacaatagacggaaaagtctcagaatcatttaaagaatttgaattaacaccaactcagtttgcagttttggatgttctctatgctaaaggcacaatgaaaattggagaattgattgaaaatatgcttgctacatcaggtaatatgactgttgttattaaaaatatggaaaaaaagggatgggtattacgccattcttgtccgaatgataagagagcctttttggtgagtttaacaactgaaggagaagaagtgataaaaaaagctctaccagagcatattaaacgtgtagaagatgctttttcagtcttaacagaaacagagcaagaagacttgattaaccttttaaaaaaatttaaaaccttg

SEQ ID NO: 2316 - protein, 145 aa, Streptococcus agalactiae
MGDEMGNFKNSAVKSMVVMRKAFRTIDGKVSESFKEFELTPTQFAVLDVLYAKGTMKIGELIENMLATSGNMTVVIKNMEKKGWVLRHSCPNDKRAFLVSLTTEGEEVIKKALPEHIKRVEDAFSVLTETEQEDLINLLKKFKTL

SEQ ID NO: 2317 - DNA, 456 bp, Streptococcus pyogenes
gtgacataccgtataaagcgaggaaatcaaatgagtcatttagataagaacaccgctttgaaagccatggtggtgtttcgtaaagctcagcgaacgctagatgcttttggggctgatatttttaaaaaggcagatttaacagccacgcagttcagtgtgcttgaagtactatatactaaaggctgtatgcgaatcaatcacttgattgattctttgttagcgacttcggggaatatgactgttgtactaaataatatggaacgcaatggctggattagcaagtgcaaagacaaaacggataaaagagcctatgtggttaccttaacagataagggtactcgcttgattgaagctgttttgcctaaacacgtcgcacgggtggaagaagcctttgctgttttgactgaaaaagaacaactttgtctgattgaacttctcaaaaagttcaaacaatta

SEQ ID NO: 2318 - protein, 152 aa, Streptococcus pyogenes
VTYRIKRGNQMSHLDKNTALKAMVVFRKAQRTLDAFGADIFKKADLTATQFSVLEVLYTKGCMRINHLIDSLLATSGNMTVVLNNMERNGWISKCKDKTDKRAYVVTLTDKGTRLIEAVLPKHVARVEEAFAVLTEKEQLCLIELLKKFKQL

SEQ ID NO: 2319 - DNA, 612 bp, Streptococcus agalactiae
atgtcatttttggaagaattaaaaaaccgtcgctctatttacgctcttggtcgcaatacagaagtttctgatgagaaaatagtagagattattaaagaggcagttcgccaatccccatctgcttttaatagtcaaacttcccgtgttgtcattttattgaatgatgaagttactaagttctgggatgaattggttgctaatgatttggtagaaacaatgaaagtacaaggtgctccagagacagctattgctggaactaaggaaaaattagctagttttggagcttcaaagggaacagtactcttctttgaagatcaagatgttgtcaaatctcttcaagaacaattcgttctttatgcggataactttccagtttggtctgagcaatcaacaggtattgcctcagtaaatacttggacagccctttctgcagaacttggacttggtggtaatttacaacattacaatccagttattgatgcatcagtacaagctgtttatggtgttccagctagttggaaacttcgtggacaactaaattttggttcaatcgaagctgaaacaggagaaaaagaattcatgaatgatgatgaccgctttaaagtcatcgga

SEQ ID NO: 2320 - protein, 204 aa, Streptococcus agalactiae
MSFLEELKNRRSIYALGRNTEVSDEKIVEIIKEAVRQSPSAFNSQTSRVVILLNDEVTKFWDELVANDLVETMKVQGAPETAIAGTKEKLASFGASKGTVLFFEDQDVVKSLQEQFVLYADNFPVWSEQSTGIASVNTWTALSAELGLGGNLQHYNPVIDASVQAVYGVPASWKLRGQLNFGSIEAETGEKEFMNDDDRFKVIG

SEQ ID NO: 2321 - DNA, 1497 bp, Streptococcus agalactiae
ttgatgaataaaaaacataaattacttaaaaatatagaggaatttaagacgataacccaaaaaaggctaactgagagaggaaagttcccatatgataccgttcattctacgtttgaaattaaggatgaaaactttatcatggaaagattgaaatcatcagggttatctatgggtaaaccagttgattatatgggcgtaaatggtatccctatttacactaaaacattatctatagttaataagtttgcctttgaaaataattcaaaagattcttcatattcttcaaacattaatattagtgaagataaaataaaagaaaatgaccaaaaaattctagatttaatagttaaatctggagctaataatcaaaacttaacagatgaagaaaaagtaattgctttcactaaatatataggtgaaataactaattatgacaatgaagcttacagagctagaaatgtcgacacagaatattacagagcttcagatttattttctgtaacagaaagaaaacttgctatgtgcgttggctatagtgtaacagccgctagggcatttaatattatggggatacctagttatgtcgtttctggtaaaagtcctcaaggaatatctcatgcagctgtgagagcgtattataatagaagttggcatatcatagatatcacagccagtacatattggaaaaatggtaattacaaaacaacgtattccgattttattaaagaatactgtatagatggttatgacgtttatgatcccgcaaaaacaaataatagatttaaagttaagtatatggaatcaaatgaagcgtttgaaaattggatacataataatggaagcaaatctatgttatttattaatgaatctgcagctctaaaagataaaaaaccaaaagatgattttgtaccagtaacagaaaaagaaaaaaacgagctgatagataagtataaaaaattattgtcacagattcctgaaaacacacaaaatccaggagaaaaaaacataagagattatttgaaaaatgaatatgaagaaatattaaagaaagataatttatttgagcatgaacatgcagaatttaaagaaagtctaaatttaaatgaatcattctacctacaattaaagaaagaagaaatgaaaccgagtgataatctcaaaaaagaagaaaaaccaagagaaaattcagtaaaagagagggagactccagctgaaaacaatgattttgtttcagtaacagaaaaaaacaacttgattgataaatataaagaattattatcaaaaatcccagagaatacacaaaatcctggggaaaagaatatacgaaattatctagagaaagaatatgaagaactactacaaaaagataaattattcaagcatgagtacacagagtttacaaaaagtctaaatttgaatgaaacattctattcacaattaaaagaaggagaaatgaaactaagtgaaaatcccgaaaaaggagaaacgaacacgaat

SEQ ID NO: 2322 - protein, 499 aa, Streptococcus agalactiae
MMNKKHKLLKNIEEFKTITQKRLTERGKFPYDTVHSTFEIKDENFIMERLKSSGLSMGKPVDYMGVNGIPIYTKTLSIVNKFAFENNSKDSSYSSNINISEDKIKENDQKILDLIVKSGANNQNLTDEEKVIAFTKYIGEITNYDNEAYRARNVDTEYYRASDLFSVTERKLAMCVGYSVTAARAFNIMGIPSYVVSGKSPQGISHAAVRAYYNRSWHIIDITASTYWKNGNYKTTYSDFIKEYCIDGYDVYDPAKTNNRFKVKYMESNEAFENWIHNNGSKSMLFINESAALKDKKPKDDFVPVTEKEKNELIDKYKKLLSQIPENTQNPGEKNIRDYLKNEYEEILKKDNLFEHEHAEFKESLNLNESFYLQLKKEEMKPSDNLKKEEKPRENSVKERETPAENNDFVSVTEKNNLIDKYKELLSKIPENTQNPGEKNIRNYLEKEYEELLQKDKLFKHEYTEFTKSLNLNETFYSQLKEGEMKLSENPEKGETNTN

SEQ ID NO: 2323 - DNA, 96 bp, Streptococcus agalactiae
gtgtctaaaaaacgactattaatgatatcactcaactatcaaaacttcaaaataacggtacactcaaaagctgagacgcagaaaaaatacttctgt

SEQ ID NO: 2324 - protein, 32 aa, Streptococcus agalactiae
MSKKRLLMISLNYQNFKITVHSKAETQKKYFC

SEQ ID NO: 2325 - DNA, 636 bp, Streptococcus agalactiae
atgataaaatcaaagattttgttgcaattaatgcaaggaaaaatagttgctgtcattcgtggaaatagccaagaagaagcttttcaagctgctcaagcatgcataaaaggtggtatttctgctatcgaaatcgcctatactaatagcaaagctagccaagtcattgaacaactagtcacacaatatactaaccaagaacaagttgtcgttggggcaggaactgttctagactcagaaactgcccgaatggctattttagcaggagcaaagtttattgtatctcccgcatttaatctacagactgctaaactatgtaatcgttatgctattccttatttaccaggttgcatgaccttatcagaggtaacaacagcacttgaagccggttgcgaaataattaaaatattcccaggaggtactctaggaacatctttcatctcatcactaaaggcacctttacctcaagtacaaattatggtgactggtggggtaaatctcacaaatgccaaagactggtttctatctggagtaacagccattggtattggtggagagttcaataaactagcagctttgggggaatttgataaaatcacagaaatggctaaacaatacaaaatacagctaaatctgaat

SEQ ID NO: 2326 - protein, 212 aa, Streptococcus agalactiae
MIKSKILLQLMQGKIVAVIRGNSQEEAFQAAQACIKGGISAIEIAYTNSKASQVIEQLVTQYTNQEQVVVGAGTVLDSETARMAILAGAKFIVSPAFNLQTAKLCNRYAIPYLPGCMTLSEVTTALEAGCEIIKIFPGGTLGTSFISSLKAPLPQVQIMVTGGVNLTNAKDWFLSGVTAIGIGGEFNKLAALGEFDKITEMAKQYKIQLNLN

SEQ ID NO: 2327 - DNA, 1005 bp, Streptococcus agalactiae
atgtctaagattctttttttcggtgaacctctcattcgcatcactccaaaagaaaatgactattttgcagatagtatctcaactaaactattctatggtggctctgaagttaataccgcaagagctctacaaggctttgggcaagatactaaactcctctcagccttacccaataatcccataggtaatagttttcttcaatttttaaaagcacagggtattgatactcattctattcagtgggttggagaacgtgttgggttatattttttagaagattcctttgcttgcagaaaaggtgaggtggtctacgaccgcgatcatagtagtttacatgactttaggataaatcaaattgatttcgatcaattatttgaaggagtttctctctttcattttagtggtattacactatcattggatgagtctatccaagagataacactgcttcttttaaaagaagctaaaaaaagagagataacaatctccttagatctcaattttcgcagtaaactaatttctcctaaaaatgccaaaatccttttttctcagttcgctacctttgcggatatttgttttggtattgaacctcttatggttgactcacaggacactaccttcttcaatcgcgatgaagctacaatagaggacgtcaaagaacgaatgatttcgcttataaatcactttgactttcaagtcattttccatactaaacgtctacaggatgaatggggacgaaaccactaccaagcttacatagcaaatcgtaaacaagagtttgtcacttcaaaagaaatcaccacagctgtaaaccagagaattggaagcggagatgcttttgtggcgggagcgctatatcaactacttcagcactcagacagcaagacagtcattgatttcgctgtcgctagtgcatctttaaaatgtgctttggaaggggacaatatgtttgagaccgttaccgcagttaacaaagtactaaatcaatcgaaagacattattcgt

SEQ ID NO: 2328 - protein, 335 aa, Streptococcus agalactiae
MSKILFFGEPLIRITPKENDYFADSISTKLFYGGSEVNTARALQGFGQDTKLLSALPNNPIGNSFLQFLKAQGIDTHSIQWVGERVGLYFLEDSFACRKGEVVYDRDHSSLHDFRINQIDFDQLFEGVSLFHFSGITLSLDESIQEITLLLLKEAKKREITISLDLNFRSKLISPKNAKILFSQFATFADICFGIEPLMVDSQDTTFFNRDEATIEDVKERMISLINHFDFQVIFHTKRLQDEWGRNHYQAYIANRKQEFVTSKEITTAVNQRIGSGDAFVAGALYQLLQHSDSKTVIDFAVASASLKCALEGDNMFETVTAVNKVLNQSKDIIR

SEQ ID NO: 2329 - DNA, 636 bp, Streptococcus agalactiae
atgaaaattgcattaatcaacgaaaatagccaagcaagtaaaaatactattatctacaaagaattgaaagcggtttctgatgaaaaaggatttgaagttttcaactacggaatgtatggcaaagaagaagaaagccagctaacttatgtacaaaatggtttactgactgctattttacttaatagcggtgctgcagattttgttattacaggctgtgggacaggaattggagcgatgcttgcttgtaatagttttcctggcgtagtctgtggattcgctgctgatcctgtcgacgcttacttattctctcaagtaaacggaggaaatgctctttcccttccttttgctaaaggatttggttggggagctgaattgaatctgaggtatttatttgaacgtcttttcgaagatgaaaaaggagggggataccctaaagagagggctgtacctgagcaacgcaatgcacgtatccttagcgaaataaaacagattacttacagagatttactctctgttttaaaagaaattgatcaagatttcttaaaggaaactatttctggggagcatttccaagaatatttcttcgctaattgccaaaatcaaaatatagcagactacttgaaatctgtcttagac

SEQ ID NO: 2330 - protein, 212 aa, Streptococcus agalactiae
MKIALINENSQASKNTIIYKELKAVSDEKGFEVFNYGMYGKEEESQLTYVQNGLLTAILLNSGAADFVITGCGTGIGAMLACNSFPGVVCGFAADPVDAYLFSQVNGGNALSLPFAKGFGWGAELNLRYLFERLFEDEKGGGYPKERAVPEQRNARILSEIKQITYRDLLSVLKEIDQDFLKETISGEHFQEYFFANCQNQNIADYLKSVLD

SEQ ID NO: 2331 - DNA, 639 bp, Streptococcus pyogenes
atgaaaattgcattaattaatgaaaatagccaagcggctaaaaatggtatcatttacgatgcccttaccacagtgacagataaacacggctaccaagtctttaactatggtatgtatggcacagaaggtgaaagccagttgacctatgttcaaaatggactcttagcttctattttattgaccactaaggcggctgattttgtggtgactggttgtgggacaggtgttggagctatgttggccttgaacagcttcccaggtgttacctgtggttttgcgagtgagccaacagaagcttatctcttttctcaaatcaatggtggtaatgccttgtccattccttttgccaaaggttttggttggggagcagagttgaatttgaccttaatatttgaacgcctctttgcagaaccaatgggtggtggttaccctaaagagcgagctattcctgaacagcggaatgcacgtattttaagtgatctgaaaaaaattacttacagagatttgttggcaattgtcaaagacatcgaccaagatttcctcaaagaaacgatttctggcgctcatttccaagagtacttctttgccaatgcggagccgtcagaattagtcacttatttgaaatcagtacttgaacag

SEQ ID NO: 2332 - protein, 213 aa, Streptococcus pyogenes
MKIALINENSQAAKNGIIYDALTTVTDKHGYQVFNYGMYGTEGESQLTYVQNGLLASILLTTKAADFVVTGCGTGVGAMLALNSFPGVTCGFASEPTEAYLFSQINGGNALSIPFAKGFGWGAELNLTLIFERLFAEPMGGGYPKERAIPEQRNARILSDLKKITYRDLLAIVKDIDQDFLKETISGAHFQEYFFANAEPSELVTYLKSVLEQ

SEQ ID NO: 2333 - DNA, 93 bp, Streptococcus agalactiae
atgcctttgtcaacgagttcttgcttaatatcattgaagacaatagttgctccagctctagcaaaagcagttgctattgaaaaaccaatgccg

SEQ ID NO: 2334 - protein, 31 aa, Streptococcus agalactiae
MPLSTSSCLISLKTIVAPALAKAVAIEKPMP

SEQ ID NO: 2335 - DNA, 810 bp, Streptococcus agalactiae
atgactgaacaattcttaaaagacaacttttcactagaaggtaaagtcgccttaataacaggcgcttcttacggcattggtttttcaatagcaactgcttttgctagagctggagcaactattgtcttcaatgatattaagcaagaactcgttgacaaaggcatctccgcctataaaaaacttggcattaaggcccatggctatgtttgtgatgttacagatgaagatggaatcaacgaaatggtggacaaaatttctcaagatgttggggtaattgatattctagttaacaacgcaggtattataaaacgcacccctatgctagagatgagcgctgcagattttcgacaagttattgatattgatttgaatgctccctttatcgtatcaaaagcggtattacctggaatgatccaaaaaggacatggtaaaatcatcaatatttgctccatgatgagtgagcttggacgcgaaacagttgctgcctatgctgctgccaaagggggacttaaaatgttaaccaagaacatcgcttctgaatacggttctgctaacatccaatgtaacggtatcgggcccggctatattgccacaccacaaacagctccccttcgtgaacgtcaagatgatggttcacgtcatccattcgaccaatttatcatcgctaaaacacctgccgctcgctggggtgaggcagaagatttaggtgcaccagctatcttccttgctagtgatgcatcaaactttatcaatggtcacatactctatgtagatggcggtattttagcttacatcggtaaacaacctcaa

SEQ ID NO: 2336 - protein, 270 aa, Streptococcus agalactiae
MTEQFLKDNFSLEGKVALITGASYGIGFSIATAFARAGATIVFNDIKQELVDKGISAYKKLGIKAHGYVCDVTDEDGINEMVDKISQDVGVIDILVNNAGIIKRTPMLEMSAADFRQVIDIDLNAPFIVSKAVLPGMIQKGHGKIINICSMMSELGRETVAAYAAAKGGLKMLTKNIASEYGSANIQCNGIGPGYIATPQTAPLRERQDDGSRHPFDQFIIAKTPAARWGEAEDLGAPAIFLASDASNFINGHILYVDGGILAYIGKQPQ

SEQ ID NO: 2337 - DNA, 432 bp, Streptococcus agalactiae
atgataaaaattattattgtagcacacggcaactttccagatggtattttaagctctttagaacttattgctgggcatcaggaatatgttgttggtattaactttattgcaggcatgtcttctaatgatgttagagttgctttgcaaagagaggttatcgatttcaaagaaattttagtattgactgatttgctaggtgggactcctttcaatgtttcttccgccttatcagtagaatatacagataaaaagataaaagttttatcgggcttgaacctttcaatgttaatggaagctgttttatctagaacgatgtttgaacatgtagatgatcttgttgataaagttataacatcatctcatgaaggaattgttgatttttctacttgccttgctacacaaactgcagaagcaacttttgagggaggcatt

SEQ ID NO: 2338 - protein, 144 aa, Streptococcus agalactiae
MIKIIIVAHGNFPDGILSSLELIAGHQEYVVGINFIAGMSSNDVRVALQREVIDFKEILVLTDLLGGTPFNVSSALSVEYTDKKIKVLSGLNLSMLMEAVLSRTMFEHVDDLVDKVITSSHEGIVDFSTCLATQTAEATFEGGI

SEQ ID NO: 2339 - DNA, 435 bp, Streptococcus
atgattgctattatcgttatgggacatggacattttgcgagtggtattgtttcagccttagaattgatcgcaggcaaacaagaaaaggtaactgcaattgattttactactgagatgaccgccgctgatgtgcaggaccaattatctcgtgctttaatcccagaagaggaaaccttagttctttgtgaccttctaggaggtaccccttttaaagtcgctgcaaccttaatggaatctcttccaaacacgacgtgtaatgttctttctggccttaacttagccatgctgattgaagctagttttgcaagacaaacagcagcttcttttgacgacttagtatcaggacttataacatgttctaaagaaggcattgttgactggaaaactctttctcagcaagaagacggtgcgacagacgatgagttaggaggcatt

SEQ ID NO: 2340 - protein, 145 aa, Streptococcus pyogenes
MIAIIVMGHGHFASGIVSALELIAGKQEKVTAIDFTTEMTAADVQDQLSRALIPEEETLVLCDLLGGTPFKVAATLMESLPNTTCNVLSGLNLAMLIEASFARQTAASFDDLVSGLITCSKEGIVDWKTLSQQEDGATDDELGGI

SEQ ID NO: 2341 - DNA, 1194 bp, Streptococcus agalactiae
atgatgaaaataaaaccggtcaaggttgagtcaattgaaaatccaaagcgttttttaaacagtagattattaactaagattgaagttgaggaagcgattgaaaaagccttgaagcaactttatattaatattgattactttggtgaagagtatccaacgcctgcaacattcaataatatttataaagttatggataacacagaatggacaaatggtttttggacagggtgcttgtggttagcttatgagtataatcaggataaaaagttaaaaaacatagcccacaaaaatgtattgtcatttctaaatcgtattaataatcgtatagcattagatcaccacgacttaggatttctttacacaccatcttgtacagcagaatatcgtatcaatggtgatgttaaagctttagaagccactataaaagctgcagataaattgatggagcgctatcaagaaaaaggtggatttattcaggcttggggagaactcgggtataaggaacactatcgcttaattatcgattgcttacttaatatccaactcttattttttgcttatgaacagacaggtgatgaaaagtatagacaagttgcggtgaatcacttctacgcttcagctaacaatgtggtgcgtgatgattcttctgcttttcatactttttatttcgacccagaaactggagaaccgttaaaaggtgtcacacgacagggttatagtgatgagtcatcttgggcaagagggcaagcatggggcatctacggtattccgcttagttaccggaaaatgaaagattatcagcagattatcctttttaaaggtatgacaaactattttctaaatcgtttacctgaagacaaggtatcctattgggaccttatttttacggatggctcgggccagcctagagatacatccgcaacagcaacggctgtgtgtggaattcatgagatgcttaaatatttaccagaagtagatcctgataaagagacatacaaatatgctatgcatacaatgcttcgtagtctgattgaacagtatagtaataatgaacttatagcaggacgtcctcttctattgcacggtgtgtattcgtggcattcaggtaaaggagtagatgaaggtaatatttggggagattattattacttagaagccttaataagattctataaagactgggaactttattgg

SEQ ID NO: 2342 - protein, 398 aa, Streptococcus agalactiae
MMKIKPVKVESIENPKRFLNSRLLTKIEVEEAIEKALKQLYINIDYFGEEYPTPATFNNIYKVMDNTEWTNGFWTGCLWLAYEYNQDKKLKNIAHKNVLSFLNRINNRIALDHHDLGFLYTPSCTAEYRINGDVKALEATIKAADKLMERYQEKGGFIQAWGELGYKEHYRLIIDCLLNIQLLFFAYEQTGDEKYRQVAVNHFYASANNVVRDDSSAFHTFYFDPETGEPLKGVTRQGYSDESSWARGQAWGIYGIPLSYRKMKDYQQIILFKGMTNYFLNRLPEDKVSYWDLIFTDGSGQPRDTSATATAVCGIHEMLKYLPEVDPDKETYKYAMHTMLRSLIEQYSNNELIAGRPLLLHGVYSWHSGKGVDEGNIWGDYYYLEALIRFYKDWELYW

SEQ ID NO: 2343 - DNA, 1197 bp, Streptococcus pyogenes
atggcacgacctttaaaaaccattgctcttgaacctatcaagcagcctgaacgatttaccaaagaagatttcctaagccaagaagacattactcaggcccttgacttagccctcaaacaagttcggcttaatatggactattttaaagaagactttccaacgccagctaccaaagataaccaatatgccattatggataatacagaatggaccaatgccttttggacaggttgcctttggttagcttacgaatacagtggggatgatgctattaaagctctggctcaagcaaatgacctttctttcctagatcgagtaacaagagacattgagctagatcaccatgatttgggctttctttacaccccttcttgcatggctgagtggaaacttttaaaaacacctgagtctagagaagctgctttgaaagcagccgacaaattagtccaacgctatcaagacaaaggcggctttattcaggcctggggagaactgggtaaaaaagaagattaccgtttaatcattgattgtctcctaaacatccaattactcttttttgctagccaagaaactggagacaaccgttaccgtgacatggcgatcaatcatttctacgcctcagccaatcatgtcatccgagatgacgcctctgcttaccacaccttctactttgatccagaaacaggtgatcctgttaaaggggtcacccgacaaggttatagcgatgattctgcttgggccagagggcaagcttggggcatttatggtattcctttgacctatcgtttcctaaaagaacctgaactcattcaactcttcaagggcatgacccattatttcttgaaccgtcttcctaaagaccaggtgtcctactgggatttaatttttggagatggtagcgagcagtctcgtgatagttcagcaaccgccattgctgtgtgtggtattcatgaaatgttaaaaaccttaccagatcatgatcctgataaaaaaacatatgaagctgccatgcacagcatgctaagagccttgattaaggattatgctaacaaagatctcaagcctggtgctcctctactgcttcacggagtctattcttggcactctggaaaaggggttgacgagggaaatatctggggagactattactatcttgaagctctgcttcgtttctacaaagactggaacccttactgg

SEQ ID NO: 2344 - protein, 399 aa, Streptococcus pyogenes
MARPLKTIALEPIKQPERFTKEDFLSQEDITQALDLALKQVRLNMDYFKEDFPTPATKDNQYAIMDNTEWTNAFWTGCLWLAYEYSGDDAIKALAQANDLSFLDRVTRDIELDHHDLGFLYTPSCMAEWKLLKTPESREAALKAADKLVQRYQDKGGFIQAWGELGKKEDYRLIIDCLLNIQLLFFASQETGDNRYRDMAINHFYASANHVIRDDASAYHTFYFDPETGDPVKGVTRQGYSDDSAWARGQAWGIYGIPLTYRFLKEPELIQLFKGMTHYFLNRLPKDQVSYWDLIFGDGSEQSRDSSATAIAVCGIHEMLKTLPDHDPDKKTYEAAMHSMLRALIKDYANKDLKPGAPLLLHGVYSWHSGKGVDEGNIWGDYYYLEALLRFYKDWNPYW

SEQ ID NO: 2345 - DNA, 492 bp, Streptococcus agalactiae
atggcagcaggaccaaatattgtaatgacacgtgttgatgagcgtcttattcatggacaaggacaactttgggtgaaatttttaagttgtaatactgttattgtggcaaatgatgatgtctccaaagatcatcttcaacaaacgttaatgaagacggtggtgccagaatcaatagcattgcgattttttgatattcaaaaagttattgatattattcacaaggccaacccagcacagacgatttttataattgttaaagatttgaaagatgtctatagacttgtagcagggggcgtcccaattaaagagattaatattggaaatattcataatggagaaggtaaagagcaggtaagtcgctctatcttcttagggatgaaggataaagagataattagaaaattaaaccaagaatatcacattgcatttaatactaaaacaactccaacaggtaacgatggtgctgtggaagttaatattttagattatatt

SEQ ID NO: 2346 - protein, 164 aa, Streptococcus agalactiae
MAAGPNIVMTRVDERLIHGQGQLWVKFLSCNTVIVANDDVSKDHLQQTLMKTVVPESIALRFFDIQKVIDIIHKANPAQTIFIIVKDLKDVYRLVAGGVPIKEINIGNIHNGEGKEQVSRSIFLGMKDKEIIRKLNQEYHIAFNTKTTPTGNDGAVEVNILDYI

SEQ ID NO: 2347 - DNA, 486 bp, Streptococcus pyogenes
atgacacaaccaaacattatcatgacgcgagttgatgagcgtttgattcacggacaggggcaattatgggtcaaattcctcaactgcaacaccgttatcgtcgctaacgatgcggtttctgaagataagattcaacaatccctcatgaaaacagttattccatccagtattgccattcgttttttctccattcaaaaagtgattgacatcattcataaagcaagtcctgctcaaagtatcttcatcgtggtcaaagatttgcaagatgccaaactcctagttgaagggggtgttcccatcacagaaatcaatatcggtaatattcataaaactgatgataaggttgcgattacccagtttatttcgctgggagaaacagacaagtctgctattcgttgcttagcccatgaccaccacgtggtttttaacaccaaaacaactccagctggcaatagcgcctctgacgttgacatcttagattatatt

SEQ ID NO: 2348 - protein, 162 aa, Streptococcus agalactiae
MTQPNIIMTRVDERLIHGQGQLWVKFLNCNTVIVANDAVSEDKIQQSLMKTVIPSSIAIRFFSIQKVIDIIHKASPAQSIFIVVKDLQDAKLLVEGGVPITEINIGNIHKTDDKVAITQFISLGETDKSAIRCLAHDHHVVFNTKTTPAGNSASDVDILDYI

SEQ ID NO: 2349 - DNA, 864 bp, Streptococcus agalactiae
atggatattagtattcttcaggctgtcttaattggactgtggacggctttctgttttagtggcatgttgcttggcctctatacaaatcgttgtatcgttctctctctaggcgttggtgttattttaggagatattcaaacagctttggcagttggagcaatatctgaactggcttacatgggatttggtgtgggagcgggagggacagttcctccaaacccaatcggtcctgggatttttggaactttgatggctattacaacagctggaactaaaggaaaaatcacaccggaagctgctcttgcattatcaaccccaattgcagttggtattcaatttcttcaaacagcaacttatactgcttttgcaggggcgcctgaaacagctaaaaaagctttgcaagcaggtaatttccgaggatttaaaattgcagcaaatggtacaatttgggcattcgctggattgggatttggtttaggagtactgggtgctctttcaacgcaaactttgacagatttatttgctctcattccccctgttttgcttaatggtctaaccttagctgggaaaatgcttcctgcaattggttttgcgatgattctctctgtaatggctaaaaaagaactcattccttatatcctacttggatatgttctagctgtttattttggtttgccagttctaactccaacagcaaatggagacggagttttaacatcagtggctactaacagtgtgcttggggttccaactatcggggtagctataattgcaacaatatttgctttgcttgatattttcagaaaaccagctgcacctactaaagaaactaagacagaaggagacaaccaagatgactggatc

SEQ ID NO: 2350 - protein, 288 aa, Streptococcus agalactiae
MDISILQAVLIGLWTAFCFSGMLLGLYTNRCIVLSLGVGVILGDIQTALAVGAISELAYMGFGVGAGGTVPPNPIGPGIFGTLMAITTAGTKGKITPEAALALSTPIAVGIQFLQTATYTAFAGAPETAKKALQAGNFRGFKIAANGTIWAFAGLGFGLGVLGALSTQTLTDLFALIPPVLLNGLTLAGKMLPAIGFAMILSVMAKKELIPYILLGYVLAVYFGLPVLTPTANGDGVLTSVATNSVLGVPTIGVAIIATIFALLDIFRKPAAPTKETKTEGDNQDDWI

SEQ ID NO: 2351 - DNA, 780 bp, Streptococcus pyogenes
atggatatcaatttgttacaggcacttttaattggtctttggacagccttttgtttcagcggaatgttacttggcatctacaccaaccgttgtattattctgtcttttggtgtagggattatcttaggtgacttgccaactgcacttagcatgggagctatctccgaattagcttatatgggatttggagtgggtgccggtggtaccgttcctcctaatcctatcggccctggtatctttggtaccttgatggctattaccagtgctggtaaagtcaccccagaagcggcactagccttatcaacaccaatcgcagttgccatccaattccttcaaacattcgcctatacagcttttgctggcgctcccgaaaccgctaaaaaacaattgcaaaaaggcaatattagaggcttcaaattcgctgccaacggcactatctgggctttcgcttttatcggattaggccttggtttattaggtgccttgtcaatggatactctccttcacttggttgattatatcccacctgtcttgctcaatggattgactgtcgctggtaaaatgttacctgctatcggatttgccatgatcttatctgttatggccaagaaagaattgattccttttgtactaattggttatgtttgtgcagcctacctccaaattccaaccattggtatcgccattattggtatcattttcgccttgaatgaattttacaacaaacctaaacaagtcgatgcaacaactgtccaaggaggccaacaagatgactggatc

SEQ ID NO: 2352 - protein, 260 aa, Streptococcus pyogenes
MDINLLQALLIGLWTAFCFSGMLLGIYTNRCIILSFGVGIILGDLPTALSMGAISELAYMGFGVGAGGTVPPNPIGPGIFGTLMAITSAGKVTPEAALALSTPIAVAIQFLQTFAYTAFAGAPETAKKQLQKGNIRGFKFAANGTIWAFAFIGLGLGLLGALSMDTLLHLVDYIPPVLLNGLTVAGKMLPAIGFAMILSVMAKKELIPFVLIGYVCAAYLQIPTIGIAIIGIIFALNEFYNKPKQVDATTVQGGQQDDWI

SEQ ID NO: 2353 - DNA, 255 bp, Streptococcus agalactiae
atgccagtaactaatttaattcccgttaaaatagtattcatagccacaaagaacagaatcggtcccatcaccaaaccatctgtcgctaaagaggctgcaatcgttgagaacaagggtgctaagcaaaattgtgataaagaatcaccgatacctgcaagaggccccataagcgccatcttaataccgcgaatttcttcttctggccgctcattatcaagcattgctaaatgtaagctagttacaaaaggtaagaaa

SEQ ID NO: 2354 - protein, 85 aa, Streptococcus agalactiae
MPVTNLIPVKIVFIATKNRIGPITKPSVAKEAAIVENKGAKQNCDKESPIPARGPISAILIPRISSSGRSLSSIAKCKLVTKGKK

SEQ ID NO: 2355 - DNA, 885 bp, Streptococcus agalactiae
ttgctttgcttgatattttcagaaaaccagctgcacctactaaagaaactaagacagaaggagacaaccaagatgactggatctaaaaaattagcaaaaagtgattacactaaaacagctttacgtgccttttatttacaaaatggctttaattacagtaactatcaaggtcttggttatgctaatgtcatatatccagctctcaaaaaatattatggagatgacaaaaaagctttagcgggagctctagaagaaaatgtggagttttacaatacaaaccctcatttcttaccttttgtaactagcttacatttagcaatgcttgataatgagcggccagaagaagaaattcgcggtattaagatggcgcttatggggcctcttgcaggtatcggtgattctttatcacaattttgcttagcacccttgttctcaacgattgcagcctctttagcgacagatggtttggtgatgggaccgattctgttctttgtggctatgaatactattttaacgggaattaaattagttactggcatgtatggttatcgtcttgggaccagttttattgataaattgagtgaacaaatgtcagttatctcacgggcagctaatatcgttggtgtaacggtcatctcaagtttagctgcaacacaagttaagcttacaatcccttacacttttgctccagaaaaagtaactagtacaacgcaaaagattgttactgtccaaggtatgcttgataaaattgcaccagctctacttccagcactctacactttccttatgttttaccttattaaaaataaaaaatggacaacttataagttagttatccttacagttattattggtatccttggtagctggttaggtattttagct

SEQ ID NO: 2356 - protein, 295 aa, Streptococcus agalactiae
MLCLIFSENQLHLLKKLRQKETTKMTGSKKLAKSDYTKTALRAFYLQNGFNYSNYQGLGYANVIYPALKKYYGDDKKALAGALEENVEFYNTNPHFLPFVTSLHLAMLDNERPEEEIRGIKMALMGPLAGIGDSLSQFCLAPLFSTIAASLATDGLVMGPILFFVAMNTILTGIKLVTGMYGYRLGTSFIDKLSEQMSVISRAANIVGVTVISSLAATQVKLTIPYTFAPEKVTSTTQKIVTVQGMLDKIAPALLPALYTFLMFYLIKNKKWTTYKLVILTVIIGILGSWLGILA

SEQ ID NO: 2357 - DNA, 879 bp, Streptococcus pyogenes
atgaattttacaacaaacctaaacaagtcgatgcaacaactgtccaaggaggccaacaagatgactggatctaataaattaaccaagaaagattacctcaaaacagctctgagagctttcttcctacaaaatgggtttaattacaataattaccaaggtatcggatacgccaatgtcatctatcctgccttgaaaaaacattttggcaatgataaaaagggcttatatcaagctttagaagataactgtgagttttacaatactaatcctcacttccttcctttcatcaccagtctgcacttggtcatgttagaaaataatcgccctgaagaagaaacccgaaacatcaaaatggcacttatggggcctttagctggtatcggtgactccttatcacaattttgcttggcgccactcttttcaacgattgcagcttccttagctagtgatggtctggttttgggaccaatcctcttcttcctagccatgaatattatcctaaccgctattaaaattggttctggactctatggctacaaggtcggcacaagctttattgataaattaagtgaacaaatggcggttgtgtcgcgcatggcaaatattgtcggcgttaccgttatcgctggactagcagctacttctgttaaaattactgttcccattacttttgccgctggcaaggtggatgcggccaatacagcacaaaaatttgtgactattcaaggaatgcttgataagattgcccctgcacttttaccagctctctttaccttactcatgtattaccttattaaaaacaaaaaatggacaacctacaaattggtcattttaactgttatcattggtgttattggcagttggttgggtattttagct

SEQ ID NO: 2358 - protein, 293 aa, Streptococcus pyogenes
MNFTTNLNKSMQQLSKEANKMTGSNKLTKKDYLKTALRAFFLQNGFNYNNYQGIGYANVIYPALKKHFGNDKKGLYQALEDNCEFYNTNPHFLPFITSLHLVMLENNRPEEETRNIKMALMGPLAGIGDSLSQFCLAPLFSTIAASLASDGLVLGPILFFLAMNIILTAIKIGSGLYGYKVGTSFIDKLSEQMAVVSRMANIVGVTVIAGLAATSVKITVPITFAAGKVDAANTAQKFVTIQGMLDKIAPALLPALFTLLMYYLIKNKKWTTYKLVILTVIIGVIGSWLGILA

SEQ ID NO: 2359 - DNA, 1902 bp, Streptococcus agalactiae
atgaaagatcgcttatataataaattcaaggattttgatagggaattttgtcaaaagtatattaaaacataccaatctaatgcctatcaagaaatgaaagcctctgttaatttgatgatgaggaacacttttgtatttaatgataattgggatatggaaccttgttctaaagcatattgtcttgatcctttggagtgggataagccagtaacagatgatccagaatggttgtatatgctaaatcgtcaaacttatctttttaaattcctggtggtctacattgttgaaggcgataagtcttaccttagacaaatgaaatattttatgtaccattggattgattgtcaatttacactaaagccagaaggggcggtaagtcgtactattgacactgggatacgttgcatgtcatggctcaaagttttgatttttttagattattttggattaataacagaaactaaaaaaattaaactattaactagtttacgggagcagataacttatatgagggactattatcgtgaaaaagatagtctaagtaactggggaattttacaaacaacagcaatattggcgtgtttatactattatgaagatgaattaaatctacctgaaattcagagttttgctgaagaagaattattacttcaaatcaagcttcaaattttagatgacgggagccagtatgaacaatcaattatgtatcatgtagaagtcttgaagtccttaatggaactagttatccttgcgcctaaatattatctaccattagaagaaactattgaaaaaatggttacctatctaattgctatgactggtccggattattgtcaactagctataggggacagtgatgtgaccgatactcgtgatattctaactttggcaacacttgtgttgaaatcttctaaaacaaaatcattttcttttgataatgttaatttagaaactttacttttgtttgggaagccatcaatttatctttttgaagaaataccgcgtgcgacaataggagagtctgcttatctttttccagattctggtcatgtgtgtttacgtgatgataggcgttatatattttttaagaacggtccatttggtagcgctcatactcatagtgataataatagtgtttgtctctatgataaaaagaaacctattttcattgatgcaggaagatatacttacaaagaagaacaactaaggtatgattttaaacgttcgactagtcattcaacatgtacccttgatgggcaacccttagaaatgatcaaggactcttggacatacaattcttatccaaaatgtgactattgtcagttgacttcaaaggataggtaccatttagtcgaaggacaactacatgtccaaagagcttctgatatctattaccataagcgatggttgttaactttaccgcaggccattaccttagttattgataaggtgagttgtccaggagagcatgtcttaacaaatcaatatattttagatgatcaggtcatttatgaaaatgggtttgttaatgacttgaaattagtaagtcctacgacctttaatctagaagattgccttatttctaagcggtataatcaattgacagaaagtcataaattagttaagaaaataaaatttgttgatgaggtgatggattataccttgatagttgatcggaactgtcaggtgaaatatgttcctttagtgcaaacgaacagtcataaggaactaagtaatagcattgcatttgatattaggtctcaagactttcattatttaattggagtgcttatggatgatattatctttggggataaactctatttgatgcaagggataaaatgcaaaggaaaagtcattgtatatgataaaaataatggcaaaatgagtcgtttaaaaaat

SEQ ID NO: 2360 - protein, 634 aa, Streptococcus agalactiae
MKDRLYNKFKDFDREFCQKYIKTYQSNAYQEMKASVNLMMRNTFVFNDNWDMEPCSKAYCLDPLEWDKPVTDDPEWLYMLNRQTYLFKFLVVYIVEGDKSYLRQMKYFMYHWIDCQFTLKPEGAVSRTIDTGIRCMSWLKVLIFLDYFGLITETKKIKLLTSLREQITYMRDYYREKDSLSNWGILQTTAILACLYYYEDELNLPEIQSFAEEELLLQIKLQILDDGSQYEQSIMYHVEVLKSLMELVILAPKYYLPLEETIEKMVTYLIAMTGPDYCQLAIGDSDVTDTRDILTLATLVLKSSKTKSFSFDNVNLETLLLFGKPSIYLFEEIPRATIGESAYLFPDSGHVCLRDDRRYIFFKNGPFGSAHTHSDNNSVCLYDKKKPIFIDAGRYTYKEEQLRYDFKRSTSHSTCTLDGQPLEMIKDSWTYNSYPKCDYCQLTSKDRYHLVEGQLHVQRASDIYYHKRWLLTLPQAITLVIDKVSCPGEHVLTNQYILDDQVIYENGFVNDLKLVSPTTFNLEDCLISKRYNQLTESHKLVKKIKFVDEVMDYTLIVDRNCQVKYVPLVQTNSHKELSNSIAFDIRSQDFHYLIGVLMDDIIFGDKLYLMQGIKCKGKVIVYDKNNGKMSRLKN

SEQ ID NO: 2361 - DNA, 1923 bp, Streptococcus pyogenes
ttggaaaggaaatgtcctatgttttttgccttcgcacgctttaaagaaacagtcaatccagacttttgcaggaattacctgctagactatcagactgacagctatgctgatcaaaaaagaatagctgacctactcttaaccaatacctttttatttgaagataattgggatatggagccctgccacatcccttaccacttagatcccattacttggcaagaggctgtcatagatgatcctgagtggaactttatgttaaatcgacagacctatctccaaaaattaatcctcgtctaccttgttgaaagagatgaacggtatctcttaacagctaaaggtttcatcctcaattggattgaatcagctattcctttagaccctaaggggttagctactagaaccttagatactggcatccgttgttttgcttgggtcaaatgtttgatttaccttaatctttttaacgccttaaccaagcaagaggaaagcctcatcctagcttccctggaaaaacaacttcaatttctccatgccaactaccttgataaatacagcctcagcaattggggaatcttgcaaaccactgcgattttattagctgatgcctactttggttctgaccttgatattgctgcagcaacagctttcgctagaaaagaattgacgcaacaaatcgcactacaaattctcgaagacggcagtcaatttgaacaatcaaccatgtatcatgtggaagtactcaaagcccttctggaattaactgctctagtccctgattatcttccacagcttagacctactttgcttgccatgagtgattatctcctcaaaatgactggtccagatcataaacaaatccctcttggtgatagcgatgttacagataccagagatattctaacgcttgcagccactatccttgaagaaccacacttaaaagctgctgcttttcccacacttgatatcgatagtcttctccttctaggagaaaaaggtgtccacacttttgaacagttacccgtccaaaccttaccaacttttgcgcatcactttgaacattccgggcacattaccatcaatcaagaaaattattatctttttttcaaaaatgggcccatcggtagttcccatacccatagcgaccaaaatagtctctgtctctattataaaggacaaccacttttctgtgatgctgggcgatacacttacaaagaagaaccattacgctatgccctaaaaagcgctagccatcattctaccgccttcttagaagaacaattacctgagcagattgatagctcctgggcttacctttcttaccccaaatccaattattgtcaccttcgacaaaatggacacgtttactttattgaaggtagctaccagacgcaattctctgataggaacaactaccaacatgaccgacaaattctcatcttaccaccaggaatttttcttatcattgatacgatacaggctcaaggcaaccactgtcttgtcagtcaatttattcttgataatcacttagacgtaaagacagatcaccttagtgacctcagactaatcagtgactgccctttcactatcgaagaaacgattttgtcaaaaaaatacaaccaatacctgactagtcacaaactcatcaaacgaaaaccctttaaagacaagggttgcaccagtaccctattagtccctgacgataccaaagttactcccttaacaccacttcaaacaggcaaacgcaacccaattgagactgccctttcctggcatttaaaaggaaagcagtttgactacagtatctgtgttctccaagaggatttaattaaaggagaaaaactagttctcctaaatagtcataaaatcagaggaaaggtggttgttatcaaccatatcacgaatgagattattcgattgaaacac

SEQ ID NO: 2362 - protein, 641 aa, Streptococcus pyogenes
LERKCPMFFAFARFKETVNPDFCRNYLLDYQTDSYADQKRIADLLLTNTFLFEDNWDMEPCHIPYHLDPITWQEAVIDDPEWNFMLNRQTYLQKLILVYLVERDERYLLTAKGFILNWIESAIPLDPKGLATRTLDTGIRCFAWVKCLIYLNLFNALTKQEESLILASLEKQLQFLHANYLDKYSLSNWGILQTTAILLADAYFGSDLDIAAATAFARKELTQQIALQILEDGSQFEQSTMYHVEVLKALLELTALVPDYLPQLRPTLLAMSDYLLKMTGPDHKQIPLGDSDVTDTRDILTLAATILEEPHLKAAAFPTLDIDSLLLLGEKGVHTFEQLPVQTLPTFAHHFEHSGHITINQENYYLFFKNGPIGSSHTHSDQNSLCLYYKGQPLFCDAGRYTYKEEPLRYALKSASHHSTAFLEEQLPEQIDSSWAYLSYPKSNYCHLRQNGHVYFIEGSYQTQFSDRNNYQHDRQILILPPGIFLIIDTIQAQGNHCLVSQFILDNHLDVKTDHLSDLRLISDCPFTIEETILSKKYNQYLTSHKLIKRKPFKDKGCTSTLLVPDDTKVTPLTPLQTGKRNPIETALSWHLKGKQFDYSICVLQEDLIKGEKLVLLNSHKIRGKVVVINHITNEIIRLKH

SEQ ID NO: 2363 - DNA, 999 bp, Streptococcus agalactiae
atgtctaaaaaaatgaccattaatgacatcgctcaattatcaaaaacttccaaaacaacggtttcttttttcttgaatcaaaaatttgaaaaaatgtcggatgagacgaggcaacgtattcaagaggtgattgatgaaacaggttatagaccaagtacgatagcaagaagtctaaattctaaaaaaacaaaactactaggtgtcttaattggagatataacaaacacattttcaaatcaaattgtaaaaggaattgagcacatcaccaaacaaaaaggctatcaaattattgtgggtaatagtaattacgatgccaaaagtgaagaagattatattgaaaatatgttaaatttaggtgttgatggtttcattattcagcctacatcaaattttcgaaagtattctcgtattttaaaagaaaaaaagaaaccaatggtattttttgatagtcaactttatgaacataagacgagttgggttaaggctaataactatgatgctgtttatgatatgacacaggagtgtctaaatcgagggtataaaaagtttattatgattactgctgatacgagcttgcttagtacacgtattgagagagcttcgggattcatggatgctttaaaggacaatggtttcggttatgacactttggtgattgaagatgatgatcattcaaaaagtgatatagaagactttctaaaagcggtagttccagataaggaggagacattagtatttgcaccaaattgttgggctttaccaatggtttttactgccatgaagaatctcaattttgatatgccacgagttggtttagttgggtttgacaatattgaatggacagacttttcatctcctaaagtgtcaacaattgtccagccggcttatgaagaaggtgaacaagtagcacagattttgattaatcgtattgaaggagatgactccgtcgataaccaacagattgtagattgccagatgttttggaaagagtcgactttt

SEQ ID NO: 2364 - protein, 333 aa, Streptococcus agalactiae
MSKKMTINDIAQLSKTSKTTVSFFLNQKFEKMSDETRQRIQEVIDETGYRPSTIARSLNSKKTKLLGVLIGDITNTFSNQIVKGIEHITKQKGYQIIVGNSNYDAKSEEDYIENMLNLGVDGFIIQPTSNFRKYSRILKEKKKPMVFFDSQLYEHKTSWVKANNYDAVYDMTQECLNRGYKKFIMITADTSLLSTRIERASGFMDALKDNGFGYDTLVIEDDDHSKSDIEDFLKAVVPDKEETLVFAPNCWALPMVFTAMKNLNFDMPRVGLVGFDNIEWTDFSSPKVSTIVQPAYEEGEQVAQILINRIEGDDSVDNQQIVDCQMFWKESTF

SEQ ID NO: 2365 - DNA, 1029 bp, Streptococcus pyogenes
atgactaaccattactattttaaaggagtgtatgcaatgcagcgcaaagtaaccatcaaagatattgctgaattagcgaaaacttcaaaaacaacagtttctttctacttaaatggcaggtttgacaagatgtctgaagaaactaaaaaccgcatcagcgagagtatcaaagctactaattataaaccgagcattgctgctagaagtctcaatgcaaaatcgactaaactcattggtgttgttataggtgacatcacaaacagtttttcaaaccaaattgtcaaaggaattgaaagcaaagcccaggaatttggttaccaaattatcatcggaaacagcaactacgacccttctcgcgaagatgaactcattgaaaagatgctcaatcttggtgttgatggttttattattcaaccaacttctaactttagaaaatattcacgtattatcgatattaaaaaaaagaaggttgtcttttttgatagccaactttacgaacatcgcacaaactgggtcaaaactaataattatgatgctgtttatgataccattcaacaatgtatcgataaaggttatgaacattttatcatgatcacgggtaaccccaatttacttagcactcgtattgaacgcgcttcaggcttcattgatgtgttagaagctaatcatcttactcatcaagaaatgattattgatgaaaatcagacttcttcagaggcaattgctcagtttttgcaaggatcactgactaaaaagagtttggtttttgtccccaattgttgggctcttccaaaagtatttacagctatgaagtctcttaaatttaatataccagagattggactagtaggatttgataacattgagtggacaaaattttcttcaccaacactaacaactattatccaacccgcctatgaagaaggcgaacaggctactaagattttaatcgatgatattgaaggtcacagtcaagaagccaaacaacaaatttttgactgtcaagtcaattggcaagaatcaactttt

SEQ ID NO: 2366 - protein, 343 aa, Streptococcus pyogenes
MTNHYYFKGVYAMQRKVTIKDIAELAKTSKTTVSFYLNGRFDKMSEETKNRISESIKATNYKPSIAARSLNAKSTKLIGVVIGDITNSFSNQIVKGIESKAQEFGYQIIIGNSNYDPSREDELIEKMLNLGVDGFIIQPTSNFRKYSRIIDIKKKKVVFFDSQLYEHRTNWVKTNNYDAVYDTIQQCIDKGYEHFIMITGNPNLLSTRIERASGFIDVLEANHLTHQEMIIDENQTSSEAIAQFLQGSLTKKSLVFVPNCWALPKVFTAMKSLKFNIPEIGLVGFDNIEWTKFSSPTLTTIIQPAYEEGEQATKILIDDIEGHSQEAKQQIFDCQVNWQESTF

SEQ ID NO: 2367 - DNA, 612 bp, Streptococcus agalactiae
atgtctgctattgataaattagtaaaagctagtcatttaattgacatgaatgacattatccgtgaaggcaatccaacccttcgcaaagtggctgaagaagtcacattcccactttctgagaaagaagaaattctcggagaaaaaatgatgcaatttttaaaacactctcaagatccaattatggctgagaagctaggcttacgtggtggtgttggtttagccgcaccacaattagacatctcaaaacgcatcattgccgtccttgttccaaacgttgaggatgctcaaggaaatccacctaaagaagcttatagcctccaagaagtaatgtacaaccctaaagttgtatcgcattctgttcaagatgctgctttatctgacggggagggatgcctatcagtagatcgtgaagtacctggctatgtcgtccgccacgcgcgtgtaactattgaatatttcgacaaaactggtgaaaaacatcgactcaaattaaaaggttacaactctattgttgttcaacatgaaattgaccacattgatggtattatgttttacgaccgtatcaatgagaaaaatcctttcgctgtcaaagaaggcttacttattttagaa

SEQ ID NO: 2368 - protein, 204 aa, Streptococcus agalactiae
MSAIDKLVKASHLIDMNDIIREGNPTLRKVAEEVTFPLSEKEEILGEKMMQFLKHSQDPIMAEKLGLRGGVGLAAPQLDISKRIIAVLVPNVEDAQGNPPKEAYSLQEVMYNPKVVSHSVQDAALSDGEGCLSVDREVPGYVVRHARVTIEYFDKTGEKHRLKLKGYNSIVVQHEIDHIDGIMFYDRINEKNPFAVKEGLLILE

SEQ ID NO: 2369 - DNA, 612 bp, Streptococcus pyogenes
atgtctgcacaagataaattaattaaacctagtcatctgattaccatggatgacattattcgtgaagggaatccaactttaagagctgtcgccaaagaagtgagcttacccttgtgtgatgaggatatcctattaggagaaaagatgatgcaatttttgaagcattctcaagatcctgtaatggcggaaaaacttggtcttagggccggtgttggtctagcagctcctcagattgatgtgtcaaaacgtatcatcgctgtgctcgttcctaatcttcctgataaagaaggaaatcctcctaaagaagcctatagctggcaagaagtcctgtataatcctaaaatcgtttctcattctgttcaagatgcagccctttctgatggcgaaggttgtttatctgtcgatcgtgttgttgaagggtatgtggttcgccatgctcgtgttacagtagactactatgataaagaaggacaacagcatcgcatcaaattaaagggatacaacgctattgtggttcaacatgaaattgaccatatcaatggtgttttgttctacgatcggatcaatgctaaaaacccctttgaaaccaaagaagagctcttgattttagac

SEQ ID NO: 2370 - protein, 204 aa, Streptococcus pyogenes
MSAQDKLIKPSHLITMDDIIREGNPTLRAVAKEVSLPLCDEDILLGEKMMQFLKHSQDPVMAEKLGLRAGVGLAAPQIDVSKRIIAVLVPNLPDKEGNPPKEAYSWQEVLYNPKIVSHSVQDAALSDGEGCLSVDRVVEGYVVRHARVTVDYYDKEGQQHRIKLKGYNAIVVQHEIDHINGVLFYDRINAKNPFETKEELLILD

SEQ ID NO: 2371 - DNA, 684 bp, Streptococcus agalactiae
atgacatatgtcctaaaactatctcaaatagggagtcaatacatggatatagaaaactactgccaagactactgtttggagactatctttccaaaacattatttcaaggatttacaagtaatcaccctaactgccggccaatccgtctgtaaacagggagaacaattagaatacttgcactacatcgtcaagggacgttttaaaattgtacgtcgactctttaacggcaaagaacatattttagatattaaaacaaaaccaacactgattggtgatattgaacttttgactaatagacaaattgtatcatctgttattgccttagaggatcttacagtcattcaattatcacttaaaggacggaaagagaaactgttaacagacgcaactttcctcctaaaacttagtcaagagctagctcaggcttttcatgatcaaaacatcaaagcgtctactaatctagggtataccgtcaaagagttacttgcaagtcatattttagcaattgaagaacaaggttactttcaacttgagttaagtagtttagctgattcgtttggcgtcagttatcgtcatttattaagagttatccacgatatggtcaaagaaggccttatccaaaaagaaaaaccaaaatactttatcaaaaatcgtttcgcactagaatcattaaatattcagcca

SEQ ID NO: 2372 - protein, 228 aa, Streptococcus agalactiae
MTYVLKLSQIGSQYMDIENYCQDYCLETIFPKHYFKDLQVITLTAGQSVCKQGEQLEYLHYIVKGRFKIVRRLFNGKEHILDIKTKPTLIGDIELLTNRQIVSSVIALEDLTVIQLSLKGRKEKLLTDATFLLKLSQELAQAFHDQNIKASTNLGYTVKELLASHILAIEEQGYFQLELSSLADSFGVSYRHLLRVIHDMVKEGLIQKEKPKYFIKNRFALESLNIQP

SEQ ID NO: 2373 - DNA, 267 bp, Streptococcus pyogenes
ttgacacaaaatgtttgccaacaaaacattacctataccgtcaaagagcgctttgcttcctatacccttgaagcgcaagccaaccaagaggttcatctaaaccttacattattagcaaaccgttttggaacaagcgatcgccatcttaagcacgtacttaagcagcccatttttcagaggattatcgaacgcatctgcttcaaaacctatcgtattgccgatttagacgctctaactcaattaagacctctgaggtatgcagcccat

SEQ ID NO: 2374 - protein, 89 aa, Streptococcus pyogenes
LTQNVCQQNITYTVKERFASYTLEAQANQEVHLNLTLLANRFGTSDRHLKHVLKQPIFQRIIERICFKTYRIADLDALTQLRPLRYAAH

SEQ ID NO: 2375 - DNA, 1161 bp, Streptococcus agalactiae
ttgaaaatctttatggagaagctaagtttactctctttatcacttatcttgctatcaactttttcgacatcaccagccctaccacaaatgatatcttattatagagataagggcttaccatcaccccaagttgaattattgttttcaattccttcgatggctattatcttcatcttgcttatcacaccttggttaagtaaaaaactttctgagaaacatatgattatctttgggctattgctaacagcattagggggaggattgccggttgtcagtcagaactaccttttagtatttgtatcgcgtcttttattggggagtggtattggttttattaatactagggccattagtgtgattagtgaatattatcaaggcaaagaaagaagaaaactcttaggattaagggggtcctttgaagttttaggaaatgctggtttgacagctttagttgggctgttgttgacttttggttggtccaaatcatttatgatttattttttagctttaccaatcttagttctatatcttgtttttgcgcctaagaaagtggtgaaagatacaaatgacaagattaaaactaaaggtcaaaaaatccctaaagctgatttaacttatattgtcgccttagctattttagcaggatttgtcataactataaatactgggattaatcttaggatacctctgctagtagtagaatttggtttgggtacgccagctcaagctagtcttgttcttagtgcgatgatgcttatgggaataatagcaggtatgagttttggtcagttgatagctatgtttcataaacaattaattccaatctgcctcgtcttattttctttaacattgcttggagttggattgccttctaatctaatggtactaacaattagtgcgatggcatcaggtttcctttacagcctgatggtcactgctgtgtttagcctagtagcagaccgtgttgaatattcgttggttggttctgcaacgacattagttttagtattttgtaatattggtggagctagtgcggctattcttctgtcttgttttgatcatttactaggacaaataaatgcagttttctatgtttatgctattttaagtttagcagttggtatgatttatttctttaaacgcctattttttaagaaaatg

SEQ ID NO: 2376 - protein, 387 aa, Streptococcus agalactiae
MKIFMEKLSLLSLSLILLSTFSTSPALPQMISYYRDKGLPSPQVELLFSIPSMAIIFILLITPWLSKKLSEKHMIIFGLLLTALGGGLPVVSQNYLLVFVSRLLLGSGIGFINTRAISVISEYYQGKERRKLLGLRGSFEVLGNAGLTALVGLLLTFGWSKSFMIYFLALPILVLYLVFAPKKVVKDTNDKIKTKGQKIPKADLTYIVALAILAGFVITINTGINLRIPLLVVEFGLGTPAQASLVLSAMMLMGIIAGMSFGQLIAMFHKQLIPICLVLFSLTLLGVGLPSNLMVLTISAMASGFLYSLMVTAVFSLVADRVEYSLVGSATTLVLVFCNIGGASAAILLSCFDHLLGQINAVFYVYAILSLAVGMIYFFKRLFFKKM

SEQ ID NO: 2377 - DNA, 1218 bp, Streptococcus pyogenes
atgtcaacattatcattggacaccacaaataagcgagctttagtggcagctattgcagcttcaggaacggatgacttgaatgtcatgtttcttgccttttccatgtcttccattatgacagacttgggtcttagtggcactcagggtggctggattgcgaccattaccaatttaggaatgttggtgggaggcctcttattcgggttgctggctgataggcaccacaagtttaaggtctttaaatggacgattttactgttttcagtagcaacaggattaatttattttacccagtctttgccctacctgtacctgatgcgatttattgctggcataggagttggaggtgagtacggtgtagccattgccataatggcagggattgtaccaccagaaaaaatgggtcggatgtcttctttaaatggtattgctggccagcttggctctattagttcggctcttttagcagggtggctggctccaagtctaggctggcgtggcctttttctctttggattacttccgattctcttggtgatttggatgactttagccatagatgaccaaaaaatttgggatcattatgggcaagaggaggaagaatgcagtcaaccaattaaaatcaatgaactattcaaaacaaaatccttaacagctcaaacccttgctttaatggtcatgacgactgtgcagattgcgggctattttggaatgatgaattggttgccaaccattattcaaacaagcttaaacctttcagtaaaaagttcgtccttgtggatggtggctactattgtcggcatgtgtttggggatgctgtattttggtcagcttttagattgctttggtccacgtctgatttattccctctttttattagcatcatctatttgtgtttacctttttcaatttgccaattccatggcgagtatggttattggaggtgctattgtcggtttttttgtcaatgggatgtttgctggctacggggctatgattaccagactttatccccatcacattcgatccacggctaataatgttattttgaatgttggccgtgctctaggaggattttcgtccgttgctattggtagtattttagatgcctcaggtatttcaatggtcatgattttcctagcttctctgtatgtgattagttttggagccatgtggtctattggtcagttaaaagcagaacgctaccaacaattgcgt

SEQ ID NO: 2378 - protein, 406 aa, Streptococcus pyogenes
MSTLSLDTTNKRALVAAIAASGTDDLNVMFLAFSMSSIMTDLGLSGTQGGWIATITNLGMLVGGLLFGLLADRHHKFKVFKWTILLFSVATGLIYFTQSLPYLYLMRFIAGIGVGGEYGVAIAIMAGIVPPEKMGRMSSLNGIAGQLGSISSALLAGWLAPSLGWRGLFLFGLLPILLVIWMTLAIDDQKIWDHYGQEEEECSQPIKINELFKTKSLTAQTLALMVMTTVQIAGYFGMMNWLPTIIQTSLNLSVKSSSLWMVATIVGMCLGMLYFGQLLDCFGPRLIYSLFLLASSICVYLFQFANSMASMVIGGAIVGFFVNGMFAGYGAMITRLYPHHIRSTANNVILNVGRALGGFSSVAIGSILDASGISMVMIFLASLYVISFGAMWSIGQLKAERYQQLR

SEQ ID NO: 2379 - DNA, 981 bp, Streptococcus agalactiae
atgattgaaaaatattataattgggcaacgcttggaaccggcgttattgccaacgaattagcccaagcactagaagcacgtggacaaaaattatattctgtagctaatagaacttacgacaaaggacttgaatttgctaccaaatatggtatccaaaaagtttatgatcacatagatcaagtatttgaagaccctgaagtggatatcatttatatctctactccccacaatactcacatctcatttttacgaaaggctttagcaaatggtaagcacgttctttgcgaaaaatctattactttaaacagcactgaacttaaagaagccatagatttagccgaaactaaccatgttgtcttagctgaagccatgactatttttcatatgccaatttatcgccaattaaaaacattagttgatagtggaaaattaggaccgttaaaaatgattcaaatgaatttcggaagttataaagaatatgatatgactaaccgttttttcagtcgtgacctagcaggcggtgctttgctggacattggtgtttatgcactttcttgtattcgctggtttatgtcagaagcacctcacaacattacctctcaagttacatttgcaccaacaggagttgatgaacaagttggtatcctactaaccaatcctgcaaatgagatggcgactgtcagccttagtttacatgcaaaacaacctaaacgagcaactatcgcttacgataaaggctacattgaactttttgaatatccgcgaggacaaaaggcagttattacttatactgaggatgggcatcaagatattctcgaagctggcaaaactgaaaatgccctccaatatgaggtagctgatatggaagaagccgtttcaggaaaaactaaccacatgtacttaaactataccaaagacgttatggatatcatgacacagctacgtcaagaatggggatttacctacccagaagaagaaaaa

SEQ ID NO: 2380 - protein, 327 aa, Streptococcus agalactiae
MIEKYYNWATLGTGVIANELAQALEARGQKLYSVANRTYDKGLEFATKYGIQKVYDHIDQVFEDPEVDIIYISTPHNTHISFLRKALANGKHVLCEKSITLNSTELKEAIDLAETNHVVLAEAMTIFHMPIYRQLKTLVDSGKLGPLKMIQMNFGSYKEYDMTNRFFSRDLAGGALLDIGVYALSCIRWFMSEAPHNITSQVTFAPTGVDEQVGILLTNPANEMATVSLSLHAKQPKRATIAYDKGYIELFEYPRGQKAVITYTEDGHQDILEAGKTENALQYEVADMEEAVSGKTNHMYLNYTKDVMDIMTQLRQEWGFTYPEEEK

SEQ ID NO: 2381 - DNA, 1893 bp, Streptococcus agalactiae
atgataaaatatcaagatgatttttaccaagcggttaatggggagtgggctaagacagctgttattcctgatgacaaaccaaggacaggtggtttttctgatcttgctgatgacattgaagcattaatgctgtcaacgacagataagtggctggctgatgaaaataaaccaagtgatacgattttaaatcattttattgcttttcataaaatgacagctgattatcaaaaacgtgaagaggtaggagtatcaccagtattaccattaattgaagaatataaaggcctacaatctttctctgagtttgcatcaaaagttgcagaatatgaactagagggtaaaccaaatgaatttccatttggtgtggctcctgactttatgaatgctcaattgaatgtactttgggctgaagcgcctgggattattttaccagatacaacttattatagtgaagataatgaaaaaggaaaggaactccttgctttttggcgtaaaagtcaagaagacctactgcctttgtttggcctttcagaacaggaaattaaagatatcttggataaggttttagcattggatgcaaaattggcacaatatgtcttatctcgcgaagagagttcggaatatgttaaactttaccatccttataactgggaagatttcacaaaattagcacctgaacttccattagatgctattttccaaaagatattaggacaaaaaccagataaagttattgttcctgaagaacgtttctggacagaatttgcatctgactattactcagaatctaattgggaattattaaaggcagatcttattttatcagctgcgaatgcctataatgcttacttaactgatgatattcgtatcaaatcgggagtttacagtcgagctttatcaggcacaccacaagcaatggataagaaaaaagcagcttactaccttgcttcaggaccttacaatcaagctctaggtttgtggtatgcaggagaaaaattctctccagaagctaaagctgatgttgagcataagattgcaacgatgattgatgtctataagtcacgcttagaaaaggcggattggcttgcacagtcaacgcgagaaaaagctattatgaaacttaatgttatcacaccacatattggataccctgagaaactaccagagacttatactaaaaaaatcattgatcctaaactatcgcttgtcgaaaatgctactaatttagacaaaatttcaatagcctatggttggagtaaatggaataaaccagttgatagaagtgaatggcatatgcctgcccacatggtcaatgcgtattatgatccacaacaaaaccaaattgtcttcccagcagccattttacaagaaccattttatgctttagagcaaagttcatcagcaaattatgggggaattggtgcagtgattgcacatgaaatatcacacgcttttgacactaatggagcttcatttgatgaacatggaagtttgaataattggtggactgatgaagattttgaagctttcaaaaaacttacagataaagtagttgagcagtttgatggactggaatcttatggcgcaaaagtcaatggtaaactaacagtatcagaaaatgttgcagatttaggtggagttgcttgtgctttagaagctgcgcagcgtgagtcagatttttcagcgagggatttctttattaactttgcgacaatttggcgtatgaaggcacgtgatgagtatatgcaaatgttagctagtgtagatgttcacgccccagcacaatggcgaactaatattacagtaacgaattttgaagaattccataaagagtttgatgttaaagatggtgataacatgtggcgtccagttgaaaaacgtgttattatttgg

SEQ ID NO: 2382 - protein, 631 aa, Streptococcus agalactiae
MIKYQDDFYQAVNGEWAKTAVIPDDKPRTGGFSDLADDIEALMLSTTDKWLADENKPSDTILNHFIAFHKMTADYQKREEVGVSPVLPLIEEYKGLQSFSEFASKVAEYELEGKPNEFPFGVAPDFMNAQLNVLWAEAPGIILPDTTYYSEDNEKGKELLAFWRKSQEDLLPLFGLSEQEIKDILDKVLALDAKLAQYVLSREESSEYVKLYHPYNWEDFTKLAPELPLDAIFQKILGQKPDKVIVPEERFWTEFASDYYSESNWELLKADLILSAANAYNAYLTDDIRIKSGVYSRALSGTPQAMDKKKAAYYLASGPYNQALGLWYAGEKFSPEAKADVEHKIATMIDVYKSRLEKADWLAQSTREKAIMKLNVITPHIGYPEKLPETYTKKIIDPKLSLVENATNLDKISIAYGWSKWNKPVDRSEWHMPAHMVNAYYDPQQNQIVFPAAILQEPFYALEQSSSANYGGIGAVIAHEISHAFDTNGASFDEHGSLNNWWTDEDFEAFKKLTDKVVEQFDGLESYGAKVNGKLTVSENVADLGGVACALEAAQRESDFSARDFFINFATIWRMKARDEYMQMLASVDVHAPAQWRTNITVTNFEEFHKEFDVKDGDNMWRPVEKRVIIW

SEQ ID NO: 2383 - DNA, 1893 bp, Streptococcus pyogenes
atgacaacttatcaagatgatttttaccaggctgtgaatggaaagtgggctgaaacagcagttattccagacgacaagcctcgaacaggtggattttcagacttagcagatgaaattgaggcattaatgctagacactacagatgcttggctagctggagaaaatatccctgatgatgctattttaaaaaattttgtgaaattccatcgtttggtggctgactacgctaaacgtgatgaagttggagtaagtccaattctccctttaattgaagaatatcagtccttaaaatctttttcagaatttgttgctaatatagcgaaatatgaattggcaggtttaccaaatgaatttccctttagtgtggcaccagactttatgaatgctcagctgaatgtgctttgggcagaagcaccaagcattcttttgccagatacaacatactacgaagaaggcaacgaaaaagctgaggaattgcgtggtatttggcgtcagtcgcaagaaaagcttttacctcaatttggtttttcaacagaagaaatcaaggatcttttggataaggtaattgagctagataagcaattggccaagtatgtcttgtctcgtgaggaaggctcagaatatgccaaattataccatccttatgtgtgggctgattttaaaaaactagctccagagcttcctttggatagcatttttgaaaagattttaggccaagtacctgacaaggttattgttcctgaggaacgtttttggacagaatttgcagccacttattactctgaagccaattgggatttactcaaggctaatttgattgtggacgcggctaatgcttacaatgcttacttgacggatgatattcgtgtggaatcaggcgcttattcgcgcgctctttcaggaacacctcaagctatggacaaacaaaaagcagccttttatttggcgcaaggaccgtttagccaagcgcttggcttgtggtatgctggtcaaaaattctccccagaagctaaggctgatgtggaaagtaaggtagcacgcatgattgaggtttataagtctcgtctagaaacggctgattggttagcaccagccacacgtgaaaaagccattactaaattaaatgttatcacgccacatattggttacccagaaaaattaccagaaacctatgctaaaaaagtgattgatgagagcttgtcattggttgaaaatgcacagaacttggctaaaatcacgattgctcacacttggagtaaatggaacaagccagttgaccgtagtgaatggcatatgccagcccacttagtcaatgcttattatgatcttcagcaaaatcagattgtctttcctgcggcaatcttacaagagccattttattctttagatcagagttcttcagccaattatggaggaattggtgcagtcattgcgcatgagatttcacatgcctttgacaccaatggtgcttcctttgatgaacatggtagcctaaatgattggtggacacaagaagactatgctgcctttaaagagcgcacagataagattgtggcgcagtttgacggcttagagtcacatggtgctaaggtcaatggtaaattgacagtttcagaaaacgtcgctgatctaggtggggtagcttgtgctttagaagcggcacaatcagaagaagacttctcagcccgtgacttctttattaactttgcgacgatttggcgtatgaaggcccgtgaggaatacatgcaaatgctagctagcattgatgttcatgctccgggtgaactgcgaacaaatgtcaccttaaccaactttgatgctttccatgagacctttgatattaaagaaggcgatgctatgtggagagctccgaaagaccgtgtgattatttgg

SEQ ID NO: 2384 - protein, 631 aa, Streptococcus pyogenes
MTTYQDDFYQAVNGKWAETAVIPDDKPRTGGFSDLADEIEALMLDTTDAWLAGENIPDDAILKNFVKFHRLVADYAKRDEVGVSPILPLIEEYQSLKSFSEFVANIAKYELAGLPNEFPFSVAPDFMNAQLNVLWAEAPSILLPDTTYYEEGNEKAEELRGIWRQSQEKLLPQFGFSTEEIKDLLDKVIELDKQLAKYVLSREEGSEYAKLYHPYVWADFKKLAPELPLDSIFEKILGQVPDKVIVPEERFWTEFAATYYSEANWDLLKANLIVDAANAYNAYLTDDIRVESGAYSRALSGTPQAMDKQKAAFYLAQGPFSQALGLWYAGQKFSPEAKADVESKVARMIEVYKSRLETADWLAPATREKAITKLNVITPHIGYPEKLPETYAKKVIDESLSLVENAQNLAKITIAHTWSKWNKPVDRSEWHMPAHLVNAYYDLQQNQIVFPAAILQEPFYSLDQSSSANYGGIGAVIAHEISHAFDTNGASFDEHGSLNDWWTQEDYAAFKERTDKIVAQFDGLESHGAKVNGKLTVSENVADLGGVACALEAAQSEEDFSARDFFINFATIWRMKAREEYMQMLASIDVHAPGELRTNVTLTNFDAFHETFDIKEGDAMWRAPKDRVIIW

SEQ ID NO: 2385 - DNA, 828 bp, Streptococcus agalactiae
gtgtcattctctaagcactatctagaaaatgatatcctctattctgcttcgattactagccgtgtagaagatttacatgaagcatttgccgacccttctgttgatgccatattagcaaccattggcggattcaattccaacgagcttttaccatatttagattatgatttaatctctaagaatcccaaaataatttgtggttactcagattcaacggccttccttaatgctatttttgccaaagcaaaaatccaaacttacatgggccctgcttattcttctttcaaaatgaaggaaggtcaaccttaccaaacacaagcttggcttactgccatgacagaaaaccactatgaactttggcctagtgaagaatggtctagtgatccctggtatgatcccagcaaaccacgccaatttttcccaacagaatggaaaatttataatcacggaaaagcttccggtacgattatcggaggtaatctctctacgtttggcctacttcgaggtactccttatgcaccgaaaattgaacgctatgtcctcttgattgaagaggctgaggaaagtaatttttatgaatttgaccgcaaccttgctgcaattttacaagcttatcctcatccacaagctattcttatggggcgctttcctaaagaatgcggcatgactccacaagtctttgaatatatcctttcaaaacatgctattttcaaggaaattcctgttatttatgatatggattttgcgcacacccaacctcttttgacagtgactattggagctgagctaagcgttgacactactacattatctctatctataaaagaa

SEQ ID NO: 2386 - protein, 276 aa, Streptococcus agalactiae
MSFSKHYLENDILYSASITSRVEDLHEAFADPSVDAILATIGGFNSNELLPYLDYDLISKNPKIICGYSDSTAFLNAIFAKAKIQTYMGPAYSSFKMKEGQPYQTQAWLTAMTENHYELWPSEEWSSDPWYDPSKPRQFFPTEWKIYNHGKASGTIIGGNLSTFGLLRGTPYAPKIERYVLLIEEAEESNFYEFDRNLAAILQAYPHPQAILMGRFPKECGMTPQVFEYILSKHAIFKEIPVIYDMDFAHTQPLLTVTIGAELSVDTTTLSLSIKE

SEQ ID NO: 2387 - DNA, 726 bp, Streptococcus pyogenes
gtggatgtcatcatgacttccataggtggctacaattctaattctgtattaaagtatatagactacgatctatttaaacagaaatttcctatctttattggatattctgacacaacagctcttgctttagccttatataaaaagactggatgtataacttacctgtctcagagcgttatctctaattttggagagtttgaaccgtttaatgaattaaattatttctattttgacttcatgcttcagagtaagtgcgaaaccttaatggtacaaataccagatgtttggacggatgagtggataaattgggaaacctatgaaagaaccaaaaaaacaaataaaaatgagtggattatttttaacaaaggtgaatttaatggtactttgatcggaggaaatctcgataccattgtaggaataataggaactgagtatatgccaaaaataacagaggataccatactcttgttagaagatgtatatacggatctaggaagactatataggaatttcacaacgcttgccttacatggtatttttgataaaataggaggacttattatttcaaaatttgaaacaataggggaaaatagcgatgttattaatgatatcattaatgaatttgtagggcatagaaagattcctattttattgaattttgattgtggtcatacccatcctagctgtttaatgcctattggtggtaaaattacgttgagtttaagc

SEQ ID NO: 2388 - protein, 242 aa, Streptococcus pyogenes
VDVIMTSIGGYNSNSVLKYIDYDLFKQKFPIFIGYSDTTALALALYKKTGCITYLSQSVISNFGEFEPFNELNYFYFDFMLQSKCETLMVQIPDVWTDEWINWETYERTKKTNKNEWIIFNKGEFNGTLIGGNLDTIVGIIGTEYMPKITEDTILLLEDVYTDLGRLYRNFTTLALHGIFDKIGGLIISKFETIGENSDVINDIINEFVGHRKIPILLNFDCGHTHPSCLMPIGGKITLSLS

SEQ ID NO: 2389 - DNA, 99 bp, Streptococcus agalactiae
ttggctaataggttagcctcaaaaccacccagacgctcaatggaagaagagggactaagaacacgaatgtggctgccttttgttaattttttcattggt

SEQ ID NO: 2390 - protein, 33 aa, Streptococcus agalactiae
MANRLASKPPRRSMEEEGLRTRMWLPFVNFFIG

SEQ ID NO: 2391 - DNA, 237 bp, Streptococcus agalactiae
atgatgtctcaattatctttggaagaacaattgaatcgactaaaagataaatacctttcttctaaaaatcaagaattttcaaatgttcacttaagtaaagtaaagaagaaaaagaagaaattaataatacttgaaaaagaaagatgtcgctgtcgattggagagagaagatactaaaaaaatcgatgataaaattgagaaattgaagaaagaattgatagatgttatgaaggaggaa

SEQ ID NO: 2392 - protein, 79 aa, Streptococcus agalactiae
MMSQLSLEEQLNRLKDKYLSSKNQEFSNVHLSKVKKKKKKLIILEKERCRCRLEREDTKKIDDKIEKLKKELIDVMKEE

SEQ ID NO: 2393 - DNA, 2067 bp, Streptococcus agalactiae
atggaagaaactattctaatagtcagctttctcctgtttttgattttatctaatgttatcaataggatatttcctaaattaccattaccatttatccagttggtctttgggattctctctggcttagtttttcataagtcacaagtccatatcgatcctgagttattccttgcctttgttattgctcctttgaactttagggaaggtcaagaaagtgatattggtagttttataaagtatcgggctattattctttacttaatcttaccaacggtatttttaacagctattgtcgttggttatgtagcagggcaccttttgccagttagtttaccacttgcggcatgctttgcgcttggagcagccttaggcccaacagatgccgttgcctttatatcgattgctaagaggtttcaatttcctaaacgggcagaaaatatcctcaaattggaaggtcttttaaatgacgctagtggtctagtttccttccagtttgctttaacagcccttgtaacaggttatttctccttagcaaaagctagtctcaagttagcattggccataatgggtggttttttaattggcttgctttttgcttttctaatgaggttatgtctcactgtcctagagaaatttgatgctgctgatgttacaggggctctacttttggaattaaccttaccttttgttgcttatttcgttgctgatttgttgggattttcagctattattgcggtggtagtggcaggagtaatgcaagcaaatcgtttgaaaaaagtgactctctttgatgctcaagtagatcgcgttacctctgttatttgggaaaccttaaattttattttaaatggtttagttttcttaatatttggaagagaactgacacgtatcattggtcctcttttaacaagtaacgcttatagtaattttgatcttattagtattgttgttttagttacttgcacactttttctagttcgctttctagcagtttcttgcttttatgcttggagatctttcaaataccataaatcatttaaaaagtattggagagagattcaactgttgactttttcaggagttaaaggaagtgtttccatagcaacaatactcttattacccaagcactcagtcataggagagttggggtatagtttgattcttttcactgttggtgcagtaacgctaatgagttttttaacgggacttttagtattaccaaagttagcgcctcccttacaggtgaaagatgattatttaatacgtctatcgattttaacaaaagtattatctgtcttagaagaagatggtaagagttctgaaaatcaagcttcattttatgcagttatagataattataatagccgtattcgtcatctcattttagaacaagaatctagtgacattaagaaggacttagctgaattgcaactgatgatgcttagtatagaaagcgatggacttgaagctgcttatcgttatggcaatatttctatcaaagaatatcgtatttaccaacgttatttaaaatacttagaacgccaagttaatcgtagctttgtgtcaaatatcacttatagtttaacgattcttatgcgtgttattcgtggtattgttcatgagtttttaacatttggacaaggaatacgaaatcggaaaaaacatttcaaaaacaggaaacggttgttagcagaagtcaatcgtcagcacttaacagatttgtacttatcaaataatgacctcattttagaaacgctagaagatatggaaggttattataatgcaactttgatagatttcttacaaaatgaacgcattcgagacgcagaattaattaaatcaggtttatttgtagaacgtgtcattgcacgcataacgccagatattttaaatgaaaccctaagaggatattacttggaacgcagaacaatctctgaatttgaaagggacggtttaattagttctaaagagtctcaaattttaagggataatgtcaatgaattagaaagctattcattaagagatagtcaatcttctataccttatcaattattggatttaaaaaaa

SEQ ID NO: 2394 - protein, 689 aa, Streptococcus agalactiae
MEETILIVSFLLFLILSNVINRIFPKLPLPFIQLVFGILSGLVFHKSQVHIDPELFLAFVIAPLNFREGQESDIGSFIKYRAIILYLILPTVFLTAIVVGYVAGHLLPVSLPLAACFALGAALGPTDAVAFISIAKRFQFPKRAENILKLEGLLNDASGLVSFQFALTALVTGYFSLAKASLKLALAIMGGFLIGLLFAFLMRLCLTVLEKFDAADVTGALLLELTLPFVAYFVADLLGFSAIIAVVVAGVMQANRLKKVTLFDAQVDRVTSVIWETLNFILNGLVFLIFGRELTRIIGPLLTSNAYSNFDLISIVVLVTCTLFLVRFLAVSCFYAWRSFKYHKSFKKYWREIQLLTFSGVKGSVSIATILLLPKHSVIGELGYSLILFTVGAVTLMSFLTGLLVLPKLAPPLQVKDDYLIRLSILTKVLSVLEEDGKSSENQASFYAVIDNYNSRIRHLILEQESSDIKKDLAELQLMMLSIESDGLEAAYRYGNISIKEYRIYQRYLKYLERQVNRSFVSNITYSLTILMRVIRGIVHEFLTFGQGIRNRKKHFKNRKRLLAEVNRQHLTDLYLSNNDLILETLEDMEGYYNATLIDFLQNERIRDAELIKSGLFVERVIARITPDILNETLRGYYLERRTISEFERDGLISSKESQILRDNVNELESYSLRDSQSSIPYQLLDLKK

SEQ ID NO: 2395 - DNA, 96 bp, Streptococcus agalactiae
ttggggcgaatttggggcgaaacaaccaaaaaccttgataaaccaaggttttcaaatccgtctaccgccttaaatataaaagattttatccaaaga

SEQ ID NO: 2396 - protein, 32 aa, Streptococcus agalactiae
MGRIWGETTKNLDKPRFSNPSTALNIKDFIQR

SEQ ID NO: 2397 - DNA, 1128 bp, Streptococcus agalactiae
ttgccaatctggcaagtcttttcttgtactcattttatcagaaatgaggtaaaaaaacaaatggcatcatatcgaaaaagagagaacgggctgtgggaataccgcatttcctacaaaaccatagatggaaaatataaacggaaagagaaaggtggttttaagaccaagaagcttgctcaggcggcagcaatcgaaattgaaaagaaattgacccaaaacatcttgacaaatgacgaagtaactctatatgactttgtcaagacctggtcagaagtctataagcgtccgtatgtaaaagataagacttgggaaacctattcaaaaaactttaagcacatcaagaactatttccaagagttgaaggtcaaagatattacaccgctttactaccaaaaaaagttgaatgagtttggcgagaaatatgcccaagaaactcttgagaaatttcactatcaaataaaaggggctatgaaagttgctgtaagggaacaggttgttacctttaattttgcagaaggtgcaaaagtgaaatctcaggtagagcccaaaaatgaagaggaagattttttagaggagcgcgaatataaggctctcttggcccttacaagagagaacatccaatatgtatcctatttcactctttaccttcttgcagtcacaggactgcgtttttctgaggctatggggctaacctggagcgatatagacttcaaaaatggcattttggatataaacaagagttttgattactcgaatactcaagattttgcagatctgaagaatgagtcatcaaaaagaaaagttccaattgattcaaatacaatagatattcttcgagaatataagaaaaatcattggcaagctaatatcaagaatagagtgtgctttggtgtatctaattcagcttgcaataaactgattaagaaaattgtgggtaggaaagtcagaaatcactcattacggcacacatacgcttcgtttttgattttgaacggggttgacattgtgacaatttctaagctccttggacatgaaagtccagatattactctgaaagtttatacacatcagatggaagcactggctgagagaaattttgagaaaatcaaaaatatttttttagtcgca

SEQ ID NO: 2398 - protein, 376 aa, Streptococcus agalactiae
MPIWQVFSCTHFIRNEVKKQMASYRKRENGLWEYRISYKTIDGKYKRKEKGGFKTKKLAQAAAIEIEKKLTQNILTNDEVTLYDFVKTWSEVYKRPYVKDKTWETYSKNFKHIKNYFQELKVKDITPLYYQKKLNEFGEKYAQETLEKFHYQIKGAMKVAVREQVVTFNFAEGAKVKSQVEPKNEEEDFLEEREYKALLALTRENIQYVSYFTLYLLAVTGLRFSEAMGLTWSDIDFKNGILDINKSFDYSNTQDFADLKNESSKRKVPIDSNTIDILREYKKNHWQANIKNRVCFGVSNSACNKLIKKIVGRKVRNHSLRHTYASFLILNGVDIVTISKLLGHESPDITLKVYTHQMEALAERNFEKIKNIFLVA

SEQ ID NO: 2399 - DNA, 402 bp, Streptococcus agalactiae
atggcattatttggtggcaaagacaaagaacctgaagtagaaatttttacagctgagccaaacgagcgagtttttgagtttaagaaatcaaagacgatagtaagaatagatgactactttatcagaattgcaagaaaaagcaacatgtcaaatatgcttctacatggacttgatggcgaaaaatcaattttgttatcagcaataactgcatatcaattaaaagagccaggggcaacggttggatatttacaattggtatatcctggatcagcagatactaaaggtggtgtctttgatgctgttaaggatgagaatacagtcacttttgtcaaagaagataaacaagccatcttagaattgaagatagcaatagaaaccgcattaaaaaataaggttcagaaa

SEQ ID NO: 2400 - protein, 134 aa, Streptococcus agalactiae
MALFGGKDKEPEVEIFTAEPNERVFEFKKSKTIVRIDDYFIRIARKSNMSNMLLHGLDGEKSILLSAITAYQLKEPGATVGYLQLVYPGSADTKGGVFDAVKDENTVTFVKEDKQAILELKIAIETALKNKVQK

SEQ ID NO: 2401 - DNA, 384 bp, Streptococcus agalactiae
ttgcctatgaaactagaccaactctgtaaagagtttggagtggaattgtgcctgttcgatgccagcgactggcatagttcgggattttacaatccaataaccaaggtcttaggggttgatgtgaatctgtctgagcaagaacaaaaacaagtcgccctacatgagttacagcataaaaatcactttccatatcagtatcagctttttagagagagatgtgaactcgacgcaaataggaatatgatccaccatcttttgaaggaagaattggaaatcgctgaggaccacactcaattcaattacctggtctttatggaaaagtacaaattaaagaccatagctgatgaggctatgatcaaggaagagtatttgaatttagttgga

SEQ ID NO: 2402 - protein, 128 aa, Streptococcus agalactiae
MPMKLDQLCKEFGVELCLFDASDWHSSGFYNPITKVLGVDVNLSEQEQKQVALHELQHKNHFPYQYQLFRERCELDANRNMIHHLLKEELEIAEDHTQFNYLVFMEKYKLKTIADEAMIKEEYLNLVG

SEQ ID NO: 2403 - DNA, 360 bp, Streptococcus agalactiae
atgtctgttttaattgataggatacgtgaactcagtaataaaaagggaatgtctcttaatgacttagaagatacacttggctacagtcgtaattctctgtatagcttgaatgaaaattctaagatgggtaaaccaaaggaaattgcacagtattttaatgtctcactagattacctactaggtctaacagataatccacgaattgccagcgatgagacagctatcattgacggtcaagttgtggatctgagagaagcagctgcccataccatgctgtttgatggtaagccacttgatgaagatgatatagattttattacagcagtcctgtctgcacacttcaaaaataaacaaaaggat

SEQ ID NO: 2404 - protein, 120 aa, Streptococcus agalactiae
MSVLIDRIRELSNKKGMSLNDLEDTLGYSRNSLYSLNENSKMGKPKEIAQYFNVSLDYLLGLTDNPRIASDETAIIDGQVVDLREAAAHTMLFDGKPLDEDDIDFITAVLSAHFKNKQKD

SEQ ID NO: 2405 - DNA, 162 bp, Streptococcus agalactiae
atgggaatcggttcaatgacagtgacagttaaagttactaacatggataaatttattgaacttagtaaagagttcaataaaaaagcccgcgagctagaagaactagctcacgaactgaagtcatttgattttgaaggcgaagttgtatcaactgatagcaac

SEQ ID NO: 2406 - protein, 54 aa, Streptococcus agalactiae
MGIGSMTVTVKVTNMDKFIELSKEFNKKARELEELAHELKSFDFEGEVVSTDSN

SEQ ID NO: 2407 - DNA, 486 bp, Streptococcus agalactiae
atgaaaggaggtcaagccatgaatttgaatcaaattcgtatcatagaggcatgccataaatttctaattggcatcacaaatttcgaagaagagttacaagatgacgttctcgtctatcgttacaaaggtaaccttgtcagctttgaaacctatcaagaatatgaacaacggtcatttgtagactataatctaaaatatggctatcttgatgacactagaacttacctagatgacagagctgatttgatagcagctttccctagcgaagagcacttgagagccttgcaaagagttaacgatgctgaacaagctcgtgtgcaaatctttaagctactatctcaggtcaatcttgactctctctccgaaaaaaattccaacatcaaaaaagataattttggatatgatttcttcaattttgcaactaaagaagaataccctgtttatcttttttcagatgatgaatcatttgagctagttgctatcagt

SEQ ID NO: 2408 - protein, 162 aa, Streptococcus agalactiae
MKGGQAMNLNQIRIIEACHKFLIGITNFEEELQDDVLVYRYKGNLVSFETYQEYEQRSFVDYNLKYGYLDDTRTYLDDRADLIAAFPSEEHLRALQRVNDAEQARVQIFKLLSQVNLDSLSEKNSNIKKDNFGYDFFNFATKEEYPVYLFSDDESFELVAIS

SEQ ID NO: 2409 - DNA, 264 bp, Streptococcus agalactiae
ttgacctcctttcataaaagatttcaagtcaattataccaaactagaaaggaaaaatatgagtcaacaacagaaaaaatggattcagctagtgaaagataagctgaatgaagaacagatgacacaaacacatctagctcgttcttgtggtgttgctaaggcaactatctcagaattgctgaaatatggcaaagggagcgacaaactcaaaaataaggtatctgatgtattacacatagatgagagctggacgaggttggaggat

SEQ ID NO: 2410 - protein, 88 aa, Streptococcus agalactiae
MTSFHKRFQVNYTKLERKNMSQQQKKWIQLVKDKLNEEQMTQTHLARSCGVAKATISELLKYGKGSDKLKNKVSDVLHIDESWTRLED

SEQ ID NO: 2411 - DNA, 708 bp, Streptococcus agalactiae
atgaacgaaatttttgtttttcacgggcaggaagtccgtactgtaaccattaacaacgagccttggtttgttgggaaagacgtggctgatattttaggctattcaaaatcacgaaatgcgattgcactccatgttgatgaggatgacgccctaaaacagggcatcacagacaatttaggtcgcatgcaagaaactattatcatcaatgaatctggtctttactcacttatcttatccagtaaattgccacaggtcaaagaattcaaacgttgggtcactagcgaggtattgccacagattcggcaacagggagcttatgtgcctgaaaatctatcagatgaggctttcatcgctctatttactggacagaagaaactgaaagagcaccagttggcattggctcaagatgttgattatctgaaaaatgagcaaccaattcatcctagctttgctcaagccttactgaagaagagaaaagctcgtgttgtctcttgtctaggtggaatggacagtccagcctatgctgataaagtcttcgcacagtcggtctttagacaagctgaggttgattttaaagaccatttcaatatcaatcgctatgacatgttgccaaagaaatttgctgaagcagcattatcttactggatgacatgggaaccaagcacaaataccaaaatgaaaattttggagatgaacgcttatgaactg

SEQ ID NO: 2412 - protein, 236 aa, Streptococcus agalactiae
MNEIFVFHGQEVRTVTINNEPWFVGKDVADILGYSKSRNAIALHVDEDDALKQGITDNLGRMQETIIINESGLYSLILSSKLPQVKEFKRWVTSEVLPQIRQQGAYVPENLSDEAFIALFTGQKKLKEHQLALAQDVDYLKNEQPIHPSFAQALLKKRKARVVSCLGGMDSPAYADKVFAQSVFRQAEVDFKDHFNINRYDMLPKKFAEAALSYWMTWEPSTNTKMKILEMNAYEL

SEQ ID NO: 2413 - DNA, 744 bp, Streptococcus pyogenes
atggaattacaagtatttactaatgaacagtttggagaagtgcgtacagcgacaatcaacaatcaaatttatttcaatcttaacgattgttgtcagattttggaattaagcaatcctcgtaaaacaattgaaagacttaataaagatggtgtaactactagtgacatcatcgacagtcttggtcgaactcaacaagccaacttcatcaacgaaagcaacttctacaagctagtcttccaatctcgcaagccagaagctgaaaagtttgcggactgggtaacatcggaagtcctaccatcaatccgcaaacatggcgcatatatgaccgaacagactttagagcaggcgctgacaagcccagacttcctcatacggcttgccaatgagttaaaagaggaaaaggagcgcagtcgtcagttagaggctgagaagtcaattttgagcgttgagaacatggttatgaagccaaaggctgattattttgatgatttggttgaccgcaatttattgactagtttccgtgaaactgctaaacaattaaaagttaaggaacgacgattcattcaatttctacttgataagaaatacgtttacagagacaagaaaggtaagcttatgccgtttgcagataaaaataacgggttatttgaagtcaaggaaagtgttaacgaaaagaccaactgggcaggaactcaaaccttaataactccaaaaggtcgtgaaacttttagactgttatttatt

SEQ ID NO: 2414 - protein, 248 aa, Streptococcus pyogenes
MELQVFTNEQFGEVRTATINNQIYFNLNDCCQILELSNPRKTIERLNKDGVTTSDIIDSLGRTQQANFINESNFYKLVFQSRKPEAEKFADWVTSEVLPSIRKHGAYMTEQTLEQALTSPDFLIRLANELKEEKERSRQLEAEKSILSVENMVMKPKADYFDDLVDRNLLTSFRETAKQLKVKERRFIQFLLDKKYVYRDKKGKLMPFADKNNGLFEVKESVNEKTNWAGTQTLITPKGRETFRLLFI

SEQ ID NO: 2415 - DNA, 528 bp, Streptococcus agalactiae
atgaacgaagtttggaaagatataccaattgttaaaggatattatcaagtttccaatcttggtcgtgttcggtctattggtagaacagtcaatgcaaaacagagaacaagaaaaacaaaaggacgcatcttaaaacagagcttatcttcaggctatgcaatagtgacactttcagtcaatggattaaggaagtcgataagagttcatagactagtagctgaagcatttataccaaatccaatcaataagcgaacgataaatcatattgatgaaaataaacttaataatagagtagataatttagaatgggcgacagataaggaaaatgctaatcatgggaatagaacaacgaaatcatctttaggtcgttgtaaacctgtagaacaatttacacttgaaggggaattcataaacacgtttgactcaataaaatctgcatcaatgaaaacaggtatctcgtcacaaagaataacagcaacagcaatggggcaccaaaaacagactcacggatataaatggaggtacgca

SEQ ID NO: 2416 - protein, 176 aa, Streptococcus agalactiae
MNEVWKDIPIVKGYYQVSNLGRVRSIGRTVNAKQRTRKTKGRILKQSLSSGYAIVTLSVNGLRKSIRVHRLVAEAFIPNPINKRTINHIDENKLNNRVDNLEWATDKENANHGNRTTKSSLGRCKPVEQFTLEGEFINTFDSIKSASMKTGISSQRITATAMGHQKQTHGYKWRYA

SEQ ID NO: 2417 - DNA, 297 bp, Streptococcus agalactiae
atggaggtacgcataatgaatgatctaatgattcaaatgcttgaccagttcgaagctggtctaatggacagaacgatgaaagtaatgcacgttgtgacagacgaaaagtatagatttcctttagaactcaacaagtctcaatgcgctttaatgctcttaggtactaaagatactgggacatttgatgaacgctttaactgtcataaggattttccgaggattccaaatgctcgtgagaaataccctcgtgatgaagtcattgaatggtatcacaagaattggcaaagaactgttatc

SEQ ID NO: 2418 - protein, 99 aa, Streptococcus agalactiae
MEVRIMNDLMIQMLDQFEAGLMDRTMKVMHVVTDEKYRFPLELNKSQCALMLLGTKDTGTFDERFNCHKDFPRIPNAREKYPRDEVIEWYHKNWQRTVI

SEQ ID NO: 2419 - DNA, 261 bp, Streptococcus agalactiae
ttggcaaagaactgttatctaagaaagaacaaaaggaactatatcatgaacaatttacaaattatcgcagtaggcacacttatttcagtaaccctgattgagtctcttatctcaaatatcaagctcagaaaagctctcaagaacaaacagacagctgggactgtcattgctcaatatatcccacaacgaggcttcattgactacaagactggaagacgtgttgacattgaccctgaaacaaagaaagaagtctttgttgac

SEQ ID NO: 2420 - protein, 87 aa, Streptococcus agalactiae
MAKNCYLRKNKRNYIMNNLQIIAVGTLISVTLIESLISNIKLRKALKNKQTAGTVIAQYIPQRGFIDYKTGRRVDIDPETKKEVFVD

SEQ ID NO: 2421 - DNA, 1329 bp, Streptococcus agalactiae
atggatgaattaaaagtattgcctcacgatatccaggctgagcagtcggttcttggttcaatttttatcaaacctgaaaaaatgattgaggtggctgagtatctgaaaccaaatgacttttacaggccagctcacaagattctatttaaggccatggtgagccttgctgatcgtggcgaggccatcgatattgtcacaatcaagtcaacgctggaaagtacggatgaacttggcatggttggcggtatcagctacatcgctgagattgttaatgcagtgccaaccagctcacacgctgagcattatgccaagattgttgctaaaaaagcacagctacggtctatcattgacaacttgtctgactcaattggcaatgcctatgatgaggacatggatattgatgagattatcgcaaaagctgagcgatcacttatcgaagttagtcaagccagtaacaagagtagtttcagacctatccatgatgtccttttggaaaatcattcaaagattgaggaacgctcaaacaataccagtcaaatcactggtattgaaacaggattttatgactttgacaagctgataacaggcttgcatgaagaccagctaattgtcttagcggcacggccagcgatggggaagacagccctagctcttaacatagctcagaatgtggcaactaagtccaataaggctgtggccgtcttctcgcttgaaatgggggctgaaagccttgttgagcggatgttgtcagctgaaggaacaatcatcaaccatcatattagaacaggaaatttgacggttaatgagtggcaacgtcttatctatgcacagggtcagcttgctgaagctccaatctttatagatgacacagctggagtcaagattactgacatcagagcaagagctaggaggctatctcaagagactgacggacttggattgatagtcattgactatcttcaactcattcaagggtcacggtctgacaaccgacagcaagaggtatctgagatttctaggcagttaaagattattgccaaggaattaaaagtgccagtcattgcactatcacagcttagccgtggggttgagcaaagaaacgacaaaaggcctatcatgtccgacttaagggaatcaggcagcattgagcaagacgctgatattgtcgccttcctctatcgtgatgcttattaccaagacaaaaaagaaggtcagccagaaaacgacatcactgagctgatcatcagaaagaacagacacggaaaccttggcacagtcaagctgtatttccacaaggaatataccaagttttctagcgttgaggaggaa

SEQ ID NO: 2422 - protein, 443 aa, Streptococcus agalactiae
MDELKVLPHDIQAEQSVLGSIFIKPEKMIEVAEYLKPNDFYRPAHKILFKAMVSLADRGEAIDIVTIKSTLESTDELGMVGGISYIAEIVNAVPTSSHAEHYAKIVAKKAQLRSIIDNLSDSIGNAYDEDMDIDEIIAKAERSLIEVSQASNKSSFRPIHDVLLENHSKIEERSNNTSQITGIETGFYDFDKLITGLHEDQLIVLAARPAMGKTALALNIAQNVATKSNKAVAVFSLEMGAESLVERMLSAEGTIINHHIRTGNLTVNEWQRLIYAQGQLAEAPIFIDDTAGVKITDIRARARRLSQETDGLGLIVIDYLQLIQGSRSDNRQQEVSEISRQLKIIAKELKVPVIALSQLSRGVEQRNDKRPIMSDLRESGSIEQDADIVAFLYRDAYYQDKKEGQPENDITELIIRKNRHGNLGTVKLYFHKEYTKFSSVEEE

SEQ ID NO: 2423 - DNA, 1374 bp, Streptococcus pyogenes
ttggaggttatgaggttgcctgaagtagctgaattacgagttcaaccccaagatttactagcagagcaatctgttcttgggtcaatctttatctcacctgataagctgattgcagtgagagaatttatcagtccagacgatttttataagtacgctcataaaattatctttcgggcaatgattaccctcagcgatcgtaatgatgccattgatgcaaccactataagaacaatcctagatgatcaagatgatctgcaaagtattggtggcttatcctatattgttgaactagttaatagtgtcccaactagtgctaatgcagaatattatgctaaaattgtagctgagaaagctatgttgcgtgatattattgctaggttgacagaatctgtcaacctagcttatgatgaaattttaaaaccagaagaggttatcgctggagttgagagagctttaattgaactcaatgaacatagtaatcgtagtgggtttcgcaaaatttcagatgtgctaaaagttaattacgaggctttagaagcacgttctaagcagacttcaaatgttacaggtttaccaactggttttagagaccttgacaagattacaacaggtttacacccagatcaattagttattttagctgctcggccagcagtggggaagactgcctttgttcttaatattgcgcaaaatgtggggactaagcaaaaaaagactgttgctattttttctttggaaatgggtgctgaaagtttagtagatcgtatgcttgcagcagaaggaatggttgattcgcacagtttaagaacagggcaactcacagatcaggattggaataatgtaacaattgctcagggagctttggcagaagcaccgatttatattgacgatacgcccgggattaaaattactgaaatccgcgcaagatcacggaaattgtctcaagaagtggatggtggtttaggtctcattgtaattgactacttacagttgattacaggaactaaacccgaaaatcgtcagcaagaggtttcagatatttcaagacagcttaaaatcctagctaaagaattgaaagtaccagttattgccctaagtcagctttctcgtggcgttgagcaaaggcaagataaacgaccagttttatcagatattcgtgaatcaggatctattgagcaggatgccgatattgtagccttcttataccgggacgattattaccgtaaagaatgtgatgatgctgaagaagctgttgaagataacacaattgaagttatcctcgagaaaaatagagctggggcgcgtggaacagtcaaactgatgttccaaaaagaatacaacaaattctcaagtatagcccagtttgaagaaaga

SEQ ID NO: 2424 - protein, 458 aa, Streptococcus pyogenes
LEVMRLPEVAELRVQPQDLLAEQSVLGSIFISPDKLIAVREFISPDDFYKYAHKIIFRAMITLSDRNDAIDATTIRTILDDQDDLQSIGGLSYIVELVNSVPTSANAEYYAKIVAEKAMLRDIIARLTESVNLAYDEILKPEEVIAGVERALIELNEHSNRSGFRKISDVLKVNYEALEARSKQTSNVTGLPTGFRDLDKITTGLHPDQLVILAARPAVGKTAFVLNIAQNVGTKQKKTVAIFSLEMGAESLVDRMLAAEGMVDSHSLRTGQLTDQDWNNVTIAQGALAEAPIYIDDTPGIKITEIRARSRKLSQEVDGGLGLIVIDYLQLITGTKPENRQQEVSDISRQLKILAKELKVPVIALSQLSRGVEQRQDKRPVLSDIRESGSIEQDADIVAFLYRDDYYRKECDDAEEAVEDNTIEVILEKNRAGARGTVKLMFQKEYNKFSSIAQFEER

SEQ ID NO: 2425 - DNA, 666 bp, Streptococcus agalactiae
ttggcacagtcaagctgtatttccacaaggaatataccaagttttctagcgttgaggaggaatgaaatgaaaaaatttgaccactatttcagcaaccatattgctgtaaaaaacgaatctgatacagtcaccattgttgactattacaatccagaaaagggctatgagtataacttacgttacattttcgatagaaaaaattcatcccttgctatcacaggagactttggggaattagttgcacgaaatttctacaatatgggtgaatgggacacattctacaatcactatactggtcatctggggtattttcttgaaaagttactatgttcaagtaggccagttcattactatgatactgacaaggctaaaagagaaattctcaatgaattctttgatggtgctgattatgatgatttagattttgatgatgaattcctacttgatcaattatttgacaattttgacgaagataaaggatttacttatattcttccagaggcttttgaacgttttagcgaagatatggaagaatatgaggtctatgaatttctatcaagggctggccgatacgtcaatgatgtctttgaactttacttagacgcttataagagagcttatgagtatctaacaaaggaggttgatgatggcacaacgcagaatgtt

SEQ ID NO: 2426 - protein, 222 aa, Streptococcus agalactiae
MAQSSCISTRNIPSFLALRRNEMKKFDHYFSNHIAVKNESDTVTIVDYYNPEKGYEYNLRYIFDRKNSSLAITGDFGELVARNFYNMGEWDTFYNHYTGHLGYFLEKLLCSSRPVHYYDTDKAKREILNEFFDGADYDDLDFDDEFLLDQLFDNFDEDKGFTYILPEAFERFSEDMEEYEVYEFLSRAGRYVNDVFELYLDAYKRAYEYLTKEVDDGTTQNV

SEQ ID NO: 2427 - DNA, 96 bp, Streptococcus agalactiae
ttgaaagcggtcagactggatatagttgtgaatccgccaatgacggataacgactacaccactatcaaagggaatcaagaacccttttgcaatcag

SEQ ID NO: 2428 - protein, 32 aa, Streptococcus agalactiae
MKAVRLDIVVNPPMTDNDYTTIKGNQEPFCNQ

SEQ ID NO: 2429 - DNA, 750 bp, Streptococcus agalactiae
ttgatgatggcacaacgcagaatgtttagtagaaaaatcactgagactgaccgttttttggaaatgccactatcatcccaagctctctatttccatttgaacatgggagctgatgatgagggctttatagataaggcaaagacgattcagagaactattggcgctagtgatgatgatatgaaattactgattgcaaaagggttcttgattccctttgatagtggtgtagtcgttatccgtcattggcggattcacaactatatccagtctgaccgctttcaatcaaccttataccagtcagaaaaggctcagctagagtatgacaagtcaaaaacagctagtcttaaacctattggaaattgtatacaaaatgtatccaaaatggagacacaggttaggttaagtaagggtagcttagataaggatagcttaactacctatcctacagtttcagacaatgaggaagaagatattccatacaaggaaattatttcttacttgaatgaaaaagctaatagaaattacagacctaacattcagaaaaacaaaactcttatcaaggctagatggtcagaaggattcaggttagatgatttcaaacatgtgattgataccacggtcaaggattggtcaggcactaagtatgaaaagtatctcagacctgaaacgctctttggttctaagtttgaaggctatttgaatcaagcaccacgaatcaagacggaaacaattgacggaaggttgggcttt

SEQ ID NO: 2430 - protein, 250 aa, Streptococcus agalactiae
MMMAQRRMFSRKITETDRFLEMPLSSQALYFHLNMGADDEGFIDKAKTIQRTIGASDDDMKLLIAKGFLIPFDSGVVVIRHWRIHNYIQSDRFQSTLYQSEKAQLEYDKSKTASLKPIGNCIQNVSKMETQVRLSKGSLDKDSLTTYPTVSDNEEEDIPYKEIISYLNEKANRNYRPNIQKNKTLIKARWSEGFRLDDFKHVIDTTVKDWSGTKYEKYLRPETLFGSKFEGYLNQAPRIKTETIDGRLGF

SEQ ID NO: 2431 - DNA, 819 bp, Streptococcus agalactiae
atgaatccttttaagaattttgaaactaggcaagtcttggaagaaacctgcgaggttcacggttgccagctctggctgactaaagtaccgattaagggacggcttgaagaactcaagcagtgtccagagtgtaccaaggccgctatcaacatctttgaaaataagttgaacagtcagagcaaaatcaacagcaagcttgctgatacatatgctgtctttgaaagagatagcttggtatcagataagctgagggctaagagtcttgagaactatgaaatcaaggatgaaattgaccagcatgctatcaattatgccaagcgtatggaacagttctaccgacaggatagaacaggcaatgccattattactggcccttctggtgttggcaaaagtcatctgacttacggcttggccaagttcatgaacgaacaattcaaagcctacgaatcaccaaaatcagttctttttatctcactggtgagcctttttaccaaaataaaagaaagcttcaaggttgacaatgggtacagacaggctgacatgattgagctgctaactagggtggactacctctttctggacgatttgggcaaggagagtcgcaaaggcgacagccagaacaatgagtggacacatcagattctctatgagattttggacaatcggagcaacacaatcatcaacactaacctgagtagtaaggagattaaggccttgtatgctgacaattatggcaacggtgctttgtctagtcggattcttgagggtgtgactggaaatagctttgcttatccgaaggatatggaagataggaggtat

SEQ ID NO: 2432 - protein, 273 aa, Streptococcus agalactiae
MNPFKNFETRQVLEETCEVHGCQLWLTKVPIKGRLEELKQCPECTKAAINIFENKLNSQSKINSKLADTYAVFERDSLVSDKLRAKSLENYEIKDEIDQHAINYAKRMEQFYRQDRTGNAIITGPSGVGKSHLTYGLAKFMNEQFKAYESPKSVLFISLVSLFTKIKESFKVDNGYRQADMIELLTRVDYLFLDDLGKESRKGDSQNNEWTHQILYEILDNRSNTIINTNLSSKEIKALYADNYGNGALSSRILEGVTGNSFAYPKDMEDRRY

SEQ ID NO: 2433 - DNA, 1314 bp, Streptococcus agalactiae
ttgatgaaatttttagacctctttgctggcattggtggttttcgccttggaatggagcaagctgggcatgagtgcataggattctgtgaaataaataaatttgctagagctagctacaaagtaatacatgatactgaaggagaaattgaactacatgacatcacaagagtttcagatgagtttattcgaggaatcggaagtgtggacgttatctgtggcggatttccgtgccaggctttctcaattgctggaaatagacgaggttttgaagatacacgaggaactttgttctttgaaattgctaggttcgcatctattctcagacctaagtatctattccttgagaacgttaaaggactcctcaaccacgaagggggggctacattcgagaccatcatcagaaccttggatgaattggggtacaacgtggaatggcaaatctttaacagcaagaattttggagtcccccagaatagggaacgagtgtttattatcggacatcttagaggagaaggtaccagaccaatttttcctttcgaatcaagcatcacagaaaattatcctatccacaccagaaaaataggaaatgttaatccatctggtaatggaatgaatggggaagtgtatgattcggaaggtttatctccaactctaacaacaaataagggagaaggagttaaaatcgctgtaaatgttgtaggcagattacctgggaaatttgaaatgccaaatagagtctacgatccagatggcctagcaccgactatcagaactatgcaaggtggagggttagagccaaaaataattcagcgaggcagaggctataatcagggaggagaatatgaaatttctccaactgtcacatgcaacagttggcaagaaaacaatcttttaaagataaaagaagccactaaaaaaggctattcagaggcagaggctggcgattcagtaaacttatctcacccaaattctgagacaagacgtggacgagttggtaaaggtattgccaatactctcttgactggagaagaacaaggtgtggttgtttatgacttgtacaacagaagaaagaaagatattgttggcactttaacagctagcggtcataacggtaatactactacgggtacttttggtatctctaacggatttagaatcagaaagcttacacctcgtgagtgttggaggctacaaggcttccctgactgggcttttgacaaggcgagtcaggtcaatagcaacagtcaattatataaacaagctggtaatagcgtaacagtaaacgtcattgctgcaattgcaaggagattgcta

SEQ ID NO: 2434 - protein, 438 aa, Streptococcus agalactiae
MMKFLDLFAGIGGFRLGMEQAGHECIGFCEINKFARASYKVIHDTEGEIELHDITRVSDEFIRGIGSVDVICGGFPCQAFSIAGNRRGFEDTRGTLFFEIARFASILRPKYLFLENVKGLLNHEGGATFETIIRTLDELGYNVEWQIFNSKNFGVPQNRERVFIIGHLRGEGTRPIFPFESSITENYPIHTRKIGNVNPSGNGMNGEVYDSEGLSPTLTTNKGEGVKIAVNVVGRLPGKFEMPNRVYDPDGLAPTIRTMQGGGLEPKIIQRGRGYNQGGEYEISPTVTCNSWQENNLLKIKEATKKGYSEAEAGDSVNLSHPNSETRRGRVGKGIANTLLTGEEQGVVVYDLYNRRKKDIVGTLTASGHNGNTTTGTFGISNGFRIRKLTPRECWRLQGFPDWAFDKASQVNSNSQLYKQAGNSVTVNVIAAIARRLL

SEQ ID NO: 2435 - DNA, 330 bp, Streptococcus pyogenes
atgagagatatgaagtttttagatttgtttgcaggaattggaggctttcgattgggtttaattaatcagtgccatgagtgtattggcttttgtgagattgataagtttgcgaggcaatcttacaaagccatctatgagaccgaaggagaaatagaatttcatgacattagacaagtcacagaccaagactttagacaacttagagggcaagtggatatcatctgcggtggtttttcccttgtcaagcattttcactcgcaggcagacgactgggatttgagggcactaggagaactctcttctttgagattactcgagcgaccaaacaga

SEQ ID NO: 2436 - protein, 110 aa, Streptococcus pyogenes
MRDMKFLDLFAGIGGFRLGLINQCHECIGFCEIDKFARQSYKAIYETEGEIEFHDIRQVTDQDFRQLRGQVDIICGGFSLVKHFHSQADDWDLRALGELSSLRLLERPNR

SEQ ID NO: 2437 - DNA, 402 bp, Streptococcus agalactiae
atgacctatgaagctacattcatgctatatggttacaaagctgttccaattggccagtttgaatctaaggagttggctgcccaagcaattattgaccatatcattgagaactctggcatacatagaccaagggtagttgcaacaatgaaaatacggagcaaggaaatcagaattgattatggttctaaaacttgctactacttgattactttaattaaaaaaaaacggaggaaaaacaaaatgagcaataatattgactataagcagggctatcgtgatgctatacagtttgccatctcagaaatcaatgaaagtgcagacaattttcttatcgatgaaaaagaggctgatagaatcaacgaaaatctaaaaacaatattaagaaaggtttatcaaaatgac

SEQ ID NO: 2438 - protein, 134 aa, Streptococcus agalactiae
MTYEATFMLYGYKAVPIGQFESKELAAQAIIDHIIENSGIHRPRVVATMKIRSKEIRIDYGSKTCYYLITLIKKKRRKNKMSNNIDYKQGYRDAIQFAISEINESADNFLIDEKEADRINENLKTILRKVYQND

SEQ ID NO: 2439 - DNA, 489 bp, Streptococcus agalactiae
atgactaaaacaatgacacttgaagagaaggttgaacagtggtttattgaccgtaacttacacgaggcaaatcctgtcaagcagtttcagaagctgattgaggaaactggggagctttactctggtattgcaaagggtaagagtgaaatcatccgtgattcacttggggacatgcaagttgtcctgattggcattgaacaacaaatcaagaacggtgctcagattgaagcaagtccacaagatatggagctgttgctacttgcttcaagtttgggggagatggctcagaaactctacaagcatatcttccacaacgaaacaaaaacaccgcttatccgtccagaacttagcttgcttcactctaatattcattccattgcaatccacaatctgacaacggctgatgattgcttggctattgcctatgaagaaatcaaggacagaaaaggcaagttaatcaatggaatttgggttaaagaggaggatttg

SEQ ID NO: 2440 - protein, 163 aa, Streptococcus agalactiae
MTKTMTLEEKVEQWFIDRNLHEANPVKQFQKLIEETGELYSGIAKGKSEIIRDSLGDMQVVLIGIEQQIKNGAQIEASPQDMELLLLASSLGEMAQKLYKHIFHNETKTPLIRPELSLLHSNIHSIAIHNLTTADDCLAIAYEEIKDRKGKLINGIWVKEEDL

SEQ ID NO: 2441 - DNA, 327 bp, Streptococcus agalactiae
atgaaaaacctgaattgggaagaattcttcaacaatctcaaggcttttgctagtgccatcatcatcactgtatttgtttttggattcaactatctgttttatgatattggctaccagaaaggccatcaggaagctgacagggtgattatctatgtggctgacaatgctggcgctgaaatgtttggcaaaatcactgataaagaaatcattgaaggccgtcacacagttacagctggcgcttatggcaagttcttggttactgaggaacaatacaatgaaattactgttggtgatgacattcctgactatttgaaaggacgtggaaac

SEQ ID NO: 2442 - protein, 109 aa, Streptococcus agalactiae
MKNLNWEEFFNNLKAFASAIIITVFVFGFNYLFYDIGYQKGHQEADRVIIYVADNAGAEMFGKITDKEIIEGRHTVTAGAYGKFLVTEEQYNEITVGDDIPDYLKGRGN

SEQ ID NO: 2443 - DNA, 354 bp, Streptococcus agalactiae
atgacaaaatgtgattttatgacaaaacggctcaatattctaaatgatgaagatgaggaaatgaagaaactcattgaacaaggctacacaaagatagaaagtgagctaggtaagataactggattcagaatcttgcatgacaatgtaaactatcctagccattatcaagggaaatacggtttagagtcaattgatgttctcaggaactttatgacccctgaaatgctcaaaggattttatctaggaaatgccctaaagtaccaactacggtaccgaaagaaaaacggccttgaagacctcaaaaaagcaagaaagaaccttgactggttgattgaagaaatggagaaagagaaa

SEQ ID NO: 2444 - protein, 118 aa, Streptococcus agalactiae
MTKCDFMTKRLNILNDEDEEMKKLIEQGYTKIESELGKITGFRILHDNVNYPSHYQGKYGLESIDVLRNFMTPEMLKGFYLGNALKYQLRYRKKNGLEDLKKARKNLDWLIEEMEKEK

SEQ ID NO: 2445 - DNA, 204 bp, Streptococcus agalactiae
atgaaaaaatcaataggaatccttgaatttaaagaatttgatgcttttgttggtggaaaggttatgcctgtctatcttcatagtgctaacccaaacgtgccaacgactaataaaaatgaggctatgagggttaccaaaaagagatacagaaaagagttctctgacaagtacattttcagaaaggttggtgaggttgatgatcaa

SEQ ID NO: 2446 - protein, 68 aa, Streptococcus agalactiae
MKKSIGILEFKEFDAFVGGKVMPVYLHSANPNVPTTNKNEAMRVTKKRYRKEFSDKYIFRKVGEVDDQ

SEQ ID NO: 2447 - DNA, 426 bp, Streptococcus agalactiae
ttggtgaggttgatgatcaataatgttgtacttattggccgcttgacaagagatgttgagctacgttacacgccgtcaaacatcgcaaacgctacttttaacctagcagtcaatcgaaatttcaagaatgctgctggtgatcgtgaagctgatttcatcaactgtgtgatgtggcgacaacaagctgaaaacttggccaattggacgaaaaaaggaatgctgattggtattactggacgaatccagacaagaagctacgaaaatcagcaaggtcagcgtatctatgtgactgaggttgttgctgacagcttccagattcttgaaaagcgtgataattcaacgaaccaggcaagcatggatgaccaattgccaccatcatttggaaatagtcagcctatggatatttcagatgatgatctaccgttt

SEQ ID NO: 2448 - protein, 142 aa, Streptococcus agalactiae
MVRLMINNVVLIGRLTRDVELRYTPSNIANATFNLAVNRNFKNAAGDREADFINCVMWRQQAENLANWTKKGMLIGITGRIQTRSYENQQGQRIYVTEVVADSFQILEKRDNSTNQASMDDQLPPSFGNSQPMDISDDDLPF

SEQ ID NO: 2449 - DNA, 264 bp, Streptococcus agalactiae
gtgcttatgaacgaatataagaaacccacctacatcgtcattcaagaggcaatggctgagcgtattagatttcttgaagatgaattatataacagagcatacaaagacattgaacggctagaagttgagaatgaccgtctgaaggttagatgccttgatttgcagttggaaaatgctgactatgtctgggatgacatgtgtcgctctgctattgctcgtgcaaaatcagaaaatcgaagaccacacagaagatggaggggaaga

SEQ ID NO: 2450 - protein, 88 aa, Streptococcus agalactiae
MLMNEYKKPTYIVIQEAMAERIRFLEDELYNRAYKDIERLEVENDRLKVRCLDLQLENADYVWDDMCRSAIARAKSENRRPHRRWRGR

SEQ ID NO: 2451 - DNA, 123 bp, Streptococcus agalactiae
ttgatttgcagttggaaaatgctgactatgtctgggatgacatgtgtcgctctgctattgctcgtgcaaaatcagaaaatcgaagaccacacagaagatggaggggaagatgaagttaaggct

SEQ ID NO: 2452 - protein, 41 aa, Streptococcus agalactiae
MICSWKMLTMSGMTCVALLLLVQNQKIEDHTEDGGEDEVKA

SEQ ID NO: 2453 - DNA, 357 bp, Streptococcus agalactiae
atggaggggaagatgaagttaaggcttgaagaactaagaaacaaacttggcctcagtcgcagagatgtgcatgaagccactggcatttctatgaacacgctgctacattatgaaaaaggcggtacaccatctattggtcaggttgaaaatatcgctaaggcttacaatatcaacccagcctggttgcttggttggattgatgaaggccagcaaccacaaccacttgaaaccgttgttgaaaagattatctatgtggaaaaggaaggctgtagattaccgccatattggaacaatgataataatggcagaatcatcaagtggaaagaatcaagaagagcattccaaaggagaacaatt

SEQ ID NO: 2454 - protein, 119 aa, Streptococcus agalactiae
MEGKMKLRLEELRNKLGLSRRDVHEATGISMNTLLHYEKGGTPSIGQVENIAKAYNINPAWLLGWIDEGQQPQPLETVVEKIIYVEKEGCRLPPYWNNDNNGRIIKWKESRRAFQRRTI

SEQ ID NO: 2455 - DNA, 462 bp, Streptococcus agalactiae
ttgacaaagaaaacagcaagtaagacaagacgtgatttccttgagtttgagcttgaggctaagtatctaaaaattgataaacttattgggcagcgccgtcatgaactggaaagaatctatgcagtcaaaaacctgacaatgccaggaatcgatgattcaggagctagtcgcagtggaacttcaactaatacttctgaaaatctagctgttgcttatgccagtgacccaatgattctgaaactggaagagttccaaaatgcgatatcagaattactagaggtacttgaacccgatgataagaaaattttccatctgaggtggggagaacatactggatatgattggattcaagtttggcacatcatggaaaatggcgagacaggttatctttacagacatagcaagcagatttatagaagacgtgaagtcatccttgatacacttgcaaaattattgttcatg

SEQ ID NO: 2456 - protein, 154 aa, Streptococcus agalactiae
MTKKTASKTRRDFLEFELEAKYLKIDKLIGQRRHELERIYAVKNLTMPGIDDSGASRSGTSTNTSENLAVAYASDPMILKLEEFQNAISELLEVLEPDDKKIFHLRWGEHTGYDWIQVWHIMENGETGYLYRHSKQIYRRREVILDTLAKLLFM

SEQ ID NO: 2457 - DNA, 540 bp, Streptococcus agalactiae
atgaatattgttgaaccgctacgagacaaagacgatatacaagccatgaaggactatctatcatcttggaatgaaaagtattacatgctatttcttttgggcatcaatacaggtttccgtgttggagatattctcaagctaaaggtcaaagatgtccaaggctggcacatcaaagttagggaacaaaagactggtaagtataaaagtattaagatgacaaggccactcaaaaacgaattgagggaatttgtcaaagacaaggaacttcatgagtatctatttcagagtcgtgtcggaaagaacaaggcgctcagttataagacggtttactggtttcttaaaagagctgctgaagacctcggcattgacaatgttggaactcatacaatgcgaaaaacctttggctatcattactacaagaagtacaagaacgttgctgacttgatgtcactattcaatcattcaagcccagcagttacactaatctacatttgtgtaaggcaagatgagcttgatactaagatgagtaattttagcctc

SEQ ID NO: 2458 - protein, 180 aa, Streptococcus agalactiae
MNIVEPLRDKDDIQAMKDYLSSWNEKYYMLFLLGINTGFRVGDILKLKVKDVQGWHIKVREQKTGKYKSIKMTRPLKNELREFVKDKELHEYLFQSRVGKNKALSYKTVYWFLKRAAEDLGIDNVGTHTMRKTFGYHYYKKYKNVADLMSLFNHSSPAVTLIYICVRQDELDTKMSNFSL

SEQ ID NO: 2459 - DNA, 285 bp, Streptococcus agalactiae
atgaaagatgaaaatgcatttgatggaattaggcttgaagctggtagcactttagaaatctatctcacgaagaacgacttagaacatattgcaaatggatatgaggtgactttagatattaagcctaacgagactgtaaataaaatcgtaataaagccaagttttgtaaataatattctaaatccgttaatcaactatgacaaaagaatagtgagtgaagcagatttaaagtttagagacatttcaagagaggttgcaagagatagttttgcattggggtcaatg

SEQ ID NO: 2460 - protein, 95 aa, Streptococcus agalactiae
MKDENAFDGIRLEAGSTLEIYLTKNDLEHIANGYEVTLDIKPNETVNKIVIKPSFVNNILNPLINYDKRIVSEADLKFRDISREVARDSFALGSM

SEQ ID NO: 2461 - DNA, 141 bp, Streptococcus agalactiae
atggggggagtccacaaaaattcaaaaataaaaaaatcaaaaataaatttatattccgattatctaaatttaaatttattttactttgaaaagtttttgtgttgtgacattcaagacaaagtaactgacagttctcttcgt

SEQ ID NO: 2462 - protein, 47 aa, Streptococcus agalactiae
MGGVHKNSKIKKSKINLYSDYLNLNLFYFEKFLCCDIQDKVTDSSLR

SEQ ID NO: 2463 - DNA, 111 bp, Streptococcus agalactiae
ttgtatcaattttcgtcaattttgggggagaggtacacaagaggattgacaccgttattattttggcgctgtcaaaattcaaaatggggggagtccacaaaaattcaaaaa

SEQ ID NO: 2464 - protein, 37 aa, Streptococcus agalactiae
MYQFSSILGERYTRGLTPLLFWRCQNSKWGESTKIQK

SEQ ID NO: 2465 - DNA, 501 bp, Streptococcus agalactiae
ttgatacaagaaaggagcatgattttgaaaatcaatgaagttttagaaaagctaggaataagtcgtgctacccttacaaggtatcgaaaaaagctgggcatatttgaagaaactaggtcaaatatcaccaaaagtcagttcaaagagttggaaaagcttgccaatcaacggcaaaagtacacaaggcaggaacgtgttgagctatctcgtaagactttcaagctgattccaaaagaaaaaatgcttgaaatcagtgataatgattcagttgggttgaaaaatctcaaaactcaatacaatcacaatcaaaaagtgattgaaaacttccagcttgaaatcaataaggtcatcaatgacggtgagctacctgataagtacctacttgatggaatggaaaagtatcaaaagcttaacatgcagatcatgtcaacgattgaaaagcaaagtccacagggtgacaggctcaaagaaatgattcaggagaagttagcacgttatggt

SEQ ID NO: 2466 - protein, 167 aa, Streptococcus agalactiae
MIQERSMILKINEVLEKLGISRATLTRYRKKLGIFEETRSNITKSQFKELEKLANQRQKYTRQERVELSRKTFKLIPKEKMLEISDNDSVGLKNLKTQYNHNQKVIENFQLEINKVINDGELPDKYLLDGMEKYQKLNMQIMSTIEKQSPQGDRLKEMIQEKLARYG

SEQ ID NO: 2467 - DNA, 1710 bp, Streptococcus agalactiae
atggttgagatgagatattttgataagtatgctcagctcatctatactggtaagattcgtatttgtaagctcacaatgaaatcaattagacgtgttgagcgatacaaagagcaatacctcttcaaacaggaggaagctgacaaacggattgagttcattgaggaagagtgcagcaatactaaaggccttgctggtaagttacgcttagcattaccacaaaaggtttggttagaaacaacgtggggcttttatcacacggttgaggttactaagaccaatcctgataccttggaagaatacacagattatgaagaaaggcgtctcattcatgaggtgcctattattgtgcctcgtggcacaggtaagactactcttggttctgctattgctgaggttggtcaaatcattgacggtgagtggggtgctgatattcagcttcttgcttacagtcgtgaacaggctggctatttgttcaatgcctcaagggcgatgttgtcgaatgaagaaagcttgctgcactatatgcgtgaggctgacatcctacggtcaaccaagcaaggtatcttgtatgaaacaactaacagtcttatgtctatcaagacttctgactatgaaagccttgacggtactaatgctcactacaatatctttgatgaggtgcacacttatgatgatgacttcatcaaggttgtgaatgatggttccagccgtaagcgtaagaattggataacctggtacatttccacaaatggaacgaagcgtgacaagctctttgataagtattacaacatctgggtagatatccttgatgacaagattatcaatgattctgtcatgccttggatttatcagttggacgatgtgtcagagattcatgaccctgatatgtggcagaaagctatgccattacttggtatcacgacagagaaagaaaccatcgctcgtgatattgagatgagcaagaatgatccagcacaacaagctgagctgatggctaagactttcaatcttcctgtcaacaactatcttgcttacttcagcaatgaagagtgtaaaggttggtcagataagtttgatgagagtttgtttgtcggagatgatgaacggaacgcccgttgtgtgattgggattgacttgtcagatgtcaatgacatctgctctatctcttttatggttgtgcgtggggaagaacggcactatctaaacaagaaattcatgccacggcataccattgagacattgccaaaggaactgcgtgataagtacactgagtgggaattaagtggcatgctgcatgtgcatgaattggactacaatgaccaagcctatatatttgaagagttacggcagtttatgagtgacaacagaattttgcctgtggcagtcggttatgaccgctacaatgcaagggaacttattcgcttgtttaacgactactacggggatatttgtcacgatattccccagacggtcaaatcgttatcaaatccgctcaaggtttacaaggagaaggctaagatgggcaaaatcatctttgatgatcctgtggcgacatggaatcatgccaacgtccgtgtcaaaattgatgccaataacaatatttttccaaacaaggaaaaggcaaaagaaaagattgatgtctttgctagtcagctagatgcctttatctgttatgaaaatttcaaggaagacttgagctactactttgat

SEQ ID NO: 2468 - protein, 570 aa, Streptococcus agalactiae
MVEMRYFDKYAQLIYTGKIRICKLTMKSIRRVERYKEQYLFKQEEADKRIEFIEEECSNTKGLAGKLRLALPQKVWLETTWGFYHTVEVTKTNPDTLEEYTDYEERRLIHEVPIIVPRGTGKTTLGSAIAEVGQIIDGEWGADIQLLAYSREQAGYLFNASRAMLSNEESLLHYMREADILRSTKQGILYETTNSLMSIKTSDYESLDGTNAHYNIFDEVHTYDDDFIKVVNDGSSRKRKNWITWYISTNGTKRDKLFDKYYNIWVDILDDKIINDSVMPWIYQLDDVSEIHDPDMWQKAMPLLGITTEKETIARDIEMSKNDPAQQAELMAKTFNLPVNNYLAYFSNEECKGWSDKFDESLFVGDDERNARCVIGIDLSDVNDICSISFMVVRGEERHYLNKKFMPRHTIETLPKELRDKYTEWELSGMLHVHELDYNDQAYIFEELRQFMSDNRILPVAVGYDRYNARELIRLFNDYYGDICHDIPQTVKSLSNPLKVYKEKAKMGKIIFDDPVATWNHANVRVKIDANNNIFPNKEKAKEKIDVFASQLDAFICYENFKEDLSYYFD

SEQ ID NO: 2469 - DNA, 1140 bp, Streptococcus agalactiae
atgaacaactatttgaaaaatttgaaggaggtttttgctaggattttccgtccaaacaatcggaaatctacaagaacctatcttcaaagaagtatctcctactggcgtaggaactccatctatttggataacatctacaataagatttcaactgacacagctcagttaaggtttaagcatgtcaagattactcgtaacccaggcggtgtcgattcgatggtttggtatgagcatagtgatttggctgaggtgctaacagtttcaccaaatccactagaagtgcctgttgtcttttggtcaaatgtaactagggctatgctgcgtgacggtgtggcggttgttgtaccacgttggaagaatggccgactggttgaaatatggcttgctaagaagacagtgacttggacagcagagagcgtggagcttatgcttgatgatgttgctgttgagcttcctcttactgatgtgtgggtatttgaaaatcctaagttgaatgtcacggctcaactcaatcagattactgagcttattgacattaacttgaatgctttgacagaaaagcttagcgatggcaattctagcttgagaggtttcttaaagctaccaactaaggcagctgatgaacatttgaagcaacaagccagggaccgtgttgatagtatgcttgacttggccaagaacggtggcattgcttatcttgagcaaggcgaagaattccaggaacttagcaaagactattctactgcttctaaggaagaattagagttcttgaaatcacagctttataatgctcatggtatcaatgagaaattatttacctgtgactatactgaggaacaatatagagcctactattctagcgtcatgaagttatatcagcgtgtctattctgaggagattaacagaaaatacttcacgaagacagcacggactcagggcaataagttactggtcttctttgatatggctgacatgatttcatttaaggatttggttgaaggtggcttcaagtccaaatatgctggattgatgaactcaaatgagttccgtgaaacctatcttggtttacctggctatgagggcggtgaagtatttgaaaccaacctgaatgctgttcgtatcggtgcagaagaatctgag

SEQ ID NO: 2470 - protein, 380 aa, Streptococcus agalactiae
MNNYLKNLKEVFARIFRPNNRKSTRTYLQRSISYWRRNSIYLDNIYNKISTDTAQLRFKHVKITRNPGGVDSMVWYEHSDLAEVLTVSPNPLEVPVVFWSNVTRAMLRDGVAVVVPRWKNGRLVEIWLAKKTVTWTAESVELMLDDVAVELPLTDVWVFENPKLNVTAQLNQITELIDINLNALTEKLSDGNSSLRGFLKLPTKAADEHLKQQARDRVDSMLDLAKNGGIAYLEQGEEFQELSKDYSTASKEELEFLKSQLYNAHGINEKLFTCDYTEEQYRAYYSSVMKLYQRVYSEEINRKYFTKTARTQGNKLLVFFDMADMISFKDLVEGGFKSKYAGLMNSNEFRETYLGLPGYEGGEVFETNLNAVRIGAEESE

SEQ ID NO: 2471 - DNA, 540 bp, Streptococcus agalactiae
atggaaaaactaaaaacctttgttgtgaagtcggttgaggatgaatcagctgactttcattttgaggcttacgcttcaacctatgacaatacagacagagaaggcgatgtgatggccaaggggtgttttgataacactctgaaatctaaggctgttgtccctatgtgtcttaatcatgaccgtaactgtgttattggtaagcatgaattgtctgtggatgaaaaaggcttgcgaacacgttcaacgtttaatcttagtgatccagaggctaagaaaacttatgacctcatgaaaatgggggcattggatagcctgagtattgggttctttattaaagattatgagcctattgacgctaagcaaccttatggcggatggattttcaaggaagttgaaatctttgaaatttctgttgtgaccgtgccagctaaccctcaagcaactgttgacaatattaaggaatttgatatgtcggcggttgataagcgaatcgctcaggcgaacatgaggcaagaaatcatgagtaaacttgcaaaaatt

SEQ ID NO: 2472 - protein, 180 aa, Streptococcus agalactiae
MEKLKTFVVKSVEDESADFHFEAYASTYDNTDREGDVMAKGCFDNTLKSKAVVPMCLNHDRNCVIGKHELSVDEKGLRTRSTFNLSDPEAKKTYDLMKMGALDSLSIGFFIKDYEPIDAKQPYGGWIFKEVEIFEISVVTVPANPQATVDNIKEFDMSAVDKRIAQANMRQEIMSKLAKI

SEQ ID NO: 2473 - DNA, 1284 bp, Streptococcus agalactiae
ttgcaaaaatttaaaggagacatgatgaaaaaatcactcattgagcttttggaagctcgtcaaaaagcaactgatgaactggctgaggtaaagcttaaaaaagccactattgaagcaaagatgaaatcttcaaccattgaagacgatgacttggaacagttaaaaactgatgcagaaagtttggtttctcaagcaacagctattaaggaaacaattgctgggctggattctgacattgaagaaactgaagaagaactcagcaaagctgctaaaatcattaaagaaaaacagaaaggtaatacacctatggattatttgaaaaccaaagccgctgctcttgactttgtccgtattctgatggacaacgaaggtagcgcaaacagtgcccgtaaagcgtgggaagctaaccttgttgaaaaaggagtgactaacctcactaagattcttccagaacctgttcttatcgctattcaagatgcctttactaactataatgggatcttgaaccacgtttcaaaagatccacgttatgcggtgcgtgttgctcttcaaactcaagtatctcaagctaaaggacacaaagctggtaagactaagaaagatgaagacttcacattcttggatttcactatcaactctgcgacagtttatatcaaatatgcctttgaatattctgacttgaagaaagatacaacaggcgcttacttcaactatgtgatgaaagaacttgctcaaggcttcatccgaactattgaacgtgctgttgtcattggtgatggaaaatctaacagtgctgaagacaaaatcactgaaatcaaatcaattgctgaagaaactgaagcgaatctctttgaaacacaagaaatcaatgttgctggtgtatttgacaatgctgttcttgaaacgctggttgctggtattgataagatggttccaaatactactccaattcttgtcacttcaaaagccattgctcgtaaattgaaattggtcaaagatgcagaaggtcgctacatcgatcctcaaccatttgctccaattgcaaccaacggaaatgttattgctggttttcaagtttacatctatgactggatggacggtgcaactaacccaatcattgcatttgctgaccaagcttataagatgattggtgatgaggctgccgctgaccgctttgatgattatgatgtaacagtcaaccgccgtcatattgagcttgctagtgttatgggtggtcgtttggctcagtacaaatcagcggttaagtttacaaacccagcaggt

SEQ ID NO: 2474 - protein, 428 aa, Streptococcus agalactiae
MQKFKGDMMKKSLIELLEARQKATDELAEVKLKKATIEAKMKSSTIEDDDLEQLKTDAESLVSQATAIKETIAGLDSDIEETEEELSKAAKIIKEKQKGNTPMDYLKTKAAALDFVRILMDNEGSANSARKAWEANLVEKGVTNLTKILPEPVLIAIQDAFTNYNGILNHVSKDPRYAVRVALQTQVSQAKGHKAGKTKKDEDFTFLDFTINSATVYIKYAFEYSDLKKDTTGAYFNYVMKELAQGFIRTIERAVVIGDGKSNSAEDKITEIKSIAEETEANLFETQEINVAGVFDNAVLETLVAGIDKMVPNTTPILVTSKAIARKLKLVKDAEGRYIDPQPFAPIATNGNVIAGFQVYIYDWMDGATNPIIAFADQAYKMIGDEAAADRFDDYDVTVNRRHIELASVMGGRLAQYKSAVKFTNPAG

SEQ ID NO: 2475 - DNA, 333 bp, Streptococcus agalactiae
atgacaatccttaaaacaatcaaagaaatggtagaagttgacgttgaagaggatatctttgacgtccaacttttacgatatatcaacagtgggatttcatatttacaaagaaatgctattcctgttatccgtatcgataaagaaacggagttagagggatggacagacattaaggaagaagatagggagacagtgcttgactggttacatctgagatgcgttcaacgttttgacaaatctttgatgacaggcagtgctgctactatggaatggattgacggagagatgacaaatcttttgtatcaactcaaggcaatctatgaagtgaagaca

SEQ ID NO: 2476 - protein, 111 aa, Streptococcus agalactiae
MTILKTIKEMVEVDVEEDIFDVQLLRYINSGISYLQRNAIPVIRIDKETELEGWTDIKEEDRETVLDWLHLRCVQRFDKSLMTGSAATMEWIDGEMTNLLYQLKAIYEVKT

SEQ ID NO: 2477 - DNA, 303 bp, Streptococcus agalactiae
atgaaatcttcaagagtagctatcattctttgctatgatgagcgtgttgaggttgaaaaaggtgtctgggagaaaaagaccgtagaaaagaaagtcaaagctgagaaagagaaaatctatcagcgaaggcttgataaagctatggcagacggtcaagttctgactgctaggtttagtgttcgttccaactatgtgactgacactcttgactatgtcaaatataatggcaaagagtacaaggttaacattgggacagaatcagatgatggtcattacactatcatcgaacttggagaactgaaa

SEQ ID NO: 2478 - protein, 101 aa, Streptococcus agalactiae
MKSSRVAIILCYDERVEVEKGVWEKKTVEKKVKAEKEKIYQRRLDKAMADGQVLTARFSVRSNYVTDTLDYVKYNGKEYKVNIGTESDDGHYTIIELGELK

SEQ ID NO: 2479 - DNA, 357 bp, Streptococcus agalactiae
ttgaggtgtttacaaatgggcggtggtagcgtgaagatgacaccgctaaaggtggatatcaagaatcaagttttagagaacattaagaaggctgcccaaagtacagaaaatgacattagaactggaagccctagacgaaacggtgtttacgaaaaaggttggacacacgacatcatagatgacgccgctgttgttcataataatggcaaagaaaaatctctatcccacctattagagaatggtcatgccactaaaaacggtggctttgttgcccctagagagcatatcagaccagcctacctcaagaataaggagaaattccttaatgatatgaaatccattaaaatcacacctaaa

SEQ ID NO: 2480 - protein, 119 aa, Streptococcus agalactiae
MRCLQMGGGSVKMTPLKVDIKNQVLENIKKAAQSTENDIRTGSPRRNGVYEKGWTHDIIDDAAVVHNNGKEKSLSHLLENGHATKNGGFVAPREHIRPAYLKNKEKFLNDMKSIKITPK

SEQ ID NO: 2481 - DNA, 681 bp, Streptococcus agalactiae
atgacttatcaatacgatacaagggaagtcactcacggtaatgcgaatggtttttatgccaaaattgctaaaactgatgctggtgccttagacttgcagaaaccttatccctttacagggctacgaagcacatcctttgaaacttctcaggaatcaaatgcctactatgcagacaatgtggaacatgttcgtttgcaaggtaaaaaatccacagaagggtctattacaacctatcagattcctaaacagtttatgattgatcacttaggtaaaaagcttacgaactctacaccaccagctttgattgatactggtgtcaatactaacttcatttggggttatgctgaaactgttacagatgagtttggagctgagattgaagagttccacatttggacgaacgttaaggcatctgcacctaaaggcagcacatcaactgatgaaacatcagcgacaccaaaagaaattgaaatcccttgtactgcctctccaaataacttcattgtggattctgaaaagaaacctgtatcagaaattgtatggcgtgatgacagcaaaggaaccgtccgtgggaagtttgacaagttgtttgctgacaagtcaccaggcaagctgattgatttcatcaatgaagcgcttggaacaaccactacacctaccacaactgttagcggaggctct

SEQ ID NO: 2482 - protein, 227 aa, Streptococcus agalactiae
MTYQYDTREVTHGNANGFYAKIAKTDAGALDLQKPYPFTGLRSTSFETSQESNAYYADNVEHVRLQGKKSTEGSITTYQIPKQFMIDHLGKKLTNSTPPALIDTGVNTNFIWGYAETVTDEFGAEIEEFHIWTNVKASAPKGSTSTDETSATPKEIEIPCTASPNNFIVDSEKKPVSEIVWRDDSKGTVRGKFDKLFADKSPGKLIDFINEALGTTTTPTTTVSGGS

SEQ ID NO: 2483 - DNA, 474 bp, Streptococcus agalactiae
atgattaaaaaagaactatcattcacagcgtttgatagttacggtgaagaaagagagcacactgaaacagtgcgctttctttactctttaccagctatcaagatgtatgaacagcgaactggtcgtaacttctttgatgacaaccaaaaagcacttacagcatatacacaacttgctcttgcaactggtgtaaactgtaacctatctgatttaactgatgaagagaaaatcaagatgatgcctctacttatggaacctgatttcatgaacttcttgactgaagtcattccttgcctttatggtgaggttgaaaatggacgtttagtacaaaatgagcttaccgctgaaacagcttcattagctccttggtttggtgatttgattgatattggtttcttctcagacctcttctatgaatttaaccgaagcagagcaaaggtgccgcaagataaaaaaaagcctcttcagaagttg

SEQ ID NO: 2484 - protein, 158 aa, Streptococcus agalactiae
MIKKELSFTAFDSYGEEREHTETVRFLYSLPAIKMYEQRTGRNFFDDNQKALTAYTQLALATGVNCNLSDLTDEEKIKMMPLLMEPDFMNFLTEVIPCLYGEVENGRLVQNELTAETASLAPWFGDLIDIGFFSDLFYEFNRSRAKVPQDKKKPLQKL

SEQ ID NO: 2485 - DNA, 126 bp, Streptococcus agalactiae
atggatgttttttgggcagaatcccaacactttaactatttgatgggaacgcttcaccaaatgagcatcaatcaggaagaaaagaaaaccttatccaacgctgatttacttagcgtgatgtcagat

SEQ ID NO: 2486 - protein, 42 aa, Streptococcus agalactiae
MDVFWAESQHFNYLMGTLHQMSINQEEKKTLSNADLLSVMSD

SEQ ID NO: 2487 - DNA, 168 bp, Streptococcus agalactiae
ttggacaaggaactagtaaagctagaccacaaagactgtccagttgagactactgaagaccaaaggccagaaagccaggcagtgaaatttgaccacgctgtggtggcagtcgtgactatgttagtccacaattcagaaagccaggcagcacaagaatcccacgttgac

SEQ ID NO: 2488 - protein, 56 aa, Streptococcus agalactiae
MDKELVKLDHKDCPVETTEDQRPESQAVKFDHAVVAVVTMLVHNSESQAAQESHVD

SEQ ID NO: 2489 - DNA, 2733 bp, Streptococcus agalactiae
atgactgaaacgtttgaaggcttatacgtcaaatttggtgctaatactgttgaatttgataggtctgtaaaaggtatcaacactgccttatctagtttgaaaaaagacttcaataacatcaacagacaattgaagatggatccagacaatgttgacttgttgaatcgtaagttggttaacttgcaagaacaggctcgtgttggtgctataaaaattgctgaactcaaaaagcaacagaaggcactgggagaatctgaagttgggtcagcacagtggaataagcttcaacttgaaattgctaaggttgaatcacagatgaagattgttgataaggcaatggagtcaacaaagaaacacattgaagatgtaggagacccaaagtctattctgaatcttaacaaagaacttgataatgttgctaaagagcttgatattgtcaatcaaaagcttgagctagaccctgacaatgtcgaactagcagagcaaaaaatgaaactacttggcaaacagtcggaattggctggggataaagtccaagaattaaagaaaaaacaagctgcccttggcgatgagaaaataggtacagaagaatggcgtcaacttcaaaatgaaatcggtcaagctgaagttgaagttctaaagattgaccgtgcaatggacattcttggtgagtcaagccgttctgcaactggagacatcaaagaggcaaccagctatttaagagctgatgtcatgatggatgttgcagataaggctggtcagattggccagaaaatggttgacgctgggaaaatgacagtagatgcttggtctgagatagatgaggctctggacaccgtcacaaccaaaactggtctgactggtgatgccttagcagagcttcaggaaattgctaaagacattgctactggtatgcctaccagctttcagaatgctggtgatgccgttggggaattgaatactcagttcggtttgactggggaaaagctgaaatcagcatctgaattacttatcaagtatgctgagattaacgaaacagacatttcaagctctgccatttctgcaaaacaagctattgaagcttacggtttgacagctgaagacttgggaatggtcttagacaatgtgaccaaagccgctcaagatacaggacagtcagttgacacgattgttcaaaaagccattgacggtgctcctcagattaaaggtttgggactttcttttgaagaaggtgctgcactgatcggtaagtttgagaaaagcggtgtggattcatctgctgctctatcctctctatcgaaagctgctgtcatctatgctaaagacggtaagactctgacagatggattgaatgagactgttagtgctattcaaaattctactagtgagacagaggctttaagtattgcctcagaaatctttggtagtaaggctgctcctagaatggtcgatgctattcagcgtggtgcttttagctttgatgacttagctgaagcagctaaaagttcctctggtactgtctccaccacatttgatgagacgcttgacccaatagataagttgactcagtattctaaccaagcaaaagagggaatggcagaacttggcggtaaattgcttgagactgtcatcccagctttagaacctttgatgggtatgcttgaatcttctgtcaattggtttactagcctaaacgaaactgatcaacagactatcgtgattcttggcctagttacaactgctgtgatgatgttgcttggtgcaattgcaccgctggtcatcgccataggggcaataggtgcgcctgtcggaattgtagtggcggcaatagtaggggctattgccgtcataacacttatcatccaagcaatcatgaactggggagccataactgaatggcttcagtcaacgtgggattcttgtgctgcctggctttctgaattgtggactaacatagtcacgactgccaccacagcgtggtcaaatttcactgcctggctttctggcctttggtcttcagtagtctcaactggacagtctttgtggtctagctttactagttccttgtccaatattttctcaagtttgattacaggtgctcagtctctgtggtcaagtttcacttccactctttccaatttgtggtctggactggtctcaactgggtcaaatttgtttaataatttgagtagcacgatttcaggaatttttaatgggatactttcaacagcaagcaatatttggaattccataaaatccactatttccaatgcaatagatggggcgaaaaatgcagtgtccaacggggtcaatgccatcaagaatctgtttaacttccagattaaatggcctcatattccactacctcacttccgtgtgagtggttctgctaaccctctggattggctaaaaggtggcttaccaagtatcggcattgactggtatgccaagggcggtatcatgaccaaaccaaccctatttggcatgaatggaaaccgtgcaatggttggcggtgaggctggcgctgaagccatcttgccattgaataagtcaaccctgggggcaattggtcaaagtattgctaacacgatgaatacatcgaacaatattaacgttaacttctctggcgtcactatcagggaagaagctgaccttaacagactagccaacgtggttggaaatcgtattgctgaagaattgcaacgtaaaactaatttgagaggaggaatggca

SEQ ID NO: 2490 - protein, 911 aa, Streptococcus agalactiae
MTETFEGLYVKFGANTVEFDRSVKGINTALSSLKKDFNNINRQLKMDPDNVDLLNRKLVNLQEQARVGAIKIAELKKQQKALGESEVGSAQWNKLQLEIAKVESQMKIVDKAMESTKKHIEDVGDPKSILNLNKELDNVAKELDIVNQKLELDPDNVELAEQKMKLLGKQSELAGDKVQELKKKQAALGDEKIGTEEWRQLQNEIGQAEVEVLKIDRAMDILGESSRSATGDIKEATSYLRADVMMDVADKAGQIGQKMVDAGKMTVDAWSEIDEALDTVTTKTGLTGDALAELQEIAKDIATGMPTSFQNAGDAVGELNTQFGLTGEKLKSASELLIKYAEINETDISSSAISAKQAIEAYGLTAEDLGMVLDNVTKAAQDTGQSVDTIVQKAIDGAPQIKGLGLSFEEGAALIGKFEKSGVDSSAALSSLSKAAVIYAKDGKTLTDGLNETVSAIQNSTSETEALSIASEIFGSKAAPRMVDAIQRGAFSFDDLAEAAKSSSGTVSTTFDETLDPIDKLTQYSNQAKEGMAELGGKLLETVIPALEPLMGMLESSVNWFTSLNETDQQTIVILGLVTTAVMMLLGAIAPLVIAIGAIGAPVGIVVAAIVGAIAVITLIIQAIMNWGAITEWLQSTWDSCAAWLSELWTNIVTTATTAWSNFTAWLSGLWSSVVSTGQSLWSSFTSSLSNIFSSLITGAQSLWSSFTSTLSNLWSGLVSTGSNLFNNLSSTISGIFNGILSTASNIWNSIKSTISNAIDGAKNAVSNGVNAIKNLFNFQIKWPHIPLPHFRVSGSANPLDWLKGGLPSIGIDWYAKGGIMTKPTLFGMNGNRAMVGGEAGAEAILPLNKSTLGAIGQSIANTMNTSNNINVNFSGVTIREEADLNRLANVVGNRIAEELQRKTNLRGGMA

SEQ ID NO: 2491 - DNA, 3633 bp, Streptococcus pyogenes
atgggagaatcttattctgttgaagcggttttgacagctgttgataaaacctttggcaaaacattacaatcggcaatccgttcaatcgatggcttggaaaagcgttcaaccggtttttcatcggtgtctcaaaaagctagttccatgtttaaatccatgttaggagcgaatttagccggacaagctatctcagcaatgacaaggacagtgtcatcaggccttggctctatgcttggcgagatgaatagttcagcgaaagcgtggaaaacttttgacgccaatttagcggacattgggtttggaaaaaaacaaattttggcagctaaaacggcgatgcaagactatgcaactaaaacaatctactcggcatcagatatggctagcacgtatgcacagttagcggcagttggtgtgaaagataccggaaagctcgtaaaagcttttggcggtttagctgcatctgctgaaaacccgaagcaggccatgaagtctatcagtcaacaaatgacgcaagcagtaggaagaccaacagttgcatggcaagactttaggataatgctggaacaggcgcctgcagggatggctaaagtcgctaaatctatgggtaaaaatcttgatgaactcgtcgccgatatccaggcgggtagggttaaaaccagcgattttttggaagcggtaaaaaaagcaggcaatgataagagtttccaaaagatggcaactgagttcaaaactgttgaccaagccatcgacggtatgcgagaaggcttatccaacaaattgcaaccagcgtttgaaaaagtgaaccaatttggaattagagcgatcgaagcaatcggtaaacaactcgataaagttgatttttctaagtttgctagtaatcttgggaaattccttgaaggaattaatatcgataaaattgtatctaatatttcatcggcgatttcatctgtcacttcaaaggttaaagaattttggggcggtttcaaacaaactggagcaattagtgctttttcaggagctttaaaaagtgtttggggagcgttaaaaaatgtagctagcgctatgagtggaggcagttggaaaaactttggctctattgtaggcggaattgtaaagcatgtgtctaattttgcaaaagctattgctgatgttgtcggtaaaatggaacctggcagattgcaaagctggatagccacttttgcagcagtcgggggagggttaaagttatttgaaaagctaacaggacaaagcgttgttggctcttttttagataaaatcagtacaaaatttggattatttggcaaaaaagctaaagaaggaaccgatcaagcagcgaatggctctcgtaaaagtggtggaatcatcagccaaatctttaatggcttgggtaatatcgttaagtctgctggtacagccatatcaacagctgcaaaaggtatcggtacagggattaaaaccgccttgtctggggcacctcctatcattagttctctaggaaccgcaatatcaacagttgcgcaaggtataggcactgggctagcaatcgcttttagaggtttaggagctgcaatcgctatggtgcctcccaccacttggctagctttaggaacggctattttaatggtaggagcggcttttgccttagcaggaactcaggctgatggcattagtcaaattttaaggactattggcgatgttgttgtacaagttttacaacaggtcactgatagtctagccactttactaactattatcgcaaacgctattggctctatgttgccaattgtagctggagctatctctcagattgtaggcgcagtagcgggcggattatctcagctcattatagccgtttcaacaggggtatctctcgttataggagctttcacaggacttcttggtggtatttctggggttattaactccattagcgctgttatccaatcgctaactggtgtgattaccgcagtattcaatggcatagctactgttatttcatctgtcggttcgactatcaaagatgtattgacgggtctaggaaccgcttttgaaggatttgggaatggtgtaaaatcagctctagaaggtgttggggcagtaattgaatcatttggtagtgcagttaggaatgtccttgacggtgttgcaaatatccttgattctatggggactgcggcacttaatgcaggccgtggcgtcaaagagatggctaaaggtattaagatgcttgttgatttatcccttggagatttggttgctacattagcagctgtggcaagcggtctagggaagatggctagctcagctggcgaaatgacaacattaggttctgctatgagcaaagtagccaatggtatgacacgtctagcaacaagtgctacgatagcaattactggattaacagtctttgccaccaccatggcaactattaagacagcagttgcaactctaccgccagtcctaacgatggcagcgagtgggtttaccacatttactactcaggcggtggcagcagtgactggattggctgcaattaatgctccaatcactatgtttaaagctcaactaatgacaataacaccagctctagcacaagctggcgctggctttgccgcgtttgttgctcaatcatcaacatttagtacaggtttagcatctgccggtcctacaatagcagcattcaatgctaatttgatgagcttatctgcaacaacaggagtgctagttgcatcaatagctggtttatcagctgtgctttctgttgtatcagctggctttagccaaataggggcttctgcgacagcaactgttggtcaaatacaagcttttgcttctagtacaacagttgtttcgtcagcatttgctagcatgcaatctatgattcaatctgccatggctgcaatagtaagcagcattataacatcatttaatcaagcggcctctcaaatgcaatcaatcttatctcgaatgctatctcaggccaggacatttgggtctcaactagagcaacaaatgagacaatcgggacagcgttcaggacaaaatcttgctcgggggctatcttctcaacaaggtgctgttattaatgctatttctagcatggttaatgctgcggtatcaagagccaacgcgggagctggtcctatgcgtcaagctggagcgtacatcggacaagggcttgcgcaaggaatgtattcagcgctaggagctgtaacagctgcagcaaacgcccttgtagcacaagccgagagagcagcaagagccaaggcgatgattcattcgccgtcaaggttgtttgcaaaacgagttggtcaatatatcccgcaaggggtagctatgggtatcgacaaaaacgctgatgtcgttgacgactctgttggcgggttatttgatagcatcaatagctttgattttaatatcgcagatagactgactagcattggagctaaattccaaggtgttgtcaaatcagagagttcgcaatcgttatcgcagcaacaagagtttgtacatacagctcaaccagcgtatataaactttagtttaggcggaaacgaatacgaagcatttgtaagtgacatcactaatcaacaagcaaaaattgaaaaaatcagactaaagagaagcagctgg

SEQ ID NO: 2492 - protein, 1211 aa, Streptococcus pyogenes
MGESYSVEAVLTAVDKTFGKTLQSAIRSIDGLEKRSTGFSSVSQKASSMFKSMLGANLAGQAISAMTRTVSSGLGSMLGEMNSSAKAWKTFDANLADIGFGKKQILAAKTAMQDYATKTIYSASDMASTYAQLAAVGVKDTGKLVKAFGGLAASAENPKQAMKSISQQMTQAVGRPTVAWQDFRIMLEQAPAGMAKVAKSMGKNLDELVADIQAGRVKTSDFLEAVKKAGNDKSFQKMATEFKTVDQAIDGMREGLSNKLQPAFEKVNQFGIRAIEAIGKQLDKVDFSKFASNLGKFLEGINIDKIVSNISSAISSVTSKVKEFWGGFKQTGAISAFSGALKSVWGALKNVASAMSGGSWKNFGSIVGGIVKHVSNFAKAIADVVGKMEPGRLQSWIATFAAVGGGLKLFEKLTGQSVVGSFLDKISTKFGLFGKKAKEGTDQAANGSRKSGGIISQIFNGLGNIVKSAGTAISTAAKGIGTGIKTALSGAPPIISSLGTAISTVAQGIGTGLAIAFRGLGAAIAMVPPTTWLALGTAILMVGAAFALAGTQADGISQILRTIGDVVVQVLQQVTDSLATLLTIIANAIGSMLPIVAGAISQIVGAVAGGLSQLIIAVSTGVSLVIGAFTGLLGGISGVINSISAVIQSLTGVITAVFNGIATVISSVGSTIKDVLTGLGTAFEGFGNGVKSALEGVGAVIESFGSAVRNVLDGVANILDSMGTAALNAGRGVKEMAKGIKMLVDLSLGDLVATLAAVASGLGKMASSAGEMTTLGSAMSKVANGMTRLATSATIAITGLTVFATTMATIKTAVATLPPVLTMAASGFTTFTTQAVAAVTGLAAINAPITMFKAQLMTITPALAQAGAGFAAFVAQSSTFSTGLASAGPTIAAFNANLMSLSATTGVLVASIAGLSAVLSVVSAGFSQIGASATATVGQIQAFASSTTVVSSAFASMQSMIQSAMAAIVSSIITSFNQAASQMQSILSRMLSQARTFGSQLEQQMRQSGQRSGQNLARGLSSQQGAVINAISSMVNAAVSRANAGAGPMRQAGAYIGQGLAQGMYSALGAVTAAANALVAQAERAARAKAMIHSPSRLFAKRVGQYIPQGVAMGIDKNADVVDDSVGGLFDSINSFDFNIADRLTSIGAKFQGVVKSESSQSLSQQQEFVHTAQPAYINFSLGGNEYEAFVSDITNQQAKIEKIRLKRSSW

SEQ ID NO: 2493 - DNA, 243 bp, Streptococcus agalactiae
ttgaaccctcaaaaccccattaccagtcaatgtctggatgtcagtggtcttgaaaaacttggtagggtggcagatgaaggtaacatcgaccacccaggcaccaaattcgtcttttccaatctcaaagctatcaaccttataacaccaaagcctaatagttggttcctgttcattttccaaccaaaacttttcacggttcaaaagagcagaaaagcgataaatttcttcatcgcttggctcaat

SEQ ID NO: 2494 - protein, 81 aa, Streptococcus agalactiae
MNPQNPITSQCLDVSGLEKLGRVADEGNIDHPGTKFVFSNLKAINLITPKPNSWFLFIFQPKLFTVQKSRKAINFFIAWLN

SEQ ID NO: 2495 - DNA, 720 bp, Streptococcus agalactiae
atgacaaaaatcaatgaacttaccattgacggtgtgaaaacatcatcttttaagtgtgatgtattggttgaaactagaccaaatgtcattgtctccagctccaaaacagctctattagagcatgatggtattagtggtgcagttgtgcaatcgaatagacaccgtggactaattgagaagccttatcatatcactttaattgagccaagcgatgaagaaatttatcgcttttctgctcttttgaaccgtgaaaagttttggttggaaaatgaacaggaaccaactattaggctttggtgttataaggttgatagctttgagattggaaaagacgaatttggtgcctgggtggtcgatgttaccttcatctgccaccctaccaagtttttcaagaccactgacatccagacattgactggtaatggggttttgagggttcaagggtcagctcttgcttttccgaagattacagtggttggtcagagcgcttctgagacatcgtttacgataggtaaccaagtgattaagcttgaaaagctctcagaatcgctcgtgatgaccaatgatcctgacaatcctagctttaagacggctagtggaaaactcattaagtgggctggtgattttatcacagttgatactgctaaggggcagaatgtcggtgttgttttaggtgctggcataacatctttgaaatttgaaacagtttgggggtgggca

SEQ ID NO: 2496 - protein, 240 aa, Streptococcus agalactiae
MTKINELTIDGVKTSSFKCDVLVETRPNVIVSSSKTALLEHDGISGAVVQSNRHRGLIEKPYHITLIEPSDEEIYRFSALLNREKFWLENEQEPTIRLWCYKVDSFEIGKDEFGAWVVDVTFICHPTKFFKTTDIQTLTGNGVLRVQGSALAFPKITVVGQSASETSFTIGNQVIKLEKLSESLVMTNDPDNPSFKTASGKLIKWAGDFITVDTAKGQNVGVVLGAGITSLKFETVWGWA

SEQ ID NO: 2497 - DNA, 693 bp, Streptococcus pyogenes
atgatacctaaagttattattgatgattttgacacatcttcaatccctaattgtgttttgaccggttacgatgtgggggatattctatcccctagttttgtcgaaaatgaagcttatggcatgaatggaactagtagggaattggagtcatataatgaatctaaaccaaccataatgtggcatttgagtacttttgatgatgcagttaatctaattaatcatttagacggccttagtaaaaaaatcgaattttggcacatacctaactctatttattactatgattgcttatctgtcaaaatcaatgcggtaaccatgtcatcatggcgtgtgactctcaaacttgctctttatccatttagatacgcaaaaggtgtctcagatgtagtaattgcaggcaacggaaacattaacaatgcaggaaatgttttcagcgaacctaagatagttgttgagggtactggtaaaggaacgctaaccattggcaaacaggtcatggaattaaatttgtcaggtaaagcaacgattgagtgcaaacatggccaacaatgcgtctatgatgctgaaggtaatgtgaaaaactcaatccgaataagaggaagtttttttgaaatacaacctggcacacaaggtattgccgtcagtggaggcattactagaacaataattagtccaaggtggaggtataaggtt

SEQ ID NO: 2498 - protein, 231 aa, Streptococcus pyogenes
MIPKVIIDDFDTSSIPNCVLTGYDVGDILSPSFVENEAYGMNGTSRELESYNESKPTIMWHLSTFDDAVNLINHLDGLSKKIEFWHIPNSIYYYDCLSVKINAVTMSSWRVTLKLALYPFRYAKGVSDVVIAGNGNINNAGNVFSEPKIVVEGTGKGTLTIGKQVMELNLSGKATIECKHGQQCVYDAEGNVKNSIRIRGSFFEIQPGTQGIAVSGGITRTIISPRWRYKV

SEQ ID NO: 2499 - DNA, 3672 bp, Streptococcus agalactiae
ttgctctttttacttgatgcaaatgtaagaacggtcaaatggaatggcattccactacatgaagccagctctgccattgtcaaagaagaaaccaacggtgatttctacctgactgttcgctatcctatcacggattcaggtatctatcagcttatcaaagaggatatgctgattaagtcgcctgtgcctgtgctgggcgctcagctgttccgtatcaagaagcctattgagaatgacgacagcatggacatcactgcctatcatgtctctgatgacatcatgaagcggtctatcactcctgtgagtgtggttggtcaaggctgtgctatggcactgtctcagatggttcaaaatgctaagactgggctaggtgatttctcctttaccagcgatattatggacagccgaacctttaacacgactgaaacggaaacgctctactctgtccttatggacggtaaacacagtattgttggaacgtgggaaggtgagcttgtccgtgataactttgccttatctatcaaacgtagccgtggggctgatcgtggtgttgtcatcacaacacacaagaacctcaaatcctatcaacgaaccaagaactctcagggtgttgtcacaaggattcatgcacggtcaaccttcaaacctgatggagctgaagatgaagtgacgctcagagtgtctgttgacagtccactaataaactcttatccctacatcaatgagaaagagtatgagaacaacaacgctgaaaccgttgaagaccttagaaagtgggctgaggctaagtttacaaatgagggcattgataaggtttctgatgccattgagattgaagcctatgagcttgacggtcaagttgtaaatctgggcgacacggttaacctcaagagtagaaagcacagtgctgacctctacaagaaggccattgcctacgagtttaacgctttaacggaagagtatatctccataacttttgatgataagccaggagttggtggttctggggtgtcaagtggcttgtctaatgttgctgatgctatacttgtagcaagtgccacagctcaggacgttgctgttcaaagggctgtgaaaaatgctaacgctgcctttgatgcagagtttggtaaaacaaaaacaaaaattaatgatgatatcgaaatcgcaaaagccaaagtagaaagctttaaatcggaactatctaatcgcatggataatcagcttcttccccttgcgacagaagctaagaatttagccagtcaggcacaagcagacttgaccagaaaagaaatagagcttagagctgaattaaatagacaagtcacaagcacagaagctgtaaaaatctctctaacaaatcttagtcacaatatggatatcattaagcaaaaagccctaaacgaccttagagacgcagagacaaggctaaaggaagctgatagcgtccaacaacttgcgacaaagcgggttgaggataaactgacaggacttagcacgaaactggagtcattctctgttggtggctataattatgtcattgacggcggagaacctaaagaactaatggctaacttctatggtaagacctatgatattaatccccaactactcgaacgaactagtcaagcgaccttgagttttagctatgaagcagaatcaactagtcgtttagaagttagactttataaaaagatgcacaccggggacactagtaagattacaattattgtcatgcctaactttgacttatctccagggaaaggctttatctctcagagctttgatttaggtggtgttatgcctgaccctagaaaccaagcctggcttgtgatgcgggggacaaatgctaaccccttgacgctctcgaaagttaagctggaacgtggtaccgttgctacagactggaataatcgcgatgaaaccttaaaagctagcttcgccgaatacaagcagaccgttgatgaaaacttagccaaccttagaacaagtacggaaaccttggcaggtcaactgacaagtgctgagtctagcattaggcagacgtcggaatcctttagcaatcgtttagttagtcttgagacctataaagatagtgaaccaaatcgagctagtcgttactttgaagcaagcaagtctgaaaccgctaagcagctatcagccttacgaacagaggttaatggctcttatgtggataagtcaacctatgaggaaaatgcaagaggtttgataagacgctttgaaagtctgtcatcagggacacagaactatgctttggggactgaaagagatgtctatctaaacgtttcagggactaccgtctatgacctttatagcttcggtactaccttagccgtaaaagggattgaaatgggagatactgtaactattgcatttaactattttgcggatagtcggacggcttttggttcttatgaactggagctatacggacatgcaggcaaaatcgaacgggttggtgaggtacagagaacgatatcaaatcgtggtacctataccgcatcttttgtggcaaacaatgccaatttcagggcaaactcccttaaaattagatttacggatagccaacttaagtttagagtgacaacacttcgtgtgactaaggggacaattcctgcggactggagtccatctccagatgacctgaaagcctactcagatactaagcttgaacagacagctaatgagattaaagctagtgtaacaagtcttgatcataaaactcttaagcaaactgatattactatgacttctgaagggattgtcctgagagcaggcaagacgagtaatgatgtggcaagagctattggctcttactttaaggtcactcctgatgctatagctctgtttagctcactgataaaagttagcgggaacatgttggttgatggttctgtaactagtcgtaagttggtaacaggcgctgtcgaaacgggacatgttaaggctggagcaatcacaggagtgcttttagcagctgaagctgtaacggcagaaaaacttaaagtcgaccaagctttctttaacaagttgatggccaacgatgcctacttgaagcaactatttgccaagtcagccttcatcactcaggttcaatccgtgacaatatctgccagtcagatttcgggcggtgttattaaagctttgaataatgccatggaaatccagatgaacagtggtcagatactttactacactgaccaagctgcactgaaacgggttttgagtggctatcctactcagtttgttaagttcgcaactggtacagtatctggtaaaggaaatgctggtgttacggtcattggttctaaccgctacggtacagaatcaaccaatgatggtggatttgttggagtccgtgcatggaacggctcaaacattgactcacttgacttagttggtgatgaaatccgattagcaagctctgcctttgacaattcagatggttgggatgttcggacacttgattcaggcttgaaaatcacaccacacaatagggctgctgaacgcaatagccgaattgaggttggtgatgtctggattttaaaaggaaatggatcctattcttctctcagagatattttgaactcattcaatgagaacttctcaaaaggcccaaatgctgactcttacacttactacccttcagggttc

SEQ ID NO: 2500 - protein, 1224 aa, Streptococcus agalactiae
MLFLLDANVRTVKWNGIPLHEASSAIVKEETNGDFYLTVRYPITDSGIYQLIKEDMLIKSPVPVLGAQLFRIKKPIENDDSMDITAYHVSDDIMKRSITPVSVVGQGCAMALSQMVQNAKTGLGDFSFTSDIMDSRTFNTTETETLYSVLMDGKHSIVGTWEGELVRDNFALSIKRSRGADRGVVITTHKNLKSYQRTKNSQGVVTRIHARSTFKPDGAEDEVTLRVSVDSPLINSYPYINEKEYENNNAETVEDLRKWAEAKFTNEGIDKVSDAIEIEAYELDGQVVNLGDTVNLKSRKHSADLYKKAIAYEFNALTEEYISITFDDKPGVGGSGVSSGLSNVADAILVASATAQDVAVQRAVKNANAAFDAEFGKTKTKINDDIEIAKAKVESFKSELSNRMDNQLLPLATEAKNLASQAQADLTRKEIELRAELNRQVTSTEAVKISLTNLSHNMDIIKQKALNDLRDAETRLKEADSVQQLATKRVEDKLTGLSTKLESFSVGGYNYVIDGGEPKELMANFYGKTYDINPQLLERTSQATLSFSYEAESTSRLEVRLYKKMHTGDTSKITIIVMPNFDLSPGKGFISQSFDLGGVMPDPRNQAWLVMRGTNANPLTLSKVKLERGTVATDWNNRDETLKASFAEYKQTVDENLANLRTSTETLAGQLTSAESSIRQTSESFSNRLVSLETYKDSEPNRASRYFEASKSETAKQLSALRTEVNGSYVDKSTYEENARGLIRRFESLSSGTQNYALGTERDVYLNVSGTTVYDLYSFGTTLAVKGIEMGDTVTIAFNYFADSRTAFGSYELELYGHAGKIERVGEVQRTISNRGTYTASFVANNANFRANSLKIRFTDSQLKFRVTTLRVTKGTIPADWSPSPDDLKAYSDTKLEQTANEIKASVTSLDHKTLKQTDITMTSEGIVLRAGKTSNDVARAIGSYFKVTPDAIALFSSLIKVSGNMLVDGSVTSRKLVTGAVETGHVKAGAITGVLLAAEAVTAEKLKVDQAFFNKLMANDAYLKQLFAKSAFITQVQSVTISASQISGGVIKALNNAMEIQMNSGQILYYTDQAALKRVLSGYPTQFVKFATGTVSGKGNAGVTVIGSNRYGTESTNDGGFVGVRAWNGSNIDSLDLVGDEIRLASSAFDNSDGWDVRTLDSGLKITPHNRAAERNSRIEVGDVWILKGNGSYSSLRDILNSFNENFSKGPNADSYTYYPSGF

SEQ ID NO: 2501 - DNA, 1956 bp, Streptococcus pyogenes
ttgatatcgattaaagatgataatacccctcttgtagcagcctttgaagatgagattacacaggaggccaatagtgattacaaactaaattttaagtatcctgctaaacacgagtatcgccctttaataaaaaaaggaataatcttagaagctgatgatctgcatggttctcagctttttaggatttttgaaattactaagcggcatggctatattaacgtttacgctaatcaggtcgctgatgacttaaatggctatgcaattgacactatcagtgttgatagggtgcaaggcatgacagtaatgtcagagttagcaggtagtatcaagcgtgagcatccttttagcttttttagtgatattgacggtcgtcacacatttaatcaatcagacgtatctgttatggacgctttagctaatggcaagcactcaatcatggggcagtggggtggcgaacttgtacgaaataaataccaaattaacttgctcaaaaaagctggcaaagataccgaaaccttgttcatgtacaagaaaaacctcaaatcttatgaggaaacagatactatcaaagggcttgtctctatccttcatttagttgctgaagtagaagaagaacatgaagtagaaaccagagaagcttcagatggaaacattggtcatagtgaatcaccgaaaaagaaaacaattagggtatctgttgagagcaagctcaaagacactcatccgataattgttgaaaagactatcaaggtgcaggatcaagatgtcaaaacagaagaggacttgcttgcatatggtaagaaatactttgaaaaaactctttgcgacataccaggtaatagtttaaaaattgatgttactaataactacgagggcgctgttaggctatttgacacagcaattgtcttccacgagctctatgacagagacttacgaatgcaaatcactggctatcggttcgcccctatggctaatcggttaaaatccatcatctttggagagattaagaccaacttagcaaaacaaattagcaatcaaattgacaataaggtagctgaatcaactgctcaacatgacgcagcatttgaagcaaaattacaaaagcagattgataatgctaatcgtatttttgacacaaaagaagctaaactccgtgaagagattgaagatggcatcaaaaaagctgaagctaatgcagaggtcaaagttgctgaggttaacgctaaagtgctggaagctgaggagctagccaaggcagtcgatgagcgactcaaaaaatttttatctgatgctgacactaaagagcaagattttgataaaaaacttgaagaatttagaacgtctcttaaagaccttgaagttgatgaaaagcagattgatgatgctttggccaaagccggttttagcaaggatagcttagctgacattaaagctaaactggaagacacgtctgaaactgccacagttacagctaacattgttggatcaactggcggcacgttttacaatcgcaacagactggatggtgatactgacaaagttatcacttttgaacaaggttatattgacattgcccataatggtgaaggttttgaagaaggcaagacatacactatcagctttgaggcaacctgtgagctactgcgtaaagtaggaatcacagtgacacaggctaacatgaaaggtgctcgcttagtgttaacacctaaaaatcccaaattagttgtcgagagttttggcttgactaaggatactgagactatcaatgtctatccgtttagctacacagtgcttgtaaccagcgactggtataaatctaagcagatagatttaaacgcgtcggaggtgcaggaattggctctggagatggattataaagatgttgttgacggtaataatgccacaatcacagggcagtggtcagacagcccacaaattatattagacggaggtaat

SEQ ID NO: 2502 - protein, 652 aa, Streptococcus pyogenes
LISIKDDNTPLVAAFEDEITQEANSDYKLNFKYPAKHEYRPLIKKGIILEADDLHGSQLFRIFEITKRHGYINVYANQVADDLNGYAIDTISVDRVQGMTVMSELAGSIKREHPFSFFSDIDGRHTFNQSDVSVMDALANGKHSIMGQWGGELVRNKYQINLLKKAGKDTETLFMYKKNLKSYEETDTIKGLVSILHLVAEVEEEHEVETREASDGNIGHSESPKKKTIRVSVESKLKDTHPIIVEKTIKVQDQDVKTEEDLLAYGKKYFEKTLCDIPGNSLKIDVTNNYEGAVRLFDTAIVFHELYDRDLRMQITGYRFAPMANRLKSIIFGEIKTNLAKQISNQIDNKVAESTAQHDAAFEAKLQKQIDNANRIFDTKEAKLREEIEDGIKKAEANAEVKVAEVNAKVLEAEELAKAVDERLKKFLSDADTKEQDFDKKLEEFRTSLKDLEVDEKQIDDALAKAGFSKDSLADIKAKLEDTSETATVTANIVGSTGGTFYNRNRLDGDTDKVITFEQGYIDIAHNGEGFEEGKTYTISFEATCELLRKVGITVTQANMKGARLVLTPKNPKLVVESFGLTKDTETINVYPFSYTVLVTSDWYKSKQIDLNASEVQELALEMDYKDVVDGNNATITGQWSDSPQIILDGGN

SEQ ID NO: 2503 - DNA, 228 bp, Streptococcus agalactiae
atgaaccaagaacaacaactcaatcaagcgctacgcttgacggtcaatgaattgacagcccagttggccaatgagtcaaccactaagaacttgctggctatccagctgactgaagttgttcaggagaaacagcaactgactcagcaaaatgctgaacttcaagcaagagtttccgaactagaaggcttgcttgatgaacaaactcaaccagaaatcattgaaggagaa

SEQ ID NO: 2504 - protein, 76 aa, Streptococcus agalactiae
MNQEQQLNQALRLTVNELTAQLANESTTKNLLAIQLTEVVQEKQQLTQQNAELQARVSELEGLLDEQTQPEIIEGE

SEQ ID NO: 2505 - DNA, 336 bp, Streptococcus agalactiae
gtgactacaacagaaaataatttacttgaccttgaaacaatcacagaaccctttgacttggcgacagcactcaagtacatgaaggaaaatggtgagttcatccgttgcaagaatgctgtcaatgacttctacatgtaccgtgacatgcagaaacgtcctgtcatcgtcaatggccgccgtcaattcaaggacgtagaaactgtctgggcatttaaccaatggggcgggacaacacccacaatcaacatagctgatttctttaatcttgaatactacatcatgacctttgatgagaacggaaatcctgactggactgagcctcacttggaggataag

SEQ ID NO: 2506 - protein, 112 aa, Streptococcus agalactiae
MTTTENNLLDLETITEPFDLATALKYMKENGEFIRCKNAVNDFYMYRDMQKRPVIVNGRRQFKDVETVWAFNQWGGTTPTINIADFFNLEYYIMTFDENGNPDWTEPHLEDK

SEQ ID NO: 2507 - DNA, 408 bp, Streptococcus agalactiae
atgccaccatggttaatagatagcactgtggttgtggcgatggtgacggtgctgggcggtctgttcagcactattatcaccacttcagccaatcggaaagaccagctgataaaacatcagtatgaggatatcaaggaagatttgtctggcttgattgacaaggttaagacgattgatcatacaaccacggaaacaaagaaaatttcagaaatcacaaaagacggtacgcttaaaatccagcgttaccgtctttttcacgatttgacaaaggaaatttctcaaggctacacaactattgaacatttcagggagttgagcattctctttgagagttatcaactgcttggcggaaatggggaaattgaagccttgtttgagaaattcaaacagttaccaattgaggaggac

SEQ ID NO: 2508 - protein, 136 aa, Streptococcus agalactiae
MPPWLIDSTVVVAMVTVLGGLFSTIITTSANRKDQLIKHQYEDIKEDLSGLIDKVKTIDHTTTETKKISEITKDGTLKIQRYRLFHDLTKEISQGYTTIEHFRELSILFESYQLLGGNGEIEALFEKFKQLPIEED

SEQ ID NO: 2509 - DNA, 327 bp, Streptococcus agalactiae
atgacacaaattacagatattatcatcagctcagctatgggaattttgaccattttggcaggaattgcagtgcaagctgtcaaggtttatttgattaaaaaaggcggtgaaaaggccgtcttgattacagaaatcttggccaagaacgctgttaatgctgtggagcaagtggccactgaaactggcttcaaaggagctgacaagctaacttctgctaaggctcagattttagctgagttgcaaaaatacaatatccacatgtcagacgatgatctcactttgtttgttgaatcagctgtcaaacaaatgcacgatgcctggaaggag

SEQ ID NO: 2510 - protein, 109 aa, Streptococcus agalactiae
MTQITDIIISSAMGILTILAGIAVQAVKVYLIKKGGEKAVLITEILAKNAVNAVEQVATETGFKGADKLTSAKAQILAELQKYNIHMSDDDLTLFVESAVKQMHDAWKE

SEQ ID NO: 2511 - DNA, 162 bp, Streptococcus agalactiae
ttgcctggatgtctgcacgtcaaggcaaggtcagctattccatggactaccgtgacggccctaacagctatgactgttccagctctgtctattatgctctcaggtcagctggtgcaagctcagcaggttgggcggtcaacactgagtacatgcacgattggc

SEQ ID NO: 2512 - protein, 54 aa, Streptococcus agalactiae
MPGCLHVKARSAIPWTTVTALTAMTVPALSIMLSGQLVQAQQVGRSTLSTCTIG

SEQ ID NO: 2513 - DNA, 1404 bp, Streptococcus agalactiae
atggaaatcaacactgaaatagccattgcctggatgtctgcacgtcaaggcaaggtcagctattccatggactaccgtgacggccctaacagctatgactgttccagctctgtctattatgctctcaggtcagctggtgcaagctcagcaggttgggcggtcaacactgagtacatgcacgattggctgattaaaaacggttatgagcttattgctgaaaacgtggattggaatgctgtccgtggtgatatagcaatttggggcatgcgagggcactcaagcggagctggtggtcatgtagtcatgtttattgaccctgaaaatatcattcactgtaactgggcaaataatggcatcacagtgaacaactacaatcagacagcggctgctagtggctggatgtattgctacgtttaccgtttgaaaagcggagcttctacccaaggaaaaagccttgataccttggtcaaggaaacccttgctggtaactacggtaatggcgaagcacgcaaggcagtgcttggcaatcaatatgaggctgttatgtcagtcatcaatggcaaaactacgactaatcaaaagactgttgaccaacttgttcaagaggtaatcgctggcaaacatggcaacggtgaagctcgtaaaaagtcgcttggtagtcaatatgatgcagttcagaaacgagtgacggaattgctcaaaaaacagccctctgagccgtttaaggctcaagaggtaaacaagcccacggaaaccaaaacaagccaaacagagctaactggacaagccacagccaccaaagaagagggcgacctctctttcaatgggactatcttgaaaaaagcggtgctggacaagattctgggcaactgtaaaaagcatgatattcttccaagttatgcactgactatcctacactatgaaggtctttggggaacttcagcagttgggaaggcagataataactggggcggtatgacctggactggtcaaggcaaccgtccaagcggtgtcactgtcacacaaggttccgcacgtccttcaaatgagggcggtcactatatgcactatgcaagcgtggatgactttctgacagactggttttatcttctaagggctggtggctcttacaaggtgtctggtgctaaaaccttcagtgaggctatcaagggaatgtttaaagttggcggtgctgtctatgattatgctgcaagcggctttgatagctatattgtcggagcttcaagccgcctcaaggctattgaggcagaaaatggttcactggacaagtttgataaagctaccgacattggtgacggtagcaaagacaagattgacattactattgaaggtattgaagttaccatcaacggtatcacttatgaactgactaaaaagccagtt

SEQ ID NO: 2514 - protein, 468 aa, Streptococcus agalactiae
MEINTEIAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGEARKKSLGSQYDAVQKRVTELLKKQPSEPFKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKATDIGDGSKDKIDITIEGIEVTINGITYELTKKPV

SEQ ID NO: 2515 - DNA, 129 bp, Streptococcus agalactiae
  misc_feature (1)..(129): n = a, c, g, or t
ttgctatttgattttctcgaagaaaaaataaaactgaaagcatacctgatgaccgccttacttgatgatggagaaattaaccttgatcactttaaaacagaatatgctttgagtgnnnnnttaattaat

SEQ ID NO: 2516 - protein, 43 aa, Streptococcus agalactiae
  misc_feature (1)..(43): Xaa = Any Amino Acid
MLFDFLEEKIKLKAYLMTALLDDGEINLDHFKTEYALSXXLIN

SEQ ID NO: 2517 - DNA, 240 bp, Streptococcus agalactiae
atggataccattgaaaatctcattattgctattgtgaaacctttgatttcacaaccagatcagttaaccataaaaattcaggatggcccagaatttttagagtaccatcttgatttagatacccaagacatcggtcgtgttatcggcaaaaagggtcgtacaattacagcgataaggtcgattgtctattcggtaccaacacaagggaaaaaagtaagactcatcattgatgagaaagaa

SEQ ID NO: 2518 - protein, 80 aa, Streptococcus agalactiae
MDTIENLIIAIVKPLISQPDQLTIKIQDGPEFLEYHLDLDTQDIGRVIGKKGRTITAIRSIVYSVPTQGKKVRLIIDEKE

SEQ ID NO: 2519 - DNA, 237 bp, Streptococcus pyogenes
atggataccattgaaaatcttattatcgctattgtgaaacctttgatttcacaaccagataatcttaccattaaaattgaagatactcctgactttttagagtatcatcttgacttggatgctcaagacatcggtcgtgttatcggcaaaaaaggtcgaactattactgcgataagatcgattgtctactcggttccaacactaggaaaaaaagttcgcttagttattgatgagaaa

SEQ ID NO: 2520 - protein, 79 aa, Streptococcus pyogenes
MDTIENLIIAIVKPLISQPDNLTIKIEDTPDFLEYHLDLDAQDIGRVIGKKGRTITAIRSIVYSVPTLGKKVRLVIDEK

SEQ ID NO: 2521 - DNA, 270 bp, Streptococcus agalactiae
atggcagtaaaaatccgtttaactcgtatgggttctaagaagaaacctttctaccgtatcaatgttgcagattcacgtgcaccacgtgacggacgttttattgaaactgttggaacatacaacccattagttgcagaaaaccaagttacaatcaaagaagaacgtgttcttgaatggttatcaaaaggtgcacaaccttcagatacagttcgtaaccttctttcaaaagctggagttatgactaaattccacgatcaaaaattctcaaaa

SEQ ID NO: 2522 - protein, 90 aa, Streptococcus agalactiae
MAVKIRLTRMGSKKKPFYRINVADSRAPRDGRFIETVGTYNPLVAENQVTIKEERVLEWLSKGAQPSDTVRNLLSKAGVMTKFHDQKFSK

SEQ ID NO: 2523 - DNA, 270 bp, Streptococcus pyogenes
atggcagtaaaaatccgtttaactcgtatgggttctaagaaaaaacctttctaccgtattaatgttgcagattcacgtgcaccacgtgatggtcgttttatcgaaacagttggaacatacaacccattagtggctgaaaatcaaattactattaaagaggatcgtgttcttgagtggttatctaaaggagcgcagccttctgataccgttcgtaacatcttgtctaaagctggtgttatggctaagttccacgaccaaaaattctctaaa

SEQ ID NO: 2524 - protein, 90 aa, Streptococcus pyogenes
MAVKIRLTRMGSKKKPFYRINVADSRAPRDGRFIETVGTYNPLVAENQITIKEDRVLEWLSKGAQPSDTVRNILSKAGVMAKFHDQKFSK

SEQ ID NO: 2525 - DNA, 1245 bp, Streptococcus agalactiae
atggaaaattggaagtttgccctatcatcgattctagggcacaagatgcgtgcttttctgaccatgttagggatcatcattggggttgcatcagttgtgttaattatggccttaggtaagggcatgaaagattcggttacaaatgagattacaaagtctcagaagaaccttcagatttattataaaacaaaagaagaccaaaaaaatgaggataactttggagctcaaggggctttcatgcaaggtagtgataccaaccgtaaggaaccaattattcaagaatcatggttaaaaaagattgctaaggaagtagatggtgttagtggctactatgtaaccaatcaaacaaatgctccagtagcttaccttgaaaaaaaggcaaagacggttaatataacaggaattaaccgcacttaccttggtatcaaaaagttcaaaattaaaagtggtcgtcaattccaagaggaggattataaccaattctcgagagttattttactagaagaaaaattagctcagagattattccagacaaatgaagcagcgttaaataaggtggtgactgtaaaaaataaatcttacttagtagtgggggtttattcggatccagaagctggttcaggcttatatggaagtaattctgatgggaatgctattttaaccaatacacagttagcttcggagtttggtgctaaagaagcagaaaacatatattttcatcttaatgatgtatcgcaatccaatcgcattggtaaagaaataggcaaacgtttaacagacattagtcatgctaaggatgggtactatgataattttgacatgacatctatagttaaatctatcaatacccaagttggtattatgacaggtgttattggagcgattgcagcaatttctctcctagttggtggtatcggagtgatgaatattatgttagtctctgtaactgagcgcacgagagaaattggccttcgtaaagcccttggggcaactcgacgtaaaattttagctcaatttttaattgaatcaatggtcttaacgattttgggtggattaattgggttattactagcctatggaggtacgatgttaattgctaatgcgcaagataagattactccttctgtgtcacttaacgtggctataggcagtttaattttctcagcatttattggaattatatttggtttattacctgctaataaagccagcaaattaaacccaattgatgctttacgatatgaa

SEQ ID NO: 2526 - protein, 415 aa, Streptococcus agalactiae
MENWKFALSSILGHKMRAFLTMLGIIIGVASVVLIMALGKGMKDSVTNEITKSQKNLQIYYKTKEDQKNEDNFGAQGAFMQGSDTNRKEPIIQESWLKKIAKEVDGVSGYYVTNQTNAPVAYLEKKAKTVNITGINRTYLGIKKFKIKSGRQFQEEDYNQFSRVILLEEKLAQRLFQTNEAALNKVVTVKNKSYLVVGVYSDPEAGSGLYGSNSDGNAILTNTQLASEFGAKEAENIYFHLNDVSQSNRIGKEIGKRLTDISHAKDGYYDNFDMTSIVKSINTQVGIMTGVIGAIAAISLLVGGIGVMNIMLVSVTERTREIGLRKALGATRRKILAQFLIESMVLTILGGLIGLLLAYGGTMLIANAQDKITPSVSLNVAIGSLIFSAFIGIIFGLLPANKASKLNPIDALRYE

SEQ ID NO: 2527 - DNA, 708 bp, Streptococcus agalactiae
gtgacaactaatcgaaaagaactgattagattgcatcagattgttaaaagttatcaaaatggggatcaaaaacttcaagtcttaaagaacattgatttgacggtttatgaaggtgaatttcttgcaatcatggggccatctggttcagggaaatccacactaatgaatattattggcttgttggattctccaacttcaggagattatagtttaaatggtaaacgtgtcgaagaactaagtcaaacaaaattagctcaagttcgaaataaggaaattggttttgtctttcaacaatttttcttgttatctaaactaacggctttacaaaatgttgaattacccttaatttatgcgggtgtacctcctaaaaagcgtaaaaatttagcaaaacaatttttagataaagttgaattaagagagcgtatgaaccatctgccaacagaattatctgggggacagaagcaacgtgtagcaatcgcgcgtgctttggtgaatagcccatctattattctagcagatgagccgactggtgccttggatacaaagacgggtgagcaaattatgcagttcctaacggaattaaatcaagaaggtaaaaccattatcatggtaactcatgaaccagaaatcgccgattatgcgactcgtaaaattgttattcgtgatggcgaaattacagcagatactactgatagtattagaattgat

SEQ ID NO: 2528 - protein, 236 aa, Streptococcus agalactiae
MTTNRKELIRLHQIVKSYQNGDQKLQVLKNIDLTVYEGEFLAIMGPSGSGKSTLMNIIGLLDSPTSGDYSLNGKRVEELSQTKLAQVRNKEIGFVFQQFFLLSKLTALQNVELPLIYAGVPPKKRKNLAKQFLDKVELRERMNHLPTELSGGQKQRVAIARALVNSPSIILADEPTGALDTKTGEQIMQFLTELNQEGKTIIMVTHEPEIADYATRKIVIRDGEITADTTDSIRID

SEQ ID NO: 2529 - DNA, 708 bp, Streptococcus pyogenes
gtgtcgcatgaaaaaaaacaattaatgcaattatcaaatattgtgaagagctatcaaaatggggatcaagttcttaaagttttgaaaggtattaatttaacagtatatgagggtgaatttttagctattatgggtccgtctggttcgggaaaatcaacactaatgaatattattggtttattagatcgtccaacatccggagattacacattacataatactaaaatagaaatccttaatgatcgtgaattagcaaaagtacgaaatgatgaaatcggctttgtctttcaacaattctttctgttagctaaattaactgcattacaaaatgttgaattgcctcttatttatgctggtgtaaacgtctcaaaaagacgtgaacaggctaagcaatttcttgaaaaagtaggacttggacgacgtatcaaacatctaccgtcagaactgtcaggaggtcaaaagcaaagggtggctatcgcacgagctttagtaaatgacccatctattattttagcggatgaaccaacaggtgcactagatactaaaacaggtcagcaaattatggaactcttgacagagttaaacaaagaaggtaaaacaattattatggttactcatgaaccagaaattgctgattttgcaactcggaaaattattattcgtgatggtgatatcacaacggatactacagctagtgttgttattgac

SEQ ID NO: 2530 - protein, 236 aa, Streptococcus pyogenes
VSHEKKQLMQLSNIVKSYQNGDQVLKVLKGINLTVYEGEFLAIMGPSGSGKSTLMNIIGLLDRPTSGDYTLHNTKIEILNDRELAKVRNDEIGFVFQQFFLLAKLTALQNVELPLIYAGVNVSKRREQAKQFLEKVGLGRRIKHLPSELSGGQKQRVAIARALVNDPSIILADEPTGALDTKTGQQIMELLTELNKEGKTIIMVTHEPEIADFATRKIIIRDGDITTDTTASVVID

SEQ ID NO: 2531 - DNA, 1248 bp, Streptococcus agalactiae
atggacatgagtaaacgacaaaatttaggaattagtaaaaaaggagcaattatatcagggctctcagtggcactaattgtagtaataggtggctttttatgggtacaatctcaacctaataagagtgcagtaaaaactaactacaaagtttttaatgttagagaaggaagtgtttcgtcctcaactcttttgacaggaaaagctaaggctaatcaagaacagtatgtgtattttgatgctaataaaggtaatcgagcaactgtcacagttaaagtgggtgataaaatcacagctggtcagcagttagttcaatatgatacaacaactgcacaagcagcctacgacactgctaatcgtcaattaaataaagtagcgcgtcagattaataatctaaagacaacaggaagtcttccagctatggaatcaagtgatcaatcttcttcatcatcacaaggacaagggactcaatcgactagtggtgcgacgaatcgtctacagcaaaattatcaaagtcaagctaatgcttcatacaaccaacaacttcaagatttgaatgatgcttatgcagatgcacaggcagaagtaaataaagcacaaaaagcattgaatgatactgttattacaagtgacgtatcagggacagttgttgaagttaatagtgatattgatccagcttcaaaaactagtcaagtacttgtccatgtagcaactgaaggtaaactccaagtacaaggaacgatgagtgagtatgatttggctaatgttaaaaaagaccaggctgttaaaataaaatctaaggtctatcctgacaaggaatgggaaggtaaaatttcatatatctcaaattatccagaagcagaagcaaacaacaatgactctaataacggctctagtgctgtaaattataaatataaagtagatattactagccctctcgatgcattaaaacaaggttttaccgtatcagttgaagtagttaatggagataagcaccttattgtccctacaagttctgtgataaacaaagataataaacactttgtttgggtatacaatgattctaatcgtaaaatttccaaagttgaagtcaaaattggtaaagctgatgctaagacacaagaaattttatcaggtttgaaagcaggacaaatcgtggttactaatccaagtaaaaccttcaaggatgggcaaaaaattgataatattgaatcaatcgatcttaactctaataagaaatcagaggtgaaa

SEQ ID NO: 2532 - protein, 416 aa, Streptococcus agalactiae
MDMSKRQNLGISKKGAIISGLSVALIVVIGGFLWVQSQPNKSAVKTNYKVFNVREGSVSSSTLLTGKAKANQEQYVYFDANKGNRATVTVKVGDKITAGQQLVQYDTTTAQAAYDTANRQLNKVARQINNLKTTGSLPAMESSDQSSSSSQGQGTQSTSGATNRLQQNYQSQANASYNQQLQDLNDAYADAQAEVNKAQKALNDTVITSDVSGTVVEVNSDIDPASKTSQVLVHVATEGKLQVQGTMSEYDLANVKKDQAVKIKSKVYPDKEWEGKISYISNYPEAEANNNDSNNGSSAVNYKYKVDITSPLDALKQGFTVSVEVVNGDKHLIVPTSSVINKDNKHFVWVYNDSNRKISKVEVKIGKADAKTQEILSGLKAGQIVVTNPSKTFKDGQKIDNIESIDLNSNKKSEVK

SEQ ID NO: 2533 - DNA, 1269 bp, Streptococcus pyogenes
atgtctaaaagaggaaaaattaaaataacaacgaaaacaaagcttattacagctagtgttataacgctagtattaattataactggaatagtcttgtggaaacaacaacgaaatacgctaacagctgatatcgctaaagaaccttactctactgttagtgtaactgaagggagtattgcttcttcgactttactatcaggtactgtaaaggctttatcagaggaatatatttattttgatgctaataaaggaaatgatgcaactgttacagttaaagtaggtgatcaggtaacgcagggccagcaattagttcaatataatacaacaacagctcagtcagcttatgatactgctgttaggagtcttaacaagattggccgacaaattaatcatcttaaaacatacggagttcctgctgttagtacagaaactaatagagatgaagctaccggtgaagagacgacaacaacagttcaaccatcagctcagcaaaatgctaattataaacagcagctgcaagatttaaatgatgcttatgcagatgcacaagcagaagtaaataaagcgcagatagcgttaaatgatacagtagttatcagtagtgtctctggaactgttgtggaagtaaataatgatattgatccttcttcaaagaacagtcaaacacttgttcacgtagcaaccgaaggacagcttcaggtgaaaggaacattgacagagtatgatttagcaaacgttaaggttggtcaatctgtaaaaattaagtctaaagtttattctaatcaagaatggactggaaaaatatcatatgtttcaaactatccaactgagtctaatgcaggttcaacaacgccagcaggtagcactggagcgggaagttctacaggagctacctatgattacaagattgatattataagtcctctcaaccagcttaaacaaggcttcactgtttctgttgaggttgttaatgaagcaaaacaggccttagttcctttaacggctgttattaagaaagataaaaaacactatgtttggacttatgatgatgctactggcaaagccaaaaaagtagaggtgacacttggaaacgcagatgcacaacaacaagaaattcataaaggagtagctgttggtgacattgttattgccaatccagataaaaatatcaaaccggataaaaaactagaaggggttatttcaataggtaccaacacaaaaccggaaaaagattctcaatcaaagaataaaaaatcaggggtggataaa

SEQ ID NO: 2534 - protein, 423 aa, Streptococcus pyogenes
MSKRGKIKITTKTKLITASVITLVLIITGIVLWKQQRNTLTADIAKEPYSTVSVTEGSIASSTLLSGTVKALSEEYIYFDANKGNDATVTVKVGDQVTQGQQLVQYNTTTAQSAYDTAVRSLNKIGRQINHLKTYGVPAVSTETNRDEATGEETTTTVQPSAQQNANYKQQLQDLNDAYADAQAEVNKAQIALNDTVVISSVSGTVVEVNNDIDPSSKNSQTLVHVATEGQLQVKGTLTEYDLANVKVGQSVKIKSKVYSNQEWTGKISYVSNYPTESNAGSTTPAGSTGAGSSTGATYDYKIDIISPLNQLKQGFTVSVEVVNEAKQALVPLTAVIKKDKKHYVWTYDDATGKAKKVEVTLGNADAQQQEIHKGVAVGDIVIANPDKNIKPDKKLEGVISIGTNTKPEKDSQSKNKKSGVDK

SEQ ID NO: 2535 - DNA, 108 bp, Streptococcus agalactiae
ttgtaccaagtcaaactttatccgatgctgctaggcaaacaattcgagatgttgcatttgatgtgtgtcgaaaagcaaacattattggagtatgttactttagtttct

SEQ ID NO: 2536 - protein, 36 aa, Streptococcus agalactiae
MYQVKLYPMLLGKQFEMLHLMCVEKQTLLEYVTLVS

SEQ ID NO: 2537 - DNA, 1596 bp, Streptococcus agalactiae
atgctaaatacaaaggataaacagcctattttgcttattattttcggacagaaaatgaaagaatatgacgatttaattagatcaactgttgagaggttatctaaaagggatagacctgttagtattcttatctcgaaggagctaaaccatgtgattcaccattatgatgcacaatttgaaaatcttgagacgcttgtggggtatataaatacacatgaagatagtttgatttaccccctttgcttagataaaaatcatgagctatttcaagagtttttagcgtggcagagtcattattcaaggcagtatatcagcgataatttatcagaaaaaagtgttcaggcaatagacaataatcaagactttgtgcaagtagattgtttagtaatgagagactctttgaataattgtttatatgtctctgatttagaatatattgaatctaataaaacaactggtaagtctctagcgattgtaccaagtcaaactttatccgatgctgctaggcaaacaattcgagatgttgcatttgatgtgtgtcgaaaagcaaacattattggagtatgttactttagtttcttaatagatttgaacagtttggattatcatataattagtttatcatctggtttgtctcatcaaagcattttatttgagactattacgacctatcctgttttagagatagcaactaaattgacagtgggatatacttttagtcaactgaagcattcttattacccaaatacctctgcctttttagagccgcaattagactatgtagctaccgtatcttttagttttgaaaaagttgactatatcttttttgctcgtaatatagagcaattatttttaaatttactcgaggctagcagtcatgatcattttccatttctgagtgatattagcgaggaagatttgatgtttgctttgattcagaaaaaagaaaatcgtctagcttatcttttggaggcttttagacgtggctttgatttgtatgatttatcctcagttactaaaatcaaccctttttacttagataaatgtttacatattgtagagttgtatgaaaacctgaataaaagccaatataatgtagatatttataaggaagctaaaaggtatggtttttcggatgactatattgctagtagttggcaaatctctttgatagacatgttagaatatcgaaaaaaacatagtgtcgcacctgttctgaagcaagtcgaacaaagttctggtgttctaactggccatcaaattcagtattttcgaagctatgattggcattcagactacatttctagcggttgtcaaaaggctttgataatggtagacaagggttattccctagtaaaattaaatgagttaattaagcaaatcaaacaaactcatttagaattattaattgttaccaatcaacctctcctcatagaacaattaaatgatacatctataatttttgacactataggtattgagaccatattaacaattatgggtatagaagaggtggaagaagtgtatttattgggagaaagtcaagcagacatgttttcaaaaatgaaaaatttttctatctcttgtcagtctatt

SEQ ID NO: 2538 - protein, 532 aa, Streptococcus agalactiae
MLNTKDKQPILLIIFGQKMKEYDDLIRSTVERLSKRDRPVSILISKELNHVIHHYDAQFENLETLVGYINTHEDSLIYPLCLDKNHELFQEFLAWQSHYSRQYISDNLSEKSVQAIDNNQDFVQVDCLVMRDSLNNCLYVSDLEYIESNKTTGKSLAIVPSQTLSDAARQTIRDVAFDVCRKANIIGVCYFSFLIDLNSLDYHIISLSSGLSHQSILFETITTYPVLEIATKLTVGYTFSQLKHSYYPNTSAFLEPQLDYVATVSFSFEKVDYIFFARNIEQLFLNLLEASSHDHFPFLSDISEEDLMFALIQKKENRLAYLLEAFRRGFDLYDLSSVTKINPFYLDKCLHIVELYENLNKSQYNVDIYKEAKRYGFSDDYIASSWQISLIDMLEYRKKHSVAPVLKQVEQSSGVLTGHQIQYFRSYDWHSDYISSGCQKALIMVDKGYSLVKLNELIKQIKQTHLELLIVTNQPLLIEQLNDTSIIFDTIGIETILTIMGIEEVEEVYLLGESQADMFSKMKNFSISCQSI

SEQ ID NO: 2539 - DNA, 1068 bp, Streptococcus agalactiae
atggcaaaaaaattgttaattctagaggatggtacggtttttgaaggactatcctttggttcatctcttgatgtaactggcgaattagttttttgtacggggaataccggctatcaggaaataataacgaatccttcacataatggaaaaattttagtttttacctcaccgctaataggaaattatggtattcatcgcagttactctgaagccattattcccacttgtttaggagttgttgttgcagagtattccagatgtgtaagtagcgatactagcaagatgaatctagatgaatttttgaaaatgaaaaaggttcctgcaatgtcgggggtcgatacaaggtatttgatgcaagttattaaagaaaaaggatttgtaaaagctactttagcagaagcaggtgatgttttatcacatttacaggatcaattaatagcgacagtattaccgacaaataatgtggaacaagtttcgacaaaaacagcttatccgtcgcctgctagcggtcgaaatattgttgtacttgattttggtcttaaacattctattttgagagaattgtctaaacgtcagtgtgacgtgactgtcattccctacaatacgtctttagaaggtattaaaaatctatacccagaaggtatcatattatctaatggtccggggaatccagaaaagcttcaggaaatcttaaacactattaaagaattacaaaaatctgttcctatgttaggtattggtttggggcaccaattaattgccatggcaaatggtgcagaaattatgagactcccagttgctaagaaggggccaaattatcccatgagagatattgctacgggtcgtttagaaacagttagtcagtttaatcattttaccgttaaccggctaaatcttccgcatgatttactggtaacacacgaaggtttgaatgatcaagagattgttgctctaaggcaccgctcatttccagtgatgtccgtgcaattttacccagaggctgctccaggccctcatgatgtgacctatttttttgatgaatttttagaaatgattggatcacgcgct

SEQ ID NO: 2540 - protein, 356 aa, Streptococcus agalactiae
MAKKLLILEDGTVFEGLSFGSSLDVTGELVFCTGNTGYQEIITNPSHNGKILVFTSPLIGNYGIHRSYSEAIIPTCLGVVVAEYSRCVSSDTSKMNLDEFLKMKKVPAMSGVDTRYLMQVIKEKGFVKATLAEAGDVLSHLQDQLIATVLPTNNVEQVSTKTAYPSPASGRNIVVLDFGLKHSILRELSKRQCDVTVIPYNTSLEGIKNLYPEGIILSNGPGNPEKLQEILNTIKELQKSVPMLGIGLGHQLIAMANGAEIMRLPVAKKGPNYPMRDIATGRLETVSQFNHFTVNRLNLPHDLLVTHEGLNDQEIVALRHRSFPVMSVQFYPEAAPGPHDVTYFFDEFLEMIGSRA

SEQ ID NO: 2541 - DNA, 555 bp, Streptococcus agalactiae
ttgaaggggctcttttatcttagagaggatactgcaatgaaaagaaaagaaattattgatgatgtgaccatgaaacgtgctattacacgtattacctacgaaattatagaacgtaacaaaaatttagataatattgtcttagcaggcattaaaacaagaggtgtttttttagccaaacgcattcaagaacgcttgaagcaattagaaaatttagatattcccgttggagaattggatactaaacctttccgtgatgatatgaaagttgaagttgacaccacaactatgccagttgacatcactgataaagatattatattaattgatgatgttctctatacaggtcgcactattcgagctgctattgataatcttgttagtttagggcgtccgagtcgtgtcagtttagctgtattaattgaccgtgggcatcgtgaactacctattcgtgcagattatgtggggaaaaatattccaacaagtcaatttgaagaaattctagttgaagtgatggaacatgatggttacgatcgtgtgagtattattgatccgagt

SEQ ID NO: 2542 - protein, 185 aa, Streptococcus agalactiae
MKGLFYLREDTAMKRKEIIDDVTMKRAITRITYEIIERNKNLDNIVLAGIKTRGVFLAKRIQERLKQLENLDIPVGELDTKPFRDDMKVEVDTTTMPVDITDKDIILIDDVLYTGRTIRAAIDNLVSLGRPSRVSLAVLIDRGHRELPIRADYVGKNIPTSQFEEILVEVMEHDGYDRVSIIDPS

SEQ ID NO: 2543 - DNA, 519 bp, Streptococcus pyogenes
atgaaaactaaggaaattgttgatgacgtgaccatgaaacgcgccattacccgtattacttatgaaattattgaacgtaataaacaattagacaatgtggttttggcaggcatcaaaacgagaggtgtttttctagctcgtcgcattcaagaaagactgcatcaattagaagggttggatttaccaattggtgagttagacatcaagccttttagagatgacatgagagttgaggaagacacaactctgatgtcagtagatattacaggcaaggatgtgattttgattgatgatgtgctttatactggtcgtaccatccgcgcagccatcgataacttagtgagtttaggtcgaccagcccgtgttagtctagctgttttggtggatcgtggccatcgggaattaccgattcgcgcggattacgttgggaaaaatattccaacaagcagtgtagaagaaattgttgttgaggttgtcgaagtcgatggccgtgatcgtgttagcattattgactcaaca

SEQ ID NO: 2544 - protein, 173 aa, Streptococcus pyogenes
MKTKEIVDDVTMKRAITRITYEIIERNKQLDNVVLAGIKTRGVFLARRIQERLHQLEGLDLPIGELDIKPFRDDMRVEEDTTLMSVDITGKDVILIDDVLYTGRTIRAAIDNLVSLGRPARVSLAVLVDRGHRELPIRADYVGKNIPTSSVEEIVVEVVEVDGRDRVSIIDST

SEQ ID NO: 2545 - DNA, 912 bp, Streptococcus agalactiae
ttgcactttggaaagaggaaagtaatggaaatcacaattaaaatagcaggagttaggctagataaagctttagcggataattctgaactgtcgcgtagtcaagctaatgaagaaattaaaaaagggattgtgttagtaaatggacaagtaaaaaaagcgaaatatactgttcaagaaggagatcggattacttttgatattcctaaagaggaagtactagattatcaagctgaaaatatccctttagatattatctatcaagatgatgacgttgctgtggttaataagccgcaagggatggttgttcacccttctgcaggccacagttcgggcaccttagttaacgccttgatgtatcatattaaggatttatcatcaattaatggcgttgttcgcccagggatcgttcatcgtattgataaagatacttctggtttattgatggttgcaaaaaatgatagagctcaccaagtgttggctgaagagttaaaagataaaaaatcgcttcgtaaatatttagcaattgtgcatggtaatttaccaaatgatcgaggtgtgattgaggctccgattggtagaagcgataaagatcgtaagaagcaagccgtgactgctaaaggtaagccagcaataactcgttttcatgttttagaacgttttggtgattataccttagttgaattgtcattggagacaggtcgaacacaccaaattcgggttcatatggcttatattggccatcctctagccggtgatcctgtctacggtccccgtaagactttagggggtaaaggacagtttttgcatgcacaaacactaggttttacgcaccctagtaacggagagaatttgattttttcagtagaggttccggaaatttttcagacaaccttagaaaagttgagaaaaaat

SEQ ID NO: 2546 - protein, 304 aa, Streptococcus agalactiae
MHFGKRKVMEITIKIAGVRLDKALADNSELSRSQANEEIKKGIVLVNGQVKKAKYTVQEGDRITFDIPKEEVLDYQAENIPLDIIYQDDDVAVVNKPQGMVVHPSAGHSSGTLVNALMYHIKDLSSINGVVRPGIVHRIDKDTSGLLMVAKNDRAHQVLAEELKDKKSLRKYLAIVHGNLPNDRGVIEAPIGRSDKDRKKQAVTAKGKPAITRFHVLERFGDYTLVELSLETGRTHQIRVHMAYIGHPLAGDPVYGPRKTLGGKGQFLHAQTLGFTHPSNGENLIFSVEVPEIFQTTLEKLRKN

SEQ ID NO: 2547 - DNA, 888 bp, Streptococcus pyogenes
atggaaattaatgtgataacatcggggcaacgcttggataaggcactagctgatttaagtcccctgtcacgtggtcaagccaatgaccaaattaagcaaggccttgttttagttaatggtcagcaaaaaaaggctaaatatacggttcaagcaggagatgtgatttgttttgaactccctaaagaagaagtcttagagtaccaagctcagaatattcccttggacattatctatgaagatgatgctctcgccattattaacaagccacagggaatggtagttcacccttcggcgggacacccttcaggaacaatggttaatgccttgatgtatcatatcaaggatttgtcctcaatcaatggtgtggttcgtccaggaattgttcatcggattgataaggacacctccggtctcttaatggtagctaaaacagatgcggctcatcaagccttagcagaagaattgaaggctaaaaaatctctcagaaaatacctcgccattgtccatggaaacctaccgaatgatcgcgggatgattgaagctcctataggtcgtagcgaaaaggaccgtaaaaaacaggctgttactgcaaaaggcaaagaagcagtgacacgttttacagtgctagaacgttttggcgattacagtctagtggaattacaactggaaactggtcgaacgcaccaaattcgtgttcatatggcctatattggtcatcctgttgctggggaccctttatatggaccacgtaagacactatcaggtcatggccaatttcttcatgcaaaaacattgggattaacgcatcctatgacaggaaaagaaatgatatttactgttgaagctcccgaaatttttcaaaaggtgttaaagctgctaagaaaaaaa

SEQ ID NO: 2548 - protein, 296 aa, Streptococcus pyogenes
MEINVITSGQRLDKALADLSPLSRGQANDQIKQGLVLVNGQQKKAKYTVQAGDVICFELPKEEVLEYQAQNIPLDIIYEDDALAIINKPQGMVVHPSAGHPSGTMVNALMYHIKDLSSINGVVRPGIVHRIDKDTSGLLMVAKTDAAHQALAEELKAKKSLRKYLAIVHGNLPNDRGMIEAPIGRSEKDRKKQAVTAKGKEAVTRFTVLERFGDYSLVELQLETGRTHQIRVHMAYIGHPVAGDPLYGPRKTLSGHGQFLHAKTLGLTHPMTGKEMIFTVEAPEIFQKVLKLLRKK

SEQ ID NO: 2549 - DNA, 903 bp, Streptococcus agalactiae
atgaatattcaacaactgcgttatgttgttgctatcgcaaatagtggtacttttcgtgaagcagctgcaaaactatttgttagtcagccaagtttatctgttgccgttcgtgatttggaaacagaattagggtttcagatttttacgcgtacaactactggtgcagtgttgaccaatcaaggcatgactttttatgagaatgctttagaagttgtgaaaagctttgattcattcgaaaaacagttttcgcaatctgaagctacagagcaagaattctcaatagcaagtcaacattatgattttctacctcctttaatcacagcgttttcaaaatgtaatgataattttagctatttccgtattttcgaatcaacaacaatacgtatcttagatgaagttgctcaagggaatagcgaaataggtatcatttatatcaatagtcaaaataaaaaaggtctacttcagcggttggacaaattggggttagagtttgtagagcttattccttttaaaactcatatttatcttgggaaagaccatcccttggctagtaaaacatctctgataatgacagatttagaaggattaccaaccgtacgttttacacaggatagagatgattatcggtattactcggagaattttgtggaagtacttgatagttctgttacctataatgttactgatagagcaacattaaatggtattttagaaagaacccaagcttatgcgacgggctcaggattcttggatagccgcagtgtgaatggtatcactgttattccattagaagatcatctagataaccaaatgatttatatcaaacgaaaagatcgtaatttatctcagatggctttaaaatttgttgctgttatggaagagtattttaagggatttaattca

SEQ ID NO: 2550 - protein, 301 aa, Streptococcus agalactiae
MNIQQLRYVVAIANSGTFREAAAKLFVSQPSLSVAVRDLETELGFQIFTRTTTGAVLTNQGMTFYENALEVVKSFDSFEKQFSQSEATEQEFSIASQHYDFLPPLITAFSKCNDNFSYFRIFESTTIRILDEVAQGNSEIGIIYINSQNKKGLLQRLDKLGLEFVELIPFKTHIYLGKDHPLASKTSLIMTDLEGLPTVRFTQDRDDYRYYSENFVEVLDSSVTYNVTDRATLNGILERTQAYATGSGFLDSRSVNGITVIPLEDHLDNQMIYIKRKDRNLSQMALKFVAVMEEYFKGFNS

SEQ ID NO: 2551 - DNA, 912 bp, Streptococcus pyogenes
atgaatattcaacaattacgctatgtggtagccatcgctaataatggaacttttcgagaagctgcctctaaattgtttgtcagtcagcctagcttatcagtttctatcaaagatttagaggcggaattagggtttcaaatttttaatcggactacttcaggaacagtcttgacaagtcaaggactagttttttatgagaaagctttagaagtagtcaagtcttttgattcttttgaaaaaaccttttctcaagctgatctggatcaaaatgaattttctattgctagccaacattatgactttttgccacctcttattacagctttttcgcaacaatacgatggtcatcgtgtctttcgtatctttgaatcaacaactattcaaattttagatgaagttgctcaaggaaacagtgaaattggtattatttacttgaatgtagacaatcaaaaaggtctctttcagcggatggataagctgggcttagaatatgtttctctaattccttttactactcatatttatctttcaaaaacgcatccattggctaatcgcgaagcgctttatttgaacgatattcaaggattacctgcggtaaggtttacccaagaaagggacgagtatttgtattattctgaaaattttgtggatactagtgaatgccctcgtatttataatgtgtcagatagggcaaccttgaacggtattttagagagaaccaatgcctttgcgacaggatcaggttttctcgatcatcggagtgttaatgggattaaagtgatacctctagctgatcatattgacaatcaaatgatttatgtcaaacgaaaagataaaaacctttctgttgctggggccacttttgtgactattttaaaagactattttgataaaagaaggaaggccttaaca

SEQ ID NO: 2552 - protein, 304 aa, Streptococcus pyogenes
MNIQQLRYVVAIANNGTFREAASKLFVSQPSLSVSIKDLEAELGFQIFNRTTSGTVLTSQGLVFYEKALEVVKSFDSFEKTFSQADLDQNEFSIASQHYDFLPPLITAFSQQYDGHRVFRIFESTTIQILDEVAQGNSEIGIIYLNVDNQKGLFQRMDKLGLEYVSLIPFTTHIYLSKTHPLANREALYLNDIQGLPAVRFTQERDEYLYYSENFVDTSECPRIYNVSDRATLNGILERTNAFATGSGFLDHRSVNGIKVIPLADHIDNQMIYVKRKDKNLSVAGATFVTILKDYFDKRRKALT

SEQ ID NO: 2553 - DNA, 291 bp, Streptococcus agalactiae
atgttaaaaatgaatcttgctaacttgcaacttttcgcccacaaaaaaggtggaggttctacatcaaacggacgtgattcacaagcaaaacgtcttggagctaaagcagctgacggacaaacagtatcaggtggatcaattctttaccgtcaacgcggtacacacatctatccaggtgctaacgttggacgtggtggggacgatacactttttgctaaagttgaaggtgttgttcgtttcgaacgtaaaggacgcgataaaaaacaagtgtctgtttacccaatcgcaaaa

SEQ ID NO: 2554 - protein, 97 aa, Streptococcus agalactiae
MLKMNLANLQLFAHKKGGGSTSNGRDSQAKRLGAKAADGQTVSGGSILYRQRGTHIYPGANVGRGGDDTLFAKVEGVVRFERKGRDKKQVSVYPIAK

SEQ ID NO: 2555 - DNA, 291 bp, Streptococcus pyogenes
atgttaaaaatgaatcttgctaacttgcaacttttcgcccacaaaaaaggtggaggttctacatcaaacggacgtgactcacaagctaaacgccttggtgctaaagctgctgacggtcaaactgtttcaggtggatcaatcctttaccgtcaacgtggaactcatatctacccaggtgtaaacgtaggccgtggtggagatgacacactttttgctaaagttgaaggtgttgtacgtttcgaacgtaaaggacgcgataaaaaacaagtttctgtttacccagtagctaaa

SEQ ID NO: 2556 - protein, 97 aa, Streptococcus agalactiae
MLKMNLANLQLFAHKKGGGSTSNGRDSQAKRLGAKAADGQTVSGGSILYRQRGTHIYPGVNVGRGGDDTLFAKVEGVVRFERKGRDKKQVSVYPVAK

SEQ ID NO: 2557 - DNA, 336 bp, Streptococcus agalactiae
atgattaaagcaacttttactcgtaatcaatcaggctatctttatagtgctgaaatcagcggtcatgctggtagtggcgagtacggctttgatgtgatttgtgcagctgttagtactttatcaattaattttattaattcattagaggctttaacaacctgccaagcgcaattgattatcaatgacgttgaaggtggttatatgaagatagatttatcttctataccacaacataaagaggataaggttcaattattatttgagtcttaccttcttggaatgactaatctgtctaaagattcttctgaatttgttagtacagtagtcatgacacac

SEQ ID NO: 2558 - protein, 112 aa, Streptococcus agalactiae
MIKATFTRNQSGYLYSAEISGHAGSGEYGFDVICAAVSTLSINFINSLEALTTCQAQLIINDVEGGYMKIDLSSIPQHKEDKVQLLFESYLLGMTNLSKDSSEFVSTVVMTH

SEQ ID NO: 2559 - DNA, 324 bp, Streptococcus pyogenes
atgattaaagcaatttttactcgccaaaaaaatggtcaactgagcagtgttacactgacaggtcatgctggtagtggtaaacatggctttgatattgtttgtgcctctgttagtactctagccattaactttgttaattctcttgaggtgttagcagattgccaagcattagtagatcttaatgatgttgaaggtgggtatatggctattacaataccaccacatgacaacaaggaggaagttcaattattatttgaatcttttcttctaggaatgactagtttggcgaaggattcttcgaaatttgtcaacactcaggtcatc

SEQ ID NO: 2560 - protein, 108 aa, Streptococcus pyogenes
MIKAIFTRQKNGQLSSVTLTGHAGSGKHGFDIVCASVSTLAINFVNSLEVLADCQALVDLNDVEGGYMAITIPPHDNKEEVQLLFESFLLGMTSLAKDSSKFVNTQVI

SEQ ID NO: 2561 - DNA, 312 bp, Streptococcus agalactiae
atgagcacatacgcaatcatcaaaactggtggtaaacaagttaaagttgaagtaggacaagctatctacgttgaaaaacttgacgttgaagcaggagcagaagttacatttaacgaagttgttcttgttggtggtgaaacaactaaagttggtactccagttgttgaaggagctactgttgttggtactgttgaaaaacaaggcaaacaaaagaaagttgtttcttacaaatacaaacctaaaaaaggtagccaccgtaaacaaggtcaccgtcaaccttatacaaaagttgttatcaacgcaatcaacgct

SEQ ID NO: 2562 - protein, 104 aa, Streptococcus agalactiae
MSTYAIIKTGGKQVKVEVGQAIYVEKLDVEAGAEVTFNEVVLVGGETTKVGTPVVEGATVVGTVEKQGKQKKVVSYKYKPKKGSHRKQGHRQPYTKVVINAINA

SEQ ID NO: 2563 - DNA, 312 bp, Streptococcus pyogenes
atgagcacatacgcaatcatcaaaactggtggaaaacaagttaaagttgaagtaggtcaagcaatctacgttgagaaaattgacgctgaagctggcgcagaagtcacttttaacgaagttgttcttgtaggtggtgacaaaactgtagttggtactccagttgttgaaggagctactgtcgttggaactgttgaaaaacaaggaaaacaaaagaaagttgtaactttcaaatacaaacctaaaaaaggtagccaccgtaaacaaggtcatcgtcaaccttacactaaagttgtcatcaacgcaatcaacgct

SEQ ID NO: 2564 - protein, 104 aa, Streptococcus pyogenes
MSTYAIIKTGGKQVKVEVGQAIYVEKIDAEAGAEVTFNEVVLVGGDKTVVGTPVVEGATVVGTVEKQGKQKKVVTFKYKPKKGSHRKQGHRQPYTKVVINAINA

SEQ ID NO: 2565 - DNA, 1164 bp, Streptococcus agalactiae
atgaagagcgctgctatgactatggaatttgagcgtgcggctgaatatcgagatttgatcgaagcaattagtttgttgcgtactaagcagcgtgttattcatcaagatatgaaggatagagatgtttttggttatttcgttgataagggttggatgtgtgtacaggtcttttttgttcgaaatggaaaattgattcagcgtgacgtgaatatgtttccttattataatgaaccagaggaagattttctaacttacatagggcaattttatcaagatacaaaacattttctacccaaagaagtctttattccacaggatattgatgctaagtcggttgaaacaattgtaggctgtaagattgttaaaccacaacgtggtgaaaagaaacagttagtaaatctggcaataaaaaatgctcgtgtcagtttacaacagaagtttgacttactggaaaaagatattcgtaaaactcatggggcaattgaaaatttaggtaatcttcttaatatccctaaaccagtacgcatagaagcatttgataattccaatattcaagggacaagtccagtagctgctatggtggtatttgtgaatggaaagccaagtaaaaaagactatcgaaagtttaaaattaagactgttatcggaccagatgattatgctagtatgagagaagtcattcatcggcgttatagtagggttttaaaagatggcttgacacctccggacttgattgtaattgatggtggtcaggggcaagtaaatatagcgcgtgatgttattgagaaccaatttggtttagccatacctattgcaggtttgcaaaagaatgataaacaccaaacacatgaattactttttggagatcctttagaagtagtagagctaccgcgtaattcagaagaatttttcttacttcaccgtattcaagatgaggtacatcgttttgctattacttttcatcgtcaattacgctccaaaaattccttttcttcaaaattagatggtatcactgggttgggaccaaaacgtaaacaattgctaatgaaacattttaaaagcttacctaatatccaaaaagctgagattgaggacattattatgtgtggtattcctaggactgttgcagaaagtctccgagattctcttaatgatcctcctaaa

SEQ ID NO: 2566 - protein, 388 aa, Streptococcus agalactiae
MKSAAMTMEFERAAEYRDLIEAISLLRTKQRVIHQDMKDRDVFGYFVDKGWMCVQVFFVRNGKLIQRDVNMFPYYNEPEEDFLTYIGQFYQDTKHFLPKEVFIPQDIDAKSVETIVGCKIVKPQRGEKKQLVNLAIKNARVSLQQKFDLLEKDIRKTHGAIENLGNLLNIPKPVRIEAFDNSNIQGTSPVAAMVVFVNGKPSKKDYRKFKIKTVIGPDDYASMREVIHRRYSRVLKDGLTPPDLIVIDGGQGQVNIARDVIENQFGLAIPIAGLQKNDKHQTHELLFGDPLEVVELPRNSEEFFLLHRIQDEVHRFAITFHRQLRSKNSFSSKLDGITGLGPKRKQLLMKHFKSLPNIQKAEIEDIIMCGIPRTVAESLRDSLNDPPK

SEQ ID NO: 2567 - DNA, 1794 bp, Streptococcus pyogenes
atgaacgaactgattaaacataaactagaactcttaccagacagccctggctgttacttacataaagataaagaaggaactattatctatgtcggtaaggccaagaatttgaaaaaacgcgtccggtcctattttcgtgggagccatgataccaaaacagagttactagtatctgagattgtagatttcgaatatattgtaacagagtcagataccgaagcgcttttgttggaaattaacttgattcaaaaaaatatgcctaagtacaacatcaagttaaaagatgataaatcttatccctttctcaaaatcacaaatgagtcttttcctcggttagtgattacaagatatattaagaaaaatgatggattgtactttgggccctacccagattcttacactgctaatgaagttaaaaagttattagataggatttttccatttaaaaagtgtaaaaatcctatcaataaggtctgtttttattaccatttaggccagtgctgtgctcataccatttgtcatacagacaaggcctattgggatcgtttaattgatgatgttaagcactttttaaatggtaaagatgacaaaattattgaagatcttcgttctaagatgttagcagcttctaaagaaatggcatttgaacgtgccgctgaatatcgagatttgatttcaggtattgccaccatgcgcaccaagcagcgggtgatgagcaaggatttgcaagatagagatatctttggctattatgttgataagggatggatgtgtgtccaagttttctttgtgcgtcaagggaaattaattcagcgtgatgttaacctttttccctattataccgatgcagaagaagatttcttaacttatatggggcaattttaccaagataaacagcatttcatccctaaagaagtctttattccagaagctattgatgaagaactggtagccgctattgtgccaaccaaaatcatcaaacccaaacgcggtgaaaaaaaacaactggtagctttggctactaagaatgctcgtgttagtctgcaacaaaaatttgatttattagaaaaagatatcaaaaaaacgagtggtgctatcgaaaatttaggtcagttacttaggattgacaagcctgtgcgcattgaagcctttgataattctaacattcaagggacaagtccagttgcggctatggttgtttttgttgatggcaaacctagtaagaaagattatcgtaaatttaagattaaaacagtggtgggaccagatgattatgccagtatgagagaagtgctttttcgaaggtacagtcgggtgaaaaaggagggactgcaagctcctaacttgattattgttgatggaggcgttggacaagtcaatgtggccaaagatgtgatagaaaaacaacttggactcactattcctgttgcgggacttcaaaaaaacgataagcaccagacccatgatttgctttttggaaacccacttgaagttgtaccgttgccgcgccgttctgaagagtttttcttactgcatcggattcaagacgaagtgcatcgctttgcagttacatttcatagacaagtgcgacgtaaaaattctttttcatcaacattagatcatatttcagggcttggcccaaagcgaaaacagttattactaagacactttaaaaccataacagcgattgcatcagctacctctgaggagattcaagctttaggtatacctaaaacagtagttgaagcaatacagcaacagataacagacaataaaaatgatagatcgtcccct

SEQ ID NO: 2568 - protein, 598 aa, Streptococcus pyogenes
MNELIKHKLELLPDSPGCYLHKDKEGTIIYVGKAKNLKKRVRSYFRGSHDTKTELLVSEIVDFEYIVTESDTEALLLEINLIQKNMPKYNIKLKDDKSYPFLKITNESFPRLVITRYIKKNDGLYFGPYPDSYTANEVKKLLDRIFPFKKCKNPINKVCFYYHLGQCCAHTICHTDKAYWDRLIDDVKHFLNGKDDKIIEDLRSKMLAASKEMAFERAAEYRDLISGIATMRTKQRVMSKDLQDRDIFGYYVDKGWMCVQVFFVRQGKLIQRDVNLFPYYTDAEEDFLTYMGQFYQDKQHFIPKEVFIPEAIDEELVAAIVPTKIIKPKRGEKKQLVALATKNARVSLQQKFDLLEKDIKKTSGAIENLGQLLRIDKPVRIEAFDNSNIQGTSPVAAMVVFVDGKPSKKDYRKFKIKTVVGPDDYASMREVLFRRYSRVKKEGLQAPNLIIVDGGVGQVNVAKDVIEKQLGLTIPVAGLQKNDKHQTHDLLFGNPLEVVPLPRRSEEFFLLHRIQDEVHRFAVTFHRQVRRKNSFSSTLDHISGLGPKRKQLLLRHFKTITAIASATSEEIQALGIPKTVVEAIQQQITDNKNDRSSP

SEQ ID NO: 2569 - DNA, 96 bp, Streptococcus agalactiae
atgaatgaaaatgtaccagcaacaacagctagtgcaactgttccaattacagatataaataaactggttaaaataattttacttagaagacgccac

SEQ ID NO: 2570 - protein, 32 aa, Streptococcus agalactiae
MNENVPATTASATVPITDINKLVKIILLRRRH

SEQ ID NO: 2571 - DNA, 651 bp, Streptococcus agalactiae
atggatgttatcatgacaaaagatcataaattagtagtcatccatgatgataatctcaaacgactctctggtatgaacaaagatgtttctaaactaactttagatcaagttacaaaaatcccaattcaccaagggcgttttgctagtcacattccatcatttacagaatttatgaagaccgctcagtcactagatcaaaaaatcatgattgaattgaaaccgtataatcaaaacctcgatatctatgcggatgaatttatcaaagaatttaaagagcttcgtctctcaaccaagcataaagtaatgtctctcaacttgacactcattgaaaaagttgagaaaaaattgccacaacttgatacaggttacctaatcccactacattggggaacgcttcaaaatcataacgttgacttttatgggattgaggaattttcatacaatgattggattgcatatctcgcccaagaatataataaacagctctatgtttggactattaaccgtgataaccttatgatacgttatttacaaagcccagttaatggaatcatcacagatgaactcaaccttttcaaggtcattaataaagatatcaaaaatagccctaattattatcaaagagctctccaacttattgatagcgagggt

SEQ ID NO: 2572 - protein, 217 aa, Streptococcus agalactiae
MDVIMTKDHKLVVIHDDNLKRLSGMNKDVSKLTLDQVTKIPIHQGRFASHIPSFTEFMKTAQSLDQKIMIELKPYNQNLDIYADEFIKEFKELRLSTKHKVMSLNLTLIEKVEKKLPQLDTGYLIPLHWGTLQNHNVDFYGIEEFSYNDWIAYLAQEYNKQLYVWTINRDNLMIRYLQSPVNGIITDELNLFKVINKDIKNSPNYYQRALQLIDSEG

SEQ ID NO: 2573 - DNA, 1773 bp, Streptococcus pyogenes
ttgtcaggcaatgagttgtttaaaataaaggagattagttcaatgacatttttatctgatttgatatcattaatgacaaaaatcagattatcttgggtaataaaggcgggtatttttcaattattatttgtaacgattgctaatattgtcttatcagaatttttctattttatattagacgttactggtcaatatcatttagataaagacaatgttgtgacttttttaaaaaatcctatagcacttgctttattaggtgcctatttatttttattagctgcttttattcaccttgagttttttgctctatatcgaattattgcggatcaagaaattagtttctatctttttagaaaacagttttcttattacctaagggggctttggaaaacattttctggttaccaattattactttttttgctttatatcctattgactattccagtcttacatattggtttatcttctgtgattactcaaaagctttatcttccagaatttattgttggggaattatcaaagataactagcacaaagtacttgctttatggcagtcttattcttgtgttttaccttaacctaagattagtatattttttaccattgatagcaatcaaccatcgtacggttgctcaagcatggagagagagttggcaaaagactaaaaagaaacatgtattgttatggatgaaactttttgcaatcaatggtcttacgattgtagtcttatcgctagctatttccatgattcttatttttgttgatatgtttaatcctaaggggaataatattattgttcagctgggagctttgacctttacatgggaactcattttttttactactattttttttaaactctgttcagcaatgattttaaaagaggcaattgaaccacaaaagcaatatgatgagccaagaagaagtaataaggcatatgttgtaatctttatcgtggttacagtaggttttgcttatcaatctcttgaacgtttaactttttttgacacatctcactctaagacagttatcgcgcatagaggacttgtatcagcaggtgtagaaaattctctggaagcccttgaaggtgctaagaaagcaggaagtgattatgtagaactggatctaatcttgactaaggataatcactttgtggtgtctcatgataatcgattgaagcgtttagctggagtaaataagacgattcgcaacttaaccttaaaagaagttgaacatctaacgagtcatcaaggacatttttcagggcgttttgtttcttttgacactttttatcaaaaggctaagaagttgaatatgccattacttattgaactcaagccaattggtacagaacctggaaattatgtcgatttgtttttagaaacttatcatcgacttggtataagcaaagataataaagtcatgtctttagatttagaagtaatagaagctatcaagaaaaaaaatccatcaattacgactggttatatcataccaattcaatttggattttttggagatgaatttgttgatttctatgtcattgaagacttttcttatcggtcttatttgtcgtcccaagctttttggaataataaagaaatttacgtttggactattaatgatcccaagcgcatagagcattatctcctaaagcctattcagggaattattacagaccaaccagctttaactaatcaattgattaaagacttaaaacaagataattcttattttagtcgattagtcagaattattagtagtctttat

SEQ ID NO: 2574 - protein, 591 aa, Streptococcus pyogenes
LSGNELFKIKEISSMTFLSDLISLMTKIRLSWVIKAGIFQLLFVTIANIVLSEFFYFILDVTGQYHLDKDNVVTFLKNPIALALLGAYLFLLAAFIHLEFFALYRIIADQEISFYLFRKQFSYYLRGLWKTFSGYQLLLFLLYILLTIPVLHIGLSSVITQKLYLPEFIVGELSKITSTKYLLYGSLILVFYLNLRLVYFLPLIAINHRTVAQAWRESWQKTKKKHVLLWMKLFAINGLTIVVLSLAISMILIFVDMFNPKGNNIIVQLGALTFTWELIFFTTIFFKLCSAMILKEAIEPQKQYDEPRRSNKAYVVIFIVVTVGFAYQSLERLTFFDTSHSKTVIAHRGLVSAGVENSLEALEGAKKAGSDYVELDLILTKDNHFVVSHDNRLKRLAGVNKTIRNLTLKEVEHLTSHQGHFSGRFVSFDTFYQKAKKLNMPLLIELKPIGTEPGNYVDLFLETYHRLGISKDNKVMSLDLEVIEAIKKKNPSITTGYIIPIQFGFFGDEFVDFYVIEDFSYRSYLSSQAFWNNKEIYVWTINDPKRIEHYLLKPIQGIITDQPALTNQLIKDLKQDNSYFSRLVRIISSLY

SEQ ID NO: 2575 - DNA, 591 bp, Streptococcus agalactiae
gtggtacaatatctaatgactataaaaaaggagctattcatgctacgagcattaaaagaagatttttttctaaccttaacctctttaaaaaatcaattttgggtttacattggaactggtatcttaatccaaactttagttgcttatttagtaaaaggaattctgagttttatctttcgtcggatattgatattgtcaaatactcccgcagtgactaaagacaattggactttactttttaatcatcccttagctttattactctttatactttatatcgtaatcctaattgggttcatctatactgagttcgctatctatactattgccatactgaaaactgaattttctctcagtatcaaaaaatggctaacaatctttcctaaaaaaataaaatcacttttaggaccacagctaatttgggtatcaatctacttacttttgacaattcctctagctaaccttggtctaaggtcaagtatactagagcatcttaaaattcctgactttatttctggcgagttaacaaagacagtctttggaaagataggttactctacccttttactgcttatttgttacttaaacctt

SEQ ID NO: 2576 - protein, 197 aa, Streptococcus agalactiae
MVQYLMTIKKELFMLRALKEDFFLTLTSLKNQFWVYIGTGILIQTLVAYLVKGILSFIFRRILILSNTPAVTKDNWTLLFNHPLALLLFILYIVILIGFIYTEFAIYTIAILKTEFSLSIKKWLTIFPKKIKSLLGPQLIWVSIYLLLTIPLANLGLRSSILEHLKIPDFISGELTKTVFGKIGYSTLLLLICYLNL

SEQ ID NO: 2577 - DNA, 246 bp, Streptococcus agalactiae
ttgaaaactaccataaaaaacaaacaaacttgtggtacaatatctaatgactataaaaaaggagctattcatgctacgagcattaaaagaagatttttttctaaccttaacctctttaaaaaatcaattttgggtttacattggaactggtatcttaatccaaactttagttgcttatttagtaaaaggaattctgagttttatctttcgtcggatattgatattgtcaaatactcccgcagtgac

SEQ ID NO: 2578 - protein, 82 aa, Streptococcus agalactiae
MKTTIKNKQTCGTISNDYKKGAIHATSIKRRFFSNLNLFKKSILGLHWNWYLNPNFSCLFSKRNSEFYLSSDIDIVKYSRSD

SEQ ID NO: 2579 - DNA, 105 bp, Streptococcus agalactiae
ttgttttttatggtagttttcaaaccggtttcacttttttatcaattttgccttcaaaagctgaaacgcattttaaaaagtgatagaatagtagggaaaatcaaa

SEQ ID NO: 2580 - protein, 35 aa, Streptococcus agalactiae
MFFMVVFKPVSLFYQFCLQKLKRILKSDRIVGKIK

SEQ ID NO: 2581 - DNA, 600 bp, Streptococcus agalactiae
atgaaatttctagaattaaataagaagcgccatgctgtgaaacattttaatgataaaccagtcgactttaaagatgttagaactgctattgaaattgcgacattagcgccatctgctaataatattcagccttggaagtttgtcgttgtccaagaaaaaaaatctgctctagcagaaggtttaccggaaagtaattgtaaccaaattaatcaagcgcagtatgttattgctttatttacagatacagatttaggacagagatcacggaaaatagctcgtattggtcgtagatctcttcctgatgatttaattggttattacatggaaactctaccaccacgctatgctttatatagtgaaaaacaaactggagagtatctctctttaaatgcaggtatcgttgctatgaatttagtacttgccttgacagatcaaggtattagttctaatatgattttagggttcgataaagcgattactaatgatgtcttagagatagataaacgttttagaccagaaatattaattactgttggttatagtgatgaaaaggttgaacctagttatcgtttgccagttgatcatattattgaaaaacgt

SEQ ID NO: 2582 - protein, 200 aa, Streptococcus agalactiae
MKFLELNKKRHAVKHFNDKPVDFKDVRTAIEIATLAPSANNIQPWKFVVVQEKKSALAEGLPESNCNQINQAQYVIALFTDTDLGQRSRKIARIGRRSLPDDLIGYYMETLPPRYALYSEKQTGEYLSLNAGIVAMNLVLALTDQGISSNMILGFDKAITNDVLEIDKRFRPEILITVGYSDEKVEPSYRLPVDHIIEKR

SEQ ID NO: 2583 - DNA, 600 bp, Streptococcus pyogenes
atgaaatttctagagttaaacaaaaaacgccatgccattaagacctttaatgaccagccagttgactacgaggatttgcgaacagccattgagattgcaaccttagcacctagtgccaataacattcaaccttggaaatttgtagtcgttcaagagaaaaaagctgagttagcaaaagggttacctctagcaaataaagtgcaggttgaacaggctcaatatgtagtggcgctattttcagacactgatttagctttacgttctcgtaaaattgcccgtatcggtgtcaaatcattaccagacgacttaattggttattatatggagactttgccaccacgttttgctgcttttaatgaggttcaaaccggtgagtacttagctattaatgcaggcattgtggctatgaacttggtgttatccttgacggatcaaaagattgcttccaatattatccttggttttgataagtcaacgaccaatgagattttagacatcgatccgcgttttcgtccagaattattgattactgttggctatagtgacgagaaaccagaaccaagttatcgtttgcctgttgatgaagtcatcgaaagaaga

SEQ ID NO: 2584 - protein, 200 aa, Streptococcus pyogenes
MKFLELNKKRHAIKTFNDQPVDYEDLRTAIEIATLAPSANNIQPWKFVVVQEKKAELAKGLPLANKVQVEQAQYVVALFSDTDLALRSRKIARIGVKSLPDDLIGYYMETLPPRFAAFNEVQTGEYLAINAGIVAMNLVLSLTDQKIASNIILGFDKSTTNEILDIDPRFRPELLITVGYSDEKPEPSYRLPVDEVIERR

SEQ ID NO: 2585 - DNA, 1404 bp, Streptococcus agalactiae
atgacaattgattttagagcagaagtagacaaacgcaaagacgctttgatggacgatttaataaatcttcttcgcattaactcggagcgtgatgattcacaagctgatgcagagcatccatttggtcctggacctgtaaaagccttggaatttttccttgagatggctgagcgagatggctacgaaacaaaaaacgtagataattatgcgggacactttacatttggtcaaggcgaagaagaactaggtatttttgggcatttagatgttgttcctgcaggcagcggttgggatacagacccttatgaaccagttatcaaggataaccgtttatatgctcgaggctcatcagacgataagggaccaacaatggcatgttattatgctctaaaaattattaaagagcttgggctaccaacatctaagaaagttcgttttgttgtaggaactgatgaagaatctggatggggagatatggattactacttcgaacatgttggtcttccaaaacctgattttggtttctctccagatgcagaatttccaattataaatggtgaaaaaggtaatattactgaatatttacatttttcaggagaaaataagggagctgttagactgcatagcttttctggcggacttcgcgaaaacatggttccagaatcagccacagcacgtttcacaagtcatttagatcagacaacacttggggctagtctagctgattttgcaagtaaacataatttgaaagcagaattatctgtagaagatgagcaatatacagcaacagtttatggtaaatctgctcatggttcaacaccacaagaaggtgttaatggggcgacttatttagctctttatctaagtcaatttgattttgaaggtcctgctcgtgctttcttagatgttacagccaacattattcacgaagacttctcaggtgaaaaacttggagtagcttatgaagatgactgtatgggaccattgagcatgaatgcaggtgtcttccagtttgatgaaactaatgatgataatactatcgctcttaatttccgttacccacaagggacagatgctaaaactatccaaactaagcttgagaaacttaacggagttgaaaaagtgactctttctgaccatgaacacacaccacactatgtacctatggacgatgaattagtatcaaccttactagctgtctatgaaaagcaaactggtcttaaaggacatgaacaggttattggtggtgggacatttggtcgcttacttgaacggggtgttgcatacggtgccatgttcccaggagatgaaaacactatgcatcaagctaatgagtacatgcctttagaaaatattttccgttcggctgctatctacgcagaagctatctatgaattaatcaaa

SEQ ID NO: 2586 - protein, 468 aa, Streptococcus agalactiae
MTIDFRAEVDKRKDALMDDLINLLRINSERDDSQADAEHPFGPGPVKALEFFLEMAERDGYETKNVDNYAGHFTFGQGEEELGIFGHLDVVPAGSGWDTDPYEPVIKDNRLYARGSSDDKGPTMACYYALKIIKELGLPTSKKVRFVVGTDEESGWGDMDYYFEHVGLPKPDFGFSPDAEFPIINGEKGNITEYLHFSGENKGAVRLHSFSGGLRENMVPESATARFTSHLDQTTLGASLADFASKHNLKAELSVEDEQYTATVYGKSAHGSTPQEGVNGATYLALYLSQFDFEGPARAFLDVTANIIHEDFSGEKLGVAYEDDCMGPLSMNAGVFQFDETNDDNTIALNFRYPQGTDAKTIQTKLEKLNGVEKVTLSDHEHTPHYVPMDDELVSTLLAVYEKQTGLKGHEQVIGGGTFGRLLERGVAYGAMFPGDENTMHQANEYMPLENIFRSAAIYAEAIYELIK

SEQ ID NO: 2587 - DNA, 1458 bp, Streptococcus pyogenes
ttggcttattttaagttaaacattatccctaaaacgaataaggagagtataatgacaaccattgattttaaagcagaagttgacaaacgtaaaaaagctatgctagcagatttagttgacctattacgcattaattcagaacgcgatgaccaattagctgatgataaacacccatttggcccaggtccagttaaggccttggagcatttcctcgcaatggctgagcgtgatggctacaaaacgcgtaatattgataactatgcaggtgactttgaatttggtcaaggtgatgaagtactaggaatctttggtcaccttgatgttgtgccagctggtagcggttgggatacagacccttatgagccagtgattaaagacgatcgcatctatgcgcgtgggtcttcggatgataaaggaccaaccatggcgtgttactacgctctgaaaatcattaaagaactgggtcttcctgtgtctaaaaaagttcgtttcattgttggtaccgatgaagaatctggctggggggatatggattattactttgctcataatggcttgaaaaatccagattttggtttctcaccagatgctgaatttccaattatcaatggtgagaaaggaaatatcactgaatacctccatttcgctggtgacaacaagggcgcttttgtgcttcatcgcttccaaggtgggttgcgtgaaaacatggtaccagaatctgccacagctgtcattacggcaccgcatgaccttgatgtgctagaagcagctttggagcaatttttatcagaacatggtgttaaaggttctatgaaggctactgatggtaaaattgaagtaactattattggtaagtctgctcacgggtcgactccagaagcgggtgttaatggtgctaccttgttggctaaattcctgaatcaatttacctttgaaggggctgctaaggattatttacatgtggcaggtgaggtgcttcatgaagactttgcggcagaaaaactaggccttgcttatactgatgaccgtatgggagccctgagcatgaacgcaggtgtcttcacctttgatagtcaatcagctgacaataccatcgccttgaatttccgctatcccaaaggaactgatgcggcaaccttaaaagcaggattggaaaaattaccaggattaactaaggtaagcctttctgagcatgaacatacacctcattatgtgccaatggatgatgaattagtagctaccttacttgctgtttacgaaaaacaaacaggtcttaaaggctacgaacaagttatcggcggaggaacctttgggcgcttgctagaacgtggtgtggcctttggagcgatgttcccaggtgatgaaaacactatgcaccaagctaatgagtatatgcctttagaaaatatttatcgctcagcagctatttatgctgaagcaatctacgaattaattaaa

SEQ ID NO: 2588 - protein, 486 aa, Streptococcus pyogenes
LAYFKLNIIPKTNKESIMTTIDFKAEVDKRKKAMLADLVDLLRINSERDDQLADDKHPFGPGPVKALEHFLAMAERDGYKTRNIDNYAGDFEFGQGDEVLGIFGHLDVVPAGSGWDTDPYEPVIKDDRIYARGSSDDKGPTMACYYALKIIKELGLPVSKKVRFIVGTDEESGWGDMDYYFAHNGLKNPDFGFSPDAEFPIINGEKGNITEYLHFAGDNKGAFVLHRFQGGLRENMVPESATAVITAPHDLDVLEAALEQFLSEHGVKGSMKATDGKIEVTIIGKSAHGSTPEAGVNGATLLAKFLNQFTFEGAAKDYLHVAGEVLHEDFAAEKLGLAYTDDRMGALSMNAGVFTFDSQSADNTIALNFRYPKGTDAATLKAGLEKLPGLTKVSLSEHEHTPHYVPMDDELVATLLAVYEKQTGLKGYEQVIGGGTFGRLLERGVAFGAMFPGDENTMHQANEYMPLENIYRSAAIYAEAIYELIK

SEQ ID NO: 2589 - DNA, 582 bp, Streptococcus agalactiae
atgactgacttggaaaaaattattaaagcaataaaaagtgattcacagaatcaaaattatacagaaaatggtattgatcctttgtttgctgctcctaaaacagctaggatcaatattgttggccaagcacctggtttaaaaactcaagaagcaagactctattggaaagataaatctggagatcgtctacgccagtggcttggagttgatgaagagacattttaccattctggaaaatttgctgttttacctttagatttttattacccaggcaaaggaaaatcaggagatttatcccctagaaaaggttttgcggagaaatggcaccctcttattttaaaagaaatgcctaatgttcaattgaccttgctagttggtcagtatactcagaaatattatcttggaagctccgcacataaaaatctaacagaaacagttaaagcttacaaagactatctacccgattatttacccctggttcacccatcaccgcgaaatcaaatttggctaaagaagaatccatggtttgaaaaagatctaatcgttgatttacaaaagatagtagcagatattttaaaagat

SEQ ID NO: 2590 - protein, 194 aa, Streptococcus agalactiae
MTDLEKIIKAIKSDSQNQNYTENGIDPLFAAPKTARINIVGQAPGLKTQEARLYWKDKSGDRLRQWLGVDEETFYHSGKFAVLPLDFYYPGKGKSGDLSPRKGFAEKWHPLILKEMPNVQLTLLVGQYTQKYYLGSSAHKNLTETVKAYKDYLPDYLPLVHPSPRNQIWLKKNPWFEKDLIVDLQKIVADILKD

SEQ ID NO: 2591 - DNA, 573 bp, Streptococcus pyogenes
atggatgatttaaccaaagctattatggcagatgaggctaatctctcctataccgaaagaggtatttttcctttatatgatgctcctcaaacagctaggattattattgttggccaagctcctggaatagtagctcaaggaaccaaactttactggaatgatcgtagtggcatccgcttacgagactggctaggtgtggacaatgacaccttttaccactcaggattgtttggcattatccctatggatttctattatcctggtaagggaaaatccggtgacttaccacctagagaaggttttgcggctaagtggcacccgccattaagagcattgatgccagaagttgaattgacgattttggttggtcgctatgctcaggacttttaccttggtaacaaggcttacaaaaccttaactgaaacagtccgtcactttgaggattacttgccagactattttccacttgttcatccttctccaagaaaccaattgtggttagctaagaacccctggtttgagcaggatttattacctatcttgcaaaaacgtgtggaggcaattctaaccaaa

SEQ ID NO: 2592 - protein, 191 aa, Streptococcus pyogenes
MDDLTKAIMADEANLSYTERGIFPLYDAPQTARIIIVGQAPGIVAQGTKLYWNDRSGIRLRDWLGVDNDTFYHSGLFGIIPMDFYYPGKGKSGDLPPREGFAAKWHPPLRALMPEVELTILVGRYAQDFYLGNKAYKTLTETVRHFEDYLPDYFPLVHPSPRNQLWLAKNPWFEQDLLPILQKRVEAILTK

SEQ ID NO: 2593 - DNA, 252 bp, Streptococcus agalactiae
atgagagataatcatctacacacgtatttttcctatgattgtcaaacggcatttgaggactatattaatggttttacaggtgaatttatcacaacagaacattttgatttatcaaatccttacaccggtcaagacgatgttcctgattatagtgcttattgtcaaaaaatagattatcttaatcagaaatatggaaatcgatttaaaaaggaattgaaatcggttattttaaagatagggaatcagatattt

SEQ ID NO: 2594 - protein, 84 aa, Streptococcus agalactiae
MRDNHLHTYFSYDCQTAFEDYINGFTGEFITTEHFDLSNPYTGQDDVPDYSAYCQKIDYLNQKYGNRFKKELKSVILKIGNQIF

SEQ ID NO: 2595 - DNA, 441 bp, Streptococcus agalactiae
ttgtcaatccatcataatggtaggtatgattatctgcaagaagaagctctgaaagtaccaacaaaggagcttttagcagattactttaatcgtatggaatttgccataggccgtgtggaagcgcacgttttagctcactttgattatggttttcgtaagttaaacttagatgtagaagatttaaaaccgtttgaaacgcaattgaagcgcattttcataaagatgttatctaaggggttagcttttgaactaaataccaaatccctttatctatatgggaatgaaaaactttatcgctatgctttagagatactcaaacagcttggttgtaaacaatactctataggctctgacggtcatattcctgaacatttttgttatgaatttgatagacttcaaggtctgctaaaggactatcaaattgatgaaaatcatttgata

SEQ ID NO: 2596 - protein, 147 aa, Streptococcus agalactiae
MSIHHNGRYDYLQEEALKVPTKELLADYFNRMEFAIGRVEAHVLAHFDYGFRKLNLDVEDLKPFETQLKRIFIKMLSKGLAFELNTKSLYLYGNEKLYRYALEILKQLGCKQYSIGSDGHIPEHFCYEFDRLQGLLKDYQIDENHLI

SEQ ID NO: 2597 - DNA, 3756 bp, Streptococcus agalactiae
atgaaaagaaaagacttatttggtgataaacaaactcaatacacgattagaaagttaagtgttggagtagcttcagttgcaacaggggtatgtatttttcttcatagtccacaggtatttgctgaagaagtaagtgcttctcctgcaaatacagcgattgcagagtcgaatattaatcaggttgacaaccaacaatctactaatttaaaagatgacataaactcaaactctgagacggttgtgacaccctcagatatgccggataccaagcaattagtatcagatgaaactgacactcaaaagggagtgacagagccggataaggcgacaagcctgcttgaagaaaataaaggtcctgtttcagataaaaataccttagatttaaaagtagcaccatctacattgcaaaatactcccgacaaaacttctcaagctataggtgctccaagccctaccttgaaagtagctaatcaagctccacggattgaaaatggttactttaggctacatcttaaagaattgcctcaaggtcatcctgtagaaagcactggactttggatatggggagatgttgatcaaccgtctagtaattggccaaatggtgctatccctatgactgatgctaagaaagatgattacggttattatgttgattttaaattatctgaaaaacaacgaaaacaaatatcttttttaattaataacaaagcagggacaaatttaagcggcgatcatcatattccattattacgacctgagatgaaccaagtttggattgatgaaaagtacggtacacatacttatcaacccctcaaagaagggtatgtccgtattaactatttgagttcctctagtaactatgaccacttatcagcatggctctttaaagatgttgcaaccccctcaacaacttggccagatggtagtaattttgtgaatcaaggactatatggaaggtatattgatgtatcactaaaaactaacgccaaagagattggttttctaatcttagatgaaagtaagacaggagatgcagtgaaagttcaacccaacgactatgtttttagagatttagctaaccataaccaaatttttgtaaaagataaggatccaaaggtttataataatccttattacattgatcaagtgcagctaaaggatgcccaacaaattgatttaacaagtattcaagcaagttttacaactctagatggggtagataaaactgaaattttaaaagaattgaaagtgactgataaaaatcaaaatgctatacaaatttctgatatcactctcgatactagtaaatctcttttaataatcaaaggcgactttaatcctaaacaaggtcatttcaacatatcttataatggtaacaatgtcatgacaaggcaatcttgggaatttaaagaccaactttatgcttatagtggaaatttaggtgcagttctcaatcaagatggttcaaaagttgaagccagcctctggtcaccgagtgctgatagtgtcactatgattatttatgacaaagataaccaaaacagggttgtagcgactaccccccttatgaaaaataataaaggtgtttggcagacgatacttgatactaaattaggtattaaaaactatactggttactattatctttacgaaataaaaagaggtaaggataaggttaagattttagatccttatgcaaagtcattagcagagtgggatagtaatactgttaatgatgatattaaaacggctaaagcagcttttgtaaatccaagtcaacttggacctcaaaatttaagttttgctaaaattgctaattttaaaggaagacaagatgctgttatatacgaagcacatgtaagagacttcacttctgatcgatctttggatggaaaattaaaaaatcaatttggtacctttgcagccttttcagagaaactagattatttacagaaattaggagttacacacattcagcttttaccggtattgagttatttttatgttaatgaaatggataagtcacgctcaacagcttacacttcctcagacaataattacaattggggctatgacccacagagctattttgctctttctgggatgtattcagagaaaccaaaagatccatcagcacgtatcgccgaattaaaacaattaatacatgatattcataaacgtggcatgggggttatacttgatgtcgtctataatcacactgcaaaaacttatctctttgaggatatagaacctaattattatcactttatgaatgaagatggttcaccaagagaaagttttggagggggacgtttaggaaccactcatgcaatgagtcgtcgtgttttggttgattccattaaatatcttacaagtgaatttaaagttgatggtttccgttttgatatgatgggagatcatgatgcggctgcgattgaattagcttataaagaagctaaagctattaatcctaatatgattatgattggtgagggctggagaacattccaaggcgatcaaggtcagccggttaaaccagctgaccaagattggatgaagtcaaccgatacagttggcgtcttttcagatgatattcgtaatagcttgaaatctggttttccaaatgaaggtactccagctttcatcacaggtggcccacaatctttacaaggtatttttaaaaatatcaaagcacaacctgggaattttgaagcagattcgccaggagatgtggtgcagtatattgctgcacatgataaccttaccttgcatgatgtgattgcaaaatcaattaataaagaccctaaggtagctgaagaagagattcatagacgtctgcgtttaggaaatgtaatgattttaacatctcaagggacagcattcattcattctggtcaagagtatggtcgtacgaagcgtttacttaaccctgattacatgacaaaagtttcagatgacaaattgcctaataaagcaacacttattgaagctgttaaagaatacccatattttattcatgattcatatgattcttcagatgccattaatcattttgattgggcagcagccacagataataacaaacacccaatttcaacgaaaacacaggcctatacagcaggtttaatcacattaaggcgttcaacagatgctttccgaaaattgagcaaagcagaaattgatcgtgaggttagcttgattacagaggtaggtcaaggtgatattaaagaaaaagatttggttattgcttaccaaacaatagattctaaaggtgatatttacgcagtatttgttaatgctgatagtaaagctagaaacgttttactaggtgaaaaatataaacaccttttaaaagggcaagtaattgttgatgctgatcaagcggggattaaaccaatctcaactcctagaggtgttcattttgaaaaagatagtttgctgattgatccattaacagcaattgtgattaaagttggcaaagttgctcctagccctaaggaggaattgcaagcagattatcccaaaacacaatctttcaaggaatctaaaacggtagaaaaagtaaatagaatagctaataagacctcaataactcctgtagtttctaagaaggccgattcatatctgacaaatgaagctaatttgccaaaaactggagataagtcatcaaaaatactaagtgtagtaggaataagcattctagcaagtctacttgctctagtaggtctctctttaaagaggaatcgtcacttaaaa

SEQ ID NO: 2598 - protein, 1252 aa, Streptococcus agalactiae
MKRKDLFGDKQTQYTIRKLSVGVASVATGVCIFLHSPQVFAEEVSASPANTAIAESNINQVDNQQSTNLKDDINSNSETVVTPSDMPDTKQLVSDETDTQKGVTEPDKATSLLEENKGPVSDKNTLDLKVAPSTLQNTPDKTSQAIGAPSPTLKVANQAPRIENGYFRLHLKELPQGHPVESTGLWIWGDVDQPSSNWPNGAIPMTDAKKDDYGYYVDFKLSEKQRKQISFLINNKAGTNLSGDHHIPLLRPEMNQVWIDEKYGTHTYQPLKEGYVRINYLSSSSNYDHLSAWLFKDVATPSTTWPDGSNFVNQGLYGRYIDVSLKTNAKEIGFLILDESKTGDAVKVQPNDYVFRDLANHNQIFVKDKDPKVYNNPYYIDQVQLKDAQQIDLTSIQASFTTLDGVDKTEILKELKVTDKNQNAIQISDITLDTSKSLLIIKGDFNPKQGHFNISYNGNNVMTRQSWEFKDQLYAYSGNLGAVLNQDGSKVEASLWSPSADSVTMIIYDKDNQNRVVATTPLMKNNKGVWQTILDTKLGIKNYTGYYYLYEIKRGKDKVKILDPYAKSLAEWDSNTVNDDIKTAKAAFVNPSQLGPQNLSFAKIANFKGRQDAVIYEAHVRDFTSDRSLDGKLKNQFGTFAAFSEKLDYLQKLGVTHIQLLPVLSYFYVNEMDKSRSTAYTSSDNNYNWGYDPQSYFALSGMYSEKPKDPSARIAELKQLIHDIHKRGMGVILDVVYNHTAKTYLFEDIEPNYYHFMNEDGSPRESFGGGRLGTTHAMSRRVLVDSIKYLTSEFKVDGFRFDMMGDHDAAAIELAYKEAKAINPNMIMIGEGWRTFQGDQGQPVKPADQDWMKSTDTVGVFSDDIRNSLKSGFPNEGTPAFITGGPQSLQGIFKNIKAQPGNFEADSPGDVVQYIAAHDNLTLHDVIAKSINKDPKVAEEEIHRRLRLGNVMILTSQGTAFIHSGQEYGRTKRLLNPDYMTKVSDDKLPNKATLIEAVKEYPYFIHDSYDSSDAINHFDWAAATDNNKHPISTKTQAYTAGLITLRRSTDAFRKLSKAEIDREVSLITEVGQGDIKEKDLVIAYQTIDSKGDIYAVFVNADSKARNVLLGEKYKHLLKGQVIVDADQAGIKPISTPRGVHFEKDSLLIDPLTAIVIKVGKVAPSPKEELQADYPKTQSFKESKTVEKVNRIANKTSITPVVSKKADSYLTNEANLPKTGDKSSKILSVVGISILASLLALVGLSLKRNRHLK

SEQ ID NO: 2599 - DNA, 3522 bp, Streptococcus pyogenes
ttgaatgttatactaaatggaggtcttatgaaaaagaaagtcaaccaaggatcaaagcgctatcaatatctgttaaaaaagtgggggataggttttgtaatcgctgcaactgggactgtcgtgttagggtgcacccctagtatcttaacacatcaagttgctgctaaaaccattgttggactagcccgcgatgaagctcaacaaggagatggcaatgctaaatctggtgatggtcttcaatcgtctagcaaggaggcaaaaccagttttagacagctcgtcagctaatcctgctagtattgctgagcatcatttgcgtatgcattttaaaacattgccagctggtgagtcgctaggaagcttgggactttgggtgtggggagatgtggatcaaccttcaaaggattggccaaatggtgctatcaccatgacaaaagcgaaaaaagatgactatggctattatctagatgtgccactagcagctaaacaccgccagcaagtgtcttatctcattaataataaagctggagagaatctttcaaaggaccagcacatctcgcttctcacgccaaaaatgaatgaagtttggatagacgagaattaccatgcgcacgcttatcgacctttgaaaaaaggttaccttcgaatcaactaccacaatcaatcgggacactacgataacttagctgtctggacctttaaagatgtcaaaaccccaacgaccgactggccaaatggacttgacttgtcacataaagggcattatggagcttatgttgatgtccccttaaaagaaggagctaacgaaatcggatttttaatccttgataaaagtaagacaggagatgctattaaagtgcaaccaaaagattatctatttaaagagttagacaatcatactcaggtttttgtcaaagacactgacccaaaagtttacaacaatccttattatattgatcaggttagtctcaaaggagctgaacaaaccacgccaaatgagattaaagccatttttacgaccttagatgggcttgatgaagatgcggtgaaacaaaacatcaagatcactgacaaagcagggaaaactgttgcaattgatgagttgacacttgacagggataagtctgtaatgacattaaagggtgattttaaggcgcaaggtgcagtctacacggttacatttggagaagttagccaagtcgctcgccaatcctggcaattaaaagataaactctatgcttacgatggtgaacttggagctaccctagctaaggatggttctgttgatttagcgctatggtctccaagtgctgatactgttaaggttgtcgtttatgataaacaagatcagacaagggtggttggtcaagctgatttgaccaagtcggacaagggtgtttggagagctcatctaacttctgacagtgtcaagggcattagtgattacacaggctactattacctttatgaaatcacgcgcggtcaggaaaaagtcatggttttggatccttacgccaaatctctcgctgcctggaatgatgcgactgctactgatgacatcaaaacagcaaaagctgcctttattgatccaagcaaactaggaccaacaggccttgattttgccaaaattaacaactttaaaaagcgtgaagacgctattatctatgaagcacatgtgcgagattttacgtcagataaggctctagaaggcaagttaacacacccttttgggactttttcagctttcgttgaacagctagactatctcaaagacttgggggttacccacgttcaattgctaccggttttgagttatttttatgccaatgagctggacaagagccgctcaacagcctacacgtcttcagacaataattacaactggggttatgacccacaacactactttgccctttctggcatgtattcggcaaatcctaatgaccctgctttacgtatcgcagagcttaaaaaccttgtcaatgagattcacaaacgtggtatgggtgttatttttgatgtggtttataaccacacggctagaacctatctctttgaagatttggaacccaactactatcattttatgaatgctgatggtacagctagagagagttttggcggaggtcgtctaggaacgacacatgccatgagtcgtcgtatcttggtggattcgattacttatctgactcgtgaattcaaggtagatggttttcgtttcgacatgatgggtgaccatgatgcggcagctattgagcaagcctttaaggcagccaaagccattaatccaaataccattatgattggcgaaggctggcgtacctaccaaggtgatgaggggaaaaaagaaattgcggcagatcaagattggatgaaagcaaccaatacggtcggtgttttctctgatgatatcagaaataccctcaagtcaggttttccaaatgaaggcacagcagcctttattactggtggcgcaaaaaatctagaaggtttattcaaaacgatcaaagcacagcctggtaactttgaagcagatgccccaggagatgtagtgcagtatattgcagcccatgacaacctgaccttacatgatgtcattgccaaatccatcaataaggatcctaaagtggctgaagaagagattcacaagcgtattcgtctaggaaataccatgattttaactgctcaagggactgcctttatccattctggtcaggaatatggacgaaccaagcagcttctaaatcccgactacaagacaaaggcgtctgatgacaaggtgccaaataaggcgactctgattgatgctgtagcgcaatacccttacttcatccacgattcttatgattcgtctgatgcggtcaatcattttgactgggcaaaggcaacagattccatagctcacccgattagcaaccaaacaaaagcctatacacagggactaattgcgttgcgtcgctcaacagatgcctttacaaaagcaaccaaagctgaggtagatcgggatgtgaccttgatcacccaagcaggacaagatggtattcaacaagaggacctcatcatgggttaccaaacagtggcatcaaatggagatcgctatgctgtctttgtcaatgcagacaacaagacccgcaaggtagttttacctcaagcctaccgctatttgctaggagcccaagtgcttgttgatgctgagcaagctggtgttactgccattgctaagcctaagggagtccagtttaccaaagaaggcttgactattgaaggcctaactgccctggtcctcaaagtatcctcaaaaacggctaatccctctcagcaaaagagtcagacagacaatcatcaaaccaaaacaccagatggctcaaaagacctagacaaatcattaatgactagaccaaaaagagctaaaacaaaccaaaagctcccaaaaacgggtgaagcctcctcaaaaggcttattagcagctggaatagctctgcttttattggctattagcctgttgatgaagcgccaaaaagat

SEQ ID NO: 2600 - protein, 1174 aa, Streptococcus pyogenes
LNVILNGGLMKKKVNQGSKRYQYLLKKWGIGFVIAATGTVVLGCTPSILTHQVAAKTIVGLARDEAQQGDGNAKSGDGLQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKDVKTPTTDWPNGLDLSHKGHYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDRDKSVMTLKGDFKAQGAVYTVTFGEVSQVARQSWQLKDKLYAYDGELGATLAKDGSVDLALWSPSADTVKVVVYDKQDQTRVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPGNFEADAPGDVVQYIAAHDNLTLHDVIAKSINKDPKVAEEEIHKRIRLGNTMILTAQGTAFIHSGQEYGRTKQLLNPDYKTKASDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLVDAEQAGVTAIAKPKGVQFTKEGLTIEGLTALVLKVSSKTANPSQQKSQTDNHQTKTPDGSKDLDKSLMTRPKRAKTNQKLPKTGEASSKGLLAAGIALLLLAISLLMKRQKD

SEQ ID NO: 2601 - DNA, 957 bp, Streptococcus agalactiae
ttgtgttataatagatgtaaacgtttttttatgaggtatatgatgaaaaattgggaaaaaccaccattagtgatggcgggattagtattagggctattagctttggggaaccttctagagggatatggcacctatgttcgctattgtttagggctagtagcacttgttttttggatttttttaatcaaaggaatattaaaaaataaaaaagaaagcaggaaggagttaagcaatcctttgattgcttctgtctttactactttttttatggcaggtatgattttatcaacctatatcttattatttagaagtttaggaatatgggtagcagttctgtcaaaaggtgtatggtggttgtcatttattgcgttaatcattcatatggctattttttcatggaaatatttgagacacttttcgatggctaatctttttccttcttggtctgtcctctatgttggtataggggtagctagcctgacagcaccaattagtggacaatttactattgggaaaatagtcttttggtatggttttattgcaactttagtattattaccatttctattcattaaagcatataaaatcgggctaccttcggcagttaagcctaatataactactatttgcgctccaatgtcgctaatcacagcgggatatgtcaatagttttgtgtcaccaaatagaggtttattactgctattaatcgtaatggcacaatttctttattttttcattctttttcaggtgcctaaattactgattggtgattttacaccaggtttctcagcctttactttcccccttgttatctcagctacctcacttaaattaagtattcagcatctatcattaccagttgatatacaggggctagtccactttgaaattgggacaacaactcttattgttatgatagtaatggtacgttatattttctttttaaggcgaacaatt

SEQ ID NO: 2602 - protein, 319 aa, Streptococcus agalactiae
MCYNRCKRFFMRYMMKNWEKPPLVMAGLVLGLLALGNLLEGYGTYVRYCLGLVALVFWIFLIKGILKNKKESRKELSNPLIASVFTTFFMAGMILSTYILLFRSLGIWVAVLSKGVWWLSFIALIIHMAIFSWKYLRHFSMANLFPSWSVLYVGIGVASLTAPISGQFTIGKIVFWYGFIATLVLLPFLFIKAYKIGLPSAVKPNITTICAPMSLITAGYVNSFVSPNRGLLLLLIVMAQFLYFFILFQVPKLLIGDFTPGFSAFTFPLVISATSLKLSIQHLSLPVDIQGLVHFEIGTTTLIVMIVMVRYIFFLRRTI

SEQ ID NO: 2603 - DNA, 948 bp, Streptococcus pyogenes
atgtcactaaaaatagctgttaataggcagaaaaggacacttatgaaacaccttaaaaccccaccattggtcatgtcaggattggcattaggaacgttgtcatttggcaatttgttggctacttatgtttcgatttttaattatttgggaattctggcagctctttttatctatggtatcttgcttgttggcatggttaggaaccttaacgataccaaaatgcagttacgacaacctctaattgcctctgtttttccaactttttttatgacagggatgttgttgtcttcactctttctcaaagtgacaggagggtgttggttaggctttctcacttggtggctattctttttgggaaatcttgtcctgattgcttattaccagtatcgttttgtcttttctttttcatgggataacgtttttccttcctggtccgtgctttttgttggaattgcaatggcggcattaacagcacctgctagtaggcagtttttattaggacaggtgattttttgggtttgtcttctcttaactgctgtgattttaccttttatggccaaaaagacttatgggattggtctaggtcaagcagtaatgcccaatatttcaacgttttgtgcccctctgtccttactttcagcgtcttatttagcaacctttcctagaccacaagtaggaatggttatctttcttctcgtcagctcacaactgttatatgcttttgtggttgtacagcttcctcgcttactcaatcgtccctttaacccaggtttttcagcttttacctttccgtttgtgattagtgccacttccttaaaaatgaccttatcttttttaggttggcaaggtttaggttggcaggttcttttgctaggagaggtattgttggcgacagctttagtcacttatgtttatggggcttacctgagatttctatttcaaaataag

SEQ ID NO: 2604 - protein, 316 aa, Streptococcus pyogenes
MSLKIAVNRQKRTLMKHLKTPPLVMSGLALGTLSFGNLLATYVSIFNYLGILAALFIYGILLVGMVRNLNDTKMQLRQPLIASVFPTFFMTGMLLSSLFLKVTGGCWLGFLTWWLFFLGNLVLIAYYQYRFVFSFSWDNVFPSWSVLFVGIAMAALTAPASRQFLLGQVIFWVCLLLTAVILPFMAKKTYGIGLGQAVMPNISTFCAPLSLLSASYLATFPRPQVGMVIFLLVSSQLLYAFVVVQLPRLLNRPFNPGFSAFTFPFVISATSLKMTLSFLGWQGLGWQVLLLGEVLLATALVTYVYGAYLRFLFQNK

SEQ ID NO: 2605 - DNA, 174 bp, Streptococcus agalactiae
atggttaaaaaattcgcatttgctaaaggaatagcaacaggagtcgttgcaacagctgctactcttgcaggtgctgcatttgctatcaaaaaaacaattattgaacctgaggaagaaaaaatagcttttatcgaagaaaatcgtaaaaaagctgcacgtaaacgtgtctctcat

SEQ ID NO: 2606 - protein, 58 aa, Streptococcus agalactiae
MVKKFAFAKGIATGVVATAATLAGAAFAIKKTIIEPEEEKIAFIEENRKKAARKRVSH

SEQ ID NO: 2607 - DNA, 174 bp, Streptococcus pyogenes
atggttaagaaatatcaatttgttaaaggtcttgctactggcgtcctagcaactgctgctactgttgctggtgctgtctttgctgtaaaaaaaacaatcattgaccctgaagaagaaaaagctgctttcattgaagaaaaccgcaaaaaagctgcgcgtcgtcgtgtagctcgc

SEQ ID NO: 2608 - protein, 58 aa, Streptococcus pyogenes
MVKKYQFVKGLATGVLATAATVAGAVFAVKKTIIDPEEEKAAFIEENRKKAARRRVAR

SEQ ID NO: 2609 - DNA, 900 bp, Streptococcus agalactiae
ttgagaagtatcatgagaaaaatcaaacttatagcagttgttggtccaactgcggttgggaagacagcattaggaattgaattagctaaaactttcaatggcgaaatcattagtggtgatagtcagcaagtttatcagaagttagatatcggaacggctaaagctagtaaagaagagcaagaacaagcttatcatcacttgattgatgttcgtgaagtaaatgagaactattcggtttatgatttcgtcaaagaggcaaaagtagctattgatacgattatttctaaggggaaaattcctattattgttggaggtactggcctatatttacagagtttgtttgagggctatcatttaggaggcgaagtcaatcaagaaactcttatggcctatcgtgaaaaattagagtctctaagtgatgaagatttatttgaaaagttgacagaacaatccattattataccacaagttaatcgtcgacgtgccattcgtgcattagaattggcgaagtttgggaatgatttgcaaaatagtgaaagtccgtatgatgttttattaattggattgaatgatgatcgtcaggtgctttatgatcgtatcaatagacgagttgatttgatgatggacaatggtctcttagatgaagctaaatggctatacgataactacccgagtgttcaagcaagtaaaggaattggctataaagaattatttccttacttttcaaagcaaataccattagaagaagctgttgataaactaaaacaaaataccagacgttttgcaaaacgccaattaacatggtttagaaaccgtatgaatgtcgaatttattatggttggtgaggaaaattatcaacaaaaaatcaagcgaaaagtcagtgattttttatcatcaaag

SEQ ID NO: 2610 - protein, 300 aa, Streptococcus agalactiae
MRSIMRKIKLIAVVGPTAVGKTALGIELAKTFNGEIISGDSQQVYQKLDIGTAKASKEEQEQAYHHLIDVREVNENYSVYDFVKEAKVAIDTIISKGKIPIIVGGTGLYLQSLFEGYHLGGEVNQETLMAYREKLESLSDEDLFEKLTEQSIIIPQVNRRRAIRALELAKFGNDLQNSESPYDVLLIGLNDDRQVLYDRINRRVDLMMDNGLLDEAKWLYDNYPSVQASKGIGYKELFPYFSKQIPLEEAVDKLKQNTRRFAKRQLTWFRNRMNVEFIMVGEENYQQKIKRKVSDFLSSK

SEQ ID NO: 2611 - DNA, 897 bp, Streptococcus pyogenes
atgacaaaaataaaaatagttgtgattgttggtccgacagcggttggaaaaacagcacttgggattagtttagccaaggcttttaatggagaaattatttcaggagatagccagcaagtttatcgacagttggatattggaacagccaaggccactcaagaagagcaagaagcagcggttcatcacttaattgatattcgtgaggtgacggagtcttattcggcctacgattttgttcaagatgctcaaaaatctatttcagatattgttagtcgtgggaaattaccaattattgtaggtggaactggtctttacttacaaagtttactcgaaggttatcatctaggaggtcaagttgatcaagaggcggtaaaagcctatcggaatgagttggagcaattggacgatcacgacttgtatgaacgcttgcaagtcaataacattaccattgagcaggtgaatcgcagacgggcgatccgagcccttgaattggctcagtttgctgatgaattagagaatgccgagacggcttatgagccgcttattatcggcttgaatgatgaccgccaagtcatctatgaccgtatcaatcagcgcgtgaatcgtatgattgaaaacggcttattggaagaagcaaaatggttatatgagcattacccgactgttcaggctagtcgtggcataggttataaggaattattcccctattttgtaggtgaaatgactttggcagaagctagtgatcaattaaaacaaaacacgagacgttttgccaagcgacagctaacttggttccgcaatcgaatggctgttagcttcactgccataacggctcctgattacccacaggtagtacatgatagggtcagggattttcttggtcagaaagagaagtca

SEQ ID NO: 2612 - protein, 299 aa, Streptococcus pyogenes
MTKIKIVVIVGPTAVGKTALGISLAKAFNGEIISGDSQQVYRQLDIGTAKATQEEQEAAVHHLIDIREVTESYSAYDFVQDAQKSISDIVSRGKLPIIVGGTGLYLQSLLEGYHLGGQVDQEAVKAYRNELEQLDDHDLYERLQVNNITIEQVNRRRAIRALELAQFADELENAETAYEPLIIGLNDDRQVIYDRINQRVNRMIENGLLEEAKWLYEHYPTVQASRGIGYKELFPYFVGEMTLAEASDQLKQNTRRFAKRQLTWFRNRMAVSFTAITAPDYPQVVHDRVRDFLGQKEKS

SEQ ID NO: 2613 - DNA, 1236 bp, Streptococcus agalactiae
gtgatagaaactaaagaagagcaagaacgtgttattttagttggggtagaacttcaagatactgagaattttgaaatgtccatggaagaacttgctagcttagctaagacagcaggagcaaatgttgttaatcattattatcaaaaaagagataaatatgatagtaaatcatttatcggatctggtaaattagaggagataaaagctattgtagaagcagatgagattgataccgttgtggttaataatcgtttgactccgcgacaaaactctaatttggaagctgaacttggtgttaaagttattgaccgtatgcaacttattttagatatctttgctatgcgtgctagaagtcatgaaggaaaattacaggttcatctagcgcaattgaaatatatgttaccacgcttagttggacaaggtattatgcttagtcgtcaagcaggaggaatcggaagccgaggtccaggagaatctcagttagagttgaatcgtcgttccattcgtcatcaaatttctgatatcgaaagacaattgaagattgtagaaaaaaatcgcgagacagttcgagaaagacgtgttgattcgacaacctttaaaattggattaattggatatacaaatgctggcaagtcaactattatgaatgttttaaccgatgataagcaatatgaagccaatgaattatttgcaacgttagacgctacaaccaagcagatctatttacaaaatcaatttcaagtcactttaacagatactgttggttttattcaagatttacctacagagttagttgcggctttcaagtctaccttagaagaaagtcgacatgtcgatttattatttcatgttattgatgctagtgaccctaatcatgaagaacacgaaaaagttgttatggagattcttaaagacttagatatgatagatattcctcgtttagcgatatacaacaagatggatgtcactgagcagctgaatgcaacaacttttccaaatgtgagaattgcagccaaaaaacaagggagtaaggatttattacgccgtcttattgtggatgaaatacgacatatctttgacgaattttcgattagagtgcatcaaaatcaagcatataagctctatgatctcaataaaatagcattgcttgatacctacacctttgaagaagaatacgagaatattacaggctatatttctcctaaacaaaaatggaagctggaagaattttatgat

SEQ ID NO: 2614 - protein, 412 aa, Streptococcus agalactiae
MIETKEEQERVILVGVELQDTENFEMSMEELASLAKTAGANVVNHYYQKRDKYDSKSFIGSGKLEEIKAIVEADEIDTVVVNNRLTPRQNSNLEAELGVKVIDRMQLILDIFAMRARSHEGKLQVHLAQLKYMLPRLVGQGIMLSRQAGGIGSRGPGESQLELNRRSIRHQISDIERQLKIVEKNRETVRERRVDSTTFKIGLIGYTNAGKSTIMNVLTDDKQYEANELFATLDATTKQIYLQNQFQVTLTDTVGFIQDLPTELVAAFKSTLEESRHVDLLFHVIDASDPNHEEHEKVVMEILKDLDMIDIPRLAIYNKMDVTEQLNATTFPNVRIAAKKQGSKDLLRRLIVDEIRHIFDEFSIRVHQNQAYKLYDLNKIALLDTYTFEEEYENITGYISPKQKWKLEEFYD

SEQ ID NO: 2615 - DNA, 1248 bp, Streptococcus pyogenes
ttggtaaaggtgatgattgagacaaagcgtcagcaagaaagagtgattcttttaggagttgagcttcagacaacagaacattttgacatgtccatgacagaattagctaatcttgccaaaacagctggtgtcaaagttatggcaagtttcagccaaaaacgagaacgttacgacagcaaaacctttatcggctcagggaaactggatgagattaaggcgattgtggaagctgatgagattgatgcagttattgtgaacaatcggttgactgctaggcaaaatgctaatctagaagctgttttagaggtaaaagtcattgaccgtatgcagttaatcttagatatttttgccatgcgtgccagaagccatgagggcaaattacaagtacaccttgcccaattgaaatatatgttacctcgtttggttggacagggcatcatgttaagtcgtcaagcaggtggtattgggagccgtggaccaggtgaaagccaactagagttaaatcgccgttcgattcgtcatcagattgctgatattgaacgccaattaactcaggtagagaaaaatcgtcaaacaattagagatcgtcgtgtgggttcagatacctttaaaattggcttgattggctacaccaatgctggcaagtcaaccattatgaacttgttgacagatgacagccactatgaagccaatgaattatttgctaccttagatgcaactacaaagcaactctatttagaaaatcaatttcaagcaaccttaacagacaccgtaggctttattcaagacttgccaacggaattagtggctgcttttaaatcaaccctagaagaaagcaaatatgtggatttgctgttacatgtgattgatgcgagtgatcccaatcatagtgagcaagaaaaagtggttttaaaccttctaaaagagctagacatgcttaatattccgcgtttagctatttataacaaggtggatatagcagaacaattcacagctactgcttttccaaatatcaggatttcagcccgttcaaaggatagcaaaattctcttgagacgtttaatcattgaccaaattcgagaccagtttgttccttttagaatcaaagtgcatcaagacaaggcgtacaagctatatgatttgaatcgagttgctcttttagaccactacacgtttgaccaagaaatagaggatatttcgggctacatttccccaaaacagcaatggagacttgacgatttttatgaa

SEQ ID NO: 2616 - protein, 416 aa, Streptococcus pyogenes
LVKVMIETKRQQERVILLGVELQTTEHFDMSMTELANLAKTAGVKVMASFSQKRERYDSKTFIGSGKLDEIKAIVEADEIDAVIVNNRLTARQNANLEAVLEVKVIDRMQLILDIFAMRARSHEGKLQVHLAQLKYMLPRLVGQGIMLSRQAGGIGSRGPGESQLELNRRSIRHQIADIERQLTQVEKNRQTIRDRRVGSDTFKIGLIGYTNAGKSTIMNLLTDDSHYEANELFATLDATTKQLYLENQFQATLTDTVGFIQDLPTELVAAFKSTLEESKYVDLLLHVIDASDPNHSEQEKVVLNLLKELDMLNIPRLAIYNKVDIAEQFTATAFPNIRISARSKDSKILLRRLIIDQIRDQFVPFRIKVHQDKAYKLYDLNRVALLDHYTFDQEIEDISGYISPKQQWRLDDFYE

SEQ ID NO: 2617 - DNA, 645 bp, Streptococcus agalactiae
atgattgattatattgatttagctttgacttatggtggttttacgagcttagataaagtttatctagagaaaaaactagatggcctctctaagcagcaacgacttgattttatcaccccacctcctagtgtgattaatgcttattttgctgaaatatatcaaaagcaagggccagaagctgcaactgattactattttgatctttccaaagccttgggcttgtttccaaaacatttatcgtttgatgaagaaaaaccttttattcgtttgaatttatcaggaaaatcatttggttttgcttacctaaatgatcaagaagaagcgagtgttttttctgaagttaaagaagtcattacaccgcagttactcttagaaattgcacagatttttcctcaatataaagtctatcgagatcggtctggtatcagaatggcaaaaatagattttgacgaaacagaatctcaaaatattacaccagaaacaagtttactagggaatgtcttacaacttaaaaaagatattattaaaataactagtttcaatcaagaagagctattagagttggttaaaacaaagtcaggtaaatactattattctagtcaaggacgtgagtcagttatttatattgatactaaatctactaat

SEQ ID NO: 2618 - protein, 215 aa, Streptococcus agalactiae
MIDYIDLALTYGGFTSLDKVYLEKKLDGLSKQQRLDFITPPPSVINAYFAEIYQKQGPEAATDYYFDLSKALGLFPKHLSFDEEKPFIRLNLSGKSFGFAYLNDQEEASVFSEVKEVITPQLLLEIAQIFPQYKVYRDRSGIRMAKIDFDETESQNITPETSLLGNVLQLKKDIIKITSFNQEELLELVKTKSGKYYYSSQGRESVIYIDTKSTN

SEQ ID NO: 2619 - DNA, 645 bp, Streptococcus pyogenes
ttgacgatttttatgaataattatattgatttagcaaaaacctatggtggatttactagtctggataccaactacctaaaccatctgttagccagtttgacagaccagcaaaaactagcttttatcacaccaccaccaagtgttattaatgcctactttgctgaaatctaccagaaacagtcaccgcaagctgcaactgattattattttaatctttctaaggctttggggctttttactgaccaaccatcttttgaggaagaaaagccctttgtacgcctcaatttgtctggaaaagcttatggttttgcttaccaaaatgaccaagaagttgcattggtattttctgaaaaagcagagcctaagaaacccgaactcttctttgaattaacacaaattttcccacaatatatggtttatgaggacaaaggccagcttaaaatgcaggctaagcagtttgagcaaggagaatgtgaagacattacacctgatgacacactcttgtcgaagatttaccgtctggcaaacggtatcaccatgcttaaggggtttaatgtagaggagttatgggctcttagccaaacattttctggtcaaaagtattatgattttgcccaacgagaatttatgatttacatcacccaa

SEQ ID NO: 2620 - protein, 215 aa, Streptococcus pyogenes
LTIFMNNYIDLAKTYGGFTSLDTNYLNHLLASLTDQQKLAFITPPPSVINAYFAEIYQKQSPQAATDYYFNLSKALGLFTDQPSFEEEKPFVRLNLSGKAYGFAYQNDQEVALVFSEKAEPKKPELFFELTQIFPQYMVYEDKGQLKMQAKQFEQGECEDITPDDTLLSKIYRLANGITMLKGFNVEELWALSQTFSGQKYYDFAQREFMIYITQ

SEQ ID NO: 2621 - DNA, 927 bp, Streptococcus agalactiae
atggaaattcaatttttaggaactggagctggtcaaccagcgaaagctcgtaatgtttcaagtttagtcttgaaattattagatgaaattaacgaggtttggatgtttgattgtggagagggtacacagcgtcaaattttagaaactacgattaaacctcgtaaagttaaaaaaatttttatcacgcacatgcacggagaccatgtttttggtcttccaggttttttatccagtcgggcttttcaagccaatgaagagcagacagatttagatatttatggaccggttggtataaaaagttttgttatgactgccttaaggacatcaggttcacgtttaccttatcgaatccattttcacgagtttgatgaatcatcactcggaaaaattatggaaacagataaatttaccgtttatgcagaaaagctagatcatactatcttttgtatgggatatcgtgttgtgcaaaaagatcttgagggcactttagatgctgaagcattgaaactagcaggtgttccatttggtcctctttttgggaaagtcaaaaatggtgagaatgttaccttagaagatggtagagaaattattgctaaagattatatttctgaaccgaaaaagggtaaagtaatcactattttgggagatactagaaaaacagatgcaagtattaggttagctttgggcgctgatgttttagttcacgaatctacttatggtaagggtgatgagcgaattgctaaatcgcatgggcattcaaccaatatgcaagcagctgatatcgctaaacaagcaaatgctaaacgactattattaaatcatgttagtgctcgttttatggggcgagattgttggcaaatggaagaagatgcaaagacgattttttcaaatacccatcttgttagagatttggaagaagtaggtata

SEQ ID NO: 2622 - protein, 309 aa, Streptococcus agalactiae
MEIQFLGTGAGQPAKARNVSSLVLKLLDEINEVWMFDCGEGTQRQILETTIKPRKVKKIFITHMHGDHVFGLPGFLSSRAFQANEEQTDLDIYGPVGIKSFVMTALRTSGSRLPYRIHFHEFDESSLGKIMETDKFTVYAEKLDHTIFCMGYRVVQKDLEGTLDAEALKLAGVPFGPLFGKVKNGENVTLEDGREIIAKDYISEPKKGKVITILGDTRKTDASIRLALGADVLVHESTYGKGDERIAKSHGHSTNMQAADIAKQANAKRLLLNHVSARFMGRDCWQMEEDAKTIFSNTHLVRDLEEVGI

SEQ ID NO: 2623 - DNA, 927 bp, Streptococcus pyogenes
atggaattacaatttttaggaactggagctggtcaaccagccaagcagcgcaatgtgtcaagtcttgccttgaaattactagacgaaatcaatgaagtctggatgtttgattgcggtgaaggaacgcaaagacaaattttagaaacgacgattaagccacgaaaaataagaaagattttcattactcatttgcatggagaccacatttttggattaccaggatttttatcaagtcggtcttttcaagctagtgaagaacagacagatcttgatatttatggaccaattggcattaaaacttacgtgttaactagtctaaaagtttctggagcgcgtgtaccttatcagattcattttcatgaatttgatgacaaatcattaggtaaaataatggaaacagataagtttgaggtctatgcagagcgtctggcgcataccattttttgcatgggttatcgagtagttcaaaaagacttagaaggaaccctagacgcagaagccttaaaagcagcgggtgttccttttggaccactctttggcaaaattaaaaatggtcaagacgttgagttggaagacggccgcctgatttgtgccaaagattatatttctgcccctaaaaaaggcaaaatcatcaccattatcggcgatacgcgcaaaacgtctgccagtgttaaactcgctaaagatgcagatgttttggttcatgaatccacctatggtaagggtgacgagcggattgcgagaaatcacgggcattctaccaacatgcaggcagcacaaatcgctcatgaagcaggcgcaaaacgcctcttgctcaatcatgtatcagctcgctttttagggcgtgattgtcgccagatggaaaaagatgccgccactatatttgaaaatgttaaaatggtacaagatttagaggaagtgattatt

SEQ ID NO: 2624 - protein, 309 aa, Streptococcus pyogenes
MELQFLGTGAGQPAKQRNVSSLALKLLDEINEVWMFDCGEGTQRQILETTIKPRKIRKIFITHLHGDHIFGLPGFLSSRSFQASEEQTDLDIYGPIGIKTYVLTSLKVSGARVPYQIHFHEFDDKSLGKIMETDKFEVYAERLAHTIFCMGYRVVQKDLEGTLDAEALKAAGVPFGPLFGKIKNGQDVELEDGRLICAKDYISAPKKGKIITIIGDTRKTSASVKLAKDADVLVHESTYGKGDERIARNHGHSTNMQAAQIAHEAGAKRLLLNHVSARFLGRDCRQMEKDAATIFENVKMVQDLEEVII

SEQ ID NO: 2625 - DNA, 759 bp, Streptococcus agalactiae
atggcaagaacgatactgattacaggagcttctggtggtttagcacaggcaattattaaccaattaccccaagacgaccatttaattgtcacagggagatcaagagaaaaacttgaaaagctttatggaaagagaccaaacaccttatgtttatcactagatataactaatgacaatgctgtaacgaatatgattgaaaaaatttatggtgaatttggtcaaattgatattttaattaataatgctggatttggttcttttaaagaattttgggattatagtgatgaagaagtcaaagacatgtttgctgtgaatacatttgcaacgatgtctatagctcgtcagataggacataagatgtctcttgtaaaatctggtcatatcgttaatattgcaagcatggctggcctcatagcaacaagtaaagctagcgtttatggggctagtaagtttgctgtcgttggattttcgaatgctcttcgtttagaattagcagaaaaaaatgtttatgtgacaagtgtaaaccctggaccaatcaaaacaggattttttgctcaggctgatccaagtggtgattatttagcaagtataggtcgttttgctctaacaccagaaaaagtatctaaaaaagtagtttctattcttggaaaaaataagagagaattaaatcttccttttatattagcttttgcgcataaatattatagtttatttccaaaaacagctgattattttgccagaaaggtattcaattataaa

SEQ ID NO: 2626 - protein, 253 aa, Streptococcus agalactiae
MARTILITGASGGLAQAIINQLPQDDHLIVTGRSREKLEKLYGKRPNTLCLSLDITNDNAVTNMIEKIYGEFGQIDILINNAGFGSFKEFWDYSDEEVKDMFAVNTFATMSIARQIGHKMSLVKSGHIVNIASMAGLIATSKASVYGASKFAVVGFSNALRLELAEKNVYVTSVNPGPIKTGFFAQADPSGDYLASIGRFALTPEKVSKKVVSILGKNKRELNLPFILAFAHKYYSLFPKTADYFARKVFNYK

SEQ ID NO: 2627 - DNA, 762 bp, Streptococcus pyogenes
atggcacaaagaatcattgttatcacgggagcttctggaggactggctcaggcaattgttaagcagttacccaaggaagacagcttgattttattaggacgtaacaaagaacgcctagaacactgttatcagcatattgacaacaaagaatgcctcgagttggatattaccaatccagtagccattgagaaaatggtcgcccagatttaccagcgctatggccgtattgatgtcttgattaataatgctggctacggagctttcaaaggctttgaagagttttctgcccaagaaatagctgatatgtttcaggttaacaccctagcgagcattcactttgcttgcttgattggtcagaaaatggcagagcaggggcaaggtcaccttattaatattgtgtccatggcaggcttgattgcgtcagccaaatcgagcatttattcagccaccaagtttgcccttatcggattttccaatgcccttcgcttagaattagcggataaaggggtttacgtgaccaccgtgaatccaggtcccattgccaccaagttttttgaccaagctgacccgtctggacattatttggaaagcgttggtaaatttactctccaaccaaatcaagtggctaagcgtttggtttctattatcgggaaaaataaacgagaattgaatttgccctttagtttagcggtgacccatcaattttacacccttttccctaaattatctgattatcttgcaagaaaggtatttaattataaa

SEQ ID NO: 2628 - protein, 254 aa, Streptococcus pyogenes
MAQRIIVITGASGGLAQAIVKQLPKEDSLILLGRNKERLEHCYQHIDNKECLELDITNPVAIEKMVAQIYQRYGRIDVLINNAGYGAFKGFEEFSAQEIADMFQVNTLASIHFACLIGQKMAEQGQGHLINIVSMAGLIASAKSSIYSATKFALIGFSNALRLELADKGVYVTTVNPGPIATKFFDQADPSGHYLESVGKFTLQPNQVAKRLVSIIGKNKRELNLPFSLAVTHQFYTLFPKLSDYLARKVFNYK

SEQ ID NO: 2629 - DNA, 2196 bp, Streptococcus agalactiae
atgatatctgctaagtatagttgggtcctcaataaccaaaagccagacgctggcttttttgaggcttcaaaaaaagaaaagataagtgaagcggtggcttccttaatttattcgcgaggtattaagacatcagcggaattacatcattttttacaaactaatttggaaaatctccatgatccttatttgttaaatgatatggataaagctgttaatcgtattagacgagctattgaaaataatgaaactattttagtttatggagactatgatgctgatggaatgacatcagcatcaatcatgaaagaagcattagatatgatgggagctgaagtccaggtttatctcccaaatcgctttacagatggttacggtcccaatcaaagtgtttataaatattttattgaacaacaagatgtttcattaatcattacggttgataatggtgtggcagggcatgaagcaattacatatgctcaaaatcaaggtgtggacgtggtagttactgatcatcacagtatgccagcagatttaccttgtgcttatgctattattcacccagaacatcctgatgctaattatccatttccttatttagcagggtgtggtgttgctttcaaagtagcttgtgctctcttagaaacaatcccgacagaaatgttggatttggttgctattgggacgattgcagatatggttagcctaactgatgaaaatcgtatcatggtaaaagctggacttgaagttatgaaagatagtgaaagaataggcttacaggagctaatatctttatcaaatattgatttaaaaacactaaatgaagaaactattggatttaaaattgctccacaattaaacgctttaggaagacttgatgaccctaatccagctattgaattactaacagggtttgatgatgaagaatctcaagcaatagcccaaatgattgatcaaaaaaatgaagagcgcaaagaaatcgttcaaactatctttgaccaagctatgcaaatgcttgatcaaacaaagcctgtacaagttttagcaaaagaaaattggcatccaggggttttaggtattgtggcgggtcgtattttagagagaactggacaacctgttattgttttgaatattgaagatggtattgctaaaggaagtgccagaagtgtagaagcacttgatatttttcaagcttttgaccagcatcgagaattattcattgcttttggaggtcacagcggagcagcaggcatgactttagaggaaagtaaagtaggtgatctttctcaagttttatgtgactatatctctaaaaaacaattggacatgagtcagaaaaaaactctgacaattgatagtgagctacgttttgacgaacttagtttagacactgttagagattttgaaaagttagcgccatttggaatggataataaaaaaccagtctttttgttaaaagattttaaagtgagtcaagccagagtcatggggcaaaacggtgctcatctgaaattaaaactagaacaagatggacaagcacttgatttggtagcatttaatatggggagtcaactacaagagttccaacaagcacaacatttggagttagctgtcactttatctgttaatcaatggaatggtgccacaaccctacaattaatgttggaggatgcgcgtgtagacggtattcaattatttgatattagaagcaaagcaagtagtttacctcatggagtgccaatcctgtctcaagaagagcagagcaaagaagttattcttttgactgttcccgatcatccacaagaattaaaacaaatgactcaaggtaaacagtttgatgccatctattttaaaaatgagataccaaaaaattattttatatctggttatggtacacgtgatcagtttgctagtttatataaaacaatatatcaattcccagaatttgacgttcgttataagttaaaagagctcagttcctaccttcatatccctgatattttattaattaaaatgattcaaatttttgaagaactacattttgttacgattacagaagggattatgacagtcaataaagaagcagaaaagcgagatatctctgagagtcaaatttatcaagaattaaaagagacagttaagtttcaagaattaatggctttagggacacctaaagaaatatatgattttatgatgagt

SEQ ID NO: 2630 - protein, 732 aa, Streptococcus agalactiae
MISAKYSWVLNNQKPDAGFFEASKKEKISEAVASLIYSRGIKTSAELHHFLQTNLENLHDPYLLNDMDKAVNRIRRAIENNETILVYGDYDADGMTSASIMKEALDMMGAEVQVYLPNRFTDGYGPNQSVYKYFIEQQDVSLIITVDNGVAGHEAITYAQNQGVDVVVTDHHSMPADLPCAYAIIHPEHPDANYPFPYLAGCGVAFKVACALLETIPTEMLDLVAIGTIADMVSLTDENRIMVKAGLEVMKDSERIGLQELISLSNIDLKTLNEETIGFKIAPQLNALGRLDDPNPAIELLTGFDDEESQAIAQMIDQKNEERKEIVQTIFDQAMQMLDQTKPVQVLAKENWHPGVLGIVAGRILERTGQPVIVLNIEDGIAKGSARSVEALDIFQAFDQHRELFIAFGGHSGAAGMTLEESKVGDLSQVLCDYISKKQLDMSQKKTLTIDSELRFDELSLDTVRDFEKLAPFGMDNKKPVFLLKDFKVSQARVMGQNGAHLKLKLEQDGQALDLVAFNMGSQLQEFQQAQHLELAVTLSVNQWNGATTLQLMLEDARVDGIQLFDIRSKASSLPHGVPILSQEEQSKEVILLTVPDHPQELKQMTQGKQFDAIYFKNEIPKNYFISGYGTRDQFASLYKTIYQFPEFDVRYKLKELSSYLHIPDILLIKMIQIFEELHFVTITEGIMTVNKEAEKRDISESQIYQELKETVKFQELMALGTPKEIYDFMMS

SEQ ID NO: 2631 - DNA, 2208 bp, Streptococcus pyogenes
atgattaaatccaaatatagctggaaaataaaagacaagaagccagatgatggcttctttaagctagcaaagacaaaaggtctaacccagaccgccgctcagttgatttatgatcgagggataaggactgaagaagccttagatgagtttttaacagcggacttgtctcaactgcatgatccttacttgctacatgacatggcaaaagctgtgccaagaattcgtcaagctattgaagagggcgaacgaattctcatttacggcgactatgatgctgatggcatgacgtcggcttctattgtcaaagaaaccctagacatgatgggagcagagcctttggtttatcttcccaaccgctttacagatggctatggccccaaccagagcgtctataaatattttattgagcaggaagctgtgtccctaattatcacggttgataatggcgtggccggacatgaagcgattagatatgctcaagaacaggaagttgatgttattgtaactgaccatcatagcctgcctgaagaattgccagaagcctttgccatcattcatcctgagcatcctgatgctgattatccctttaaacacttagctggctgtggcgttgcctttaaattggcaacagctttgctagaaagtttaccaacagactgtctagacttggtagctattggaaccattgccgatatggtaagcttgacaggtgaaaaccgtgttttagtcaaaaatggtctggccatgctcaaacacaccgaaagagtgggcttgcaggagttgatgtccttgtctcctattgatttggaacattttaatgaagacgccattggctttcagattgctccgcaattaaatgctttagggcgcttagatgaccctaatccagccattgagctactgacgggctttgatgaccaagaagctcaagcgattgccttgatgattaagaaaaaaaatgaagagcgtaaggccttagtccaagacatttttgatcaagcgatggctatggttgatcctcaaaaacctgttcaagtcttggcacaagctggctggcatcctggtgttcttgggattgtcgctggtcgtatcatggaaactattggacaaacggtcgtcgttttgaccattgataatggctttgcaaaaggctcggccagaagtttagaagctattaatatttttgaagccttaaatggcaagcgtgagttatttacagcctttgggggacatgctggtgcagcaggaatgaccctgcccgttgacaacttggaagctctttcagactttctttgtcagtttgtgatagaacgtggcttagatcagactgccaaaaatacgttaactattgatgaaagactgtctttggacgaccttagccttgatattttaaagagtttagataaattagccccttatgggatggatcatcaaaagccggtcttttatgtcaaggacataagggttagtcaagcgcgtaccatagggcaagaccagagccatcttaaatttaaagtcagtcagggcaaagcttcctttgacgtactggcttttggtcaaggaagtcaactgcaagagttccgacaagctactggtttagaattagcagttaccttatctgtcaaccattggaatgggaacacgagtctccaattcatgttagtagatgctcgtgttgacggagtgcaacttcttgacttaaggacaaaaacagccaaagttcctgaaggtattccgactattgaagaagacccaaatgccagagtcattctgattaatgacatccctgaagatttcaaaacctggcgcaaccagtttgttcacaaggattttgacgccatctattttaaaaatcagatgaaacatccttattatttaacaggatttggcagcagagagcagtttgccaagctctacaaaaccatctatcagtttcctgaatttgatttacgacataaattgacagagttgagtcactatttaaacatagaaaaacttttactgattaagttgattcaaatttttgaagagttgtcttttgtgacgattgacgatgggctgatgacggttaacccccaagcgcaaaaacgagagatttcagagagccacatttaccaagacttaaaagaattggtgaaatttcaagaaatcatggctttggctagcccgaaagagatgtatgattatttggtgaaatcaaacgatcaa

SEQ ID NO: 2632 - protein, 736 aa, Streptococcus pyogenes
MIKSKYSWKIKDKKPDDGFFKLAKTKGLTQTAAQLIYDRGIRTEEALDEFLTADLSQLHDPYLLHDMAKAVPRIRQAIEEGERILIYGDYDADGMTSASIVKETLDMMGAEPLVYLPNRFTDGYGPNQSVYKYFIEQEAVSLIITVDNGVAGHEAIRYAQEQEVDVIVTDHHSLPEELPEAFAIIHPEHPDADYPFKHLAGCGVAFKLATALLESLPTDCLDLVAIGTIADMVSLTGENRVLVKNGLAMLKHTERVGLQELMSLSPIDLEHFNEDAIGFQIAPQLNALGRLDDPNPAIELLTGFDDQEAQAIALMIKKKNEERKALVQDIFDQAMAMVDPQKPVQVLAQAGWHPGVLGIVAGRIMETIGQTVVVLTIDNGFAKGSARSLEAINIFEALNGKRELFTAFGGHAGAAGMTLPVDNLEALSDFLCQFVIERGLDQTAKNTLTIDERLSLDDLSLDILKSLDKLAPYGMDHQKPVFYVKDIRVSQARTIGQDQSHLKFKVSQGKASFDVLAFGQGSQLQEFRQATGLELAVTLSVNHWNGNTSLQFMLVDARVDGVQLLDLRTKTAKVPEGIPTIEEDPNARVILINDIPEDFKTWRNQFVHKDFDAIYFKNQMKHPYYLTGFGSREQFAKLYKTIYQFPEFDLRHKLTELSHYLNIEKLLLIKLIQIFEELSFVTIDDGLMTVNPQAQKREISESHIYQDLKELVKFQEIMALASPKEMYDYLVKSNDQ

SEQ ID NO: 2633 - DNA, 96 bp, Streptococcus agalactiae
ttgcaaatattattaaaatataataaaattaagaaaataatggaatttttgataaagaatattaaaggcgaggataaaatctatgagacctatcgt

SEQ ID NO: 2634 - protein, 32 aa, Streptococcus agalactiae
MQILLKYNKIKKIMEFLIKNIKGEDKIYETYR

SEQ ID NO: 2635 - DNA, 2562 bp, Streptococcus agalactiae
atgagacctatcgttagaaaaaagatgtacaaaaaaggcaaattttgggtcgttgcaggtatcgttaccattttaggtggtagtgcaattcttggtcaagatgtcaaggcagaacaggcagaagcagtaacttcaacgatctcagagaaaactgatagcagtcagactatttcggatacttccaagttaacgttacctgttaattcctcggaggctatgaaaaatagtgcagagcctttaataaaaacagcctttgctacatctgtttcatctaatcctagagagatagcagctaccccagtcaaaacctttgatgctagctcaaaagttgttgtaaaagctagtactgctgagcactcagcaaatcaaacaaattctaatgttaatcaagtagctaatgatagtgaagttattactcaacaaaattcaacaaagcaattaccaacagtgacttactctgctcatgttcaagatattggatggcaaaagtcggttgataatgcaacagtttcaggaacagtaggacaagaaaagcaggttgaggcaataaaattgtctattaaagcacctgaaggaataacaggaaaacttagctataaaacttatgttaaaggacaaggttggcaaccttcagtagagagtggtcaagttagtggtactgttggtcagagtagacctattgaagcactaagcattaaccttactgataatttacaaaaattatatgatgtctattatcgtgttcatgttcaagatatcgggtggatggcttgggctaaaaatggagcttacgctgggactttgggaatgtcaaagcgccttgaagcttacgaagtaaaatttacccttaaaggacaatctgttttaacaccaactatacctaaggaagagagacctgtcttaaattatcaggttaaggtaggccaaaatggttggcaatctaataaacttgaaggacaaatggcgggaactttaggagaatccaaagccctagatggagtaaaattcactcttagcaccttgaagtatggggacattctctatcgtactcatgtacaagataaaggttggggagaaattttaggtagtcaaacaagtaaggattatcaaggaaaaagactagaagctattcaattggacttaagtgggaatttaaaacaaaattatgatatttattatcgcgctcacgtccaagataaaggttggatggcttggcaaaaaaataatagtgtagcaggtacagtcggagaatcgaaacgtttagaggctttggaggtaaaactagtagctaaagcttcagattttagttcccaaacaaatcattcattcttagaaatgaagcatcctggattaagttatcaaacttatcttcaaaaagatggttggaaaccaacggttttggaaggccaattaggaggtagtattggactttcaaaatctataaaagccatcaaacttaacttaggtagtacagctctaggaaatatagaatatagaacttttcttaatggttcaggttggcaaactgttgttaattcagggagagaaagtaatgtaccaaatgaatctcaacaagtagaagctattcagatgcgattgacaggtctgctatcgaaaacctatagtgtgatgtatcgagttcacatgcaagattatggttggcaggattggacttataacaatgacatcgctggtagtactaaccaaggaaaacgaattgaagcaatcgaaattaaattagttgagactgctaaaataccggtaactgtccaaacgacttataagggaactggaaactataatgtacgagtgacaaatgttattagtcctggggatttaaaaattgctatttggtcagataaaaacaatcaggatgaccttaagtggtataccgtcgcacccaaaaatcatgaagctacattgacatttaatgttacaaatcatagagacaatggtaaatactttatccatgtttatcaggaaaatgcttctaatcaaaaacaattattggtaaaaacttctctacaagtcgcacattcaaattataatactccttactttagccaacgtgatggaaggtgggcaagtcgaagatatggtatggcaactttaggagaaactggttgtgtaccaacttctctagctatgattttgtcttctttgaaaggagaaactgttttaccaacgcaaattgcagattacctttaccataagacagttgaatttaatcgtggtgttcaaggaacaacttctagaggaattttaaaagcagccaaagaatggggtgtaactgcaactgcattaggaactcaagctaaccttgtacaagcgttgaaggatggttatcatgtcctagcggcagtacaaaataatgtttttgttcttcatggaagtcatgaaatcgttctcaaaggatataataacggactgacacatgtctctgacccttacacaccgtccttgtctggttggtatccaatttcacaactttggaaagaacagagctattatagtgaggatagaattgatattggagcaccttttgtcaaggtaacagatgcc

SEQ ID NO: 2636 - protein, 854 aa, Streptococcus agalactiae
MRPIVRKKMYKKGKFWVVAGIVTILGGSAILGQDVKAEQAEAVTSTISEKTDSSQTISDTSKLTLPVNSSEAMKNSAEPLIKTAFATSVSSNPREIAATPVKTFDASSKVVVKASTAEHSANQTNSNVNQVANDSEVITQQNSTKQLPTVTYSAHVQDIGWQKSVDNATVSGTVGQEKQVEAIKLSIKAPEGITGKLSYKTYVKGQGWQPSVESGQVSGTVGQSRPIEALSINLTDNLQKLYDVYYRVHVQDIGWMAWAKNGAYAGTLGMSKRLEAYEVKFTLKGQSVLTPTIPKEERPVLNYQVKVGQNGWQSNKLEGQMAGTLGESKALDGVKFTLSTLKYGDILYRTHVQDKGWGEILGSQTSKDYQGKRLEAIQLDLSGNLKQNYDIYYRAHVQDKGWMAWQKNNSVAGTVGESKRLEALEVKLVAKASDFSSQTNHSFLEMKHPGLSYQTYLQKDGWKPTVLEGQLGGSIGLSKSIKAIKLNLGSTALGNIEYRTFLNGSGWQTVVNSGRESNVPNESQQVEAIQMRLTGLLSKTYSVMYRVHMQDYGWQDWTYNNDIAGSTNQGKRIEAIEIKLVETAKIPVTVQTTYKGTGNYNVRVTNVISPGDLKIAIWSDKNNQDDLKWYTVAPKNHEATLTFNVTNHRDNGKYFIHVYQENASNQKQLLVKTSLQVAHSNYNTPYFSQRDGRWASRRYGMATLGETGCVPTSLAMILSSLKGETVLPTQIADYLYHKTVEFNRGVQGTTSRGILKAAKEWGVTATALGTQANLVQALKDGYHVLAAVQNNVFVLHGSHEIVLKGYNNGLTHVSDPYTPSLSGWYPISQLWKEQSYYSEDRIDIGAPFVKVTDA

SEQ ID NO: 2637 - DNA, 516 bp, Streptococcus agalactiae
atggatttaaataattacatcgcttcaattgaaaactatcctcaagaaggaattactttccgtgatatctccccattaatggctgatggtaaagcatacagctatgctgttcgtgaaattgtacaatatgctgctgataaagatattgatatgattgttggaccagaagctcgtggctttattgttggttgcccagttgcttatgctcttggtattggttttgctccagtccgtaaaccaggtaaattaccacgcgaagttatttcagctgactatgaaaaagaatatggtcttgatacattgacaatgcacgcagatgctattaaaccaggccaacgtgttttaattgttgatgaccttttagctactggtggaacagtaaaagcgacaattgaaatgattgaaaaacttggtggcgttgtcgcaggctgtgctttcctagttgaacttgatggattaaatggtcgtaaagctattgaaggttatgatactaaggtattgatgaactttccagga

SEQ ID NO: 2638 - protein, 172 aa, Streptococcus agalactiae
MDLNNYIASIENYPQEGITFRDISPLMADGKAYSYAVREIVQYAADKDIDMIVGPEARGFIVGCPVAYALGIGFAPVRKPGKLPREVISADYEKEYGLDTLTMHADAIKPGQRVLIVDDLLATGGTVKATIEMIEKLGGVVAGCAFLVELDGLNGRKAIEGYDTKVLMNFPG

SEQ ID NO: 2639 - DNA, 516 bp, Streptococcus pyogenes
atggatttaacaaattacattgcatcgatcaaagattaccctaaagctggtattacgtttcgagatatctcacctttaatggctgacggtaaagcatatagctatgctattcgtgaaatagcacagtacgcttgtgataaagatattgatatggttgttggacctgaagcgcgtggttttatcattggttgtcctgttgcagttgagttaggaattggttttgctcccgttcgtaaaccaggaaaactgccaagagatgttgtctctgccgattacgaaaaagaatatggtcttgatactttaactatgcatgcagatgctattaagcctggacaacgtgttttgattgtcgatgatttactagcgactggcggtacagtaaaagcaactattgaaatgattgaaaaacttggtggtattgtagctggttgtgccttccttattgaattagaaggtttaaatggacgccatgctattaggaactatgactataaagtcttaatgcagtttcctggg

SEQ ID NO: 2640 - protein, 172 aa, Streptococcus pyogenes
MDLTNYIASIKDYPKAGITFRDISPLMADGKAYSYAIREIAQYACDKDIDMVVGPEARGFIIGCPVAVELGIGFAPVRKPGKLPRDVVSADYEKEYGLDTLTMHADAIKPGQRVLIVDDLLATGGTVKATIEMIEKLGGIVAGCAFLIELEGLNGRHAIRNYDYKVLMQFPG

SEQ ID NO: 2641 - DNA, 678 bp, Streptococcus agalactiae
atgacttatttggaacaatatcagtcagggcaattgactctaccaagtgctttattttttcactttaaatctatttttaagacagcagacgattttttagtttggcaatttttctatttacaaaatacaactaatttatccgatctaacaccgagccgtattgcgacatcacttgataaaacagtggcagatatcaatcgttctatatcgaatttaacaagtcaaggtttactagatgtcaaaacaattgagttgaatcatgaaatcgagattatctttgatacaagccctgtgtttgctaaattagataaacttttcgaagaggataatcaagtaataatagacaataaaacctctgattcgaatcgtctgaaagatttagtaggagacttcgaacgtgaattaggtcgcttattaagtccttttgaattagaagatttacaaaagacactgcaagaagatcagacagatcctgatattgttagggcagctcttagagaagcggttttcaatgggaaaacaagttggaattatatcaatgctatccttcgcaactggcggcgtgaaggattgacgacacttcgacaaattgaagagagaaaacaagcacgtgaagataaccaaatgaaagatttagcgatttcggatgattttaaaaatgcaatgaatttatgggaa

SEQ ID NO: 2642 - protein, 226 aa, Streptococcus agalactiae
MTYLEQYQSGQLTLPSALFFHFKSIFKTADDFLVWQFFYLQNTTNLSDLTPSRIATSLDKTVADINRSISNLTSQGLLDVKTIELNHEIEIIFDTSPVFAKLDKLFEEDNQVIIDNKTSDSNRLKDLVGDFERELGRLLSPFELEDLQKTLQEDQTDPDIVRAALREAVFNGKTSWNYINAILRNWRREGLTTLRQIEERKQAREDNQMKDLAISDDFKNAMNLWE

SEQ ID NO: 2643 - DNA, 681 bp, Streptococcus pyogenes
atgagttttttagaacattataagtcaggtaatttggttatcccaagtgccttgctttttcattacaaagatctttttaagagctcagatgattttttggtctggcagtttttctatcttcaaaatacgacaaagcgagacgacttagcacccagtcaaattgctcatgcgcttggaaaatcagttgctgatattaataaaatcatttcatctttgactaatcaagggcttttagatatgcggacaattgaacttactggagaaattgaaattatttttgatgcgagtcctgtgttagccaagttagatcaattgtttgtcagtcaaacggcaactgaaattgacaaacaagaaacaccaaatcatttcaaacgattagttgatgaatttgaacgtgaactaggacgattcttgagtccttttgagttagaagatcttgaaaaaacgcttcgtgatgataaaacagatcctgatttgatacgagaagctttaaaagaagctgtcttcaacggcaaaacaaattggaaatatatccaggctatcttacgtaattggcgaaaagaaggtattgttaatcttcgacaagtagaagaacgtagacgtgttagagaaggcgaagatctttctcaagtgacgatatcagaggattttctatctgcgatgaatttatggagtgattca

SEQ ID NO: 2644 - protein, 227 aa, Streptococcus pyogenes
MSFLEHYKSGNLVIPSALLFHYKDLFKSSDDFLVWQFFYLQNTTKRDDLAPSQIAHALGKSVADINKIISSLTNQGLLDMRTIELTGEIEIIFDASPVLAKLDQLFVSQTATEIDKQETPNHFKRLVDEFERELGRFLSPFELEDLEKTLRDDKTDPDLIREALKEAVFNGKTNWKYIQAILRNWRKEGIVNLRQVEERRRVREGEDLSQVTISEDFLSAMNLWSDS

SEQ ID NO: 2645 - DNA, 681 bp, Streptococcus agalactiae
atggatttacaattatcaaaacgattacaaaaagttgcaaactacgttccaaaaggagctcggttattagatgtaggaagtgatcatgcttacttacctatttttttgttgcagatgggatactgtgattttgccattgctggtgaagtggtgaatggaccgtatcagtctgcgttgaaaaacgtttcagaacatggtctcacttcaaagatagatgttcgcttagcaaatggtttgtcagcttttgaagaagcagataatattgatacgataactatctgtggaatgggtggtcgtttgattgctgatattttgaataacgatatagacaaacttcagcacgttaaaacactagtcttacaacctaataatcgggaagatgatttaagaaaatggttagctgcaaatgattttgaaatagtagcagaagatatcttgactgaaaatgacaaacgctatgaaattttagttgttaagcatggtcatatgaatttaactgctaaagaattgcgatttggtccatttttattatccaataacacaacggtttttaaagaaaaatggcaaaatgagcttaataaattaacttttgctttaaactctattcccaatagtaaaatggaagaacgcgctattttggaagataaaatacaggatataaaggaggttcttgatgaaagc

SEQ ID NO: 2646 - protein, 227 aa, Streptococcus agalactiae
MDLQLSKRLQKVANYVPKGARLLDVGSDHAYLPIFLLQMGYCDFAIAGEVVNGPYQSALKNVSEHGLTSKIDVRLANGLSAFEEADNIDTITICGMGGRLIADILNNDIDKLQHVKTLVLQPNNREDDLRKWLAANDFEIVAEDILTENDKRYEILVVKHGHMNLTAKELRFGPFLLSNNTTVFKEKWQNELNKLTFALNSIPNSKMEERAILEDKIQDIKEVLDES

SEQ ID NO: 2647 - DNA, 684 bp, Streptococcus pyogenes
atggatagtcaattatcaaaccgtttggcccaagttgcggcctatgttccaaaaggtgtcaaattattagatgttggcagtgatcatgcctaccttcccatatttttggtagaaactaatcagatttcagcagccattgctggcgaagtggttaggggtccctacgaatctgctcttaaaaatgtcacacagtctggccttgccgagcatattcaggtgcgcttagccaatggccttgcagcctttgaagaagctgatgatgtgacagccattaccatttgtggcatgggtggccgtttgattgctgatattttagaggcaggtaaggaaaaattgcagggcattgaacgtctggttttacaacccaacaatcgtgaggatgatttacgggcttggttatcggttaacgcttttaaaattgttgcagaaaccatcatggctgaaaatgacaaatattatgaaatcatcgttgctgagcatggtgaaaaggccttatccgcgacagaattgcgttttggtccatacctttctcaggaaaaatcagtcgtttttaaagagaagtggcaacgagaaatggataagttagcttatgccttgtcctgcatcccagaagaaaaaactcaagagcgtcagcttctcttgacaaaaatacaacaaataaaagaggtgattgttcatgaaagc

SEQ ID NO: 2648 - protein, 228 aa, Streptococcus pyogenes
MDSQLSNRLAQVAAYVPKGVKLLDVGSDHAYLPIFLVETNQISAAIAGEVVRGPYESALKNVTQSGLAEHIQVRLANGLAAFEEADDVTAITICGMGGRLIADILEAGKEKLQGIERLVLQPNNREDDLRAWLSVNAFKIVAETIMAENDKYYEIIVAEHGEKALSATELRFGPYLSQEKSVVFKEKWQREMDKLAYALSCIPEEKTQERQLLLTKIQQIKEVIVHES

SEQ ID NO: 2649 - DNA, 789 bp, Streptococcus agalactiae
ttgatgaaagctagagaacttattgatgtatatgaaacttattgtccacaggaattatctatggaaggagatatttcaggtcttcaaattggatctttagataaagaaataaagacagtcatggtagctttagatgttcgagagactacagtagctgaagcaattgaacgtcaagtagatcttcttattgtaaagcatgctcctatttttcgtccattaaaggatttggtagcaacgccgcaaaataagatttatatagaccttcttaaatcagacattgctgtttatgtgagccatactaatatagatatcgttcctaatggacttaacgactggttttgtgaattattagatattcaatatcccgatatattatctgagacaagtaatggttatggtattggtcgcattggtgatattagaccccagagttttgaattttttgcatggaaaattaaagatgtgtttggtttagatagcgttcgtttagtttcatatgataaatctaatcctgaaattcaacgagttgctatttgtgggggtagtgggcaaagtttctacaaagaagctattgcaaaaggagcagatgtttttgtaacgggagatatttattatcatactgcacaagaaatgatcacaaatggtttgcttgcgattgacccaggtcatcatattgaggttttatttgtttctaaaatagctactatgattgagcagtggaaacttgaaaaaggctgggatatttcagttttagagagtaaagctccaacaaatcccttttaccatatg

SEQ ID NO: 2650 - protein, 263 aa, Streptococcus agalactiae
MMKARELIDVYETYCPQELSMEGDISGLQIGSLDKEIKTVMVALDVRETTVAEAIERQVDLLIVKHAPIFRPLKDLVATPQNKIYIDLLKSDIAVYVSHTNIDIVPNGLNDWFCELLDIQYPDILSETSNGYGIGRIGDIRPQSFEFFAWKIKDVFGLDSVRLVSYDKSNPEIQRVAICGGSGQSFYKEAIAKGADVFVTGDIYYHTAQEMITNGLLAIDPGHHIEVLFVSKIATMIEQWKLEKGWDISVLESKAPTNPFYHM

SEQ ID NO: 2651 - DNA, 792 bp, Streptococcus pyogenes
ttgttcatgaaagctaaaaccctaattgatgcctatgaagccttttgcccacttgatttatctatggaaggagacgttaaaggtcttcaaatgggttcattggataaagacattcgtaaggttatgattactttagatatccgagagtcaacagtagcagaagccatcaaaaatgaagttgatctcattataactaagcatgctcccatctttaaaccgcttaaagatctggtttcatcccctcagcgtgatatccttctagatttggtcaagcatgacatttctgtctatgtgagccataccaatattgacattgtaccaggtgggctaaatgattggttttgtgacctgctagaaatcaaggaagcaacttacttgtctgaaaccaaagaaggctttggcattggtcgtattggaacagttaaagaacaagcgttagaagagttagcaagtaaggtcaaaagggtgtttgatttagataccgtgcgacttatccgttacgataaggaaaaccctttgatttcaaagattgctatctgtggcggaagtggtggtgaattttatcaggatgctgtgcaaaaaggcgcagacgtttatattacaggggatatctattaccatacagcacaggagatgctgacagaaggactatttgcggttgacccggggcatcatattgaggtgctttttacggagaaattaaaggagaaactccaagggtggaaagaagagaacggttgggatgtcagcattatttcaagcaaagcctcgaccaatccatttagccattta

SEQ ID NO: 2652 - protein, 264 aa, Streptococcus pyogenes
LFMKAKTLIDAYEAFCPLDLSMEGDVKGLQMGSLDKDIRKVMITLDIRESTVAEAIKNEVDLIITKHAPIFKPLKDLVSSPQRDILLDLVKHDISVYVSHTNIDIVPGGLNDWFCDLLEIKEATYLSETKEGFGIGRIGTVKEQALEELASKVKRVFDLDTVRLIRYDKENPLISKIAICGGSGGEFYQDAVQKGADVYITGDIYYHTAQEMLTEGLFAVDPGHHIEVLFTEKLKEKLQGWKEENGWDVSIISSKASTNPFSHL

SEQ ID NO: 2653 - DNA, 1101 bp, Streptococcus agalactiae
atgaaaaagatagcaattattggtgcaggagcagtcggagcgacactagcctattacttatcaaaagaaaaggatattcaggttactgtttttgattatggagttggacaagcaactaaggctgctgcggggattattagcccatggttttcaaaacgtcgtaataaagcctggtatcgtatggcgaggttgggggctgatttttattcaaagctagtcacggatttacaaaaagatggttttgaaacaaaattttatcagcaaactggtgttttcttattaaaaaaggacgagagtcagttagagtcattgtttgcactagcagataaacgtcgactagaatctcctctaataggtgatttacaaatactaaataaaagtgaagcaaatactcactttcctgagttagatggctatgaacagttactttatgcgagcggaggagcacgagtagaaggggcggacttaacacgaatattgttagaagcaagtggtgttaatgtcatcaaggatgaagttcactttacgataactgataatggctttcgtgttcaaggaattgattttgataaacttgttttagcgagtggagcctggctagctaagatattagatgagcacaactatcaggtagatgttcgccctcaaaaagggcaattgcgagactattattttagcaatattaatacaggaaaatatcctgttgtaatgccagaaggtgagctagatattatcccatttgataatggtaaagtctctgtaggtgcaagtcacgaaaatgatatggcttttgatttaaacattgattttaaagtcttagacaagtttgaagagcaagctattggctattttccgcaattaaaaaaagcagatacgacttctgaacgtgttggaattcgtgcctatacaagtgatttttctccattttttggccctgtcccttgtatggagggtgcatatgctgcaagtggattaggatcaactggcttaacagtgggcccattaattggttatgaattatgtcaattaatcttaaataaagaaaatcagctaaatttagaggattacgatattacaaaatacgtgaaaaagattagtaga

SEQ ID NO: 2654 - protein, 367 aa, Streptococcus agalactiae
MKKIAIIGAGAVGATLAYYLSKEKDIQVTVFDYGVGQATKAAAGIISPWFSKRRNKAWYRMARLGADFYSKLVTDLQKDGFETKFYQQTGVFLLKKDESQLESLFALADKRRLESPLIGDLQILNKSEANTHFPELDGYEQLLYASGGARVEGADLTRILLEASGVNVIKDEVHFTITDNGFRVQGIDFDKLVLASGAWLAKILDEHNYQVDVRPQKGQLRDYYFSNINTGKYPVVMPEGELDIIPFDNGKVSVGASHENDMAFDLNIDFKVLDKFEEQAIGYFPQLKKADTTSERVGIRAYTSDFSPFFGPVPCMEGAYAASGLGSTGLTVGPLIGYELCQLILNKENQLNLEDYDITKYVKKISR

SEQ ID NO: 2655 - DNA, 1104 bp, Streptococcus pyogenes
atgaaaatagccattattggggcggggattgtaggatcaaccgccgcttattatttacaacaaagtggtcaaaaagaagttaccatttttgaccatggtcaaggacaagccactaaggcagctgctggtattattagtccttggttttcaaagcgtcgcaataaagtttggtaccgcatggctcgtttaggagcggacttttatcagcaattaatcaatgacctcaaagaagatggttttgcaacagatttttatcagcaaaatggcatctatgttttaaaaaagcaggaagaaaaactaagagatctttatgaattagcgttagcaagaaaggtagaatcaccgattattggtgagttagccattaaaaatcgtaaagaactggggaatgattttaaaggattgattggctttgataactgtctgtacgcttcaggagctgctagagtggagggagccgctttatgtgagacattactcaaggctagtggttatccagttattcgccaaaaagtcactctgaaacagcaaggaagtggttatgagattgctggtcattattttgatcaggtcattctggcagcaggagcatggctacctgacttattgaggcctttaggctatcaggttgatgtgcgaccacaaaagggacaactcttggattatgacgttcatcacatcatcagcgacacttatccagttgttatgccagaaggtgaaatagatcttattccttttaaccaaggtaagatttctgttggtacgagtcacgaaaatgataaaggttatgatttggagcctgattggcaggttttaaaaaaacttgaaatgcaagctcttacttatttgccgttattaaaagaagctactcaaaaaacgtgtcgtgtaggaataagagcttataccagtgattattctcctttttatggtcaggtttcaggattgaagaacctttatacagctagtggtttagggtcatcgggattaacagttggacctttgattggctatgaattagctcaattattgctaggacacgaaggacttttgacgcctagcgactattctcctgagccttaccttttgcggtctactggtaaagcg

SEQ ID NO: 2656 - protein, 368 aa, Streptococcus pyogenes
MKIAIIGAGIVGSTAAYYLQQSGQKEVTIFDHGQGQATKAAAGIISPWFSKRRNKVWYRMARLGADFYQQLINDLKEDGFATDFYQQNGIYVLKKQEEKLRDLYELALARKVESPIIGELAIKNRKELGNDFKGLIGFDNCLYASGAARVEGAALCETLLKASGYPVIRQKVTLKQQGSGYEIAGHYFDQVILAAGAWLPDLLRPLGYQVDVRPQKGQLLDYDVHHIISDTYPVVMPEGEIDLIPFNQGKISVGTSHENDKGYDLEPDWQVLKKLEMQALTYLPLLKEATQKTCRVGIRAYTSDYSPFYGQVSGLKNLYTASGLGSSGLTVGPLIGYELAQLLLGHEGLLTPSDYSPEPYLLRSTGKA

SEQ ID NO: 2657 - DNA, 867 bp, Streptococcus agalactiae
atgaaaggtattattttagcgggaggttcaggtactcgcttgtacccattaactcgtgctgcatcaaaacaattgatgccaatttatgataaaccaatgatttattatccattgtcagttttgatgttagcaggaataaaagaaatactgattatttctactccacaagatttgcctcgctttgaagatatgcttggagatggttcagaactaggaatctctctttcttatgctgaacaaccaagcccagatgggttagcacaggccttcattatcggtgaagattttattggtgatgatcacgttgctttagtattaggtgataatatttaccatggaccaggtttatctgcaatgctacaacgtgcagctagtaaagaaagtggagcaaccgtctttggctatcaagtaaaagatccagaacgttttggtgttgtcgagtttgatactgatatgaatgccatttctattgaagaaaaaccagcgcaacctaagtctaattatgctgtcacaggtctttatttctatgataacgatgtggttgaaatcgctaaaaatattaagccaagccctcgtggagaacttgaaattactgatgttaacaaagcctaccttgatagaggtgacttatcagttgagttaatgggacgtggatttgcgtggttagacactggaactcacgaaagtcttcttgaagcagcacaatatattgaaacagtacaacgcatgcaaaacgttcaagttgctaaccttgaggaaattgcttaccgcatgggctacatcactcgtgaacaagtccttgagttggcacaaccacttaagaaaaatgagtatggtcaatacctacttcgtttgattggagaagcc

SEQ ID NO: 2658 - protein, 289 aa, Streptococcus agalactiae
MKGIILAGGSGTRLYPLTRAASKQLMPIYDKPMIYYPLSVLMLAGIKEILIISTPQDLPRFEDMLGDGSELGISLSYAEQPSPDGLAQAFIIGEDFIGDDHVALVLGDNIYHGPGLSAMLQRAASKESGATVFGYQVKDPERFGVVEFDTDMNAISIEEKPAQPKSNYAVTGLYFYDNDVVEIAKNIKPSPRGELEITDVNKAYLDRGDLSVELMGRGFAWLDTGTHESLLEAAQYIETVQRMQNVQVANLEEIAYRMGYITREQVLELAQPLKKNEYGQYLLRLIGEA

SEQ ID NO: 2659 - DNA, 867 bp, Streptococcus pyogenes
atgaaaggtattattcttgcaggaggttcagggacacgcttgtatccactgacccgtgccgcatctaaacagttgatgcccatttatgacaaaccaatgatttattacccattgtcaaccttgatgttggcagggattaaagatgttttaatcatttcaactccccaagatcttcctcgtttcgaagaattgctaggagacgggtcagaatttggcattagcttatcctataaggaacaaccaagcccagatggtttagcacaagctttcattattggagaggagtttatcggtgatgaccgtgttgctcttattttaggagataatatttaccacggtaatggcctcactaaaatgcttcaaaaggcagctgccaaagaaaaaggagccaccgtttttggttatcaagtgaaagaccctgagcgctttggagtggtggaatttgatgagaacatgaatgctatctctatcgaagaaaaaccagaagtgcctaagtctcactttgcagtgactggactttatttctatgacaatgacgtggtagagattgctaaaaacattaaaccaagcgcgcgtggtgagttggaaattacagacgtcaacaaggcttacttggaacgtggtgacctctccgttgaattgatggggcgtggttttgcatggttagacactggaacgcatgaaagtctacttgaagcggctcaatatattgaaactgttcaacgcttgcaaaacgctcaagtggcaaatctggaagaaattgcctatcgcatgggctatatcagtaaagaagatgtccataaattggcgcaatctttaaagaaaaacgaatacgggcaatacttgcttcgtttgattggagaagct

SEQ ID NO: 2660 - protein, 289 aa, Streptococcus pyogenes
MKGIILAGGSGTRLYPLTRAASKQLMPIYDKPMIYYPLSTLMLAGIKDVLIISTPQDLPRFEELLGDGSEFGISLSYKEQPSPDGLAQAFIIGEEFIGDDRVALILGDNIYHGNGLTKMLQKAAAKEKGATVFGYQVKDPERFGVVEFDENMNAISIEEKPEVPKSHFAVTGLYFYDNDVVEIAKNIKPSARGELEITDVNKAYLERGDLSVELMGRGFAWLDTGTHESLLEAAQYIETVQRLQNAQVANLEEIAYRMGYISKEDVHKLAQSLKKNEYGQYLLRLIGEA

SEQ ID NO: 2661 - DNA, 90 bp, Streptococcus agalactiae
ttgaagctattcctggattgttggaattcgatattcccgttcgtggagacaaccgaggatggttcaaagagaactttcaaaaagaaaaaa

SEQ ID NO: 2662 - protein, 30 aa, Streptococcus agalactiae
MKLFLDCWNSIFPFVETTEDGSKRTFKKKK

SEQ ID NO: 2663 - DNA, 591 bp, Streptococcus agalactiae
atgactgaacaattttttgataaagaattaacttgtcgcccaattgaagctattcctggattgttggaattcgatattcccgttcgtggagacaaccgaggatggttcaaagagaactttcaaaaagaaaaaatgataccgcttggtttcccagaaagcttctttgaggcagacaaactacaaaataatatttcgtttaacaagaaaaatactttgcgaggtctccatgcagagccttgggataaatatgtttcgatcgctgatgaaggacgtgtgatcggtacttgggttgacctccgtgaaggtgacagttttggtaacgtttaccaaacgattatcgatgcctcaaaaggtatctttgttccacgcggtgttgctaatggtttccaagttctttcagataaagcagcttatacttatctcgttaacgattattgggcacttgaactcaaaccaaaatatgctttcgttaattatgcagatccaaatctaggcattcagtgggaaaaccttgaagaagcagaagtctcagaagcagataagaatcacccacttctcaaagatgtaaaacctttgaagaaggaagatttg

SEQ ID NO: 2664 - protein, 197 aa, Streptococcus agalactiae
MTEQFFDKELTCRPIEAIPGLLEFDIPVRGDNRGWFKENFQKEKMIPLGFPESFFEADKLQNNISFNKKNTLRGLHAEPWDKYVSIADEGRVIGTWVDLREGDSFGNVYQTIIDASKGIFVPRGVANGFQVLSDKAAYTYLVNDYWALELKPKYAFVNYADPNLGIQWENLEEAEVSEADKNHPLLKDVKPLKKEDL

SEQ ID NO: 2665 - DNA, 591 bp, Streptococcus pyogenes
atgacagaaactttttttgacaaaccattggcttgccgagaaatcaaagaaatcccaggcttactagagtttgatattcctgttcgtggggataatcgtggctggtttaaagaaaatttccaaaaagaaaaaatgttgccaattggctttccagaacgtttttttgaggaaggaaaactacaaaacaacgtttctttttcacgtcagcatgtgctgcgtggacttcatgctgaaccttgggataaatacatctcagttgctgatgatggcaaggttttaggagcttgggttgatcttcgtgagggagagacttttggaaacgtctaccagacagtgattgatgcttcaaaaggaatgtttgttcctagaggggttgctaatggctttcaagttctttcagagactgtctcttacagttatcttgtcaatgactactgggctcttgacttgaaacctaagtatgcttttgtaaactatgctgacccaagtcttgggattacttgggaaaatctagcagctgcagaagtttctgaagcagataaaaaccatcctcttcttagtgatgtcaaaccactgaaaccaaaagaccta

SEQ ID NO: 2666 - protein, 197 aa, Streptococcus pyogenes
MTETFFDKPLACREIKEIPGLLEFDIPVRGDNRGWFKENFQKEKMLPIGFPERFFEEGKLQNNVSFSRQHVLRGLHAEPWDKYISVADDGKVLGAWVDLREGETFGNVYQTVIDASKGMFVPRGVANGFQVLSETVSYSYLVNDYWALDLKPKYAFVNYADPSLGITWENLAAAEVSEADKNHPLLSDVKPLKPKDL

SEQ ID NO: 2667 - DNA, 102 bp, Streptococcus agalactiae
ttgcgtcaaacaacattgctaattcgtttttacttgctaaggttaatgccttttaagaagttgaaaattacaaatcttccttcttcaaaggttttacatctt

SEQ ID NO: 2668 - protein, 34 aa, Streptococcus agalactiae
MRQTTLLIRFYLLRLMPFKKLKITNLPSSKVLHL

SEQ ID NO: 2669 - DNA, 126 bp, Streptococcus agalactiae
atgaaaccagctccaccagttacgataatgtttttaaattcagtcattttttctccgaaaaattttttctttttgctatttgaaggatactgttctgttagaagtagttctatggaatgtcatgcc

SEQ ID NO: 2670 - protein, 42 aa, Streptococcus agalactiae
MKPAPPVTIMFLNSVIFSPKNFFFLLFEGYCSVRSSSMECHA

SEQ ID NO: 2671 - DNA, 930 bp, Streptococcus agalactiae
ttgacatatgcaggtaaccgtgctaacattgaagccattcttggtgatcgtgttgagttagttgttggtgacatcgctgacgctgaattggtagacaagttggctgccaaagcagatgctattgttcactatgcggctgagagccacaatgacaactcacttaacgatccaagtccatttatccatacaaactttatcggaacttacactttgcttgaagcagctcgtaaatacgatatccgtttccaccacgtgtcaactgatgaagtttatggagatctgccacttcgtgaagaccttccaggaaatggtgaaggaccaggtgaaaaattcactgctgaaacaaaatacaatccatcatcaccttactcatcaactaaggcagcttctgaccttatcgttaaggcatgggtacgttccttcggcgtaaaagcgaccatttcgaactgttcaaataactatggaccataccaacacatcgaaaaattcattccacgtcaaattacaaatatcttggcaggaatcaaaccgaaactttatggtgaaggtaaaaacgtccgtgactggatccacacaaatgatcattcaacaggtgtctgggctattttgactaagggtcgtattggtgaaacataccttattggtgccgacggtgagaaaaacaacaaggaagttcttgaacttatccttgagaaaatgggtcaaccaaaagacgcttacgatcacgtaactgaccgtgctggacacgaccttcgttacgctatcgattctacaaaattgcgtgaagaacttggttgggaaccacaattcacaaacttctcagaaggtttggaagaaacaatcaactggtacactgaaaaccaagattggtggaaagcagagaaagaagcagttgaagctaactacgctaaaacgcaagaagtcattaac

SEQ ID NO: 2672 - protein, 310 aa, Streptococcus agalactiae
MTYAGNRANIEAILGDRVELVVGDIADAELVDKLAAKADAIVHYAAESHNDNSLNDPSPFIHTNFIGTYTLLEAARKYDIRFHHVSTDEVYGDLPLREDLPGNGEGPGEKFTAETKYNPSSPYSSTKAASDLIVKAWVRSFGVKATISNCSNNYGPYQHIEKFIPRQITNILAGIKPKLYGEGKNVRDWIHTNDHSTGVWAILTKGRIGETYLIGADGEKNNKEVLELILEKMGQPKDAYDHVTDRAGHDLRYAIDSTKLREELGWEPQFTNFSEGLEETINWYTENQDWWKAEKEAVEANYAKTQEVIN

SEQ ID NO: 2673 - DNA, 1038 bp, Streptococcus pyogenes
atgtataaaaatattatcgtaactggtggagctggtttcatcggatctaactttgtgcactatgtctacaataaccacccagatgttcatgtaactgtccttgataaattgacatatgcaggtaaccgtgctaacattgaagctattcttggtgatcgtgttgagttagttgttggtgatatcgctgacgctgaattggtagataaattggctgccaaaacggatgctattgttcactatgcggctgagagccacaacgataactcattggaagatccaagtccatttatccatacaaactttatcggaacttacactttgcttgaagcagctcgtaaatacgatatccgtttccaccacgtgtcaactgatgaagtttatggagatcttccacttcgtgaagaccttccaggacagggtgaaggaccaggtgaaaaattcactgctgaaacaaaatacaatccatcatcaccttactcatcaactaaggcagcttctgaccttatcgttaaggcatgggtacgttccttcggtgtgaaagcgaccatttcgaactgttcaaataactatggaccataccaacacatcgaaaaattcattccacgtcaaattacaaatatcttggcaggaatcaaaccaaaactttatggtgaaggtaaaaacgtccgtgactggattcatactaatgatcattctacaggagtatgggctattttgactaagggtcgtatcggtgaaacataccttattggtgccgacggcgagaaaaacaacaaggaagttcttgagcttatccttgagaaaatgggtcaaccaaaagacgcttatgatcacgtaactgaccgtgctggtcacgatcttcgttacgctattgattctacaaaattgcgtgaagaactcggctgggaaccacaatttacaaacttttcagaaggtttggaagaaactattaagtggtacacagaaaatgagacatggtggaaagcagaaaaagatgctgtagaagccaagtatgctaaaactcaagaagtgattaaa

SEQ ID NO: 2674 - protein, 346 aa, Streptococcus pyogenes
MYKNIIVTGGAGFIGSNFVHYVYNNHPDVHVTVLDKLTYAGNRANIEAILGDRVELVVGDIADAELVDKLAAKTDAIVHYAAESHNDNSLEDPSPFIHTNFIGTYTLLEAARKYDIRFHHVSTDEVYGDLPLREDLPGQGEGPGEKFTAETKYNPSSPYSSTKAASDLIVKAWVRSFGVKATISNCSNNYGPYQHIEKFIPRQITNILAGIKPKLYGEGKNVRDWIHTNDHSTGVWAILTKGRIGETYLIGADGEKNNKEVLELILEKMGQPKDAYDHVTDRAGHDLRYAIDSTKLREELGWEPQFTNFSEGLEETIKWYTENETWWKAEKDAVEAKYAKTQEVIK

SEQ ID NO: 2675 - DNA, 123 bp, Streptococcus agalactiae
ttggttatatcttctttaaaaatagcactattgatattgaacgcaaagagcaaacaggtacttggaacagcattaatcgtacttctaaaaatacctcaatcgttagcaatccttttatcacta

SEQ ID NO: 2676 - protein, 41 aa, Streptococcus agalactiae
MVISSLKIALLILNAKSKQVLGTALIVLLKIPQSLAILLSL

SEQ ID NO: 2677 - DNA, 165 bp, Streptococcus agalactiae
atgatgaaaatacacgtggttggtataccggagatggtatgttctatctttataatagtgatcaatctcattatagtaatcatttttggccaaccgtcaatccttataaaatggctggaacaactgaaaaagatgctaagcgtgaagatacgactaaggatttca

SEQ ID NO: 2678 - protein, 55 aa, Streptococcus agalactiae
MMKIHVVGIPEMVCSIFIIVINLIIVIIFGQPSILIKWLEQLKKMLSVKIRLRIS

SEQ ID NO: 2679 - DNA, 120 bp, Streptococcus agalactiae
ttgatcccactaaaaaatatgaggtcaagtttgatattgaaacaagtaacaaggctggacaagctttccttcgtattatggagaaaaaagataacaatacgcgactttggctttctgaga

SEQ ID NO: 2680 - protein, 40 aa, Streptococcus agalactiae
MIPLKNMRSSLILKQVTRLDKLSFVLWRKKITIRDFGFLR

SEQ ID NO: 2681 - DNA, 3216 bp, Streptococcus agalactiae
atggaaatcaaaaagaaacatcgtattatgctttattcagcccttattttaggaacaatattggttaacaatagttaccaagctaaagctgaagagcttaccaaaactacctcaacgtcacaaataagagatactcaaactaataatgttgaagctccccagactgaaagtaccactgtcaaagagactagcaccacaaccacacaacaagatttgtctaactccacagcttcaaccgcaactgcaacagccactcctagcacaatgaaacaagtagtagataatcaaactcaaaataaggagctggtgaaaaacggagattttaatcaaactaaccctgtatctggaagctggtcacatacaggcgctagggaatggtctgcttggattgataaagaaaatactgctgataaatcacctattatccaacgtaccgaacaaggccaagtaagtctatccagcgacaaaggctttagaggtgctgtaacacaaaaagtgaacattgatcccactaaaaaatatgaggtcaagtttgatattgaaacaagtaacaaggctggacaagctttccttcgtattatggagaaaaaagataacaatacgcgactttggctttctgagatgaccagcggtactactaacaaacataccttaacaaagatatataacccaaagttagatgtctccgaggtgacacttgaactttattatgaaaaaggaacaggttctgttacttttgataatatatcaatgaaagcaaaaggccctaaagactcagagcatccacaacccgtcacaacacaaattgaaaaaagcgttaatacggctttaaacaaaaattacgtttttaataaagctgactaccaatacactctaaccaatccgtctcttgggaaaattgttggtggaatattgtatccaaacgctactggttcaacaactgttaaaatatctgataaatctggcaaaataattaaagaagtaccgttatcagttacagcttcaacagaagataactttacaaaactcctcgacaaatggaacgacgtgactattggtaatcatgtttacgatactaatgattcgaacatgcaaaagcttaatcagaaattagatgaaactaacgccaaaaacatcgaagctatcaaactggattctaatcgcactttcctttggaaagatttagataatctcaataattcagcacagttaaccgctacttatcgtcgtttggaagatttagctaaacaaatcaccaatccacactctactatttacaaaaatgaaaaagctattcgtactgtaaaagagagtctggcttggcttcatcaaaacttctacaatgttaataaagatatagaaggctctgccaattggtgggattttgaaatcggtgttcctcgctcaattacaggtaccctagctctcatgtataactacttcactgacgctgaaataaaaacttataccgacccaattgaacattttgttcctgatgcaggatttttccgtaaaacgcttgtcaatccatttaaagcccttggtggtaatctagtcgatatggggcgcgttaaaatcattgaaggtttacttcgtaaagacaatactattatcgaaaaaacttctcattctctaaaaaatctttttactactgctactaaagctgaaggcttctatgctgacggttcttacatcgaccatacgaatgttgcttatactggcgcctatggtaatgttctgatagatggtttgacacaattgctgcctatcattcaagaaactgactataaaatctctaatcaagaacttgatatggtttataaatggattaatcaatcatttttacctttaattgtaaaaggtgagttaatggatatgagtcgtggacgctcaattagtagagaggctgcttcttctcatgcggctgcagttgaagttctcagaggtttcctcagattggctaacatgtctaatgaagagcgaaacttagacctcaaatcaactattaaaacgattatcacttcaaataaattctacaacgtcttcaataacctcaaatcgtattccgatattgccaacatgaataagctgcttaatgacagtacagtcgctactaaacctttaaaaagtaatttatcaacctttaatagcatggaccgcttagcttattataatgccgagaaagactttggtttcgcactttcattacattctaaacgtaccctcaactatgaaggaatgaatgatgaaaatacacgtggttggtataccggagatggtatgttctatctttataatagtgatcaatctcattatagtaatcatttttggccaaccgtcaatccttataaaatggctggaacaactgaaaaagatgctaagcgtgaagatacgactaaggatttcatgagcaaacatagcaaagacgctaaagaaaaaaccggtcaagttacaggagcatctgactttgttggttccgtcaaacttaatgatcactttgctcttgccgctatggactttactaactgggatcgcaccttaacagcacaaaaaggttgggttatcttaaatgataagattgtctttttaggtagcaacatcaagaatactaacggcattggaaatgtttctacaacaattgatcaacgaaaagacgattctaaaacaccttatactacatacgtcaatggaaaaactgttgatttaaagcaagcaagttctcaacaatttacagatacaaagagtgtctttttagaatcaaaagaacctggtcgcaatattggttatatcttctttaaaaatagcactattgatattgaacgcaaagagcaaacaggtacttggaacagcattaatcgtacttctaaaaatacctcaatcgttagcaatccttttatcactataagccaaaagcatgacaacaaaggtgatagctatgattacatgatggttccaaacattgatcgcacaagttttgataaattagccaatagcaaagaagtagaattactagaaaacagttcaaaacaacaagttatctatgataaaaacagtcaaacttgggctgttatcaaacacgataatcaagagagtctcattaacaatcaattcaaaatgaataaagcgggactttacctagtacaaaaagttggtaatgactatcaaaatgtctattaccaacctcaaagcatgacaaaaacagaccaattagctatc

SEQ ID NO: 2682 - protein, 1072 aa, Streptococcus agalactiae
MEIKKKHRIMLYSALILGTILVNNSYQAKAEELTKTTSTSQIRDTQTNNVEAPQTESTTVKETSTTTTQQDLSNSTASTATATATPSTMKQVVDNQTQNKELVKNGDFNQTNPVSGSWSHTGAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLDVSEVTLELYYEKGTGSVTFDNISMKAKGPKDSEHPQPVTTQIEKSVNTALNKNYVFNKADYQYTLTNPSLGKIVGGILYPNATGSTTVKISDKSGKIIKEVPLSVTASTEDNFTKLLDKWNDVTIGNHVYDTNDSNMQKLNQKLDETNAKNIEAIKLDSNRTFLWKDLDNLNNSAQLTATYRRLEDLAKQITNPHSTIYKNEKAIRTVKESLAWLHQNFYNVNKDIEGSANWWDFEIGVPRSITGTLALMYNYFTDAEIKTYTDPIEHFVPDAGFFRKTLVNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKDFMSKHSKDAKEKTGQVTGASDFVGSVKLNDHFALAAMDFTNWDRTLTAQKGWVILNDKIVFLGSNIKNTNGIGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYDYMMVPNIDRTSFDKLANSKEVELLENSSKQQVIYDKNSQTWAVIKHDNQESLINNQFKMNKAGLYLVQKVGNDYQNVYYQPQSMTKTDQLAI

SEQ ID NO: 2683 - DNA, 2484 bp, Streptococcus pyogenes
gtggtatatttttacttagtaaatcaatttacttttattatctcatttttatattggaggaatttatcagtgaatacttatttttgcacacaccataaacaattactactttattcaaacctattccttagctttgctatgatgggccaaggaactgccatttatgccgatacactgacttcaaattcagaacctaataatacttactttcaaacgcaaacgctcactactacagatagcgaaaaaaaggtagtacagccacaacaaaaagactactatactgaattgttagaccaatggaacagtattatcgcaggcaacgatgcttatgataaaaccaatcctgacatggtcacttttcataataaagctgaaaaggatgctcaaaacattattaaaagctatcaagggcctgaccacgaaaatagaacttacctttgggaacatgcaaaggattattccgcttctgctaatatcacgaaaacttaccgcaatattgaaaaaatagcaaaacagatcactaatcctgaatcatgctattatcaagatagtaaagctattgctattgtaaaagacggtatggccttcatgtatgaacacgcttataatctagatcgtgaaaatcatcaaacaactggaaaagaaaacaaagaaaattggtgggtttatgaaattggaactcctcgtgctattaataataccttatccttgatgtatccttattttactcaagaagaaattcttaaatacacagctccaatcgaaaaatttgtgcctgaccctactcgttttagggttcgcgctgccaatttttcaccttttgaagccaatagcggaaatttaattgatatggggcgtgttaaactcatttccggtattcttcgtaaagatgatctcgaaattagtgatacaatcaaagcaattgagaaagttttcacgctagttgatgaaggaaatggtttttaccaagacggttctttaattgatcacgtggttactaacgctcaaagtccactttataaaaaaggcattgcttacactggagcttacggtaatgtgcttatagatggcttatcgcaattaattcctattattcaaaaaacaaagtctcctataaaagcggataaaatggctactatctatcattggattaaccattcttttttccctatcatcgttcgtggagaaatgatggatatgactcgagggcgttctatcagtcgttttaatgcccaatctcatgttgctggcattgaagcacttcgtgctattttacgtattgctgacatgtctgaagagcctcaccgtttggcacttaaaacacgtataaaaacactcgtcacacaagggaatgctttttacaatgtctatgataatttgaaaacctatcacgatatcaaacttatgaaagaactactaagtgatacttctgttccagtccaaaaacttgatagttacgtagctagtttcaatagtatggataaattggcactatataataataaacacgattttgcttttggcctatcaatgttttcgaatcgaactcaaaattatgaagctatgaataatgaaaatcttcatggctggtttacttctgatggaatgttttacctatacaataacgatttaggacactacagtgaaaactattgggcaacggtaaatccctaccgcttacctggaaccacagaaactgagcaaaaaccactagagggaactcctgagaatattaaaacgaactatcaacaagttggcatgactggtctctctgatgacgcttttgttgcaagtaaaaaacttaataacacaagtgctctagctgctatgaccttcactaattggaataaaagcctcaccctcaataaagggtggtttatcttaggaaacaaaataatctttgttggtagcaatatcaaaaaccaatcatctcacaaggcgtatacaactattgaacaacgaaaagaaaatcaaaagtacccttactgttcttatgttaacaatcaacccgttgacttgaataatcagctagttgattttacaaacactaaaagtattttccttgaaagtgatgatcccgctcaaaatattggttactacttcttcaagccaacaacacttagcataagtaaggcacttcaaacagggaaatggcaaaacataaaagctgatgacaaatcaccagaagccatcaaagaagtttcaaatacctttatcactatcatgcaaaaccatactcaagatggcgatcgttatgcctatatgatgcttccaaatatgactcgtcaagaatttgaaacctatattagcaagcttgatatcgacttattagaaaacaatgacaaactggccgctgtctacgatcatgatagtcaacagatgcacgtcattcactatggaaaaaaagcaacgatgttttcaaatcataatctttctcatcaaggcttttatagttttcctcatcctgtcaggcaaaatcaacaa

SEQ ID NO: 2684 - protein, 828 aa, Streptococcus pyogenes
VVYFYLVNQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 2685 - DNA, 480 bp, Streptococcus agalactiae
atgactaaattagcaacaatttgttacattgacaatggcaaggaattacttctattgcaccgcaacaaaaaagagaatgatgttcatgagggaaagtggatctcggtaggtggtaaactggaggcaggtgaaactcctgatgaatgtgctaagcgtgaaattctagaagaaacccatttaacggtaaaaaaaatggattttaaaggagtcatcacttttcctgaatttacgccaggtcatgattggtatacctatgtctttaaagtaacagattatgaaggagagttaatttcagatgatgaatcacgagaaggaactttagaatgggtaccatatgatcaagttctttctaagccaacgtggcaaggagattacgaaatttttaaatggattttagaagatgttcctttcttttctgctaagtttgtttatgatgaacaccaaaatttaattgaaaagacggttaatttttatgaaaaa

SEQ ID NO: 2686 - protein, 160 aa, Streptococcus agalactiae
MTKLATICYIDNGKELLLLHRNKKENDVHEGKWISVGGKLEAGETPDECAKREILEETHLTVKKMDFKGVITFPEFTPGHDWYTYVFKVTDYEGELISDDESREGTLEWVPYDQVLSKPTWQGDYEIFKWILEDVPFFSAKFVYDEHQNLIEKTVNFYEK

SEQ ID NO: 2687 - DNA, 474 bp, Streptococcus pyogenes
atgactcaattagcaaccatttgttacattgataatggcgattctttgctattattacaccgcaataaaaaagaaaatgatgtccacaaaggcaagtggatttcagttgggggtaagctcgaggctggtgagaccccagatgagtgtgcccgtcgtgagattttagaggaaacccatttgactgttacagagatggcctttaaaggaatcattacttttccagaatttacccctggtcatgactggtatacctatgtttttaaagtaacaggatttgaaggagacctcatttcagatgaagagtcacgagaaggaaccttggaatgggtaccttacgatcaagtgttggaaaagccaacttgggaaggtgattatgacatttttaaatggattttagaagaccgttcttttttctctgccaaatttacctatgaccaaaacaaccaactcatggataaatctgtgaccttttat

SEQ ID NO: 2688 - protein, 158 aa, Streptococcus pyogenes
MTQLATICYIDNGDSLLLLHRNKKENDVHKGKWISVGGKLEAGETPDECARREILEETHLTVTEMAFKGIITFPEFTPGHDWYTYVFKVTGFEGDLISDEESREGTLEWVPYDQVLEKPTWEGDYDIFKWILEDRSFFSAKFTYDQNNQLMDKSVTFY

SEQ ID NO: 2689 - DNA, 480 bp, Streptococcus agalactiae
ttgaaaagacggttaatttttatgaaaaatagagattttagggttagagaacagctcgaaacattcggagtcagagtttctgctttaatcatagaaaatcaaaaactgctattaatatatgctcctcatctcgataaatactatttgccaggtggggcgcttcaagttggagaagatagcaataaggctgttgcgagagaagtacttgaggaaataggtcttcacagccaagttggtgatttagcctatattattgagaatcagtttaatattaagagacatcattatcactcagttgaatttttatattttgttaatctcttgggtcaggcgccagaatctatcaaagaaggaacgcataagcgacattttgtatggcttccaataaaagaattaacaaaaattgattgtaatcctaattttttagcacaggatttgatagaatggccaggtcatgttgtgcataaaattgttcaaaat

SEQ ID NO: 2690 - protein, 160 aa, Streptococcus agalactiae
MKRRLIFMKNRDFRVREQLETFGVRVSALIIENQKLLLIYAPHLDKYYLPGGALQVGEDSNKAVAREVLEEIGLHSQVGDLAYIIENQFNIKRHHYHSVEFLYFVNLLGQAPESIKEGTHKRHFVWLPIKELTKIDCNPNFLAQDLIEWPGHVVHKIVQN

SEQ ID NO: 2691 - DNA, 315 bp, Streptococcus pyogenes
ttgattgttagaaatggtaagaattttttaactagagatgcagatgaccaatattacaccattggtggtacaagtttggtaggtgaaaaaacgcatgaaactgttttacgtgaaaccttagaggaagttggtattcgagctaaggttaatcaactggcttttatggttgagaatcattttgatatcgatgatgttttctggcataatattgaatttcattatttggtaagccccttagaagaccctaaactagaaatgatagagaatgcaagcgacaggtttgtgaatggattccaatcaatcaactggatcaaa

SEQ ID NO: 2692 - protein, 105 aa, Streptococcus pyogenes
LIVRNGKNFLTRDADDQYYTIGGTSLVGEKTHETVLRETLEEVGIRAKVNQLAFMVENHFDIDDVFWHNIEFHYLVSPLEDPKLEMIENASDRFVNGFQSINWIK

SEQ ID NO: 2693 - DNA, 1188 bp, Streptococcus agalactiae
atgaatcgaccatcagaaaaagaatttaaaaatagtttgttttttaaatggatcttaaataatcaagcagttattgctctcatgattacctttttggtatttttaacgatttttatttttaccaaaatctcttttatgtttaaacctgtgtttgattttcttgctgtgctgatattgccgcttgtaatttctggcttgctttattacctattaaaacctatggttacatttttagagaagcggggaattaagcgtgtaacagcgatattatcagtttttactattataatccttctgttaatttgggcaatgtctagttttattcccatgatgagtaatcaattacgccattttatggaagatctcccttcatatgtgaataaagtgcaaatggaaacaagttcgtttatagatcacaacccttggttaaaatcttataaaggggaaatatcgagcatgttatctaatatcagtagccaagcggtctcttatgctgaaaaattttcaaagaatattttagattgggcaggaaatttagctagtacagttgcacgtgtgacagtagcaacaatcatggctccctttattttgttttatcttttaagagatagtcgcaacatgaagaatggtttcttaatggttttaccaaccaaactacgccaaccaactgatcgtattttgcgagaaatgaatagtcaaatgtcagggtatgtgcaaggacaaatcattgttgctattactgttggtgttattttttcaataatgtatagtattataggccttagatatggcgtgacattagggattattgccggtgtgttaaatatggttccctatttgggaagttttgtcgcccaaattccagtgtttatcttagcgcttgtcgcaggacctgttatggttgttaaagttgcgattgtttttgttattgagcaaactctagaaggacgctttgtctcacccttggttttaggtaataaacttagcattcatccaattacaattatgtttattttattaacctctggagcgatgtttggtgtttggggagtattcctcagtattccgatttatgcatctatcaaagttgttgttaaagaattgtttgattggtacaaagctgtcagtgggctatatacagtagatgttgttactgaagaaagaagtgaagaagttaaaaatgttgaa

SEQ ID NO: 2694 - protein, 396 aa, Streptococcus agalactiae
MNRPSEKEFKNSLFFKWILNNQAVIALMITFLVFLTIFIFTKISFMFKPVFDFLAVLILPLVISGLLYYLLKPMVTFLEKRGIKRVTAILSVFTIIILLLIWAMSSFIPMMSNQLRHFMEDLPSYVNKVQMETSSFIDHNPWLKSYKGEISSMLSNISSQAVSYAEKFSKNILDWAGNLASTVARVTVATIMAPFILFYLLRDSRNMKNGFLMVLPTKLRQPTDRILREMNSQMSGYVQGQIIVAITVGVIFSIMYSIIGLRYGVTLGIIAGVLNMVPYLGSFVAQIPVFILALVAGPVMVVKVAIVFVIEQTLEGRFVSPLVLGNKLSIHPITIMFILLTSGAMFGVWGVFLSIPIYASIKVVVKELFDWYKAVSGLYTVDVVTEERSEEVKNVE

SEQ ID NO: 2695 - DNA, 1179 bp, Streptococcus pyogenes
atgcccttaatacctgaaaagtctagaacagatagcttattttacaaatggtttttaaataatcaagctaccatggctttagtaataacacttttagcctttttaacgatttttgtttttactaaaatctcttttttatttatgccagtgatttctttttttgcggtcatcatgttgcccttggttatttcgaccattctgtattatctgaccaaacccttagttgaccttattaatcacttgggcccgaatcgtaccacctctatttttattgtttttggtttgattaccttactttttgtctgggcgatttcaggctttgttcccatggtacagacccaacttaccagttttattgaggatctgcccaaatacgtgggcaaggtcaatgaagaagccaataaacttcttgaaaatgaatggttagtcagctataagccccaactccaagacatgcttacccatacaagtcaaaaggctttggattacgcgcaaagtttttcaaaaaatgctattgactgggctggtaattttgctggtgccattgctcggattaccgtggctattattatttcgccctttattctcttttattttttacgagacagtagccacatgaaaaatggccttgtgaatgtcttacctctcaaattacgggtgcctatggttcgagtcttgggagatattaacaagcaattatcaggctatgtgcaagggcaggttacggttgcaattgttgtcggctttatgttttctatcatgtttagccttgtgggactgaaatatgccatcacttttgggattattgctggctttcttaacatgataccttacttaggaagtttccttgccatgatacctgttgtgattatggctatggtacaaggcccatttatgttggttaaggtgcttgttatctttatgattgagcaaaccatcgaagggcgttttgtagcaccgcttgttttgggaaataagctgagcattcatcctattaccattatgttcttgttattgactgcaggctctatgtttggtgtctggggtgttttccttgtcatcccaatctacgcttctgtcaaagttgtgattaaagaattatttgactggtacaaaaaagttagcggtttgtatgacgaagaagtattggtgattgaggaggttaaggaccatgttaaa

SEQ ID NO: 2696 - protein, 393 aa, Streptococcus pyogenes
MPLIPEKSRTDSLFYKWFLNNQATMALVITLLAFLTIFVFTKISFLFMPVISFFAVIMLPLVISTILYYLTKPLVDLINHLGPNRTTSIFIVFGLITLLFVWAISGFVPMVQTQLTSFIEDLPKYVGKVNEEANKLLENEWLVSYKPQLQDMLTHTSQKALDYAQSFSKNAIDWAGNFAGAIARITVAIIISPFILFYFLRDSSHMKNGLVNVLPLKLRVPMVRVLGDINKQLSGYVQGQVTVAIVVGFMFSIMFSLVGLKYAITFGIIAGFLNMIPYLGSFLAMIPVVIMAMVQGPFMLVKVLVIFMIEQTIEGRFVAPLVLGNKLSIHPITIMFLLLTAGSMFGVWGVFLVIPIYASVKVVIKELFDWYKKVSGLYDEEVLVIEEVKDHVK

SEQ ID NO: 2697 - DNA, 1260 bp, Streptococcus agalactiae
atgttgttactgaagaaagaagtgaagaagttaaaaatgttgaatagtgaaaaaatgattgtttctatccaaaatcaggatttagaacatgctaacaagtatttcgaaaaagcgttgaaaaatgatcctgaggaagtcttgttggaactaggagcttatttggagagtattggttttttaccccaagcaaaacgtctctatgatcaaatccgaccaaattatccagaagttgctatcaatttagctcaaattgttgccgaagatggagatattgaacaagcattcttatacttagattatatctcagaagatagtcaagagtatgtttcagccctccttgttatggctgacttatatgatatggaaggcttgactgatgttgcgcgtgaaaagcttttgctagccagcaaacttagcgatgacccattggttacatttggtttagctgaaatgaaccttagtttggaacattatcaagaagcgatagaaggatatgcctcacttgacaatcgagaaatcttagaaacgactggagtttcaacttatcagcgtattggtaaatcctacgctattatggggaaatttgatgcagctatcgaatttttagaaaaagccgttgacattgagtatgatgatttaacagtttttgagttagcaacaatcctttatgatcaagaagaatatcaaaaagctaacctttattttaaacagttggatactattaatccagactttgctggctatgaatatatctatggtttatctcttcgtgaggagcataaatctgaagaagctttacgtctagttcagcaaggtattcgtaaaaatagttttgatggtcaacttctcttactagcctcacaattatcgtatgaattacatgatgttcattcgtcggagtcttatttgaaacaagctgaaaaagtttctgaaaatcaagatgaaattgttatgagattgtcaaatttgtatcttgaagaagagcggtttgaggaagtcttggaattagacaatgataatttagaaaatatccttgcaaaatggaatatcgctaaagcacacaaggctttagaaatggatgatagtgtagactattatcaatctttgtataatgatttaaaagataatccagaatttttacaagattatgcttacattttgagagaatttggttaccttgataaggcacaagaagtaggaaaggcttatttaaaattagttccagatgatatagagatgtcagaatgggtgaataacatt

SEQ ID NO: 2698 - protein, 420 aa, Streptococcus agalactiae
MLLLKKEVKKLKMLNSEKMIVSIQNQDLEHANKYFEKALKNDPEEVLLELGAYLESIGFLPQAKRLYDQIRPNYPEVAINLAQIVAEDGDIEQAFLYLDYISEDSQEYVSALLVMADLYDMEGLTDVAREKLLLASKLSDDPLVTFGLAEMNLSLEHYQEAIEGYASLDNREILETTGVSTYQRIGKSYAIMGKFDAAIEFLEKAVDIEYDDLTVFELATILYDQEEYQKANLYFKQLDTINPDFAGYEYIYGLSLREEHKSEEALRLVQQGIRKNSFDGQLLLLASQLSYELHDVHSSESYLKQAEKVSENQDEIVMRLSNLYLEEERFEEVLELDNDNLENILAKWNIAKAHKALEMDDSVDYYQSLYNDLKDNPEFLQDYAYILREFGYLDKAQEVGKAYLKLVPDDIEMSEWVNNI

SEQ ID NO: 2699 - DNA, 1263 bp, Streptococcus pyogenes
ttgaggaggttaaggaccatgttaaatagtgaaaaaatgattgcttccttggatcagcaagacctagcgcacgctgaaaaatatttccaaaaagctttaaaagaagatgatgcagatagtttaatcgccttaggagaatacttagaaagtataggttttttgccacatgccaagcgtatttatttgcagttagctgatgattacccagaactcaatataaatttagctcagattgcagcagaagacgacgccattgaagaagctttcttgtatttggataaggtttcaaaagatagccccaattatttgtcagctctcttagtaatggctgacctctatgacatggaaggactgacagaggtggcgcgtgaaaaattgcttcaagcagtgggcatcagcccagagccattggtcatttttggtttggcagaaattgacatgtccttgcagcattttaaagaagctattgattactatgcacagttagacaatcgtcaaatccttgaattgacaggtatttccacttatcaacgcattggacgagcctatgctagcttagggaaatttgaggcagccatcgaattcttggaaaaggccgtggccattgaatacgaagatgaaactgtttttgaattggcgaccctcatgtatgaccaagaaaattatcaaaaagccaatctttactttaaacagttggaaaccatcaatccagattatccaggttatgaatatggttatgctttgagtcttcatgaagagcataagacgtcagaagctttgcgcttggttcaacagggcctacgtaaaaatgcatttgacagtcaattattattactagcatcgcagctttcttatgaattacacgataggcagaatgctgaaaattacctgcttcaagcaaaggaagtagctgttgatgacgaagagattctcatgcgtttagtgaccctttattttgatgccgagcgttttgaggaggttattgctcttaatcgtgagacgattgataatgtcttaaccaaatggaccattgcaaaggcttaccacgccttggaacaagaagaagttgccttggctctttataatgagatttcggctgatttggcagaaaatccagagtttttacaggattatgcctatttattaagggagtttggccagtttcacaaggctatccaaatggctaccgcttacctcagacaagtgcctgatgatgtgaatatgcaagactttcttgaccatatcaagcaccaacaatcagaa

SEQ ID NO: 2700 - protein, 421 aa, Streptococcus pyogenes
LRRLRTMLNSEKMIASLDQQDLAHAEKYFQKALKEDDADSLIALGEYLESIGFLPHAKRIYLQLADDYPELNINLAQIAAEDDAIEEAFLYLDKVSKDSPNYLSALLVMADLYDMEGLTEVAREKLLQAVGISPEPLVIFGLAEIDMSLQHFKEAIDYYAQLDNRQILELTGISTYQRIGRAYASLGKFEAAIEFLEKAVAIEYEDETVFELATLMYDQENYQKANLYFKQLETINPDYPGYEYGYALSLHEEHKTSEALRLVQQGLRKNAFDSQLLLLASQLSYELHDRQNAENYLLQAKEVAVDDEEILMRLVTLYFDAERFEEVIALNRETIDNVLTKWTIAKAYHALEQEEVALALYNEISADLAENPEFLQDYAYLLREFGQFHKAIQMATAYLRQVPDDVNMQDFLDHIKHQQSE

SEQ ID NO: 2701 - DNA, 1680 bp, Streptococcus agalactiae
atgacagaatcacataatcaatatggggctgacttaattgtcgatagcctcattaatcatgatgtcaaatatgtttttggtatcccaggagctaagattgaccgcgtatttgacactctagaagataaaggtccagagttaattgttgctcgtcatgagcagaacgcgacttttatggctcaggctgtcgggcgtattacgggagaaccaggagttgttattgcaactagtggacctgggatctcgaacttggcaacagggttagttactgcgacagatgaaggtgatgctgttctagcaattggtggacaggttaagcgaggagatttattgaaacgtgctcatcaatcaatgaataacgttgctatgctggaacctattacaaaatattctgctgaggttcatgaccctaatactttgtcagaaactgttgcaaacgcctatcgtcttgctaaatctggtaaaccaggagcaagttttatctctattcctcaagacgttacagacagtccagtctcagtaaaagcaatcaaacctcttagtgcacctaaattgggttcggcatctgttttagatattaattatttagcgcaagctattaacaatgctgttttaccggtactgttattaggaaatggcgcatcttcagagggagtaactgctgccgtacgtcgacttcttgatgctgttaaactaccagtagtagaaactttccaaggtgcgggtattgtgtcacgtgagctcgaggatgaaacattctttggtcgtgtaggcctcttccgtaatcaacctggagatatgcttttgaagcgtgcagacctagttattgctatcgggtatgaccctattgaatatgaggcgcgtaactggaatgctgaaatttctgctcgtattattgttattgacgttgaacaagcagaaattgatacgtatttccaacccgagcgagaactgattggagacatggcacatacacttgatttacttttaccagctattaaaggatatgaattgccagaaggttcaaaagagtatttgaaaggtcttcgtaataatattgaaaacgttagcgatgttaaatttgatcgtgactcagctcatggacttgttcatcctcttgatctcattgatgtactccaagaaaataccaccgatgacatgactgttacagttgatgtgggaagccattatatttggatggctcgctactttaaatcatatgaagcgcgtcacttgcttttctcaaacggaatgcaaacattaggagttgctctaccttgggcaatttctgcggctcttttgcgtcccaacacaaaagttatttcagtttctggtgatggtggcttcttattctcagctcaagagttagaaactgcagttcgtcttcatctaccaattgttcacattatttggaacgatggaaaatataacatggttgaattccaagaagaaatgaagtatgggcgttcttcaggtgttgactttggaccagttgattttgtaaaatacgctgaaagtttcggtgctaaaggttaccgtgtagacagcaaagacagttttgaagaaacactcaaacaagctctaatcgatgctgaaaatggaccagtgttgattgatgtgcctattgactataaagataacgtgacactaggtgaaacaatcttacctgacgagttctac

SEQ ID NO: 2702 - protein, 560 aa, Streptococcus agalactiae
MTESHNQYGADLIVDSLINHDVKYVFGIPGAKIDRVFDTLEDKGPELIVARHEQNATFMAQAVGRITGEPGVVIATSGPGISNLATGLVTATDEGDAVLAIGGQVKRGDLLKRAHQSMNNVAMLEPITKYSAEVHDPNTLSETVANAYRLAKSGKPGASFISIPQDVTDSPVSVKAIKPLSAPKLGSASVLDINYLAQAINNAVLPVLLLGNGASSEGVTAAVRRLLDAVKLPVVETFQGAGIVSRELEDETFFGRVGLFRNQPGDMLLKRADLVIAIGYDPIEYEARNWNAEISARIIVIDVEQAEIDTYFQPERELIGDMAHTLDLLLPAIKGYELPEGSKEYLKGLRNNIENVSDVKFDRDSAHGLVHPLDLIDVLQENTTDDMTVTVDVGSHYIWMARYFKSYEARHLLFSNGMQTLGVALPWAISAALLRPNTKVISVSGDGGFLFSAQELETAVRLHLPIVHIIWNDGKYNMVEFQEEMKYGRSSGVDFGPVDFVKYAESFGAKGYRVDSKDSFEETLKQALIDAENGPVLIDVPIDYKDNVTLGETILPDEFY

SEQ ID NO: 2703 - DNA, 762 bp, Streptococcus agalactiae
gtgaaacaatcttacctgacgagttctactaagacgaggtctaatatgtcagaaacagttaaattatttcaatacagtaccttgagttcactgatggcaggattgtacaaaggcagtctaactatcggagaattattaactcacggtgacttaggaatcggtactgttcatatgattgatggtgaattgattgtattggatgggaaagcttatcaagctattggtacagatggtaaagcagagattatccaattatcagatgatgtgacagtaccctatgcagcggttttaccacaccatatccaaaaacaatttgatatcaatgctgagatagataataaggatttggaagagatgattctaaaaaactttgaaggtcaaaatctctttaagtctttaaaaatcaaaggaacgttttcaagaatgcacgttcgtatgattccaaaatctccacaacataaacgttttgcagatattgcatctaatcagccagaatttaccagagagaatgtatctggtacgttggttgggatttggacgccggaattatttcatggtgtgggggtaaaagggttccatgtccactttatttcagacgatttaactttcggtgggcatgttatggattactcgctcacacaaggaaaagttgaaattggaaaggttgaccaacttgaccaatgtttcccaactcaagatcaagaatttttgaaagctaactttgacctacaaaagcttagagaagatattgatttaagtgaa

SEQ ID NO: 2704 - protein, 254 aa, Streptococcus agalactiae
MKQSYLTSSTKTRSNMSETVKLFQYSTLSSLMAGLYKGSLTIGELLTHGDLGIGTVHMIDGELIVLDGKAYQAIGTDGKAEIIQLSDDVTVPYAAVLPHHIQKQFDINAEIDNKDLEEMILKNFEGQNLFKSLKIKGTFSRMHVRMIPKSPQHKRFADIASNQPEFTRENVSGTLVGIWTPELFHGVGVKGFHVHFISDDLTFGGHVMDYSLTQGKVEIGKVDQLDQCFPTQDQEFLKANFDLQKLREDIDLSE

SEQ ID NO: 2705 - DNA, 1653 bp, Streptococcus agalactiae
atgtcttttgatggattttttttacatcacctcacaaatgaattacaagaacagattgaaaaaggacgtatccaaaaagttaaccaaccttttgaccatgaattggtattaacaatacgcaacaatcgtcgcaactataaactactcctatctgctcatcctgtatttggacgtatccaaactaccgaagcaaatttccaaaatcctcaaaatccaaatacttttacaatgatcatgagaaagtatttgcaaggtgcagtgattgaaaccattcaacaaattgaaaatgaccgtatattagaaatcgtcgtgtctaataaaaacgaaatcggtgatcacattaaagcaacacttgttgttgaaatcatgggaaaacacagtaacattatcttgattgataaaaatgaacataaaattattgaatcaattaagcatgttggtttctcacaaaactcctatcgtactatccttcctggttcgacttacattgccccacccaaaacaaaagcaatcaatccttttgatatttctgatcaaaccctatttgagctgcttcaaaccaatgatctaagccctaaaaacctccaacagctcctccaaggtttaggacgcgatactgcgctagaattatctcactgtttgaaagacaataaacttaacgattttcgtcaattcttttcgagagaatattatcccagcctaacagaaaaatccttttccgctgtccaattctcaagcagtcacgaaacatttcagtctcttggacaattgttagattattactaccaagagaaggctgaaaaagatcgcatagcacagcaagctagtgacctcatccaccgtgttcaaagtgagttagagaaaaatatcaaaaaactagctaagcaacaagacgaacttctagctactgaaaatgcagaggagtttcgccaaaaaggagagcttctaactacctatctctctatggtaccaaataatcaagatgtcgttgtgcttgataattattacaccaaccaaaccattgagatttcacttgatcgagctttaacacccaaccaaaatgcccaacgctactttaaaaaatatcaaaaattaaaagaagctgtaaaacatttaaaaggaattatttcagatacggaaaatacaatcacctaccttgaatctgttgaaacatcgctaaatcatgcttctatggaagatatcaatgatattcgtgaagaacttgttgaaactggatttattaagcgacgcgcacatgataaacaacataagcgtaaaaaacctgaacaatatttagcatccgatggcaagactattattatggtgggacgtaataatctccaaaatgacgagttaacatttaaaatggctcgtaaaggggagttgtggtttcatgccaaggatatccccggaagccatgtgttaattcgggataacctcaatccaagtgacgaggttaagacagatgccgccgagttagctgcttattactctaaagctcgtctctccaatcttgttcaagtagacatgattgaagcaaaaaaactcaataaaccaagtggtactaagccaggttttgtaacttacactggtcaaaaaaccttacgagtcactcccacacaagaaaaaatagatagccttaaactaaaaaaa

SEQ ID NO: 2706 - protein, 551 aa, Streptococcus agalactiae
MSFDGFFLHHLTNELQEQIEKGRIQKVNQPFDHELVLTIRNNRRNYKLLLSAHPVFGRIQTTEANFQNPQNPNTFTMIMRKYLQGAVIETIQQIENDRILEIVVSNKNEIGDHIKATLVVEIMGKHSNIILIDKNEHKIIESIKHVGFSQNSYRTILPGSTYIAPPKTKAINPFDISDQTLFELLQTNDLSPKNLQQLLQGLGRDTALELSHCLKDNKLNDFRQFFSREYYPSLTEKSFSAVQFSSSHETFQSLGQLLDYYYQEKAEKDRIAQQASDLIHRVQSELEKNIKKLAKQQDELLATENAEEFRQKGELLTTYLSMVPNNQDVVVLDNYYTNQTIEISLDRALTPNQNAQRYFKKYQKLKEAVKHLKGIISDTENTITYLESVETSLNHASMEDINDIREELVETGFIKRRAHDKQHKRKKPEQYLASDGKTIIMVGRNNLQNDELTFKMARKGELWFHAKDIPGSHVLIRDNLNPSDEVKTDAAELAAYYSKARLSNLVQVDMIEAKKLNKPSGTKPGFVTYTGQKTLRVTPTQEKIDSLKLKK

SEQ ID NO: 2707 - DNA, 1728 bp, Streptococcus pyogenes
ttgcaagctctttcgtccatatttttagtcaagtatttgtggtataatgaagagattagaattcagaaaggagaaaccatgtcttttgacggctttttcttacaccatttaaccaacgaattaaaagagaacttgctttacggtcgtatccaaaaggtcaatcaaccctttgaacgggaacttgtcttaaccattcgtaaccatcgcaagaattataaattgctattgtctgcccatcctgtttttggaagggtacaaatcacccaagcagactttcaaaatcctcaggtacctaatacctttaccatgattatgcgtaaatacctccagggtgcagtcattgagcagttagaacagattgataatgaccgcattatcgaaatcaaggtatctaataaaaatgaaatcggagatgctattcaggcaaccctaatcattgaaatcatggggaagcacagtaatatcatcttggtggaccgtgcagaaaataaaatcatcgaatccattaaacatgttggtttttcacaaaactcttaccgcaccattttacctggctctacctacattgagcctcctaaaacagctgctgttaatccttttacaattacagatgtgcctctatttgaaatcctccaaacacaagaactaacagttaaaagcttgcaacagcattttcaaggtttggggcgagacaccgcaaaagagttggccgagcttctgaccacagacaaattaaaacggttccgtgagttttttgctagacctactcaggcaaatctgaccacagcttcttttgcgcctgttcttttctcagatagtcatgcgacgtttgagactttgtctgacatgcttgaccacttttatcaagacaaggctgagcgtgaccgtatcaatcagcaagccagtgatttgatccaccgtgtgcaaactgaactggacaaaaatcgcaacaagctaagtaagcaagaagctgagctgctagccactgaaaatgctgagttgttccgtcaaaaaggagaattattgaccacctacctcagtctggtcccaaacaaccaagactctgtgattttagacaattattatacaggggaaaaaattgagattgccttagacaaggctctgacaccaaatcaaaatgctcaacgttattttaaaaaataccaaaagctaaaagaagctgtcaaacacttatctggattgattgccgataccaagcaaagtattacttactttgagagcgtagactacaatttatctcaagcaagtatcgacgacatcgaagatattcgcgaagaattatatcaggctggctttttgaaaagtcgccaaagagacaaacgccataaacgtaaaaagcctgagcagtacctggcttcagatggaacaaccattctcatggtgggacgcaataacttgcaaaatgaagaactcacctttaaaatggctaaaaaaggagaactctggttccatgctaaggatatccctggaagtcatgtcatcatcaaagacaatcttgacccaagtgacgaggttaaaactgatgctgccgaactagctgcttattattcgaaagctaggttatcaaatctcgttcaggtcgatatgattgaagctaaaaaattacacaaacctagtggcgccaagccaggatttgtgacttatactggtcaaaaaactttacgggttactcctgaccaagccaaaattctctctatgaaattatcc

SEQ ID NO: 2708 - protein, 576 aa, Streptococcus pyogenes
LQALSSIFLVKYLWYNEEIRIQKGETMSFDGFFLHHLTNELKENLLYGRIQKVNQPFERELVLTIRNHRKNYKLLLSAHPVFGRVQITQADFQNPQVPNTFTMIMRKYLQGAVIEQLEQIDNDRIIEIKVSNKNEIGDAIQATLIIEIMGKHSNIILVDRAENKIIESIKHVGFSQNSYRTILPGSTYIEPPKTAAVNPFTITDVPLFEILQTQELTVKSLQQHFQGLGRDTAKELAELLTTDKLKRFREFFARPTQANLTTASFAPVLFSDSHATFETLSDMLDHFYQDKAERDRINQQASDLIHRVQTELDKNRNKLSKQEAELLATENAELFRQKGELLTTYLSLVPNNQDSVILDNYYTGEKIEIALDKALTPNQNAQRYFKKYQKLKEAVKHLSGLIADTKQSITYFESVDYNLSQASIDDIEDIREELYQAGFLKSRQRDKRHKRKKPEQYLASDGTTILMVGRNNLQNEELTFKMAKKGELWFHAKDIPGSHVIIKDNLDPSDEVKTDAAELAAYYSKARLSNLVQVDMIEAKKLHKPSGAKPGFVTYTGQKTLRVTPDQAKILSMKLS

SEQ ID NO: 2709 - DNA, 1002 bp, Streptococcus agalactiae
atgaaaaataaagggctgatagctacgctaattctattgactatattagtggttggagaattattttataacaaatcagaaaaacgtcttaatttatcagaaaagcaagttgttaaaattggtattttacagtatgtaacccatgatgctttggatgctattgaaaagggagttgaagatggtctagctcaagaaggatataaagggaaaaaagttaaattaaccgttttaaacgccgaagctgatcaaagtaaaattcaagcgatgagtaaacaattagttaatcatcacaatgatattttgattggaattgcgacaccatcagcacaaggtttagcagcttcgactaaggacactcctataatcatgggagctgtttctgatcctttaggggccaagttagtaacgaatatgaagaaaccaacaactaatgttacaggattatcaaacgttgttccgaccaagcaaactgtgcaattaatcaaggatataactcccaatattaaacgtataggaattctttatgctagtagcgaagataattctgtatcacaagtaactgagtttacaaaatatgctcaaaaagcagggctagaagttcttaaatattctgtaccatctacaaatgaaattaagacaagtatgtcagtcatgaccaaaaaagtagacgctgtctttgttccacaagataatactattgcgagtgcttttagaacagttatcgtagcagcaaaccaagctaatatacctgtgtattccagtgttgataccatggttgaacaaggaagtatagcatcagtagcgcagagtcaatatggcttagggttagaaactgcaaaacaggccattaaagtcctaagagggaagccggttaaagatgtaccagtcaaagttattgatacagggaagccaagcctcaatttgaaagcagccaaacacttaggaattaaaattcctaagaagattatgaaacaggcagaaattaccgttaaggttgacgat

SEQ ID NO: 2710 - protein, 334 aa, Streptococcus agalactiae
MKNKGLIATLILLTILVVGELFYNKSEKRLNLSEKQVVKIGILQYVTHDALDAIEKGVEDGLAQEGYKGKKVKLTVLNAEADQSKIQAMSKQLVNHHNDILIGIATPSAQGLAASTKDTPIIMGAVSDPLGAKLVTNMKKPTTNVTGLSNVVPTKQTVQLIKDITPNIKRIGILYASSEDNSVSQVTEFTKYAQKAGLEVLKYSVPSTNEIKTSMSVMTKKVDAVFVPQDNTIASAFRTVIVAANQANIPVYSSVDTMVEQGSIASVAQSQYGLGLETAKQAIKVLRGKPVKDVPVKVIDTGKPSLNLKAAKHLGIKIPKKIMKQAEITVKVDD

SEQ ID NO: 2711 - DNA, 996 bp, Streptococcus pyogenes
atgaaaaacaagagtttaatagctaccctccttgttttaactgtaatagtgataggctctctattatcaaaaggagtatcaaaggaaaaccgtgatttggctaaccaacaaaacattacaattggcatcttacaattcgttactcatgaggctcttgatgatattaagcgaggtattgaagatcaactcaaaaagcagatgcctcaaaaacaaaatgtagtgattaaggttatgaatgctgagggggatcagagtaaaatccaaacaatgagtaggcaattagtgcaatcaggaagtgatatcgtgattggtatcgcaaccccggcggcgcaaggcttagcagccaccagcaaggatatcccagttgtcatgtcagcagtatctgatccagtaggatctagattagtgatgcaattggatcaacctgaagctaatgtaactggtctatctaataaagtgcctgttaaacagacaattgatttaatgaaaaagctgacaccacatgtcaaaacagttggaattttatatgcaagtaatgaggataattccttatctcaagttaaagagtttaggcggttagctcgcaaaaagggctaccaagttatttcatacgcggttccttctactaatgaagttcctgccacgatgtcagttatgttaggtaaagtagacgcggtatttatcccccaagacaatactatagcaagtgcattttcatcagtcatgacaaccagcaaggctgcaaagattcctgtctacactagcgttgatcgaatggttgaaaaaggtggtttggcagctatttctcaaaatcagtacgatttgggagttcaaacagctaatcaggtgttaaaattaatcaaaggaaagcgtgttgtagatgttcctgtcaaagttgtggatattggtcaaccgctaattaataagaatgtagcagcagaattaggtattgctattaaaaaagaagattttccttcagcttcttttattgagaat

SEQ ID NO: 2712 - protein, 332 aa, Streptococcus pyogenes
MKNKSLIATLLVLTVIVIGSLLSKGVSKENRDLANQQNITIGILQFVTHEALDDIKRGIEDQLKKQMPQKQNVVIKVMNAEGDQSKIQTMSRQLVQSGSDIVIGIATPAAQGLAATSKDIPVVMSAVSDPVGSRLVMQLDQPEANVTGLSNKVPVKQTIDLMKKLTPHVKTVGILYASNEDNSLSQVKEFRRLARKKGYQVISYAVPSTNEVPATMSVMLGKVDAVFIPQDNTIASAFSSVMTTSKAAKIPVYTSVDRMVEKGGLAAISQNQYDLGVQTANQVLKLIKGKRVVDVPVKVVDIGQPLINKNVAAELGIAIKKEDFPSASFIEN

SEQ ID NO: 2713 - DNA, 861 bp, Streptococcus agalactiae
atgattatttcatcagtttcacaaggtttattatgggggatattaggattagggatatacttaacctttagaatcttaaaatttccagacatgacaacagagggctccttccctctagggggagcggtttgtgttaccttaatgaatcaaggggttaatcctattttggcgacgattctaggcatgctatcagggatgttagcgggatttgttactggtttactttatactaaaggaaagataccgacgattttagcagggattttagtaatgacctcatgccactctattatgctaatggttatgaaaagagcaaatctaggtttaaatgagattcaaacattgaaagattttcttccgttttcaaatgatttaaatcttctcgtattaggcttgatagctattctcttggtgatttctgccttaatttattttctctatacacgcttggggcaagcttatattgcaacaggagataaccctgatatggcaaagagcttcggcattgataccgacaaaatggaaatgcttggcttaattgtatcaaatggcttaattgctttatcaggagctttagtaagtcaacaagatggatatgctgatgtatcaaaaggtataggtgttattgttattgggttagctagtattattattggagaggtactttactctactggtttaactctctttgaacgtttaattgctatagtggtgggttctattctttatcaatttttaataacggcagtaatcgccttaggatttaatacgaattacctaaaattatttagtgcaatagtgcttggaatttgtttaatggttcctgtcctaaaaacgaagattttgaaaggagtacgctta

SEQ ID NO: 2714 - protein, 287 aa, Streptococcus agalactiae
MIISSVSQGLLWGILGLGIYLTFRILKFPDMTTEGSFPLGGAVCVTLMNQGVNPILATILGMLSGMLAGFVTGLLYTKGKIPTILAGILVMTSCHSIMLMVMKRANLGLNEIQTLKDFLPFSNDLNLLVLGLIAILLVISALIYFLYTRLGQAYIATGDNPDMAKSFGIDTDKMEMLGLIVSNGLIALSGALVSQQDGYADVSKGIGVIVIGLASIIIGEVLYSTGLTLFERLIAIVVGSILYQFLITAVIALGFNTNYLKLFSAIVLGICLMVPVLKTKILKGVRL

SEQ ID NO: 2715 - DNA, 879 bp, Streptococcus pyogenes
atgaggaaaaatatgattatttcatcagtttcacaaggccttatatggggagttttaggattaggaatctacctgacctttaggattttaaacttccctgacatgactacagaaggttcttttcctttaggaggagctgttgcggtcaccgctattagcttagggtggaatccatttctatcaaccttacttggtatgttatcaggtgctttagcaggttttttaacagggctgttatatacgaaaggaaaaatgccaacacttttagcgggaattttggtgatgacgtcatgtaactccattatgctaatggtaatgggaagagcaaacttgggtttacatgatcataaacgtattcaggattgtttacctttttcaattgatttaaatagccttttaacaggtctgataactgttgtgattgttattagcgttttgatctatttcctttacactaatctaggtcaagcttatatcgctacgggagacaataaagatatggctaagagttttggtattaacacggattggatggaagttatgggacttgtggtttctaatagtttaatagctttatcaggtgctctagtgagccaacaagatggctatgcagatgtctcaaaagggattggagttattgttattggtttggcgagcataattgttggtgaagtactatactcaactggactgactcttttagaacgtttgattgctattgtaataggctcgattctttatcaatttttaatttcagtagttattacgctaggttttaatacaagttatttgaaattaattagtgctcttgttttagcactgtgcctcatgataccagtggtaaaagagcgcttctttaagggagtgaggttaacacga

SEQ ID NO: 2716 - protein, 293 aa, Streptococcus pyogenes
MRKNMIISSVSQGLIWGVLGLGIYLTFRILNFPDMTTEGSFPLGGAVAVTAISLGWNPFLSTLLGMLSGALAGFLTGLLYTKGKMPTLLAGILVMTSCNSIMLMVMGRANLGLHDHKRIQDCLPFSIDLNSLLTGLITVVIVISVLIYFLYTNLGQAYIATGDNKDMAKSFGINTDWMEVMGLVVSNSLIALSGALVSQQDGYADVSKGIGVIVIGLASIIVGEVLYSTGLTLLERLIAIVIGSILYQFLISVVITLGFNTSYLKLISALVLALCLMIPVVKERFFKGVRLTR

SEQ ID NO: 2717 - DNA, 813 bp, Streptococcus agalactiae
ttgtttaatggttcctgtcctaaaaacgaagattttgaaaggagtacgcttataatggtgatgaaaatcatagagttaaaagaagcaaccgtacaagtcagtaatggtttagcagaaatgaaaacgatattagatcatgttaatttgagtatttatgaacatgacttcattacaatattgggtggaaatggagctggaaaatcaacgctttttaatgtaattgcaggtaccttgatgttaagcagtggaaatatttacatcatgggacaagatgttactaatttatcagcagaaaaacgagctaaatatttatcacgggtatttcaagatccgaaaatgggaacagcacctaggatgacagttgctgaaaatttattagttgctaaatttcgaggtgaaaagagaccgctagttcctagaaagattattaactatacggaagaatttcaaaaattgattgctagaactggtaatggacttgatcgccatttagagacacctacaggtttattatcaggtggacaaagacaagcgcttagtttattaatggcaactttgaaaaaaccaaatctgttattattggacgaacacacagcagcgcttgatcctagaacaagtgtttcgcttatgggcttgactgatgagtttatcaaacaagattcgttgactgccttaatgattacacatcatatggaagatgctctcaaatatggaaatcgtgtattagtaatgaaagatggcaagattgtcagagatttaaatcaggcacaaaaaaacaagatggctatagctgactattatcaattatttgat

SEQ ID NO: 2718 - protein, 271 aa, Streptococcus agalactiae
MFNGSCPKNEDFERSTLIMVMKIIELKEATVQVSNGLAEMKTILDHVNLSIYEHDFITILGGNGAGKSTLFNVIAGTLMLSSGNIYIMGQDVTNLSAEKRAKYLSRVFQDPKMGTAPRMTVAENLLVAKFRGEKRPLVPRKIINYTEEFQKLIARTGNGLDRHLETPTGLLSGGQRQALSLLMATLKKPNLLLLDEHTAALDPRTSVSLMGLTDEFIKQDSLTALMITHHMEDALKYGNRVLVMKDGKIVRDLNQAQKNKMAIADYYQLFD

SEQ ID NO: 2719 - DNA, 756 bp, Streptococcus pyogenes
atgacaaaaattattgaattgatcaatgcaacagttgacgtagataatggttttgaagatgctaaaacaatattggacaatgtgacactaactatctatgaacatgattttttaactattttaggaggaaatggagctggaaaatcaaccctttttaatgtaattgcaggaacgctaagtttgacacgggggcaaattaggattcttggtcaggatgtgacgcattggccagcagaaaaaagagctctttacctatcgcgagtctttcaagattccaaaatgggaacagcccctcggatgacagtggctgaaaatctcttaatcgcacgtcaaagaggaggaaaacgctccttggcttctcgaaaaataacagagcacttagctagttttgaggatttggttaaacgaacaggaaatggcctagaaaagcatttagaaacaccagcaggtcttttgtctggtggacaaagacaagctttaagtttattaatggcaacgttgaaaaagccagctctcttattattagatgaacatacggctgctcttgaccctaagacgagtcaatctttaatgcaattgacagatgagtttgtgacaaaagatggcttaacagctttgatgattacccaccatatggaagatgcattaacttatgggaatcgtctgattgtaatgaaagatggaaacattattaaagatttaaatcaaatggaaaaagaacaactgacgattactgactattaccaactatttgat

SEQ ID NO: 2720 - protein, 252 aa, Streptococcus pyogenes
MTKIIELINATVDVDNGFEDAKTILDNVTLTIYEHDFLTILGGNGAGKSTLFNVIAGTLSLTRGQIRILGQDVTHWPAEKRALYLSRVFQDSKMGTAPRMTVAENLLIARQRGGKRSLASRKITEHLASFEDLVKRTGNGLEKHLETPAGLLSGGQRQALSLLMATLKKPALLLLDEHTAALDPKTSQSLMQLTDEFVTKDGLTALMITHHMEDALTYGNRLIVMKDGNIIKDLNQMEKEQLTITDYYQLFD

SEQ ID NO: 2721 - DNA, 1659 bp, Streptococcus agalactiae
atgagcgacataaaaatcatggctcttggaggtgttcgtgaaaacggaaaaaacctatatgtagtagaagtcaatgattctatctttgttttggatgctggactcaaatatcctgaaaatgaacaactgggtgttgatgttgttattccaaatcttgattacttaattgaaaataaaaaacgtgttcaggggattttcttaacccatggacatgcggatgctattggtgcattgccttatattatcgccgaagtcaaagcacctgtgtttggctcacctctcacaattgaattagctaagttattcgttaaaaatagtacagcagtcaagaaattcaataatttccatgtgattgatagtgaaacggaaattgaatttcaagatgcggtgatttcgttctttaaaacgactcattcaattccagagtcaatgggaattgttattgggacaaaagagggaaatatcgtttacacaggtgactttaaatttgatcaagctgcaaggaaatattaccaaacagatctggcgcgtttagctgaaattggtcgtgatggtgttttagcacttttatcagattctgcaaatgctacaagcaatgagcaagttgctagcgaatatgaggtcggtgatgaaattaagagcgttattgaagacgcagaaggtagagtcatcgtagcggcagttgcaagtaatctcattcgtattcaacaagtctttgatgcagcggcagaaaacggtcgtcgagtagttttaacgggttttgatattgaaaatattgttcgtacggccattcgtatgaaacgcattcatattgctgatgaaaatatgattatcaaacctaaagatatgacacgttacgaagataacgaattattaatccttgaaactggacgtatgggagagccgataaatggtctccaaaaaatggcgatcggacgtcatcgttatgttcaaattaaagatggtgatttagtatttatcgtaacaacaccaagtattgcaaaagaggcagttgtagcgcgtgttgaaaatctgatttataaagctggtggctcagttaaattgataacacagaatttgcgcgtatcaggtcatgcaaatggtcgcgaattacaattattaatgaatctattgaaacctaaataccttttcccaattcaaggagagtatagggatttgtcagcacatgcgggcttagctcaagaggtaggaatgtcagcagatgatatttatattgtgaagcgtggtgacatcatggttcttgaaaaagatggcttcttccatagtggatctgttcctgctggagatgttatgattgatggaaatgctattggtgacgttggtaatattgtacttcgtgaccgcaaggtattatctgaagatggaatttttattgttgttataactgtcagcaaaaaagaaaagaaaattatttctaaagctcgtgttaatacgcgtggttttgtgtatgtgaaaaaaagcagagatattttgcgtgagagcgcagaattagttaatacaacggtagaagattacttaagtaaagatacatttgactggggtgaacttaaagggaaagtgcgtgatgaggtcagcaagttcttatttgaccaaacgaaacgtcgcccagcaatccttcctgtggttatggaagttcgt

SEQ ID NO: 2722 - protein, 553 aa, Streptococcus agalactiae
MSDIKIMALGGVRENGKNLYVVEVNDSIFVLDAGLKYPENEQLGVDVVIPNLDYLIENKKRVQGIFLTHGHADAIGALPYIIAEVKAPVFGSPLTIELAKLFVKNSTAVKKFNNFHVIDSETEIEFQDAVISFFKTTHSIPESMGIVIGTKEGNIVYTGDFKFDQAARKYYQTDLARLAEIGRDGVLALLSDSANATSNEQVASEYEVGDEIKSVIEDAEGRVIVAAVASNLIRIQQVFDAAAENGRRVVLTGFDIENIVRTAIRMKRIHIADENMIIKPKDMTRYEDNELLILETGRMGEPINGLQKMAIGRHRYVQIKDGDLVFIVTTPSIAKEAVVARVENLIYKAGGSVKLITQNLRVSGHANGRELQLLMNLLKPKYLFPIQGEYRDLSAHAGLAQEVGMSADDIYIVKRGDIMVLEKDGFFHSGSVPAGDVMIDGNAIGDVGNIVLRDRKVLSEDGIFIVVITVSKKEKKIISKARVNTRGFVYVKKSRDILRESAELVNTTVEDYLSKDTFDWGELKGKVRDEVSKFLFDQTKRRPAILPVVMEVR

SEQ ID NO: 2723 - DNA, 1659 bp, Streptococcus pyogenes
atgactgatattaaaatgattgccttgggaggggtccgtgaatacggaaaaaacttctatttggtagaaattaacgattctatgtttattttagacgcagggctcaagtaccctgaaaatgagcaacttggggtagatttagtcatccccaatttagattatgtaattgaaaacaaaggtaaagtacaagggattttcttgagtcatggccatgctgacgccattggagcccttccttatttgttagctgaagtatcagctcctgtatttggatctgaattgactattgaattagccaagctatttgtgaaaagtaataacagcactaagaaatttaataattttcatgtggtagacagtgatactgaaattgaatttaaagatggcctagtttcgttctttagaacaacgcattcaatcccagaaagtatgggtattgttattggaacagataaaggaaacattatttataccggtgacttcaaatttgatcaagcagcaagagaaggttatcagacggatttgctacgtttagctgagattgggaaagaaggggttctagctcttttatcagattcagtcaatgcgacaagcaacgatcagattgccagcgaatctgaagttggtgaagaaatggacagtgttatctctgatgctgatggccgtgtcattgtagctgcagtagcctcaaatcttgttcggattcagcaagtatttgattccgccactgcccatgggcgtcgtgttgttttaaccggaacagatgcagaaaatattgtcagaacagctttacgtctagaaaaattaatgattacggatgagcgtcttttaattaaacctaaggatatgtctaaattcgaagaccatgaattaatcatccttgaagctggtcgtatgggtgagccaattaatagcttacaaaaaatggcagcgggacgtcaccgttatgttcaaatcaaagaaggagaccttgtttatattgtaacaacaccaagtacggctaaagaagctatggtggcgcgtgttgaaaacttgatttacaaggccggtggttctgttaaattaatcactcaaaacttacgtgtttcaggccatgctaatgggcgtgatttgcaactattgatgaatttgttaaaaccccagtatctttttccagtacaaggagaatatcgtgatttagctgcccatgcaaagctagctgaagaagttggtatttttccagagaatattcatattctgaagcgtggcgatatcatggtgcttaatgacgaaggttttctccatgaaggaggtgtacctgccagtgatgtcatgattgacggtaatgctatcggtgatgtgggtaatatcgttttacgagaccgtaaagtcttgtcagaagatggtattttcattgttgctattactgtttctaaaaaagaaaaacgcattatttctaaggctaaagttaatacgcgtggatttgtgtatgtcaagaaaagtcatgatattttaagagaaagtgcagaattagttaatacaactgttggcaattacttaaaaaaagatacctttgactggggcgaattaaaagggaatgtcagagatgatttgtctaaattcttatttgaacaaaccaaaaggcgcccagcgattctgccggttgtgatggaagttcgt

SEQ ID NO: 2724 - protein, 553 aa, Streptococcus pyogenes
MTDIKMIALGGVREYGKNFYLVEINDSMFILDAGLKYPENEQLGVDLVIPNLDYVIENKGKVQGIFLSHGHADAIGALPYLLAEVSAPVFGSELTIELAKLFVKSNNSTKKFNNFHVVDSDTEIEFKDGLVSFFRTTHSIPESMGIVIGTDKGNIIYTGDFKFDQAAREGYQTDLLRLAEIGKEGVLALLSDSVNATSNDQIASESEVGEEMDSVISDADGRVIVAAVASNLVRIQQVFDSATAHGRRVVLTGTDAENIVRTALRLEKLMITDERLLIKPKDMSKFEDHELIILEAGRMGEPINSLQKMAAGRHRYVQIKEGDLVYIVTTPSTAKEAMVARVENLIYKAGGSVKLITQNLRVSGHANGRDLQLLMNLLKPQYLFPVQGEYRDLAAHAKLAEEVGIFPENIHILKRGDIMVLNDEGFLHEGGVPASDVMIDGNAIGDVGNIVLRDRKVLSEDGIFIVAITVSKKEKRIISKAKVNTRGFVYVKKSHDILRESAELVNTTVGNYLKKDTFDWGELKGNVRDDLSKFLFEQTKRRPAILPVVMEVR

SEQ ID NO: 2725 - DNA, 846 bp, Streptococcus agalactiae
ttgatagtgttaagaggttaccaaattttggtagcctttcttgctagaatggaggtttttatggcattttttaatattgaatatcactctaaggtactaggaacggaacgtcaagtcaatgttatttacccagatgcttttgagatgtctgatgataaaattgatgattgtgacattcctgttttgtatcttctccatggaatggggggaaatgagaattcttggcaaaaacgcacaaatatagagcgtcttttacgtcatactaatcttatcgtcgtgatgccatcaacagacttagcatggtataccaacacaaagtatgggttggattattttgatgcaatagctatcgagttaccaaaagttttgaaacgtttctttcctaatatgtctgataagagagagaaaaatttcattgccggattatctatggggggatatggagcatataaaatagctctactgactaatcgtttttctcatgctgcctctttgtcaggtgcactttcttttgactttgatttattattcaataatggcaacaataacattaactattggtcgggaatttttggcgatttgaataacactgataacatagagcgtcattcactaaggcgttacgttgagtcttttgatatgaagactaaattttatgcatggtgtggttatgaagattttctttttgaagctaatgaagtcgcaattgatgaacttcgtcaattaggtttaactattgactatttcaatgatcatggtaaacatgaatggtattactggaatcaacaattagaaaaagtcttagaatggctccctgttgattatgtcaaagaagagcgcctttct

SEQ ID NO: 2726 - protein, 282 aa, Streptococcus agalactiae
MIVLRGYQILVAFLARMEVFMAFFNIEYHSKVLGTERQVNVIYPDAFEMSDDKIDDCDIPVLYLLHGMGGNENSWQKRTNIERLLRHTNLIVVMPSTDLAWYTNTKYGLDYFDAIAIELPKVLKRFFPNMSDKREKNFIAGLSMGGYGAYKIALLTNRFSHAASLSGALSFDFDLLFNNGNNNINYWSGIFGDLNNTDNIERHSLRRYVESFDMKTKFYAWCGYEDFLFEANEVAIDELRQLGLTIDYFNDHGKHEWYYWNQQLEKVLEWLPVDYVKEERLS

SEQ ID NO: 2727 - DNA, 783 bp, Streptococcus pyogenes
atggcaagtattgcaattgaataccattcggtagttttaggaatggagcgtaaggtaaatgtgatttatcctgaccagtctgaaatccctaaaaaagatcaaggggataaggatattcctgttttatatttgttacatggtatgggaggcaatgaaaactcttggcaaaaacgaacagctattgaacgcttgttgcggcataccaatttgatagtcgttatgccttcgacagacctaggttggtatacagacacggcttatggacttaactattatcgggcgttgtcacaagagttaccgcaggtcttagcagctttctttcctaatatgacccagaaacgagaaaaaacctttgttgctgggctctctatgggtggctatggtgcctttaagtgggcactcaaaagcaatcggttttcttatgcggcatcgttttcaggcgctttggatttttctcctgagaccttgcttgagggaaaactgggagaattagcctattggcagggcgtttttggccagtttgatgaccctgaccttgacaagcattaccttaaaaatatggtggcagaaagtgatggaaaaaccaaattttatgcttggtgtggctatgaggattttctttttgccactaatgaaaaagctattgctgattttcaggctcaaggtcttgacattgattatcataaaggtcatggtaaacatgagtggtactattggaaccagcaattagaagtcctgttagagtggttaccgataaactaccaaaaagaagaaaggttgtct

SEQ ID NO: 2728 - protein, 261 aa, Streptococcus pyogenes
MASIAIEYHSVVLGMERKVNVIYPDQSEIPKKDQGDKDIPVLYLLHGMGGNENSWQKRTAIERLLRHTNLIVVMPSTDLGWYTDTAYGLNYYRALSQELPQVLAAFFPNMTQKREKTFVAGLSMGGYGAFKWALKSNRFSYAASFSGALDFSPETLLEGKLGELAYWQGVFGQFDDPDLDKHYLKNMVAESDGKTKFYAWCGYEDFLFATNEKAIADFQAQGLDIDYHKGHGKHEWYYWNQQLEVLLEWLPINYQKEERLS

SEQ ID NO: 2729 - DNA, 708 bp, Streptococcus agalactiae
atgagaacactatttagaatgatatttgctattccaaagtttatctttagattgatttggaatatcatttggggaatattcaagacagttcttgttattgcgattattttatttggcttgtattactatgcgaatcacagtcaatcagaatttgctaatcaacttagtgacattattcagacaggaaaaacatttttaaattttgctgacactaatcagctcaaaaattcctttactaatctagctacggataatgttcatcattcagaaaataccagatgggataaaaatcaggcaactatctatatagcaactagagattctgagttggtctctgcttacaagcaagcaatctccaattggaatgcaacaggtgcttttgtgttacaaacaacagataatcctaatgctgatattattgctaaggattactcagatgctaaaacacaagctgcgggtgtagctgaaaccgagaaaaatgctttaactaatcgtatttcaaaggtaacagttgaattaaacacattttaccttaagaataaacagtttggttatgaccatactaggattgttaatacggccgaacatgaattaggacatgcgttaggtctaggacataatgatcaacaacattccgttatgcagtcaaaaggttcgcattatggcattcaagaagttgatattcaaacgctaaaaaacttatatgca

SEQ ID NO: 2730 - protein, 236 aa, Streptococcus agalactiae
MRTLFRMIFAIPKFIFRLIWNIIWGIFKTVLVIAIILFGLYYYANHSQSEFANQLSDIIQTGKTFLNFADTNQLKNSFTNLATDNVHHSENTRWDKNQATIYIATRDSELVSAYKQAISNWNATGAFVLQTTDNPNADIIAKDYSDAKTQAAGVAETEKNALTNRISKVTVELNTFYLKNKQFGYDHTRIVNTAEHELGHALGLGHNDQQHSVMQSKGSHYGIQEVDIQTLKNLYA

SEQ ID NO: 2731 - DNA, 324 bp, Streptococcus pyogenes
atgaaacaattactggcgatcattttgtggctgcctaagctaatagtgaaaatgttttggcaccttatcaaagggtttttacaaactatcttattagtaacgattattattatagggctgatgtactattctaatcacagtgattccgttttagccaataagatctcgatagttactgagcaagtggtgcaaatttttgatatcttaacacaaaagccatctgcaaagacgcgtcatgggagtggtaatagtcattccactttccttgttagcgctaaagaaggtaatcaacgacttaaaaagagttcgatttcttttggaaac

SEQ ID NO: 2732 - protein, 108 aa, Streptococcus pyogenes
MKQLLAIILWLPKLIVKMFWHLIKGFLQTILLVTIIIIGLMYYSNHSDSVLANKISIVTEQVVQIFDILTQKPSAKTRHGSGNSHSTFLVSAKEGNQRLKKSSISFGN

SEQ ID NO: 2733 - DNA, 669 bp, Streptococcus agalactiae
atggacgaactaaaaaaacttgctggagtgaccgctgcaaaatacgttaaaaacggtatgattgtaggtttagggacaggttctacagcatatttttttgttgaagaaattggacgccgtgtcaaagaagagggattgcaagtcgtaggcgttacaacgtcaaaccgtacgactgagcaggcaagaggattaggtattccgttgaaatcagcagatgatattgatgtcattgatgtcactgtggatggagcagatgaagtagaccctgattttaatggtatcaagggtggcggtggtgcgctgctcatggaaaaaatagtagctactccaactaaagaatatatctgggttgtcgatgagagcaaacttgttgaaacgttaggtgcatttaaattgcctgttgaggttgttagatatggttctgagcgtctttttcgggtttttaaatcaaaaggttattgtccttctttccgtgaaacagaaggtgaccgctttatcactgatatggggaactacattatcgacctagatttgaaaaaaatagaggatccaaagcagttagcgaatgaacttgaccatacagttggtgttgttgaacatggtttatttaatggtatggttaataaagttatagtagcaggcaaaaacggtcttgacatacttgaaaaa

SEQ ID NO: 2734 - protein, 223 aa, Streptococcus agalactiae
MDELKKLAGVTAAKYVKNGMIVGLGTGSTAYFFVEEIGRRVKEEGLQVVGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVAGKNGLDILEK

SEQ ID NO: 2735 - DNA, 681 bp, Streptococcus pyogenes
atggaagcactcaaaaaaattgccggtgttaccgctgcgcaatatgtgactgatggcatgaccattgggcttggaactgggtcaacggcttactattttgttgaggaaattggccgtcgcgtaaagcaagaaggactgcaagtggttggtgtgactacgtcaagtgtgactagcaagcaagcagaagtcttgggcattcctttaaaatcgatagatgatattgatagcattgacctcaccgtagatggtgctgatgaagtggataagaatttcaatggaatcaagggtggcggcgcagccttactaatggaaaaaattgttgcaacaccaacaaaagaatacatctgggttgttgatgcttctaaaatggtagagcatctgggtgcctttaagttaccagtcgaagtcgttcaatatggtgctgatcgtttgttccgtgtctttgaaaaagctggttacaaaccgtcttttcgtatgaaaggtgatagtcgtttggtgacagacatgcaaaactatattattgatcttgatttgggttgtattaaagatcctgttgcttttggtcacctgctagatggaacagttggtgttgtggaacacggtctctttaatggtatggttgataaggtgattgttgctagtaaagacggcgttactgttttagaagcgcctacagcaggc

SEQ ID NO: 2736 - protein, 227 aa, Streptococcus pyogenes
MEALKKIAGVTAAQYVTDGMTIGLGTGSTAYYFVEEIGRRVKQEGLQVVGVTTSSVTSKQAEVLGIPLKSIDDIDSIDLTVDGADEVDKNFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPTAG

SEQ ID NO: 2737 - DNA, 1209 bp, Streptococcus agalactiae
atgtcacaatttgatcgcattcacttagttgtcttagattcagtggggattggagcggcaccagatgccaatgattttgtcaatgcaggagttcctgatggtgcttcagacacgcttggccacatttcaaaaacagttggacttgcggtgccaaacatggctaaaatcggacttggtaatattcctcgtccccaagcgcttaagaccgtccctgcagaagaaaatccaagtggctacgcgacgaagttacaagaagtatcacttggtaaagatacaatgacagggcattgggagatcatgggcttaaatattacagagccatttgatactttctggaatggttttccagaagatattattacaaagattgaggatttttcaggacgtaaagttattcgtgaagcgaataaaccttattcagggacagctgttattgatgacttcggaccacgccaaatggaaactggtgagctcatcatctatacctcagctgatccagtcctacaaattgcagctcatgaggatatcattcctctagaagaactctaccgtatttgtgaatatgctcgtagtatcacaatggagcgtccagctctccttggtcgtattatcgctcgtccatatgtaggtgaaccaggcaactttacgcgtacagccaaccgtcacgactatgcagtatcaccatttgaagataccgtattaaataaactagatcaagctggcatcgatacttatgctgttggtaaaatcaatgatattttcaatggttcaggcattaatcatgatatgggacataacaaatcaaatagtcatggtattgatactttgataaaaacaatggggttatcagagtttgaaaaaggcttctcctttactaatttggttgactttgatgctctctatggtcaccgtcgtgatcctcatggttatcgtgattgtcttcatgagtttgatgagcgtcttccagagatcatttcagcgatgcgtgacaaagacttacttttgatcactgccgatcatggtaatgacccaacttatgcaggtacagaccatacaagagaatacattcctctcttagcctatagcccatctttcacaggaaacggccttatcccagtagggcatttcgcagatatttcagcaacagttgcggataactttggtgttgatactgcgatgattggagagagcttcttgcaggacttggta

SEQ ID NO: 2738 - protein, 403 aa, Streptococcus agalactiae
MSQFDRIHLVVLDSVGIGAAPDANDFVNAGVPDGASDTLGHISKTVGLAVPNMAKIGLGNIPRPQALKTVPAEENPSGYATKLQEVSLGKDTMTGHWEIMGLNITEPFDTFWNGFPEDIITKIEDFSGRKVIREANKPYSGTAVIDDFGPRQMETGELIIYTSADPVLQIAAHEDIIPLEELYRICEYARSITMERPALLGRIIARPYVGEPGNFTRTANRHDYAVSPFEDTVLNKLDQAGIDTYAVGKINDIFNGSGINHDMGHNKSNSHGIDTLIKTMGLSEFEKGFSFTNLVDFDALYGHRRDPHGYRDCLHEFDERLPEIISAMRDKDLLLITADHGNDPTYAGTDHTREYIPLLAYSPSFTGNGLIPVGHFADISATVADNFGVDTAMIGESFLQDLV

SEQ ID NO: 2739 - DNA, 1209 bp, Streptococcus pyogenes
atgtcaaaatttaatcgtattcacttggttgttttagactctgtcggtattggtgcagcaccagatgctgacaaattctttaatgctggtgtagctgatacagattctgacaccctcggtcatatttcagaagcagcaggcttatcggttccaaatatggcaaaaattggacttggaaacatttctcgtccaataccactaaaaactgttccaacagaagacaatcctactggttacgtgaccaaattggaagaagtatctcttggaaaagataccatgacaggccattgggaaattatgggcttgaacattacggaaccttttgacactttctggaatggtttcccagaagagattttaactaagattgaagaattctcaggccgcaaaatcattcgcgaggccaacaaaccttattcaggaactgcggttattgatgattttggtccgcgtcaaatggaaacaggtgagttgattgtttacacctcagcagacccagtgcttcaaattgcagcccatgaagacattattcctgtggaagagctttacaagatttgtgaatatgctcgctccatcacgcttgaacgccctgcccttttaggccgtattattgcgcgtccttatgtaggcgacccaggaaactttacacgtacggctaaccgtcatgactatgcagtgtctcctttccaagataccgttttgaacaaactggctgacgcaggtgtcccaacttatgccgttggtaagattaatgacatctttaatggttcaggtattacaaacgacatgggacataataagtcgaacagccatggtattgacacgcttattaagactcttcaattacctgagtttactaagggattctcctttactaacctcgttgattttgatgccaactttggtcatcgtcgtgacccagagggttatcgcgactgcttgcatgaatttgacaatcgcctacctgaaatcatcgcaaatatgaaagaagacgatttgcttctcatcactgctgaccatggtaatgacccaacctatgcaggcaccgaccacactcgtgaatacattccattgcttgcctactctgtatcctttactggaaatggtcttattccacaagggcattttgcggatatttcagcaactgttgcagaaaattttggagttgatacagccatgattggggagtcattccttagtcacttaaaa

SEQ ID NO: 2740 - protein, 403 aa, Streptococcus pyogenes
MSKFNRIHLVVLDSVGIGAAPDADKFFNAGVADTDSDTLGHISEAAGLSVPNMAKIGLGNISRPIPLKTVPTEDNPTGYVTKLEEVSLGKDTMTGHWEIMGLNITEPFDTFWNGFPEEILTKIEEFSGRKIIREANKPYSGTAVIDDFGPRQMETGELIVYTSADPVLQIAAHEDIIPVEELYKICEYARSITLERPALLGRIIARPYVGDPGNFTRTANRHDYAVSPFQDTVLNKLADAGVPTYAVGKINDIFNGSGITNDMGHNKSNSHGIDTLIKTLQLPEFTKGFSFTNLVDFDANFGHRRDPEGYRDCLHEFDNRLPEIIANMKEDDLLLITADHGNDPTYAGTDHTREYIPLLAYSVSFTGNGLIPQGHFADISATVAENFGVDTAMIGESFLSHLK

SEQ ID NO: 2741 - DNA, 807 bp, Streptococcus agalactiae
atgacattattagaaaaaattaatgagactagagactttttgcaagcaaaaggcgtcacagcaccagaatttggccttattttaggctctggtttaggagaattagctgaagaaatcgaaaatcccattgttgtggattatgcagacatcccaaattggggacagtcaacagtagttggtcatgctggaaaattagtgtatggggatttatcaggccgtaaggtattagcacttcaaggtcgttttcacttttatgaaggaaatacaatggaagtcgttactttcccagtacgtatcatgagagcattggcttgccacagtgtgcttgtgactaatgcagcgggtgggattggatacggaccaggaactttaatgctgatcaaagaccacatcaatatgattgggactaaccctctcataggtgagaaccttgaagaatttggaccacgtttcccagacatgtcggatgcttatacagcaacatatcgacaaaaagctcaccaaattgctgaaaaacagaatatcaaactcgaagaaggtgtgtacttgggtgtatcaggacccacttatgaaacacctgcagaaattcgtgcattccaaacaatgggcgcacaggcggtaggtatgtccacggttccagaggtgatcgttgcagctcactcagggcttaaagtgttaggaatttcagcaattactaactttgccgctggcttccaatctgagctcaatcatgaggaggtcgttgaagttactcagcgtattaaagaagatttcaagggattagttaaatcattagttgctgaactt

SEQ ID NO: 2742 - protein, 269 aa, Streptococcus agalactiae
MTLLEKINETRDFLQAKGVTAPEFGLILGSGLGELAEEIENPIVVDYADIPNWGQSTVVGHAGKLVYGDLSGRKVLALQGRFHFYEGNTMEVVTFPVRIMRALACHSVLVTNAAGGIGYGPGTLMLIKDHINMIGTNPLIGENLEEFGPRFPDMSDAYTATYRQKAHQIAEKQNIKLEEGVYLGVSGPTYETPAEIRAFQTMGAQAVGMSTVPEVIVAAHSGLKVLGISAITNFAAGFQSELNHEEVVEVTQRIKEDFKGLVKSLVAEL

SEQ ID NO: 2743 - DNA, 807 bp, Streptococcus pyogenes
atgtcattgatgactaaaattaacgaaacaaaagactttttagttactaaaggaattgaaactccagaatttggattaattctgggttcaggccttggtgaacttgctgaagaagtagaaaatgctattgttattgattatgcagatattccaaactggggcaagtcaacggttgttggccatgctggaaagttagtttacggagatttagctggccgtaaagtgctcgccttacaaggacgtttccatttttacgaaggaaatccgcttgaagtggtgactttccctgttcgtgtcatgaaagctctgggatgtgaaggcgttcttgtcacaaatgcagctggtggtatcggctacggcccaggtaccttgatggcaatcacagaccatatcaatatgaccggaaataacccactaatcggtgaaaacttggacgagtttggtccacgctttcctgatatgtctgatgcctatactaaggtttatcgcaataaggcacatgaagtggctgaaaaaatgaacatcaaactagaagatggtgtttatatgggcttgactggtccaacttatgaaacaccagcagaaatccgtgctttcaaagtattaggagcagatgctgttggcatgtcaactgtaccggaagttattgtggctgctcattctggacttaaagtgcttggtatttcagctattacaaactttgcagctggtttccaatcagaattgaaccatgaagaagttgtggaagtgacccaacatatcaaagaagatttcaaaggtcttgttaaagctattttagcggagttg

SEQ ID NO: 2744 - protein, 269 aa, Streptococcus pyogenes
MSLMTKINETKDFLVTKGIETPEFGLILGSGLGELAEEVENAIVIDYADIPNWGKSTVVGHAGKLVYGDLAGRKVLALQGRFHFYEGNPLEVVTFPVRVMKALGCEGVLVTNAAGGIGYGPGTLMAITDHINMTGNNPLIGENLDEFGPRFPDMSDAYTKVYRNKAHEVAEKMNIKLEDGVYMGLTGPTYETPAEIRAFKVLGADAVGMSTVPEVIVAAHSGLKVLGISAITNFAAGFQSELNHEEVVEVTQHIKEDFKGLVKAILAEL

SEQ ID NO: 2745 - DNA, 1269 bp, Streptococcus agalactiae
ttgctgaactttaaaatggtttctcgattatactatgctgtcaagtttatgatagccgttctatttatgacagttatggcaggagttggagctatcttaatgcactatgtattaatgtttacagagtggttagcatttggtgatagtagagaaaatactctgtctttgttaaatagtgtcacaccaattaaaagagtgttatcacttactttagtctcctttttagcatcccttagttggtattacttacaaatcaaaccaaagcaaataactagtattaaacaacaggttgtttttaaggatttttctgtaaaaaaatcaccttactggctacatataggtcacgcatttttgcaattgatttatgtaggaactggtggccctattggaaaagaaggagcgccacgagagtttggagccataaatgctgggaaaatatcggatttattagcacttaaagtgctggataaacgtttattaatcattagtggtgcagctgcaggtttgtcagcagtttatcaagtccccctagctagtgtattctttgcttttgaaactttagctttaggaatctcactgaaaaatattgtgacattgctagcctctacttttggtgcagctagtattgctcaattagttatttcgacagcccctctttatcatatttcaaagatgagtctgaattcacagtcattagcttttatgttcttgatcgttttatgtgtaactccgattgcgattagctttagatatttaaatcaaaaagtgacagagagacgtattaaaaatataaaaatattgttaagtttgccagtagtgtcattgatagtatctgttttatcaatcgtctatccccagattttaggaaatggtaatgccctagttcaagaagtctttaaagggaccacagttagcttaatcgctattttagttgttctcaagatgatagcaacattatccactctttacgctggtgcttatggcggtatactgacaccatctttttccattggtgcttgtttaggttttttgttagctagtatttctattcctttacttccccacatatcgatagtaaccagtatgttggttggtgcagctatttttttagctattacaatgagagcgccactgacagctgtcggtttagtcatatcttttactggtcaatctgttataactattgttcccctaactatagcagtactttttgctactgcctatgattattttataagaaaaatgaggagtttatatgtcaatccatat

SEQ ID NO: 2746 - protein, 423 aa, Streptococcus agalactiae
MLNFKMVSRLYYAVKFMIAVLFMTVMAGVGAILMHYVLMFTEWLAFGDSRENTLSLLNSVTPIKRVLSLTLVSFLASLSWYYLQIKPKQITSIKQQVVFKDFSVKKSPYWLHIGHAFLQLIYVGTGGPIGKEGAPREFGAINAGKISDLLALKVLDKRLLIISGAAAGLSAVYQVPLASVFFAFETLALGISLKNIVTLLASTFGAASIAQLVISTAPLYHISKMSLNSQSLAFMFLIVLCVTPIAISFRYLNQKVTERRIKNIKILLSLPVVSLIVSVLSIVYPQILGNGNALVQEVFKGTTVSLIAILVVLKMIATLSTLYAGAYGGILTPSFSIGACLGFLLASISIPLLPHISIVTSMLVGAAIFLAITMRAPLTAVGLVISFTGQSVITIVPLTIAVLFATAYDYFIRKMRSLYVNPY

SEQ ID NO: 2747 - DNA, 1311 bp, Streptococcus pyogenes
atgacgattataattatggactctaatagtgctcacgagactgataatctatcagtctcttttcttaacttttgttataatagtcttatgaaacgacactttttactcttgaccttttacctctttttaacaggtttaacagctggccttgttgcttttatcttaacaaaagccattcacctgattcagtccctcagttttggattcagtcaaggttcttttagcactatgattgctagtgttccaccacaaagacgagctctttcactcctctttgctggacttcttgcaggtcttgggtggcacctattggctaaaaaaggaaaggacattcaatctattcagcaaatcattcaagatgacatctcatttagtccctggacacagttttggcatggttggctccaattaacgaccgtatctatgggagctcctgtcggccgagaaggagcttcacgggaagtcgctgttaccttgacgtctctttggagccaaagatgcaacttgtcaaaagccgatcaaaaacttttattagcctgcgcttctggcgctgcccttggtgctgtctacaatgctcccttagccactattttatttatcttagaagctattcttaaccgttggtcccttaaaaatatatacgctgcctgcctaacgagctatgtggctgtggaaacagttgctttattacaaggccgacatgagattcaatacctaatgcctcagcaacattggacgctaggaacccttattgggtccgtcctggctggtcttatcctttccctctttgctcacgcttacaaacatcttttgaaacaccttcctaaggctgatgccaaaagtcagtggtttattccgaaagttctcatcgcttttagccttatcgcaggactcagcattttcttcccagagattttaggaaatggcaaagctggattactcttttttctccatgaagaaccacatctgagctatattagctggctacttgttgccaaagctgtcgctatctctttagtttttgcttctggagcaaaagggggtaaaattgctccttctatgatgcttggaggtgctagtggcttactactagctatccttagtcagtaccttattcccttgtctctatcaaatacgttagccattatggttggtgcaacaatctttttaggtgtgatcaataagatacccttggcggcaccagtttttctggttgaaattacaggccaatcgttactaatgattatccctttagcattagctaacctcattttttattttagctatcagttttatcgtttcatccttaaa

SEQ ID NO: 2748 - protein, 437 aa, Streptococcus pyogenes
MTIIIMDSNSAHETDNLSVSFLNFCYNSLMKRHFLLLTFYLFLTGLTAGLVAFILTKAIHLIQSLSFGFSQGSFSTMIASVPPQRRALSLLFAGLLAGLGWHLLAKKGKDIQSIQQIIQDDISFSPWTQFWHGWLQLTTVSMGAPVGREGASREVAVTLTSLWSQRCNLSKADQKLLLACASGAALGAVYNAPLATILFILEAILNRWSLKNIYAACLTSYVAVETVALLQGRHEIQYLMPQQHWTLGTLIGSVLAGLILSLFAHAYKHLLKHLPKADAKSQWFIPKVLIAFSLIAGLSIFFPEILGNGKAGLLFFLHEEPHLSYISWLLVAKAVAISLVFASGAKGGKIAPSMMLGGASGLLLAILSQYLIPLSLSNTLAIMVGATIFLGVINKIPLAAPVFLVEITGQSLLMIIPLALANLIFYFSYQFYRFILK

SEQ ID NO: 2749 - DNA, 708 bp, Streptococcus agalactiae
atgtcaatccatattgaagcaaaacaaggtgaaattgcagataaaattttacttccaggagatccactccgtgcgaaatttattgccgagaattttttagaagatgcggtgtgttttaacacagttcgcaatatgtttggttatacaggtacctataaaggacatcgtgtttctgttatgggaactggtatgggtatgccttcaatttcaatttatgctcgcgaactaattgttgattatggggttaaaacattgattcgcgtaggaacagcaggtgctattaatcctgatatccatgttcgtgaacttgttttggcacaagcagcagcaacaaattctaatattatccgtaatgattggcctgaatttgattttccgcaaattgctgattttaaacttttggataaagcttatcacatcgcaaaggaaatggatattacaactcatgtaggcagtgtattatcttcagacgtgttttattcaaaccaaccagatcgtaatatggccttgggtaaactaggtgttcatgctattgagatggaagcagcagctctctactatcttgcagctcaacacaatgttaatgctcttgctatgatgacgatttcagataacttgaataatccagaagaagatacaagtgcagaagagcgtcaaacaacatttactgatatgatgaaagttgggctcgaaacacttatttctgaa

SEQ ID NO: 2750 - protein, 236 aa, Streptococcus agalactiae
MSIHIEAKQGEIADKILLPGDPLRAKFIAENFLEDAVCFNTVRNMFGYTGTYKGHRVSVMGTGMGMPSISIYARELIVDYGVKTLIRVGTAGAINPDIHVRELVLAQAAATNSNIIRNDWPEFDFPQIADFKLLDKAYHIAKEMDITTHVGSVLSSDVFYSNQPDRNMALGKLGVHAIEMEAAALYYLAAQHNVNALAMMTISDNLNNPEEDTSAEERQTTFTDMMKVGLETLISE

SEQ ID NO: 2751 - DNA, 711 bp, Streptococcus pyogenes
atgtctatccatatttctgccaaaaaaggcgatattgctgataaaattcttctacctggagatcctttgcgcgcgaaatttatcgctgaaaatttcctagaagatgcagtgtgttttaacgaagtgcgtaacatgtttggctacacaggaacttacaaagggcaccgcgtttctgtcatgggaactggtatggggatgccttcgatctctatctatgctcgtgaattaatcgttgattacggtgtcaaaacattgatccgtgttggtactgcgggtgcgattgacccagaagttcatgtgcgtgaattggtgcttgcccaagcagcagcaaccaactcaaatattatccgtaatgacttcccagaatttgatttcccacaaattgctgattttggtttacttgacaaggcttaccatatcgccagagaaatgggagtaacaactcacgttgggaatgtgctttcttctgatgtcttttacactaacatgcctgagcgtaatatggctcttggtaaattgggtgttaaagccatcgaaatggaagcagcagctctttactatttagctgctcagcaccatgtcaaagcccttggaatcatgacgatctcagataacttgaatgatccaaccgaagatactacagctgaagagcgccaaacaactttcactgatatgatgaaggtcggcttggaaaccttaattgccaatgac

SEQ ID NO: 2752 - protein, 237 aa, Streptococcus pyogenes
MSIHISAKKGDIADKILLPGDPLRAKFIAENFLEDAVCFNEVRNMFGYTGTYKGHRVSVMGTGMGMPSISIYARELIVDYGVKTLIRVGTAGAIDPEVHVRELVLAQAAATNSNIIRNDFPEFDFPQIADFGLLDKAYHIAREMGVTTHVGNVLSSDVFYTNMPERNMALGKLGVKAIEMEAAALYYLAAQHHVKALGIMTISDNLNDPTEDTTAEERQTTFTDMMKVGLETLIAND

SEQ ID NO: 2753 - DNA, 777 bp, Streptococcus agalactiae
atgaggatagaaatgacagatttttcaactgctcttaaagtattagtggatcagtattcttatcataatgctttcttattattacaaaaacatggtcctttaaactcagatttattatttttattggaaatgatgaaagagcgtcgagagttaaacattgattttctttttgctcatcaagaacaagttgttatattacaagaaaaatacaatataaagcttttgcataacccgtatgatttagagttgctggcaaattacatcatggatttagaagcaaaagtaaaaaacggattaatcatagattttgtccgtagtgttagtcctattttatatcgtctatttatgattttacttgcacaagaagtacctcacttgcatgattacatccataatgcaagagatgatcactacgatacttggaagtttaaagaattaaaggagtcaaaccacccagtccttttggcattctctgaaaggtggcacgatagtcgcttgacttctaaaagcctggcagaatgtttacaattaaccgaccttgatgaagaagtgaaatcgaccatcattcaattaagacagttcgaaaaatcagtcagaaatcctttggctcacctgattaaaccttttgatgagcaagaactatatcgtacaactcaattttcttctcaagcatttttagaccagattatcttcttggcaaaggtaattggtgttgagtatgatactgttaattttcactacgatacggttaacaagcttattataaatatacttgag

SEQ ID NO: 2754 - protein, 259 aa, Streptococcus agalactiae
MRIEMTDFSTALKVLVDQYSYHNAFLLLQKHGPLNSDLLFLLEMMKERRELNIDFLFAHQEQVVILQEKYNIKLLHNPYDLELLANYIMDLEAKVKNGLIIDFVRSVSPILYRLFMILLAQEVPHLHDYIHNARDDHYDTWKFKELKESNHPVLLAFSERWHDSRLTSKSLAECLQLTDLDEEVKSTIIQLRQFEKSVRNPLAHLIKPFDEQELYRTTQFSSQAFLDQIIFLAKVIGVEYDTVNFHYDTVNKLIINILE

SEQ ID NO: 2755 - DNA, 792 bp, Streptococcus pyogenes
ttgccaatgactaataatcaaacactagacatccttttggatgtctatgcttataatcacgcctttagaattgctaaagccttgccaaatatccctaaaactgccctctatttactagagatgttaaaagagcgcagagaattgaaccttgcctttctagcggaacatgcagcagagaatcggaccattgaagaccagtatcactgttcattatggcttaaccaatcgcttgaagatgagcagattgccaattacattttggatttagaagttaaagtaaaaaacggtgctattattgatttcgtcaggtcagtgtcgcctattctttaccgactttttctcagactaatcacgtcagaaattccaaacttcaaggcttatatttttgatacaaagaatgaccaatatgatacctggcattttcaggccatgttggaatctgatcacgaggttttcaaggcttacctgtctcaaaagcagtctcgcaatgtgacgaccaaaagcttagcagacatgttgacgttgacctccttacctcaggaaatcaaggacttggtttttttgttacgacattttgaaaaggctgtccgtaatcctctggctcatttgattaagccttttgatgaagaggaactgcatcgcaccactcatttttcttctcaggcttttttggaaaacattatcaccttggcgactttttctggtgtaatctaccgacgtgagcctttttactttgatgacatgaatgccattattaaaaaggagttgagcctttggagacaatctattgtc

SEQ ID NO: 2756 - protein, 264 aa, Streptococcus pyogenes
LPMTNNQTLDILLDVYAYNHAFRIAKALPNIPKTALYLLEMLKERRELNLAFLAEHAAENRTIEDQYHCSLWLNQSLEDEQIANYILDLEVKVKNGAIIDFVRSVSPILYRLFLRLITSEIPNFKAYIFDTKNDQYDTWHFQAMLESDHEVFKAYLSQKQSRNVTTKSLADMLTLTSLPQEIKDLVFLLRHFEKAVRNPLAHLIKPFDEEELHRTTHFSSQAFLENIITLATFSGVIYRREPFYFDDMNAIIKKELSLWRQSIV

SEQ ID NO: 2757 - DNA, 921 bp, Streptococcus agalactiae
atgagaattcaacaattacaatatgttattaagattgtagaaactggtagcatgaatgaagccgctaaacaactctacattacccaaccttcactttcaaacgctgttaggaaccttgagactgagatgggtatccaaatttttattcgaaatccaaaaggaataacgttaacaaaagatggtatggaatttctgtcatatgcgcgacaaattctagaacaaacagcacttcttgaagagcgttataagggtgataatacaagtcgtgagctgttcagcgtttcttcacaacactatgcatttgtggttaacgcttttgtagctctctttaatggcacagacatgacccaatacgaactttttttacgtgaaactaggacttgggaaattattgatgatgttaaaaatttccgttcagagattggtgttctgtttcttaatagctataatagagatgtattaaccaaattattcgacgataattccttaattgccacaactctttttactactacacctcatattttcgtgagcaaatccaatcccttagctaatagaaaaaaattaaatatgaaagatttagaagattatccttatctgagttatgatcaaggcctgcataattctttctacttttctgaggaaatgatgtctcaaattcctcacccaaaatccattgttgtcagtgatagagcaactctgtttaatttaatgattggattagatggttatacagtggcaactggtatcctcaactcaaaattgaacggtgacgaaattgtcgcaatccctcttgacgtggatgatgttattgatattgtctatatccgacacgacaaagcaaacctttcaaaaatgggacaaaaatttattgactatttattagaggaagtttcgtttaatcataaaaataaacagtcc

SEQ ID NO: 2758 - protein, 307 aa, Streptococcus agalactiae
MRIQQLQYVIKIVETGSMNEAAKQLYITQPSLSNAVRNLETEMGIQIFIRNPKGITLTKDGMEFLSYARQILEQTALLEERYKGDNTSRELFSVSSQHYAFVVNAFVALFNGTDMTQYELFLRETRTWEIIDDVKNFRSEIGVLFLNSYNRDVLTKLFDDNSLIATTLFTTTPHIFVSKSNPLANRKKLNMKDLEDYPYLSYDQGLHNSFYFSEEMMSQIPHPKSIVVSDRATLFNLMIGLDGYTVATGILNSKLNGDEIVAIPLDVDDVIDIVYIRHDKANLSKMGQKFIDYLLEEVSFNHKNKQS

SEQ ID NO: 2759 - DNA, 903 bp, Streptococcus pyogenes
atgagaattcaacaactgcattatattatcaaaattgttgagtgcggctctatgaatgaagctgctaagcaattatttatcacacaaccaagtctatccaatgcggtcaaggatttggaaatggagatgggcattaccattttcaaccgaaatcctaaagggatcaccttgacaaaagatggggtggaatttttatcttatgctcgccaaattatagagcaaacatcactgttagaagaccgctataaaaaccacaatactggccgagagctctttagcgtttcatctcaacattatgccttcgtagtcaatgcatttgtctcactcctcaagcggaccgacatgactcggtatgaactctttttgcgcgagacaagaacttgggaaatcattgatgatgtcaaaaactttcgatctgaaattggtgttctctttatcaacgactataaccgagatgtcttgaccaaattatttgatgacaatcatttgaccgcctctccattatttaaggcacagcctcatatttttgtcagcaaatcaaatcctctagcaactaaaagcctattaagcatggacgacttgagagattttccttacctgagctatgaccaagggattcacaactccttttatttttcagaagagatgatgtcccagatgccccacaacaaatcaattgtggtcagtgaccgtgccaccctctttaacttaatgattggtttagatggctacaccgttgccagtggtattctaaatagcaatctaaatggtgaccagattgtggctatcccgctagatgtccctgacgaaattgacattgtttttatcaagcatgaaaaagccaacttgtccaaaatgggggaacgttttatcgaataccttctcgaagaagtaacctttgat

SEQ ID NO: 2760 - protein, 301 aa, Streptococcus pyogenes
MRIQQLHYIIKIVECGSMNEAAKQLFITQPSLSNAVKDLEMEMGITIFNRNPKGITLTKDGVEFLSYARQIIEQTSLLEDRYKNHNTGRELFSVSSQHYAFVVNAFVSLLKRTDMTRYELFLRETRTWEIIDDVKNFRSEIGVLFINDYNRDVLTKLFDDNHLTASPLFKAQPHIFVSKSNPLATKSLLSMDDLRDFPYLSYDQGIHNSFYFSEEMMSQMPHNKSIVVSDRATLFNLMIGLDGYTVASGILNSNLNGDQIVAIPLDVPDEIDIVFIKHEKANLSKMGERFIEYLLEEVTFD

SEQ ID NO: 2761 - DNA, 1455 bp, Streptococcus agalactiae
atgtctaatcattcgcgccgtcaccaaaagaaacactcacatacacctctacgggtgattaatttatttcttttggtgatttttattttgttaagtgtagtctcattatttcttatgtatcgtcaccattttttggcatttagacacctgaacgtcatttatggagttgtaattgttttaatcattttagtaagtttatttctttgtattaagaataaagctagaatttttacaactataattttagtattagcttctattttcgttgctactactttatatggatttaagtcaaccattgatttgacaaataatctaaataaaactgcttcatactctgaaattgagatgagtgtagttgtaccaaaagattctaaaataaccaatatagaagctgtcagcaaattagccgcaccagttaaaaacgatacttcaaatattactgatttgatagaacatataaaatcagaaaaaggaatctctattacaccacaaaaaacagattcttaccaggatgcatacaatagaattaaaagtggtgatagtcaggctatggttttaaataatgcttatgttagcttaattgaacttagcacccctgattttaaatcgcagataaaaacgatttatacttacaaaattaagaaaaaaattaatcgtaaaaatactaatcataaagaaggggtatttaatatctatattagcggtattgatacttttggctctatatcaacagtatcaagatctgatgtaaatattattatgacggttaataccaatacccacaaagtattgttaacgacaacaccacgagatgcctatgtaaaaattccagatggtgggggcaatcaatatgataaattaacccatgcaggtttgtatggcgttgagacatcaatgaaaacacttgaaaacctttacgacatcaaccttgattattatgctagaattaatttttcatcatttttaaaattaatagacctcttgggaggagtgacagtttataacgatcaagcttttacaagtaaacatggtaattttgacttccctgttggtcaagtaacattgaattctgagcaggctttgggctttgttagagaacgttattctctacaaggaggcgataacgatagaggtagaaatcaagaaaaagtgattgcagctattataaataagttagcttctagtcagtcagtaacaaaattaaatagcattacctcacagctccaaacgtccgttcaaactaatatgactattgataacattaatgatttgattaacaatcaattgtcaactggacaacgcttcactgtcgagtcacaagcattaactggtcatggttcaacgggtgaactcccttcatatgcaatgccaggagctcaactttatatgatgtcaattgatcaatctagcttatctaatgcaaaatcaaaaattaagaacacaatggaggaa

SEQ ID NO: 2762 - protein, 485 aa, Streptococcus agalactiae
MSNHSRRHQKKHSHTPLRVINLFLLVIFILLSVVSLFLMYRHHFLAFRHLNVIYGVVIVLIILVSLFLCIKNKARIFTTIILVLASIFVATTLYGFKSTIDLTNNLNKTASYSEIEMSVVVPKDSKITNIEAVSKLAAPVKNDTSNITDLIEHIKSEKGISITPQKTDSYQDAYNRIKSGDSQAMVLNNAYVSLIELSTPDFKSQIKTIYTYKIKKKINRKNTNHKEGVFNIYISGIDTFGSISTVSRSDVNIIMTVNTNTHKVLLTTTPRDAYVKIPDGGGNQYDKLTHAGLYGVETSMKTLENLYDINLDYYARINFSSFLKLIDLLGGVTVYNDQAFTSKHGNFDFPVGQVTLNSEQALGFVRERYSLQGGDNDRGRNQEKVIAAIINKLASSQSVTKLNSITSQLQTSVQTNMTIDNINDLINNQLSTGQRFTVESQALTGHGSTGELPSYAMPGAQLYMMSIDQSSLSNAKSKIKNTMEE

SEQ ID NO: 2763 - DNA, 1272 bp, Streptococcus pyogenes
atgaaaattggaaaaaaaatagttttaatgttcacagctattgtgttaacaactgtcttggcattaggtgtctatctaactagtgcttataccttctcaacaggagaattatcaaagacctttaaagatttttcgacatcttcaaacaaaagtgatgccattaaacaaacaagagctttttctatcttgttgatgggtgttgatacaggctcttcagagcgtgcctccaagtgggaaggaaacagtgattcgatgattttggttacggttaatccaaagaccaagaaaacaactatgactagtttagaacgagataccttaaccacgttatctggacccaaaaataatgaaatgaatggtgttgaagctaagcttaacgctgcttatgcagcaggtggcgctcagatggctattatgaccgtgcaagatcttttgaatatcaccattgataactatgttcaaattaatatgcaaggccttattgatcttgtgaatgcagttggagggattacagttacaaatgagtttgattttcctatctcgattgctgaaaacgaacctgaatatcaagctactgttgcgcctggaacacacaaaattaacggtgaacaagctttggtttatgctcgtatgcgttatgatgatcctgagggagattatggtcgacaaaagcgtcaacgtgaagtcattcaaaaggtattgaaaaaaatccttgctcttgatagcattagctcttatcggaagattttatctgctgtaagtagtaatatgcaaacgaatatcgaaatctcttctcgcactatccctagtctattaggttatcgtgacgcacttagaactattaagacttatcaactaaaaggagaagatgccactttatcagatggtggatcataccaaattgttacctctaatcatttgttagaaatccaaaatcgtatccgaacagaattaggacttcataaggttaatcaattaaaaacaaatgctactgtttatgaaaatttgtatgggtcaactaagtctcagacagtaaacaacaactatgactcttcaggccaggctccatcttattctgatagtcatagctcttacgctaattattcaagtggagtagataccggccagagtgctagtacagaccaggactctactgcttcaagccataggccagctacgccgtcttcttcatcagatgctttagcagctgatgagtctagctcatcagggtctggatcattagttcctcctgctaatatcaaccctcagacc

SEQ ID NO: 2764 - protein, 424 aa, Streptococcus pyogenes
MKIGKKIVLMFTAIVLTTVLALGVYLTSAYTFSTGELSKTFKDFSTSSNKSDAIKQTRAFSILLMGVDTGSSERASKWEGNSDSMILVTVNPKTKKTTMTSLERDTLTTLSGPKNNEMNGVEAKLNAAYAAGGAQMAIMTVQDLLNITIDNYVQINMQGLIDLVNAVGGITVTNEFDFPISIAENEPEYQATVAPGTHKINGEQALVYARMRYDDPEGDYGRQKRQREVIQKVLKKILALDSISSYRKILSAVSSNMQTNIEISSRTIPSLLGYRDALRTIKTYQLKGEDATLSDGGSYQIVTSNHLLEIQNRIRTELGLHKVNQLKTNATVYENLYGSTKSQTVNNNYDSSGQAPSYSDSHSSYANYSSGVDTGQSASTDQDSTASSHRPATPSSSSDALAADESSSSGSGSLVPPANINPQT

SEQ ID NO: 2765 - DNA, 729 bp, Streptococcus agalactiae
atgattgatattcattctcatatcgtttttgatgtagatgatgggcctaaaacgcttgaagagagtttatctttaatagaagaaagttatcgacaaggtgttagaataattgtttcgacatcacatagaagaaaaggtatgtttgaaacacctgaagatattatcttcaaaaacttttctatagttaaacacgaagcggaaaaaagatttgaacatcttcaaatcttatatggtggagaattgtactatacaagtgatatgttagaaaaactgaagttaaagcaaattccaactttaaacaatacgaaatttgctttaattgaattttctatgcaaacttcttggaaagatattcatacagctttgtcaaatgttttaatgcttggtattacaccagtcgttgcgcatatagagaggtataacgctttagagaatcaaaaagaacgggtgaaggaaattattaatatggggtgttacacacaaataaatagttcccatattttgaaacaaaaactttttaatgataagcataaacgctttaagaaaagagcccgttattttttagaggaaaatttagtgcattttgtagcgagtgatatgcataaccttgatgttagaccgccatttttagcagaagcttataagattatctgtagagatttcggtaaagaacgtgctaaccaactttttattgaaaatgctcaatctatattaaaaaaccattacatt

SEQ ID NO: 2766 - protein, 243 aa, Streptococcus agalactiae
MIDIHSHIVFDVDDGPKTLEESLSLIEESYRQGVRIIVSTSHRRKGMFETPEDIIFKNFSIVKHEAEKRFEHLQILYGGELYYTSDMLEKLKLKQIPTLNNTKFALIEFSMQTSWKDIHTALSNVLMLGITPVVAHIERYNALENQKERVKEIINMGCYTQINSSHILKQKLFNDKHKRFKKRARYFLEENLVHFVASDMHNLDVRPPFLAEAYKIICRDFGKERANQLFIENAQSILKNHYI

SEQ ID NO: 2767 - DNA, 690 bp, Streptococcus agalactiae
atgaataaaatagctaatacagaagttgaaataaatatattcaaccttttaaaaaaattgtggaaaaagaaatttttaatcacatttgttgccattgcatttgcaacagctggacttttctatagtctttttattgttacgccacaatatacttcttcaacaaggatatatgtcattaaccctaatacccctaataatagtattactgcacaagatctacaagcggggagttttcttgcaaatgactataaggagattattacgtctactgacgttctagaaaaagttatttcttctgaaaaattgaattatccttcgtctcagttgttgcaaaaaataacagtttctattttaaaagatacacgtgttatttcaatatcggtcgaagatgctaatccaaaaatgtctcaaaaattagcaaattcagttagagaagcagcagtttcaaaaatcaaggcagttactcaagtagaggatatcactactcttgagaagggaaatttacctaaagcaccatcttctcctaatattaaaaagaatgtactaatcgggtttattgttggtgcaggattatcaactattgttttagttattatgggtattttggatgatcgtgttaatactgaagaagatattgaaaaggtcctaggacttacttctttaggtatagtaccagatttgaataaactt

SEQ ID NO: 2768 - protein, 230 aa, Streptococcus agalactiae
MNKIANTEVEINIFNLLKKLWKKKFLITFVAIAFATAGLFYSLFIVTPQYTSSTRIYVINPNTPNNSITAQDLQAGSFLANDYKEIITSTDVLEKVISSEKLNYPSSQLLQKITVSILKDTRVISISVEDANPKMSQKLANSVREAAVSKIKAVTQVEDITTLEKGNLPKAPSSPNIKKNVLIGFIVGAGLSTIVLVIMGILDDRVNTEEDIEKVLGLTSLGIVPDLNKL

SEQ ID NO: 2769 - DNA, 687 bp, Streptococcus agalactiae
atgactcgtttagaaatagttgatagcaagttaagacaagcaaaaaaaacagaagaatacttcaatgcgatccgtacaaacatacagtttagtggaaaggaaaataaaattcttgcaattacctctgttagggaaggggaaggaaaatccactgcttcaacaagtttagctttatctttagctcaagcaggatttaaaacattattaattgatgcggatactaggaactctgttatgtctggaacctttaaagcaactggaactattaaaggcttgacgaattatttatcaggtaatgcagatcttggagatattatctgtgaaaccaatgttcctagactgatggtcgttccttcagggaaagtaccaccaaatccaacagcattacttcagaacgcttattttaataagatgattgaagctattaaaaatatatttgattatattatcatcgatactccacctattggtttagttgttgatgccgcaataatcgctaatgcttgcgatggttttattttagtaacccaagcaggcagaataaaacgtaattatgttgaaaaagcaaaagaacagatggaacaaagtggttcaaagttcttaggtattattcttaataaagttaatgaatctgttgctacttacggcgattatggaaattacggaaaaagggatagaaaaaggaag

SEQ ID NO: 2770 - protein, 229 aa, Streptococcus agalactiae
MTRLEIVDSKLRQAKKTEEYFNAIRTNIQFSGKENKILAITSVREGEGKSTASTSLALSLAQAGFKTLLIDADTRNSVMSGTFKATGTIKGLTNYLSGNADLGDIICETNVPRLMVVPSGKVPPNPTALLQNAYFNKMIEAIKNIFDYIIIDTPPIGLVVDAAIIANACDGFILVTQAGRIKRNYVEKAKEQMEQSGSKFLGIILNKVNESVATYGDYGNYGKRDRKRK

SEQ ID NO: 2771 - DNA, 1386 bp, Streptococcus agalactiae
ttgaaagaaaaagaaaatatacaaaagattattatagcgatgattcaaacagttgtggtttatttttctgcaagtttgacattaacattaattactcccaattttaaaagcaataaagatttattgtttgttctattgatacattatattgtcttttatctttctgatttttacagagacttttggagtcgtggctatcttgaagagtttaaaatggtattgaaatacagcttttactatattttcatatcaagttcattattttttatttttaaaaactcttttacaacgacacgactttccttttttacttttattgctatgaattcgattttattatatctattgaattcatttttaaaatattatcgaaaatattcttacgctaagttttcacgagataccaaagttgttttgataacgaataaggattctttatcaaaaatgacctttaggaataaatacgaccataattatatcgctgtctgtatcttggattcctctgaaaaggattgttatgatttgaaacataactcgttaaggataataaacaaagatgctcttacttcagagttaacctgcttaactgttgatcaagcttttattaacatacccattgaattatttggtaaataccaaatacaagatattattaatgacattgaagcaatgggagtgattgtcaatgttaatgtagaggcacttagctttgataatataggagaaaagcgaatccaaacttttgaaggatatagtgttattacatattctatgaaattctataaatatagtcaccttatagcaaaacgatttttggatatcacgggtgctattataggtttgctcatatgtggcattgtggcaatttttctagttccacaaatcagaaaagatggtggaccggctatcttttctcaaaatagagtaggtcgtaatggtaggatttttagattctataaattcagatcaatgcgagtagatgcagaacaaattaagaaagatttattagttcacaatcaaatgacagggctaatgtttaagttagacgatgatcctagaattactaaaataggaaaatttattcgaaaaacaagcatagatgagttgcctcaattctataatgttttaaagggtgatatgagtttagtaggaacacgccctcccacagttgatgaatatgaaaagtataattcaacgcagaagcgacgccttagttttaagccaggaatcactggtttgtggcaaatatctggtagaaataatattactgattttgatgaaatcgtaaagttagatgttcaatatatcaatgaatggtctatttggtcagatattaagattattctcctaacactaaaggtagttttactcgggacaggagctaag

SEQ ID NO: 2772 - protein, 462 aa, Streptococcus agalactiae
MKEKENIQKIIIAMIQTVVVYFSASLTLTLITPNFKSNKDLLFVLLIHYIVFYLSDFYRDFWSRGYLEEFKMVLKYSFYYIFISSSLFFIFKNSFTTTRLSFFTFIAMNSILLYLLNSFLKYYRKYSYAKFSRDTKVVLITNKDSLSKMTFRNKYDHNYIAVCILDSSEKDCYDLKHNSLRIINKDALTSELTCLTVDQAFINIPIELFGKYQIQDIINDIEAMGVIVNVNVEALSFDNIGEKRIQTFEGYSVITYSMKFYKYSHLIAKRFLDITGAIIGLLICGIVAIFLVPQIRKDGGPAIFSQNRVGRNGRIFRFYKFRSMRVDAEQIKKDLLVHNQMTGLMFKLDDDPRITKIGKFIRKTSIDELPQFYNVLKGDMSLVGTRPPTVDEYEKYNSTQKRRLSFKPGITGLWQISGRNNITDFDEIVKLDVQYINEWSIWSDIKIILLTLKVVLLGTGAK

SEQ ID NO: 2773 - DNA, 447 bp, Streptococcus agalactiae
atgaaaatttgtctggttggttcaagtggtggtcatctagcacacttgaaccttttgaaacccatttgggaaaaagaagataggttttgggtaacctttgataaagaagatgctaggagtattctaagagaagagattgtatatcattgcttctttccaacaaaccgtaatgtcaaaaacttggtaaaaaatactattctagcttttaaggtccttagaaaagaaagaccagatgttatcatatcatctggtgccgctgtagcagtaccattcttttatattggtaagttatttggttgtaagaccgtttacatagaggttttcgacaggatggataaaccaactttgacaggaaaattagtgtatcctgtaacagataaatttattgttcagtgggaagaaatgaaaaaagtttatcctaaggcaattaatttaggaggaattttt

SEQ ID NO: 2774 - protein, 149 aa, Streptococcus agalactiae
MKICLVGSSGGHLAHLNLLKPIWEKEDRFWVTFDKEDARSILREEIVYHCFFPTNRNVKNLVKNTILAFKVLRKERPDVIISSGAAVAVPFFYIGKLFGCKTVYIEVFDRMDKPTLTGKLVYPVTDKFIVQWEEMKKVYPKAINLGGIF

SEQ ID NO: 2775 - DNA, 489 bp, Streptococcus agalactiae
atgatttttgtcacagtggggacacatgaacagcagttcaaccgtcttattaaagaagttgatagattaaaagggacaggtgctattgatcaagaagtgttcattcaaacgggttactcagactttgaacctcagaattgtcagtggtcaaaatttctctcatatgatgatatgaactcttacatgaaagaagctgagattgttatcacacatggcggcccagcgacgtttatgaatgcagtttctaaaggaaaaaaaactattgtggttcctagacaagaacagtttggagagcatgtgaataatcatcaggtggactttgttaataaggtaaaaacaatgtataattttgatatcgttgtagatattgaaaggttacaaaatgtagtctatgagggaatgatgaatcgtccgtttttagaaactaatagtagtaattttattgaagaatttaaggtaatattaaaggagttgtgcgatgaaaatcaa

SEQ ID NO: 2776 - protein, 163 aa, Streptococcus agalactiae
MIFVTVGTHEQQFNRLIKEVDRLKGTGAIDQEVFIQTGYSDFEPQNCQWSKFLSYDDMNSYMKEAEIVITHGGPATFMNAVSKGKKTIVVPRQEQFGEHVNNHQVDFVNKVKTMYNFDIVVDIERLQNVVYEGMMNRPFLETNSSNFIEEFKVILKELCDENQ

SEQ ID NO: 2777 - DNA, 1092 bp, Streptococcus agalactiae
atgaaaatcaataaaaactctttattttatattgcaatatttttagttaatttttttaaatcactgggtttaggcgagggaaactcagcttacaaaatagtgatgttagttgcaattttactgtgtggaataaaatttttattagatagcctttattttgaaagaagaaaactcgtgatcatctttttattatttatcgcgaccattttgaatttattctttgttcataaggttacttttatattaactttaattttttttctagcattaaaggacatctctctaaaaaaagctttctctataataataggatcgcgtattttgggagttctattaaatcaaatttttgtgaaattagatttaatagaaattaagtatgtcaatttttatagggatggacaatttattctgagaagtgacttaggttttggtcatcctaactttattcataatttttttgctctaactattttcttgtatattgtactcaattataaacgactaaagcctgttgtgatggttttatttttaacattaaattatttattgtaccaatatactttttcaaggacagggtattatatcgtaattttatttattgtactcatttatgtgacaaagaatagcttaataaaaagagtatttatgaaattagcaccctatgtacaattttttttattagtatttacctttttgagttctacaattttttttaattcaaattttgttcaaaaattagatgttcttttaacaggtagattacactatgctcatttacaacttgtagatggtttaactccttttggaaatagttttaaggaaacaagtgtcctatttgataatagctactctatgttattgagtatgtatggtgtagtacttaccatgttttgtatgataatctattatatctatagtaaaaagataatcataattgaacttcaactactcctatttataatgtctataatattatttactgaaagtttttatcccagtgtggtaatgaatattagttggctagtttttggtaaaatattttgtgatggtatcgaacctataaaaaaggaatttactattgtgaataatata

SEQ ID NO: 2778 - protein, 364 aa, Streptococcus agalactiae
MKINKNSLFYIAIFLVNFFKSLGLGEGNSAYKIVMLVAILLCGIKFLLDSLYFERRKLVIIFLLFIATILNLFFVHKVTFILTLIFFLALKDISLKKAFSIIIGSRILGVLLNQIFVKLDLIEIKYVNFYRDGQFILRSDLGFGHPNFIHNFFALTIFLYIVLNYKRLKPVVMVLFLTLNYLLYQYTFSRTGYYIVILFIVLIYVTKNSLIKRVFMKLAPYVQFFLLVFTFLSSTIFFNSNFVQKLDVLLTGRLHYAHLQLVDGLTPFGNSFKETSVLFDNSYSMLLSMYGVVLTMFCMIIYYIYSKKIIIIELQLLLFIMSIILFTESFYPSVVMNISWLVFGKIFCDGIEPIKKEFTIVNNI

SEQ ID NO: 2779 - DNA, 723 bp, Streptococcus agalactiae
atgatacctaaagttatacattattgttggtttggaggaaatcccttaccagataatttaaagaaatatataaaaacttggagagaacaatgtccggattatgaaattattgaatggaatgagcataattatgatgttagtaaaaatgtttttatgagagaagcatatactaagaagaattttgcttatgtttctgactatgcaagattggatattatttatacttatggggggttctatctagatactgatgtggagcttttaaaaagtttagatcctttgaggattcatgagtgttttctagcaagggagattagttgtgatgtgaatacaggattaataattggcgctgttaaaggacatcactttttaaaatcaaatatgtctatatatgacaaaagtgatttaacttctcttaataagacatgtgtagaggttacaactaatttattgataaacagagggcttaagaataagaatattattcaaaagattgatgatataacaatatatccgagaaattattttaatccaaagaatttattaacaggtaaggttgattgtctgactagtgttacctattctatacatcattacgaaggaagttggaaaagttcttcatttatttcagattctctaaagattagagtaaggctcataattgattttttatttggatatggtacttatagaatgcttctaaggtttctaaagttaaagaaa

SEQ ID NO: 2780 - protein, 241 aa, Streptococcus agalactiae
MIPKVIHYCWFGGNPLPDNLKKYIKTWREQCPDYEIIEWNEHNYDVSKNVFMREAYTKKNFAYVSDYARLDIIYTYGGFYLDTDVELLKSLDPLRIHECFLAREISCDVNTGLIIGAVKGHHFLKSNMSIYDKSDLTSLNKTCVEVTTNLLINRGLKNKNIIQKIDDITIYPRNYFNPKNLLTGKVDCLTSVTYSIHHYEGSWKSSSFISDSLKIRVRLIIDFLFGYGTYRMLLRFLKLKK

SEQ ID NO: 2781 - DNA, 885 bp, Streptococcus agalactiae
atgttatatatttttactcctacatttaacagaggctaccgattatcctatctgtatgattctctatgtaatcagacaaataaaaattttatatggttgattgttgatgatggttctgaggacagtactaaggaaattgtaagtaattatataaaagagaataaagttagtattgtatatctgtataaacgtaatggcggtaagcattcagcctataatctagcaatgagatatatgcaaccaagtgattatcatgtatgtgtagatagtgatgattggttattagaagatgcagttgaaattatttttaaagatttagagagcctaacgttgtctaatagatatgtaggccttgtttatcctcgatattcattaaaccaaggtaataattggttgaatcccaaaatattagaagttaatattcctgatttaaaatataaatatcacttaaaaattgaaacttgtattgttattaataatgcttatttagtagatttcgaatttccttgtttcgaaggggagaatttcttatcagaagaaataatgtatatatatttatcaaaaaagggatacttttgtccccaaaataggaaaatctattgttttgactacttagaagatggtttgacttctaatatttttaaattatggagaaaaaatttcaaagggactattttttcattagaaaattcatatatgtatgtaatgtcttttcctaatatatttgatcgctggtggtcagctataaagataaaaatgaacatacaggctttgaaaatgactactttaggggtaatacctacactaaagagtgaagaggctgggtggaaaattttgttgggttttagctatctttggaaggtagcaaggtttaaaaagagcgag

SEQ ID NO: 2782 - protein, 295 aa, Streptococcus agalactiae
MLYIFTPTFNRGYRLSYLYDSLCNQTNKNFIWLIVDDGSEDSTKEIVSNYIKENKVSIVYLYKRNGGKHSAYNLAMRYMQPSDYHVCVDSDDWLLEDAVEIIFKDLESLTLSNRYVGLVYPRYSLNQGNNWLNPKILEVNIPDLKYKYHLKIETCIVINNAYLVDFEFPCFEGENFLSEEIMYIYLSKKGYFCPQNRKIYCFDYLEDGLTSNIFKLWRKNFKGTIFSLENSYMYVMSFPNIFDRWWSAIKIKMNIQALKMTTLGVIPTLKSEEAGWKILLGFSYLWKVARFKKSE

SEQ ID NO: 2783 - DNA, 981 bp, Streptococcus agalactiae
atggaattaatttcaataatagtgcctgtatataatggagaaatatatattgggagatgtctagatagtattcttgagcaaacttatcagaatttagagattatcataattgatgatggctctagtgatcgcacaggggatatttgcgaaaagtattttttggaagacaggcgaataaaatatttctatcaagaaaacagaggccaatcagttgcacgtaacaacggagtacttaggtgtacaggagattggattgcttttttagacagtgatgatgtttatcttccttattcaattgaggttatgtacaacatacagaaagctaccaatgccgatattgttttaactagtattggtaacttcaacaatacttacaatactagtattaattcacagtatttaaaagagattaaactttatactttagaggtggcgttggaagaaatgtattatgggaaaacttatggagtttccccgttagcaaaattatatccgagaagtaatttattgagtaatccatatccagaaggaaaaattcatgaagatatggatacaacttttaagcttatatcttgcgcttcaaaaatagcagtttgtgatattgtcactgcagtggtgtattttagcgataatagtactactaggacaaaattcaatgagagaatgttgtatttttttgaggcaattcaaaataatattgtatttataaatctaaattttccacataatacatctttaatctctgctgtaatatataatgaagtatttggtggaatagatatatgtgggaagatgattgattttaaattatatgatacagttgattattacagaaaaaaatatagaaaatattttaagactattctctttaataataggattagtgtgaaggagaaggttaaatatatattatttatttcctctataagatatttcactattgtaagaaaaatatataatttgaggttatcaaggaatgga

SEQ ID NO: 2784 - protein, 327 aa, Streptococcus agalactiae
MELISIIVPVYNGEIYIGRCLDSILEQTYQNLEIIIIDDGSSDRTGDICEKYFLEDRRIKYFYQENRGQSVARNNGVLRCTGDWIAFLDSDDVYLPYSIEVMYNIQKATNADIVLTSIGNFNNTYNTSINSQYLKEIKLYTLEVALEEMYYGKTYGVSPLAKLYPRSNLLSNPYPEGKIHEDMDTTFKLISCASKIAVCDIVTAVVYFSDNSTTRTKFNERMLYFFEAIQNNIVFINLNFPHNTSLISAVIYNEVFGGIDICGKMIDFKLYDTVDYYRKKYRKYFKTILFNNRISVKEKVKYILFISSIRYFTIVRKIYNLRLSRNG

SEQ ID NO: 2785 - DNA, 963 bp, Streptococcus agalactiae
atggataaagttagtatcattatcccagtttataacgttcaatctttcctaaacgagtgtatagaaagtgttttagctcaaacttattcaaatttagaaattattctagttaacgatggctctacagataattccggggatatctgtgattattattcagaaatagatgggcgtatattcgtttttcacaaaaataatggtggtttatcagatgctcgtaattatggaattagtagagctactggcgattatatttatttacttgattcggatgattatctatataaagaagatgcaatcgagagaatggttgaatttagcgagaaatataattcagaaattgttttagggtgttatgttgaaaaaagagaacaacatattataaatatcgttttagaagatgaaatgatagaaactattagtccagtacaagcaatacaaaatatttataattatgatgcctatagagctatttttactgtagcacataataaattatataagagagaattattttctacgctgtgctatccagtagggaagttacacgaagatgaatttttaacctataaattatatttgaaagccaaaaatataattttctttagatataatacttatgcatatcgtattagagaaaatagcataatgactggttcctacaatattaaaaggctacatgctgtagaagcacttaaggaaagaatttatttattagaaaagtatccagacttagtatttcaaagtgagagagctttaattaaaactatggaagtaaatttgatagagttatataaaaataatttttataaggaatttcatactctgaaaactgaatataaaaaaactatttttgattttataaaaaaacaacgtatgctactaaaaataaagtattatttaaagtattgtgtagtgcattttaaaatattaaattgtaaaagaaagaaaaagataaataaa

SEQ ID NO: 2786 - protein, 321 aa, Streptococcus agalactiae
MDKVSIIIPVYNVQSFLNECIESVLAQTYSNLEIILVNDGSTDNSGDICDYYSEIDGRIFVFHKNNGGLSDARNYGISRATGDYIYLLDSDDYLYKEDAIERMVEFSEKYNSEIVLGCYVEKREQHIINIVLEDEMIETISPVQAIQNIYNYDAYRAIFTVAHNKLYKRELFSTLCYPVGKLHEDEFLTYKLYLKAKNIIFFRYNTYAYRIRENSIMTGSYNIKRLHAVEALKERIYLLEKYPDLVFQSERALIKTMEVNLIELYKNNFYKEFHTLKTEYKKTIFDFIKKQRMLLKIKYYLKYCVVHFKILNCKRKKKINK

SEQ ID NO: 2787 - DNA, 1005 bp, Streptococcus agalactiae
atgtataaagtttcaattatttgcaccaattataacaaagctccttggatatctgatgcacttgacagttttttaagccaagtgacagattttgaggttgaaattattgttattgatgatgcttctacagatgactcacgagagattttaaagagttatcaaaaaaagtcttcaggaaaaattaaattactctttaacgaaactaatattggaataacaaagacttggataaaagcatgcctttatgcaaaaggcaaatatattgctagatgtgatggtgatgattactggacggatagttttaaactccaaaaacaagttgatgtcttagaagcttccaaacggtcacgatggtgtaatactgattttgactttgtaaatagtcaaggcgacttattatatgctaatgctttttcatctggtcatacacctttgacagatacttacgaaaaagttttagccttaaaagggatgacgatggcatcgacatggttagttgatgctgatttaatgagacaagtaaaccaaaaaatcaatgtagatacaccagacgatacttttgatattcaactagagttatttcaactgactcaactgacctatattaaagactcaacgacgatttatcgcatgacaaccgattctgattcaagacctactgatacaccaaaaatgatttatcgtattcaaaaactacttgatactcagttaaattacttaaaaaagtataatcaggtagatacaaaagaagtgtctgaactattattacaacaagatgctaagcaagaaatacgaattcatgagttgagttgctttattcaagaattacaacaaactatcgtagataaaacaaagcagcaagaaacacgtgaagtggagttgcaaaatgtcatagaagaacaaaaaaatcaactatctgaattaagacaacaataccatgccattattaattcacgtcaatggaaatacacgtctaagctcattgcttttattaggagaaaaaaa

SEQ ID NO: 2788 - protein, 335 aa, Streptococcus agalactiae
MYKVSIICTNYNKAPWISDALDSFLSQVTDFEVEIIVIDDASTDDSREILKSYQKKSSGKIKLLFNETNIGITKTWIKACLYAKGKYIARCDGDDYWTDSFKLQKQVDVLEASKRSRWCNTDFDFVNSQGDLLYANAFSSGHTPLTDTYEKVLALKGMTMASTWLVDADLMRQVNQKINVDTPDDTFDIQLELFQLTQLTYIKDSTTIYRMTTDSDSRPTDTPKMIYRIQKLLDTQLNYLKKYNQVDTKEVSELLLQQDAKQEIRIHELSCFIQELQQTIVDKTKQQETREVELQNVIEEQKNQLSELRQQYHAIINSRQWKYTSKLIAFIRRKK

SEQ ID NO: 2789 - DNA, 954 bp, Streptococcus pyogenes
atgaataattttgtgtgtcatactttataccatttactgattactataataaagttaaaagataaagaaaatactagaatatttatttgtgacactatcacgaattatgaaacttgggtaaaaacattaaatgaacagggaataaggacggaagcagttaaagagtttgcttatcgggagcagttacaaagtaaaaatattgaagaagtgatggagcttgtagattcagacttaaatcactactttgagagagtagatacacaagtctatctatttaatgatgatactttaataggtcgctatatggtgtatttgggtaaaaattatcatctaattgaagatggttataactgttttcaagccaagttattcttgggtggttctgtcgtaaaacgagtaattaaaacttacttatttaaaaagtatgttccgtatggtttttcaaaatattgtctctcaattgaggttaattctttagtggggctacctcatgacataaggagtaagaaatataaagaactaccgagaaaaaaattatttgatagtcttaacaaagagcaaaaatcactgattttcaaaatatttaaaacaaaaccattaactataactccaaagtcagtattattgttgacacagccacttgcacaagataaatgttataaaacacctacagagaggtttcaaagtattcaagagcaatacgattattttgacgatattgtccaggaatatagaacgttagggtacaatgtttatttaaaagttcatcctagagatgtagtagattattccaaattgccggtagagctattaccatcaaatatccctatggaaattatagagttgatgttaacaggacggttcgaatttgggataacacattcgtccaccgcgctggattttttaacttgtgttgataaaaaaataactttagtagatctgaaggatattaaa

SEQ ID NO: 2790 - protein, 318 aa, Streptococcus pyogenes
MNNFVCHTLYHLLITIIKLKDKENTRIFICDTITNYETWVKTLNEQGIRTEAVKEFAYREQLQSKNIEEVMELVDSDLNHYFERVDTQVYLFNDDTLIGRYMVYLGKNYHLIEDGYNCFQAKLFLGGSVVKRVIKTYLFKKYVPYGFSKYCLSIEVNSLVGLPHDIRSKKYKELPRKKLFDSLNKEQKSLIFKIFKTKPLTITPKSVLLLTQPLAQDKCYKTPTERFQSIQEQYDYFDDIVQEYRTLGYNVYLKVHPRDVVDYSKLPVELLPSNIPMEIIELMLTGRFEFGITHSSTALDFLTCVDKKITLVDLKDIK

SEQ ID NO: 2791 - DNA, 141 bp, Streptococcus agalactiae
atgaaaaatcaaaggaatagacacagtgacaatgaaccgaaaatacttaggattgtaaaaagatttgctatgataataaatataagcaaaggcaactattccagttattatagtaggaacaaaagctccaaaaaccctaga

SEQ ID NO: 2792 - protein, 47 aa, Streptococcus agalactiae
MKNQRNRHSDNEPKILRIVKRFAMIINISKGNYSSYYSRNKSSKNPR

SEQ ID NO: 2793 - DNA, 1398 bp, Streptococcus agalactiae
atgaatactaagaaattacttcaatctggttttatttatacactcgggaatttattggtgcaaggattagcctttatcacacttcccatctacactcgagtcatctcaacagaagtttatggccaatatagtttatatgttgcttggatgggaattattactctgtttattggtcttcagacgagcggttctttaagttcggctcgagtcaaatatggagaagagtttaaaagctactctgggagtgccttttctgtaggtaatatatggtttcttattgtacttttgatagcttttctatttagaagttttcttgcaccattagttggtttttctgaatctatttttttattaatggtgtgtcaaagttacgctaactatgtggtgactttctttggtcagtattttatacaacaacagaggagcttggctaatttaatactatccttagccaatgcagtttcatctgttgcactatctctatttttaatttttcattggtccgatgactttttatctagggtttttggagcttttgttcctactataataactggaatagttgcctttgcttatatttattatcatagcaaatctttttacaatcctaagtattttcggttcattgtcactgtgtctattcctttgatttttcatttgttaggacatcagttattaaatcaattagataggattatgctagctcgcttatatagtactaaagaagttgcaatgtatagtttcggttattcgcttggaatgattattcagattgttttgaatagtattaatatggcttggattccatggttttttgatgctagaaaagaaaaattactgcaactttcaacttatattagccgttatctctatttaggagttttcttaacattaggttatttgactgtttttcctgagttagctcaaataatgggaggagacaagtatagtagtagtgttcaatttatttctttaattattgtcagctattttttagtctttctctatacatttcctgtaaatatccaattcttctatgctaatacgacatggattcctattgggacattattagctgctggtgtaaattggttactaaaccttgtattaattcctcattatgcagcctatggcgctgctatggctacaataatatcttatttagccttgttgatttttcatcatattgtttcgaaagttaaataccattattcagatgtctcagttaggcagtacattattttaagtggtatagtatttagttatgctatgttaatgaacatgttcctaggtaatatcgttattagatggagtttaggaataattattcttatagtatatagcattgtttttcaaaaagtcattttagacttattgggtaaaaaaagaaggagaaga

SEQ ID NO: 2794 - protein, 466 aa, Streptococcus agalactiae
MNTKKLLQSGFIYTLGNLLVQGLAFITLPIYTRVISTEVYGQYSLYVAWMGIITLFIGLQTSGSLSSARVKYGEEFKSYSGSAFSVGNIWFLIVLLIAFLFRSFLAPLVGFSESIFLLMVCQSYANYVVTFFGQYFIQQQRSLANLILSLANAVSSVALSLFLIFHWSDDFLSRVFGAFVPTIITGIVAFAYIYYHSKSFYNPKYFRFIVTVSIPLIFHLLGHQLLNQLDRIMLARLYSTKEVAMYSFGYSLGMIIQIVLNSINMAWIPWFFDARKEKLLQLSTYISRYLYLGVFLTLGYLTVFPELAQIMGGDKYSSSVQFISLIIVSYFLVFLYTFPVNIQFFYANTTWIPIGTLLAAGVNWLLNLVLIPHYAAYGAAMATIISYLALLIFHHIVSKVKYHYSDVSVRQYIILSGIVFSYAMLMNMFLGNIVIRWSLGIIILIVYSIVFQKVILDLLGKKRRRR

SEQ ID NO: 2795 - DNA, 1023 bp, Streptococcus agalactiae
atggtttatattattgcagagattggttgcaatcataatggagatattaatcttgcgaaaaaaatggtagatgttgccgtgtcttgtggtgttgatgctgttaaatttcagacttttaaagctgagaaacttatttctaaatttgctcccaaagctgaatatcaaaaagcaactacaggaacagcagacagtcaacttgagatgacgaaacgtttagagttaagctttgaagaatacttagaaatgcgtgattatgcaatttcaaaaggtgtggagaccttttcaacaccttttgatgaagagtcattagagttcttaatttctacagatatgccaatttacaaaattccatcaggagaaatcactaatttaccttacttagaaaagattggcaagcaacaaaagaaagttattctttcgacgggtatggcggtaatggaagagatccatcaagcggtgaatattttacgtcagaatggtacaaccgacatttctattttacattgtacaacagagtacccaacaccttacccctctctaaatttaaacgttattcatactttgaaagatgaatttaaagatttaacgataggttattcggatcattcaattggatcagaagtacctatcgcagcagcagcaatgggtgcagaagttattgaaaaacactttactttagatactaatatggaaggtccggatcataaagccagtgcaacacctgatattttagctgctttagttaaaggggttcgcattgttgaacaagccttaggtagatttgaaaaaatcccagatccagtagaagaaaaaaataagattgttgctcgtaaatcagtcgttgctttaaaaccaattaaaaaaggcgatatttattcaatagaaaatattacggtgaagcgcccaggtaatggtatttctcctatgaactggtatgacatcttgggacaagaagcgcaagatgatttcgaagaggatgaagttattcgtgattcacgctttgaaaatcaattgcccgagtta

SEQ ID NO: 2796 - protein, 341 aa, Streptococcus agalactiae
MVYIIAEIGCNHNGDINLAKKMVDVAVSCGVDAVKFQTFKAEKLISKFAPKAEYQKATTGTADSQLEMTKRLELSFEEYLEMRDYAISKGVETFSTPFDEESLEFLISTDMPIYKIPSGEITNLPYLEKIGKQQKKVILSTGMAVMEEIHQAVNILRQNGTTDISILHCTTEYPTPYPSLNLNVIHTLKDEFKDLTIGYSDHSIGSEVPIAAAAMGAEVIEKHFTLDTNMEGPDHKASATPDILAALVKGVRIVEQALGRFEKIPDPVEEKNKIVARKSVVALKPIKKGDIYSIENITVKRPGNGISPMNWYDILGQEAQDDFEEDEVIRDSRFENQLPEL

SEQ ID NO: 2797 - DNA, 1152 bp, Streptococcus agalactiae
atgaaaaaaatttgtttagtaaccggatcgcgtgctgaatacggaataatgaagccattgattcaaagattgtcaaaagataaagaagtcaacttacaaattattgcaacagcaatgcatctggaagaaaagtacggctatacttatcgtcaaattgaagaagacggttttgatattgcttataaagttcccttacatctttatgatactgacagaagaactgtatctactgcaatggcgcatttacaactaggattgaccaaaatttttgacaaggaagactatgatctagtcatcattttaggggatcgttatgaaatgttaccagttgtgaatgtagcgttgatttataatgtcccagtatgccaccttcatggaggggagacctcattaggcaattttgatgagtatattcgccatgcaattactaagatgagtcacctacacttagtctctacagaggactttcgtcaacgtgtgattcagatgggagaacaacctcaatttgtaattaacacaggagctctcggagtggaaaatgctctatcaatcccttctctaaccaaagaagcaatagaaaagcaattaggtattgcactagaggaatcctattttgttgttctctatcatcctgttacttttgaacaaggaaaaagtgctggagagcagatgaaagcggtactatcagccctttctaagtttggtgtccagtgtctatttataggatccaattcagatactggttctgatgatattgcaaaggctatcaatacttatttgacaaatcatgaaaatagtcattgctttgcttctttatcaacccaactttatcattccttaattcgtcattcactaggactgattggtaattcgtcttctggtttaatagaagttccttctttgatgaaacctactcttaatattggtgatcgccaaaaaggtaggctacatggagaaagtgtagtaagtgtaccagtcgaaacctcctctgtattggagggattatcaaaattgaatgaagtgaccaactttgacaatccctactacaaagagaatgcttcatctattgcatatgaagcaataaagctgtatttgaaagatgaaccttcaatttcccaaccattttatgatttaaaggagaataatctaaaa

SEQ ID NO: 2798 - protein, 384 aa, Streptococcus agalactiae
MKKICLVTGSRAEYGIMKPLIQRLSKDKEVNLQIIATAMHLEEKYGYTYRQIEEDGFDIAYKVPLHLYDTDRRTVSTAMAHLQLGLTKIFDKEDYDLVIILGDRYEMLPVVNVALIYNVPVCHLHGGETSLGNFDEYIRHAITKMSHLHLVSTEDFRQRVIQMGEQPQFVINTGALGVENALSIPSLTKEAIEKQLGIALEESYFVVLYHPVTFEQGKSAGEQMKAVLSALSKFGVQCLFIGSNSDTGSDDIAKAINTYLTNHENSHCFASLSTQLYHSLIRHSLGLIGNSSSGLIEVPSLMKPTLNIGDRQKGRLHGESVVSVPVETSSVLEGLSKLNEVTNFDNPYYKENASSIAYEAIKLYLKDEPSISQPFYDLKENNLK

SEQ ID NO: 2799 - DNA, 627 bp, Streptococcus agalactiae
atgaaaaaaaagttggcatttttaggcgcaggaagtcatgctgatgcgattgctccggttattgatcctcttgtgtatgatttcgtaggtttttttgatgataaagatattacggagcatgatggttatcctgttcttggaaaactttatgatgtgctaccttaccttgaagatggctcaatagatgcagtatttattacaataggtgataatgctaaaaggaaagaactatttgaatatgtagcaaaggattattatgactttattattaacatcattagtcccaatgctttagtattgacaccagatagtatttgtggacgtggtatctttattggttttggggcttttataggttctaaagtgaagctgtttgataacaatgttgttaatacaggagcgctcattgaacatcatactgttgtagaatcacactgtaatatagcacctaatgctaccataaatggtctttgttatattagagaagaagtttatgtaggtagtgccagtgttattattcaaaccttggatatttcatcatgtacgacaattggagcaggagctgttgttgtaaaagatattatagaacctggaacctatgtaggggttccagccaaaaaaataaaa

SEQ ID NO: 2800 - protein, 209 aa, Streptococcus agalactiae
MKKKLAFLGAGSHADAIAPVIDPLVYDFVGFFDDKDITEHDGYPVLGKLYDVLPYLEDGSIDAVFITIGDNAKRKELFEYVAKDYYDFIINIISPNALVLTPDSICGRGIFIGFGAFIGSKVKLFDNNVVNTGALIEHHTVVESHCNIAPNATINGLCYIREEVYVGSASVIIQTLDISSCTTIGAGAVVVKDIIEPGTYVGVPAKKIK

SEQ ID NO: 2801 - DNA, 1239 bp, Streptococcus agalactiae
atgaagccaatttgtattattcctgcgcgatcagggtcaaaaggattaccagataagaatatgttattcctatctggtaaacccatgattttccatactatagatgctgcaattgaatctggaatgtttgataagaaagatatttttgttagtacagattcagaattgtacagagagatttgtttagaacgcggtatttcagtggtgatgagaaaaccggaactttcaactgatcaggcaacttcgtatgatatgttaaaagattttttatctgactatgaagataatcaggagtttgtgttacttcaagtaacttctccactaagaaaatcatggcatataaaggaagcaatggagtattattcttcacatgatgttgacaatgttgtaagtttttctgaagttgagaaacaccctagtctgtttacaacattatctgatgaaggctatgctatagatatggtgggagcagataaaggttatcgtcgccaagatttacaacctttatactatccgaacggcgctatttttatttctaataaagaaacttacttaagggaaaaaagctttttcacctctaggacatatgcttatcaaatggcaaaggaattttcattagatgttgatacgagagatgattttatccacgtcatcggtcacctctttttcgattatgccattagggaaaaagagaataaagttttttataaagaaggctatagtcgtttgttcaatagagaagcttcaaagataattttaggtgattcaaaaacgatatctacctcactagaaagttaccataattattcccaaggtggtgtaacattagcaacgatgttggaaaacttacctaactttttgacagctaatgtaacagaggcttttgtttctataggggtaaatgatctcattacaggttatagtgtggaagaaatattcagcaatttccaaaaactctactcattattagctgagaataaaataaagatgagattgacaactattgcttacaccctttttagagaaactgtcaataatgcagatattgagaaaatcaatcaatggctaacagaattttgttatcaaaatcagattccactgttagatattaatagatttttatcaaaggatggtaatctaaattatcatttaactagtgatggattgcattttactcaagaggctaatgatttgttacaaagtcaatatcaattatttgtagacgaagttaaaacctta

SEQ ID NO: 2802 - protein, 413 aa, Streptococcus agalactiae
MKPICIIPARSGSKGLPDKNMLFLSGKPMIFHTIDAAIESGMFDKKDIFVSTDSELYREICLERGISVVMRKPELSTDQATSYDMLKDFLSDYEDNQEFVLLQVTSPLRKSWHIKEAMEYYSSHDVDNVVSFSEVEKHPSLFTTLSDEGYAIDMVGADKGYRRQDLQPLYYPNGAIFISNKETYLREKSFFTSRTYAYQMAKEFSLDVDTRDDFIHVIGHLFFDYAIREKENKVFYKEGYSRLFNREASKIILGDSKTISTSLESYHNYSQGGVTLATMLENLPNFLTANVTEAFVSIGVNDLITGYSVEEIFSNFQKLYSLLAENKIKMRLTTIAYTLFRETVNNADIEKINQWLTEFCYQNQIPLLDINRFLSKDGNLNYHLTSDGLHFTQEANDLLQSQYQLFVDEVKTL

SEQ ID NO: 2803 - DNA, 489 bp, Streptococcus agalactiae
ttgagtatgagagaaactgaaacacacgatcaccaagcgctaattcaaaaattgttagtcagtattcattatttaaccttgtttcgtgatgaaattatattagtagaaaaaaccccatctttactggggaaacatttttctattgctattgtgcagaatgaactaggtgagatactttctaaaatagaagctttgagtaagcaaaaaaaactgattcgttctatttattggtatgatgaatcgtcatttaaagttatgaataaggctctggctattgtagaagaatggattaagggcttagataatcttttagaattctgtcaatcacagacggtttttcaagcaattttaggtgatgaacgtgcacatgtatttggaatccttattgatgtttatacttctttaaacattataaatacttctttgaaagaagaaaattctagaccagtgtccttatctgatttggctctaggtcttaaggacgaagat

SEQ ID NO: 2804 - protein, 163 aa, Streptococcus agalactiae
MSMRETETHDHQALIQKLLVSIHYLTLFRDEIILVEKTPSLLGKHFSIAIVQNELGEILSKIEALSKQKKLIRSIYWYDESSFKVMNKALAIVEEWIKGLDNLLEFCQSQTVFQAILGDERAHVFGILIDVYTSLNIINTSLKEENSRPVSLSDLALGLKDED

SEQ ID NO: 2805 - DNA, 534 bp, Streptococcus pyogenes
gtgaatgttactgaacaaaatagtcatcaaatcttaatccaaaagttattggtcagtatccactatttgactctttttcgagatgaactgaagcttgtagaacgaactccttctatacttggaggggaatttccagctcatttagtacagtctgagttgggagatattgttgcggccattgataccttggatatgcagcaacgcttgattgagtctaccttttggtatgaagaatcagcttttaagttgatgaacaaaactttggatattgtcgataattggattaaaggagtggatcatctgatagatttatgccagtccaaagaagtctttcaaattattattggagataaacgcattcgagtttttggggtcttaagtgatgttttttcatctttaaaagtgagtgctttgtcacttaaggaagctcctattccggatgtgctctatgaacatatccagagggttaatcttgaagaagaagcttttataaaatattaccaaagccctaaggtacccacaggtgagtttgaa

SEQ ID NO: 2806 - protein, 178 aa, Streptococcus pyogenes
VNVTEQNSHQILIQKLLVSIHYLTLFRDELKLVERTPSILGGEFPAHLVQSELGDIVAAIDTLDMQQRLIESTFWYEESAFKLMNKTLDIVDNWIKGVDHLIDLCQSKEVFQIIIGDKRIRVFGVLSDVFSSLKVSALSLKEAPIPDVLYEHIQRVNLEEEAFIKYYQSPKVPTGEFE

SEQ ID NO: 2807 - DNA, 651 bp, Streptococcus agalactiae
atgaaacattctagttggcatgatttaataaaaagagaactacccaatcattactacaataaaattaatacatttatggatgcagtttacgaaagcggaatcgtttatcctccaagagataaggtgttcaatgccatacagataacaccactagaaaacgtaaaagtagtgattattggccaagatccttaccatggacctcaacaagctcaaggactctcattttctgttccagacaatttaccagctcctccttcacttcaaaatattctaaaagaattagcagaagatatcgggtcacgttcacatcatgacttaacatcatgggcgcaacaaggagtgctgctattaaatgcttgtttaacagttccagaacaccaagctaatggtcatgctgggcttatatgggaaccttttactgatgctgtcatcaaagtggttaaccaaaaggaaacaccagtagtctttattctgtggggtggctatgctcgaaagaaaaagtcgctaattgataatcctattcatcatattattgagagtcctcatccgagtcccttatctgcttatcgtggcttctttggtagcagacctttttctagaacaaatcatttcttagaagaagaaggaataaatgagattgattggttaaat

SEQ ID NO: 2808 - protein, 217 aa, Streptococcus agalactiae
MKHSSWHDLIKRELPNHYYNKINTFMDAVYESGIVYPPRDKVFNAIQITPLENVKVVIIGQDPYHGPQQAQGLSFSVPDNLPAPPSLQNILKELAEDIGSRSHHDLTSWAQQGVLLLNACLTVPEHQANGHAGLIWEPFTDAVIKVVNQKETPVVFILWGGYARKKKSLIDNPIHHIIESPHPSPLSAYRGFFGSRPFSRTNHFLEEEGINEIDWLN

SEQ ID NO: 2809 - DNA, 651 bp, Streptococcus pyogenes
atggctcattcaatttggcatgagaaaatcaaatcatttttgccggagcattactacggtcgcatcaatcactttttagatgaagcctatgcttccggtcttgtctatcctccacgagaaaatgtctttaaagccttacaagtcactcctttggaagaaaccaaagtgttgattttaggacaagacccttatcatggccccaaacaggcccagggcttatcattttcagttccagaagagatttctgctccgccatcccttattaatattttaaaagaattagcagatgacattggtcctcgtgaccatcatgatttaagcacttgggctagtcaaggggttctgcttttgaatgcttgcttaacagtgccagcaggccaggctaatgggcatgcaggcttaatatgggagccatttacagatgctgttattaaagtgctgaatgagaaagacagccctgtagttttcattttgtggggagcttatgcaaggaagaaaaaagccttcattactaatccaaagcaccacatcatcgagagccctcatccaagccctttgtcatcttatcgtggcttttttggcagcaaacccttttcaagaaccaatgctattttagaaaaagagggcatgactggcgtagattggctaaaa

SEQ ID NO: 2810 - protein, 217 aa, Streptococcus pyogenes
MAHSIWHEKIKSFLPEHYYGRINHFLDEAYASGLVYPPRENVFKALQVTPLEETKVLILGQDPYHGPKQAQGLSFSVPEEISAPPSLINILKELADDIGPRDHHDLSTWASQGVLLLNACLTVPAGQANGHAGLIWEPFTDAVIKVLNEKDSPVVFILWGAYARKKKAFITNPKHHIIESPHPSPLSSYRGFFGSKPFSRTNAILEKEGMTGVDWLK

SEQ ID NO: 2811 - DNA, 636 bp, Streptococcus agalactiae
atgaatattataattatgattatcattgcctatctgttaggctctatccaaactggactttggattggtaaatatttttaccaagtcaatcttcgtcaacacggtagtggtaatactggcaccacgaataccttccgtattttaggtgtaaaagctggcattgtcactttgactattgacattttaaaagggactctagcaacacttattcctatcatattaggtataacgacagtatctccattttttatcggtttttttgctattataggtcacactttccctatttttgcacaattcaaaggtgggaaagccgttgctacaagcgctggggttttgctaggatttgcaccttcttttttcctttacttattagttatctttttattaacgctttatctttttagcatgatttccctatccagtattacagtagctgttgtaggtattcttagtgtcttaatttttccattagtaggctttatattaacggactacgactggatatttaccactgtggttatcttaatggccctaacgattattatccgacatcaggataatatcaaacgtattcgaaaaaggcaagaaaatttggttccgtttggcttaaacctaagtaaacaaaaaaataaa

SEQ ID NO: 2812 - protein, 212 aa, Streptococcus agalactiae
MNIIIMIIIAYLLGSIQTGLWIGKYFYQVNLRQHGSGNTGTTNTFRILGVKAGIVTLTIDILKGTLATLIPIILGITTVSPFFIGFFAIIGHTFPIFAQFKGGKAVATSAGVLLGFAPSFFLYLLVIFLLTLYLFSMISLSSITVAVVGILSVLIFPLVGFILTDYDWIFTTVVILMALTIIIRHQDNIKRIRKRQENLVPFGLNLSKQKNK

SEQ ID NO: 2813 - DNA, 720 bp, Streptococcus pyogenes
ttgcaaaataatttgctaattttttccgaattcttttccagatctagttctccaatctatgaatatgttataataaggattatgaaattactactttttattaccattgcctatttacttggttctattccaactggactatggattggacagtacttttaccacatcaacttacgagagcatggatcaggaaatactggaaccacaaatacttttcggattttaggtgtcaaggcaggaacagctaccttagctattgatatgtttaaagggacactttcaatattgttaccaattatttttggtatgacttcaatttcatccattgctatcggctttttcgcagttttagggcatacttttcctatttttgccaactttaaaggtggtaaggccgtagcaacaagtgctggtgtattgctaggctttgctccgttatatctcttttttttagcatctatctttgttttagttctctatttatttagtatgatatctttagctagtgtggtttcagctatcgttggtgtgttatctgttttaacatttcctgccattcattttcttttaccaaattatgactactttttaacttttattgtgatattacttgcgttcattattattataagacacaaagataacattagtcgtatcaaacatcatactgaaaatctaataccttgggggctaaatttaagcaaacaagtgcctaaaaaa

SEQ ID NO: 2814 - protein, 240 aa, Streptococcus pyogenes
LQNNLLIFSEFFSRSSSPIYEYVIIRIMKLLLFITIAYLLGSIPTGLWIGQYFYHINLREHGSGNTGTTNTFRILGVKAGTATLAIDMFKGTLSILLPIIFGMTSISSIAIGFFAVLGHTFPIFANFKGGKAVATSAGVLLGFAPLYLFFLASIFVLVLYLFSMISLASVVSAIVGVLSVLTFPAIHFLLPNYDYFLTFIVILLAFIIIIRHKDNISRIKHHTENLIPWGLNLSKQVPKK

SEQ ID NO: 2815 - DNA, 102 bp, Streptococcus agalactiae
gtgacctccaaattttttcatcttttttatattacaagttttttgctgtttttgcaaaattatttttttaaaaatagcaaaaagacttttatgcttatgtta

SEQ ID NO: 2816 - protein, 34 aa, Streptococcus agalactiae
MTSKFFHLFYITSFLLFLQNYFFKNSKKTFMLML

SEQ ID NO: 2817 - DNA, 1959 bp, Streptococcus agalactiae
ttggaggtcactttggctaaacaagatataacagtgacgaattatggcgacgatgctattcaagtcttagaaggattagatgctgttcgtaagcgtccagggatgtatatcggttccacagatggaactggtttacatcatttagtgtgggaaattgtagataatgcagttgatgaagctctatcaggttttggaaatcgcattgatgttattattaacaaagatgggagtataactgttacagaccatggacgcggtatgccaactggaatgcatgctatgggaaaacctactgttgaagtcatcttcacggtgcttcatgcaggtggaaaatttggacaaggtggttataaaacatcaggtggtctccatggtgttggatcatctgtagttaatgctttgtcttcttggttagaagttgaaatcattcgcgacggagctatttacagacaacgttttgaaaatggtggtaagcccgttacaactctgaaaaaaattggcacggcaccaaaatcaaaatctggaacttctgtcagctttatgccagatcaatcagtattttcaacgatagattttaagtttaatacaattgcagagcgcttaaaggaatctgcttttctcttaaaaaatgttactttaaccttaacagataatcgttcagaagaagcagagcatctagaatttcattatgaaaacggtgttcaagattttgtagagtatttaaatgaagataaagaaacgttgacaccaatcatgtttttcgaaggtgaagaacaagaatttcatatcgaagttgctttgcagtataatgatggtttttcagataatatcctttcttttgtcaataatgttcgtactaaagatggtggaacacatgaaactggcttgaaatcagctattacaaagtctatgaatgactatgcacgtaaaacaggacttcttaaagaaaaagataaaaaccttgaaggttctgattatcgtgaggggctatcagccattttatctattcttgtacctgaggagcacttgcaatttgaaggtcaaactaaagataaactaggaagtcccttagcacgaccaattgttgatggtattgtttctgaaaagttaacttactttcttatggaaaatggagatttagcatctaatttaatccgtaaggcaataaaagcacgtgatgcgcgtgaagctgcacgtaaagcacgtgatgaaagtaggaatgggaaaaagtcgaaaaaagataaaggtctactttctggaaaattaacccctgcacaatcaaaaaatgctaagaaaaatgaactctatttagtcgaaggagactctgcaggtggctctgctaagcaaggtcgtgatagaaagtttcaagctattttaccgttgcgaggaaaagtattgaatacagctaaggcaaagatggctgatattataaaaaacgaagaaattaatacaatgatccataccattggtgcaggtgttggtcctgattttaatcttgacgatattaattatgataaaattatcattatgaccgatgctgatactgacggagctcatattcagacactattattaactttcttttatcgctatatgagacctcttgttgaagagggacatgtctatattgctttgccacctttgtataaaatgtcaaaaggaaaaggtaagaaagaaattgttgagtatgcttggacggatatagagttagaagaattacgacaaaaatttggtaaaggctcactattacaacgatataaagggcttggggaaatgaatgccgatcaattgtgggaaaccactatgaaccctgagacaaggacattaattcgtgtaacaattgaagatttagcaagagcagaacgtcgagttaatgtcttgatgggtgataaagttcctccaagacgccaatggattgaagataatgtcaagtttactttagaagagaatacagtattt

SEQ ID NO: 2818 - protein, 653 aa, Streptococcus agalactiae
MEVTLAKQDITVTNYGDDAIQVLEGLDAVRKRPGMYIGSTDGTGLHHLVWEIVDNAVDEALSGFGNRIDVIINKDGSITVTDHGRGMPTGMHAMGKPTVEVIFTVLHAGGKFGQGGYKTSGGLHGVGSSVVNALSSWLEVEIIRDGAIYRQRFENGGKPVTTLKKIGTAPKSKSGTSVSFMPDQSVFSTIDFKFNTIAERLKESAFLLKNVTLTLTDNRSEEAEHLEFHYENGVQDFVEYLNEDKETLTPIMFFEGEEQEFHIEVALQYNDGFSDNILSFVNNVRTKDGGTHETGLKSAITKSMNDYARKTGLLKEKDKNLEGSDYREGLSAILSILVPEEHLQFEGQTKDKLGSPLARPIVDGIVSEKLTYFLMENGDLASNLIRKAIKARDAREAARKARDESRNGKKSKKDKGLLSGKLTPAQSKNAKKNELYLVEGDSAGGSAKQGRDRKFQAILPLRGKVLNTAKAKMADIIKNEEINTMIHTIGAGVGPDFNLDDINYDKIIIMTDADTDGAHIQTLLLTFFYRYMRPLVEEGHVYIALPPLYKMSKGKGKKEIVEYAWTDIELEELRQKFGKGSLLQRYKGLGEMNADQLWETTMNPETRTLIRVTIEDLARAERRVNVLMGDKVPPRRQWIEDNVKFTLEENTVF

SEQ ID NO: 2819 - DNA, 1950 bp, Streptococcus pyogenes
gtgttgactaagaaagaaattacaattaataattataatgacgatgctatccaagtcctagaagggttagatgctgttcgcaagcgtccagggatgtatatcggttcaacagatgctacgggattgcaccacctgatttgggaaattgttgataatgctgtcgatgaggccttgtctggttttggagatgatattaaggttgttatcaataaagatggctcggtcagtgtggcagatagcggacgtggaatgccaacaggccagcatgccatggggattcccaccgttcaagttatttttacgattcttcatgcaggtggtaaatttggtcagggtggctacaaaacgtcaggtggtttgcacggtgttggctcctctgttgtcaatgctttgtctgcctggttagaagtcgaaatcacaagagacgggtcagtgtatcgtcagcgctttgaaaatggtgggaaacctgttacaacccttaaaaaagttggcacagctcctaagtctaaatcaggaacggttgtaacctttatgcctgatgataagattttttcaactattgactttaagttcaataccatttcagaacgattgaaagaatctgcttttcttttgaaaaatgtcaagatgagcttgacagatcttcgtggagatgacccgattattgaagagtttcattatgaaaatggggttcaagatttcgtcgaatacctcaatgaagataaggaaaccttgacacctgttatttacatggaaggtcaagaccaagactttcaagtcgaggttgctttgcagtataacgatggtttctccgacaatatcttatcctttgtaaacaatgtgcgcaccaaagatggtggaagccatgaaacgggactaaagtcagctattaccaaagcgatgaatgactatgctcgtaaaaccaatctcttaaaagaaaaggataaaaatctagagggctcagattatcgagaaggactctcagcagtattatctatcttagttcctgagcagcacttgcaatttgaaggacagaccaaagacaaattgggaagtcccttagctagacctattgtagagagcattgtttctgaaaaattaaccttctttttactcgaaaatggagaagtagcttctcatctagttcgcaaagccattaaagctagagatgctcgcgaagctgctcgaaaagcgcgtgatgactcacgtaatggtaagaaaaacaaaaaagacaaaggcttgttgtcgggaaaactaaccccagctcagtccaaaaatgccaagaaaaatgaattgtatctggtcgaaggagattctgcgggaggttcagccaaacaaggacgagaccgcaaatttcaggctattttaccattacgtggcaaagttttaaataccgaaaaagctaagatggctgacatcttgaaaaatgaagaaattaacactatggtttataccattggagctggagtgggagctgactttaacctcgaggatatcaactatgataagattattatcatgaccgatgctgataccgatggggctcatattcagactcttttgctgactttcttttaccgttatatgcgaccgttggtggaagcaggtcacgtttatattgcgcttcccccgctttacaaaatgtcaaaaggtaaaggcaaaactgaaaaaattgcttatgcttggactgatggtgaattggaagatctgcgcagagaatttggcaagggggctattcttcaacgctataaaggactgggtgaaatgaatgctaaccaattatgggaaaccactatggaccctgaaaccagaacccttattcgtgttactattgacgacttggcaagagcagagcgacgtgtttctgtgttgatgggtgacaaagcagccccacgccgtcagtggatcgaggataacgtcaagtttaccttagaagaaaatacggtgttt

SEQ ID NO: 2820 - protein, 650 aa, Streptococcus pyogenes
VLTKKEITINNYNDDAIQVLEGLDAVRKRPGMYIGSTDATGLHHLIWEIVDNAVDEALSGFGDDIKVVINKDGSVSVADSGRGMPTGQHAMGIPTVQVIFTILHAGGKFGQGGYKTSGGLHGVGSSVVNALSAWLEVEITRDGSVYRQRFENGGKPVTTLKKVGTAPKSKSGTVVTFMPDDKIFSTIDFKFNTISERLKESAFLLKNVKMSLTDLRGDDPIIEEFHYENGVQDFVEYLNEDKETLTPVIYMEGQDQDFQVEVALQYNDGFSDNILSFVNNVRTKDGGSHETGLKSAITKAMNDYARKTNLLKEKDKNLEGSDYREGLSAVLSILVPEQHLQFEGQTKDKLGSPLARPIVESIVSEKLTFFLLENGEVASHLVRKAIKARDAREAARKARDDSRNGKKNKKDKGLLSGKLTPAQSKNAKKNELYLVEGDSAGGSAKQGRDRKFQAILPLRGKVLNTEKAKMADILKNEEINTMVYTIGAGVGADFNLEDINYDKIIIMTDADTDGAHIQTLLLTFFYRYMRPLVEAGHVYIALPPLYKMSKGKGKTEKIAYAWTDGELEDLRREFGKGAILQRYKGLGEMNANQLWETTMDPETRTLIRVTIDDLARAERRVSVLMGDKAAPRRQWIEDNVKFTLEENTVF

SEQ ID NO: 2821 - DNA, 2457 bp, Streptococcus agalactiae
atgtctaatattcaaaatatgtcccttgaggacattatgggagagcgttttgggcgctattctaagtatatcattcaagaacgggcgttgccggatattcgtgatggcttaaaacctgttcaacgtcgaatcctttattcaatgaataaagatggtaatacttttgaaaagggatttcgcaaatctgcaaaatcagtcggtaatgttatggggaatttccatcctcatggggattcctctatctatgacgcgatggttcgtatgtctcaagattggaaaaatcgtgagacattgattgaaatgcacggaaataatggttctatggatggagatcctgcggcggctatgcgttatacggaagcccgtctatcagaaattgctggttatcttcttcaagatattgataagaataccgtaccctttgcgtggaattttgatgatacagagaaagaaccaactgttttaccagctgcctttcccaatcttttagtcaacggagcaacaggaatatctgcaggctatgcgacagatattccaccacataatctagcagaagtcattgatgctgtcgtgtacatgattgatcaccctaaagctaaattagataaattaatggaatttctacctggtccagattttccaactggcgctatcattcaaggaaaagatgaaattcgtaaggcatatgagactggtaaggggagagtagcggttcgctcgcgaactgctattgaaaccttaaaaggtggtaagaaacaaattattgttactgaaattccttatgaagttaataagtcagttttagtaaaacgaatcgatgatgttcgtgttaataataaagttccaggaatagcagaggtgcgtgatgagtctgatagagatggtcttcgtatcgctattgagctcaaaaaagaagccgatgaaacaattgtcttaaattatctttttaaatatacagacctacaagttaattataatttcaatatggttgctattgatgactacacccctaagcaggtgggtctatcaagaatattaactagctatatcgctcaccgaagagaaattattattgctcgttcaaaatttgataaagaaaaagccgaaaaacgtctccatattgttgagggactgattagggttctttctattttggatgaagtgattgcattaattcgtgcttctgagaataaagctgatgcgaaagagaatttgaaggtcagctatgagttttcagaagctcaagcagaggctatcgtcacattgcaattatatcgtctcacaaatactgatattgtgacgttgagagaagaagaagaagaacttcgtcaacaaatcacaatgcttaaggcaattattagtgatgaacgtacgatgtataacgtaatgaaacgtgagttacgtgaggtcaaaaagaaatttgccaatactagacgttctgaacttcaagaattagctgaaactattgaaatcgatactgcaagtttaattatcgaagaggacacatacgtcagtgttactagaggcggatatgtaaaacgcaccagccctcgctctttcaatgcatcaactgttgatgaacttggtaagcgagaagatgacgaattgatatttgtgagcaatgcaaagactacccaacatttattgatgtttactaaccttggtaatcttgcttatcgtccagttcatgaattagctgatattcgatggaaagacgttggtgaacatttatcacaaaatcttgttaactttgcttcaaatgaagaaattatttatgctgaattagtagatgattttactaaagaaacttattttgctgtcactagcttagggcaaataaagcgttttgaacgtcaagaaatcagtccatggcggacatataagtcaaaaacagctaaatatgctaagttaaaaagtgtagaggattatgttgtgactgttgcccctatccaattagaggatgttatacttgtcacttataatggttatgcgttgagatttagtataaatgatgtaccagtcgtcggtagtaaagccgcaggtgtaaaagcgatgaatttaaaagatcgtgatcacatcgtatctgcatttatagctaacaccacaagtttatatttattaactcatagaggaagtcttaaacgaatggccattgatgttatccccacaactagtcgtgctaatcgaggacttcaagttcttcgtgaattgaaatccaaaccgcatcgcgtttttaaagcaggacctgtatatttagaggattcatcttttgaatttgatttatttagttcagtatcgaatcatgaaggagatactttcgtacttgagattatgtctaaaacaggaaaagtttacgatgttgatttaagtcaatggagtttttctgaacgtacaagtaatggctcttttgtatctgataagatttctgacgaagaagtattctcagttaaaattaag

SEQ ID NO: 2822 - protein, 819 aa, Streptococcus agalactiae
MSNIQNMSLEDIMGERFGRYSKYIIQERALPDIRDGLKPVQRRILYSMNKDGNTFEKGFRKSAKSVGNVMGNFHPHGDSSIYDAMVRMSQDWKNRETLIEMHGNNGSMDGDPAAAMRYTEARLSEIAGYLLQDIDKNTVPFAWNFDDTEKEPTVLPAAFPNLLVNGATGISAGYATDIPPHNLAEVIDAVVYMIDHPKAKLDKLMEFLPGPDFPTGAIIQGKDEIRKAYETGKGRVAVRSRTAIETLKGGKKQIIVTEIPYEVNKSVLVKRIDDVRVNNKVPGIAEVRDESDRDGLRIAIELKKEADETIVLNYLFKYTDLQVNYNFNMVAIDDYTPKQVGLSRILTSYIAHRREIIIARSKFDKEKAEKRLHIVEGLIRVLSILDEVIALIRASENKADAKENLKVSYEFSEAQAEAIVTLQLYRLTNTDIVTLREEEEELRQQITMLKAIISDERTMYNVMKRELREVKKKFANTRRSELQELAETIEIDTASLIIEEDTYVSVTRGGYVKRTSPRSFNASTVDELGKREDDELIFVSNAKTTQHLLMFTNLGNLAYRPVHELADIRWKDVGEHLSQNLVNFASNEEIIYAELVDDFTKETYFAVTSLGQIKRFERQEISPWRTYKSKTAKYAKLKSVEDYVVTVAPIQLEDVILVTYNGYALRFSINDVPVVGSKAAGVKAMNLKDRDHIVSAFIANTTSLYLLTHRGSLKRMAIDVIPTTSRANRGLQVLRELKSKPHRVFKAGPVYLEDSSFEFDLFSSVSNHEGDTFVLEIMSKTGKVYDVDLSQWSFSERTSNGSFVSDKISDEEVFSVKIK

SEQ ID NO: 2823 - DNA, 2463 bp, Streptococcus pyogenes
ttgaatatgtcaaacattcaaaacatgtcccttgaggatattatgggagaacgcttcggccgttattccaagtatattattcaggaacgggcacttcctgatattcgagatggattgaaacccgttcagcgtcggattctttattcgatgaataaggatggcaatacttttgaaaaaggttaccgtaaatcagccaaatcagttggtaatattatggggaatttccacccacatggggattcctctatttatgatgccatggtacggatgagtcaagattggaagaaccgtgaaatccttgttgaaatgcacggaaataatggttcaatggatggtgatccgcctgcggctatgcgttatacagaagctcgcttgtctgaaattgcgggttatcttcttcaagacattgagaaaaatacggtctcttttgcttggaactttgatgacacagaaaaagaacccaccgttttaccagcagcttttcctaacttacttgtcaatgggtcttctggtatttccgcaggctatgcgacagatattccaccgcacaatttgtcagaagtgattgatgctgttgtgtatatgattgatcatcccaaagctagtttagagaaattaatggagtttttaccaggaccagatttcccgacaggaggcattatccaaggagctgacgaaatcaaaaaagcctacgaaacaggtaagggacgtgtcgttgttcgctctaggacagaaatcgaggaacttaaaggtggtaaacaacaaattattgtcactgagattccttatgaagttaacaaagcagtcttggtcaaaaagattgacgatgtgcgtgttaacaataaagtcccaggcatcgtagaagtacgcgatgaatctgatcgcacaggtcttcgcatagctattgagttgaaaaaagaggctgatagccaaaccattctaaattatttgttgaaatacacagaccttcaagttaattataattttaacatggttgctattgaccacttcacaccacgtcaagtaggacttcaaaaaatactatcaagctatatcagtcaccgtaaagatattattattgagcggtctaaattcgataaagccaaagctgaaaaacgcctccacattgttgaaggattgattcgtgtcttgtccatcttagatgagattattgctttgattagatcgtctgacaataaggctgatgctaaagaaaatctgaaagtcagctatgatttctctgaggaacaagcagaagcgattgtaaccttgcagctttatcgtttaactaataccgatattgttactctccaaaatgaagaaaatgatttaagagacttaatcacgaccctttccgctattatcggtgacgaagcaaccatgtataacgtcatgaaacgtgaattaagagaggtgaaaaagaaattcgccaatcctcgtttatcagagttacaagcagaaagtcaaatcattgagattgacactgccagcttgattgcagaggaagaaacttttgttagtgtgacacggggcggatacctcaaaagaaccagcccacgatccttcaatgcgtctagtttggaagaagttggcaagagagatgatgacgaactcatcttcgttaaacaggccaaaacaacagaacaccttttgttatttacaactttaggcaatgtcatttaccggccaatccatgaattgaccgatttacgttggaaggatatcggtgaacatttatcacaaaccatttcaaacttcgcgacagaagaagagattctctacgctgatattgtgacttcctttgaccagggcttgtatgtggctgtcacacaaaatggttttatcaaacgctttgatcgtaaagaactaagtccttggcgaacttataaatctaaatcaaccaaatatgtgaagctaaaggatgacaaagaccgcgtggttaccttgtcaccagttattatggaagacctcctattagtgactaaaaatggttatgctttgcgattctccagtcaggaagtgcctattcaagggttgaaatctgctggtgttaaaggcattaacttgaaaaacgatgacagccttgcctcagcctttgctgtgacaagtaactctttctttgtcttaactcagaggggttctctcaaacggatggctgtcgatgatattcctcagacaagtcgtgccaatcgtggactattggtcctacgagagttaaaaaccaaacctcatagagtttttctggccggaggcgttcaatcagatacttcagctgagcagtttgatttgttcactgatatacctgaagaagaaactaatcaacaaatgcttgaagtcattagtaagactggtcaaacctacgagattgctttagaaacgctttcgttatcggaaagaatcagcaacggctcctttatttcagacactatttcggatcaagaagtactggtagctagaacacgt

SEQ ID NO: 2824 - protein, 821 aa, Streptococcus pyogenes
LNMSNIQNMSLEDIMGERFGRYSKYIIQERALPDIRDGLKPVQRRILYSMNKDGNTFEKGYRKSAKSVGNIMGNFHPHGDSSIYDAMVRMSQDWKNREILVEMHGNNGSMDGDPPAAMRYTEARLSEIAGYLLQDIEKNTVSFAWNFDDTEKEPTVLPAAFPNLLVNGSSGISAGYATDIPPHNLSEVIDAVVYMIDHPKASLEKLMEFLPGPDFPTGGIIQGADEIKKAYETGKGRVVVRSRTEIEELKGGKQQIIVTEIPYEVNKAVLVKKIDDVRVNNKVPGIVEVRDESDRTGLRIAIELKKEADSQTILNYLLKYTDLQVNYNFNMVAIDHFTPRQVGLQKILSSYISHRKDIIIERSKFDKAKAEKRLHIVEGLIRVLSILDEIIALIRSSDNKADAKENLKVSYDFSEEQAEAIVTLQLYRLTNTDIVTLQNEENDLRDLITTLSAIIGDEATMYNVMKRELREVKKKFANPRLSELQAESQIIEIDTASLIAEEETFVSVTRGGYLKRTSPRSFNASSLEEVGKRDDDELIFVKQAKTTEHLLLFTTLGNVIYRPIHELTDLRWKDIGEHLSQTISNFATEEEILYADIVTSFDQGLYVAVTQNGFIKRFDRKELSPWRTYKSKSTKYVKLKDDKDRVVTLSPVIMEDLLLVTKNGYALRFSSQEVPIQGLKSAGVKGINLKNDDSLASAFAVTSNSFFVLTQRGSLKRMAVDDIPQTSRANRGLLVLRELKTKPHRVFLAGGVQSDTSAEQFDLFTDIPEEETNQQMLEVISKTGQTYEIALETLSLSERISNGSFISDTISDQEVLVARTR

SEQ ID NO: 2825 - DNA, 1020 bp, Streptococcus agalactiae
atgacagtaaatttagattgggataatttaggttttgcttacagaaaattaccattccgatacatttcgcattttaaagatgggaaatgggatgatggcaagttgacagatgatgcaacgctacatatttcagaaagttcacctgctctccattatgggcaacaagcttttgaaggattgaaagcttatagaactaaagatggctctattcagttatttcgtccagatcaaaatgcagaacgacttcaaagaacagcagatcgtcttttaatgccacatgttccgacagacaaatttattgcagcggttaaatctgttgtacgcgctaatgaggagtttgttccaccgtatggtacaggggcaacattatacattcgtcccttattaattggtgtgggagatattattggagttaaacctgctgaagaatatatttttacggtatttgcaatgccagtaggtagttattttaaaggtggtttaacaccaactaactttattgtttccaaagaatatgatagagcagcaccgaatggtacaggagctgcaaaagttggtggtaactatgctgctagtcttcttcctgggaaatatgctcatgagaaacaattttcagatgttatctatcttgatccagcgacacatactaaaattgaagaggttggagcagctaatttctttggaattactaaagataatcagtttatcacccctttgagtccttcaattttaccttcaattactaaatattcattgctttaccttgctaaagaaaggtttggtatggaagcgattgaaggagatgtctttgtcgacgaattagataaattcacagaagctggcgcatgtggtacagccgcagttatttcaccaattggaggaattcaaaacggagatgacttccatgtcttctacagtgagacagaagttggtccagcgacacgcaaactatatgatgagttagtagggatccagtttggtgatgttgaagcaccagaagggtggatttataaagtagat

SEQ ID NO: 2826 - protein, 340 aa, Streptococcus agalactiae
MTVNLDWDNLGFAYRKLPFRYISHFKDGKWDDGKLTDDATLHISESSPALHYGQQAFEGLKAYRTKDGSIQLFRPDQNAERLQRTADRLLMPHVPTDKFIAAVKSVVRANEEFVPPYGTGATLYIRPLLIGVGDIIGVKPAEEYIFTVFAMPVGSYFKGGLTPTNFIVSKEYDRAAPNGTGAAKVGGNYAASLLPGKYAHEKQFSDVIYLDPATHTKIEEVGAANFFGITKDNQFITPLSPSILPSITKYSLLYLAKERFGMEAIEGDVFVDELDKFTEAGACGTAAVISPIGGIQNGDDFHVFYSETEVGPATRKLYDELVGIQFGDVEAPEGWIYKVD

SEQ ID NO: 2827 - DNA, 1065 bp, Streptococcus pyogenes
ttgaaaaaaagttacaatagaaaaaagcagaaaagaggtacgatgatgacaatagcaattgattgggacaacctaggatttgaatatcataagttgccatttcgttacatttcttattacaaaaatggtcaatgggataaaggtcaattaacagaagatgccaccttacatatctcagaaagcgctccagcgcttcattatggacaacaagcttttgaaggcttaaaggcttatcgcaccaaagatggctctattcaactatttagaccagaccgtaatgcagtgcgtttacaagccacagcagaccgcttgttgatgccacaagtatcaacagagcaatttattgatgcagctaagcaagtggttaaagccaatgaagactttgtaccaccttacggaacaggtgcaacgctttacctgagaccgttattaattggagttggagatattattggggttaaaccagccgaagaatatattttcaccatttttgccatgccagtaggaaactatttcaaaggtggacttgctccaactaattttattgtttctgaagcgtttgaccgcgccgctccttacggaacaggtgctgctaaggtgggaggaaactatgcaggaagtttgctaccaggtaaggccgctaaatcagcaggcttttctgatgtgatttacttagatccagcaacccatactaaaattgaagaagtcggagctgcaaacttttttggcattactgcaaataatgaatttgttacgccacttagtccatccatcttgccatctattacgaagtattcactcttacaactagctgaagaaagacttggtatgacagtaattgagggtgatgttccaattaatgaattggataaatttgtggaagcaggagcttgtggaacagcagctgttatctctccaattggcggtatccagtacaaggataacttacatgtcttttacagtgaaacagaagttggtcctgtgacacgccgtttatacgatgagttggtcggcattcaatttggggatattgaagcaccagaaggttggattgtaaaagtagat

SEQ ID NO: 2828 - protein, 355 aa, Streptococcus pyogenes
LKKSYNRKKQKRGTMMTIAIDWDNLGFEYHKLPFRYISYYKNGQWDKGQLTEDATLHISESAPALHYGQQAFEGLKAYRTKDGSIQLFRPDRNAVRLQATADRLLMPQVSTEQFIDAAKQVVKANEDFVPPYGTGATLYLRPLLIGVGDIIGVKPAEEYIFTIFAMPVGNYFKGGLAPTNFIVSEAFDRAAPYGTGAAKVGGNYAGSLLPGKAAKSAGFSDVIYLDPATHTKIEEVGAANFFGITANNEFVTPLSPSILPSITKYSLLQLAEERLGMTVIEGDVPINELDKFVEAGACGTAAVISPIGGIQYKDNLHVFYSETEVGPVTRRLYDELVGIQFGDIEAPEGWIVKVD

SEQ ID NO: 2829 - DNA, 117 bp, Streptococcus agalactiae
ttggagttaatagtgagtaaaaaagataagaaaattgaaattcaaatttcagacgctcaagtaacagttaatggaactaaggttgatggataccaactcgttatggaaaaaaaattg

SEQ ID NO: 2830 - protein, 39 aa, Streptococcus agalactiae
MELIVSKKDKKIEIQISDAQVTVNGTKVDGYQLVMEKKL

SEQ ID NO: 2831 - DNA, 231 bp, Streptococcus pyogenes
gtgatgagtaaaaaagataaaaaaattgaaatccaactgattgatcacaaagttatggttaatgagactaagattgatggctatcaattacaaattggtaaacgtgtggttggagaaattgcagaacttgatgagaaatttgctgtcttaaaaaatgatggagtagattgcttcttcaaaacgctcgaacaagcggttgaaaatatcattgaaaactacaatttgaaccat

SEQ ID NO: 2832 - protein, 77 aa, Streptococcus pyogenes
VMSKKDKKIEIQLIDHKVMVNETKIDGYQLQIGKRVVGEIAELDEKFAVLKNDGVDCFFKTLEQAVENIIENYNLNH

SEQ ID NO: 2833 - DNA, 300 bp, Streptococcus agalactiae
ttgtcacgtgcatttaatttagctgaaaaagttactcattctgtattggtggactcttcattgtttgaaaataatcaagagaaggcgctatatcaagctattttgtcacttgaactgactgaggatatgcatgacaacttagataagcttttcgcacttagtccaattattaatgatttctttgataatacaatggtaatgacagatgatgaaaaaatgaaacaaaatcgtctggctatactcaatagccttgttgcaaaggcaagaacagtcgctgcttttaacttattaaacacaaaa

SEQ ID NO: 2834 - protein, 100 aa, Streptococcus agalactiae
MSRAFNLAEKVTHSVLVDSSLFENNQEKALYQAILSLELTEDMHDNLDKLFALSPIINDFFDNTMVMTDDEKMKQNRLAILNSLVAKARTVAAFNLLNTK

SEQ ID NO: 2835 - DNA, 2037 bp, Streptococcus pyogenes
atgagtaaaaatctactaatcgaacttggtctggaagaacttccagcctacgtggtcacaccaagtgaaaaacaactgggagagcgcttggcgactttcttaacagaaaatcgtctctcttttgaagatatacaaaccttttcaactccacgccgtttggcagtgcgtgtgtctggattagctgatcagcaaacggatttgactgaggactttaaagggcctgctaagaaaattgcccttgatgctgatgggaatttctcaaaagctgctcaaggatttgttcgtggcaaaggcttgaccacagatgctatcgaattccgcgaagtcaaaggagaagaatacgtttatgtgaccaaacacgaagctggaaaacctgctaaggaagtgcttctaggcgttactgaagtgttatcagcaatgaccttcccagtcagcatgcactgggctaacaatagttttgaatacattcgtcctgttcacaccttgacagttctgttgaatgatgaggccttggaacttgacttcttggatattcattctggacgcgtcagccgtggtcaccgttttttaggtactgaaaccactatcacaagtgctgattcttatgaggctgatttacgcagccagtttgttatcgctgatgctaaagagcgtcaagagatgattgtggagcaaatcaagacgcttgaagtggagcagggtgtgcaagttgacattgacgaagacttgcttaatgaagttttgaacttggtcgagtttccaacagctttcatgggaagttttgaggctaaataccttgatgtcccagaagaagtattggtaacatcaatgaaaaaccaccaacgttattttgtagtacgtgatcaggctggtcacttgatgccaaactttgtatcagttcgtaatgggaatgatcaagccattgaaaatgttattaaagggaacgaaaaagttttggtagctcgcttagaagatggtgaattcttctggcgtgaggatcagaaattgcaaattgctgatttggttgccaaattgaccaatgtgaccttccatgaaaaaatcggctctcttgctgaacacatggatcgtacgcgtgtcattgccgcatcacttgctaaggaagccaacctatctgctgaggaagtcacagctgttgaccgtgctgcccaaatttacaaatttgacctgttaacaggtatggtgggtgaatttgatgagctgcaagggattatgggtgaaaaatatgcccttctagctggtgaagatgctgctgtggcaacagcaatccgtgaacactacttacctgatgctgcaggaggtgcgctacctgaaaccaaagttggcgctgtcctggccttggcagctaaattggatactctcttgtcattcttttctgttggcttgattccatctggctctaatgatccttatgctctacgtcgtgcaacccaagggattgtccgtattcttgatcattttggatggcgcatcccaatggataagctggtagatagcttatatgacttgtcctttgatagtttgacctatgccaataaggcggatgtgatgaactttatccgtgctcgtgtggataagatgatgggcaaagccgcaccaaaagacattcgggaagctattctagcaagttcaacctttgtggttccagaaatgttggccgcagctgaagctcttgtcaaagccagtcatacggaaaattacaaaccagcagttgaatctttgtcacgtgcttttaatttggcagaaaaagcggacgcttctgttcaggtggaccctagcctctttgaaaatgagcaagaaaacactttgtttgcagctattcaaggcttgactctagcaggcagtgctgcccagcagttagaacaggtctttgcccttagcccagtgattaatgatttctttgataacacaatggttatggcaggagatcaagcccttaaaaacaaccgtttagctattttatcagatttagtaagcaaagctaagaccattgttgcttttaaccaactaaacaccaag

SEQ ID NO: 2836 - protein, 679 aa, Streptococcus pyogenes
MSKNLLIELGLEELPAYVVTPSEKQLGERLATFLTENRLSFEDIQTFSTPRRLAVRVSGLADQQTDLTEDFKGPAKKIALDADGNFSKAAQGFVRGKGLTTDAIEFREVKGEEYVYVTKHEAGKPAKEVLLGVTEVLSAMTFPVSMHWANNSFEYIRPVHTLTVLLNDEALELDFLDIHSGRVSRGHRFLGTETTITSADSYEADLRSQFVIADAKERQEMIVEQIKTLEVEQGVQVDIDEDLLNEVLNLVEFPTAFMGSFEAKYLDVPEEVLVTSMKNHQRYFVVRDQAGHLMPNFVSVRNGNDQAIENVIKGNEKVLVARLEDGEFFWREDQKLQIADLVAKLTNVTFHEKIGSLAEHMDRTRVIAASLAKEANLSAEEVTAVDRAAQIYKFDLLTGMVGEFDELQGIMGEKYALLAGEDAAVATAIREHYLPDAAGGALPETKVGAVLALAAKLDTLLSFFSVGLIPSGSNDPYALRRATQGIVRILDHFGWRIPMDKLVDSLYDLSFDSLTYANKADVMNFIRARVDKMMGKAAPKDIREAILASSTFVVPEMLAAAEALVKASHTENYKPAVESLSRAFNLAEKADASVQVDPSLFENEQENTLFAAIQGLTLAGSAAQQLEQVFALSPVINDFFDNTMVMAGDQALKNNRLAILSDLVSKAKTIVAFNQLNTK

SEQ ID NO: 2837 - DNA, 255 bp, Streptococcus agalactiae
atggatcctaaaaaaattgctcgtattaacgagctttcaaaaaagaaaaaaacagttggattgaccggagaagagaaggttgaacaagcaaagctccgtgaagagtatattgaaggtttccgccgatcagtccgtcaccacgttgaaggaattaaattagtggatgatgagggcaatgatgttaccccggaaaaacttcgtcaagtccagagagaaaaaggactacatggtcgtagtttggatgatccaaattct

SEQ ID NO: 2838 - protein, 85 aa, Streptococcus agalactiae
MDPKKIARINELSKKKKTVGLTGEEKVEQAKLREEYIEGFRRSVRHHVEGIKLVDDEGNDVTPEKLRQVQREKGLHGRSLDDPNS

SEQ ID NO: 2839 - DNA, 255 bp, Streptococcus pyogenes
atggatcctaaaaaaattgctcgtatcaatgagctggctaaaaagaaaaaaacggtaggcttgactggacctgaaaaagtggaacaggcaaaactccgtgaagaatacattgaaggctatcgtcgctctgtcagacaccatatcgaaggcatcaaattggtggacgaagaaggaaacgacgtgacccctgaaaaattaagacaggtgcaacgtgaaaaaggcttgcacggccgttcattagatgacccaaaatca

SEQ ID NO: 2840 - protein, 85 aa, Streptococcus pyogenes
MDPKKIARINELAKKKKTVGLTGPEKVEQAKLREEYIEGYRRSVRHHIEGIKLVDEEGNDVTPEKLRQVQREKGLHGRSLDDPKS

SEQ ID NO: 2841 - DNA, 1506 bp, Streptococcus agalactiae
atgtcttcagaagaaaaatacattatggcgattgaccagggaacaacaagctctcgagcaattatttttaataaaaaaggtgaaaaaattgcgagtagccaaaaagaatttccccaaatttttcctcaagcaggctgggtagagcataatgctaatcagatttggaattctgttcaatctgtcattgctggagcttttattgaatcaagcatcaaacctggacagatagaggctattgggattaccaatcaacgtgaaacaactgttgtttgggataaaaaaacaggtcttccaatttataatgctattgtatggcaatcgcgacaaacagccccgattgctgatcaattgaagcaagaaggtcatactaacatgattcatgaaaaaactggtcttgtcattgatgcttacttctcagcaacaaaagttcgttggattttagaccacgttcctggagcacaggaacgtgctgaaaaaggagagttgctttttggaacaattgatacttggttagtttggaagttaactgatggtctcgtccatgttacagactattcaaatgctgctcgtacgatgctttataatattaaagaacttaaatgggatgatgaaattttagagttactaaatattcctaaagcaatgttaccagaagtaaaatctaattctgaagtttatgggaaaactactccattccatttttacggtggagaggtgccaatttctggtatggctggtgaccaacaggcagcattatttggacagttggcctttgaacctggtatggtaaaaaacacttatggtacaggttccttcattatcatgaatacgggcgaagagatgcaactgtctcaaaataatctattaacaacgattggttacggcattaatggtaaggttcattatgcacttgaaggatcaatcttcattgcaggaagcgctattcaatggttacgtgatggtcttagaatgattgaaacgtcaagtgagtcagaaggccttgctcaatcatcaacaagtgacgatgaggtttatgtggttccagcttttacaggtttgggtgcaccgtattgggattcaaatgctagagggtcagtatttggattaactcgtgggacaagtaaagaagattttgttaaagctacacttcagtcaattgcttatcaagtacgagacgttattgacactatgcaagttgattcaggaattgatatccaacaacttcgtgtagatggtggagctgcaatgaataatttattaatgcaattccaagcggatattttagggattgatattgctcgtgcgaagaaccttgaaactactgccttgggtgcagctttcttagccggactttcagttggctattgggaaagtatggatgaactaaaagaactgaacgcaacaggacaacttttccaagcaacaatgaatgagtctcgaaaagaaaaactgtataaagggtggagaaaagctgtcaaagcgacacaagtatttgctcaagaggat

SEQ ID NO: 2842 - protein, 502 aa, Streptococcus agalactiae
MSSEEKYIMAIDQGTTSSRAIIFNKKGEKIASSQKEFPQIFPQAGWVEHNANQIWNSVQSVIAGAFIESSIKPGQIEAIGITNQRETTVVWDKKTGLPIYNAIVWQSRQTAPIADQLKQEGHTNMIHEKTGLVIDAYFSATKVRWILDHVPGAQERAEKGELLFGTIDTWLVWKLTDGLVHVTDYSNAARTMLYNIKELKWDDEILELLNIPKAMLPEVKSNSEVYGKTTPFHFYGGEVPISGMAGDQQAALFGQLAFEPGMVKNTYGTGSFIIMNTGEEMQLSQNNLLTTIGYGINGKVHYALEGSIFIAGSAIQWLRDGLRMIETSSESEGLAQSSTSDDEVYVVPAFTGLGAPYWDSNARGSVFGLTRGTSKEDFVKATLQSIAYQVRDVIDTMQVDSGIDIQQLRVDGGAAMNNLLMQFQADILGIDIARAKNLETTALGAAFLAGLSVGYWESMDELKELNATGQLFQATMNESRKEKLYKGWRKAVKATQVFAQED

SEQ ID NO: 2843 - DNA, 1524 bp, Streptococcus pyogenes
atgtcgcaagaaaagtatatcatggctattgatcagggaacaacaagttcacgagcgattattttcaatcaaaaaggggaaaaggttagcagtagccaaaaagaattccctcagattttcccacacgctggttgggtagagcacaatgctaatcagatttggaattcggttcagtctgttattgcgggtgcttttattgagtctagcatcaaaccaagccaaattgaagcaatcggaattaccaaccaacgtgagaccacagtggtttgggacaaaaaaacgggtgtacctatttataatgctattgtgtggcaatcacggcagacggcaccaattgctgagcaactcaaacaagatggccatacaaaaatgatccatgaaaagacaggccttgttattgatgcttacttttctgcaaccaagatccgttggattttggaccatgttcctggtgctcaagaacgagctgaaaaaggcgagttactttttggaaccattgatacttggctggtttggaaattgacagatggtgctgttcatgtgacggattattccaatgcggctcgtaccatgctctataatattaaagacttaacatgggatgatgagattttagagcttttaaatattccaaaagatatgcttccagaggttaaatccaattctgaaatttatggcaaaacagctgcctttcatttttatgggggcgaagtgcctatttcaggtatggcgggtgaccaacaggcagctttgtttggccaactagcttttgagcctggtatggtgaaaaacacttatggcacaggttctttcattatcatgaatactggtgatgagatgcagttatcgagtaataatcttttgaccaccattggttacgggattaatgggaaggttcactatgccttggaaggttccatctttattgcaggctctgccattcaatggttgcgagatggtcttaaaatgattgagacttcaccagaatctgaacagttcgctctagcatcaactagtgacgatgaagtttatgttgtgcctgcttttaccggtttaggagctccttactgggattctaatgcgcgtggatctgtctttggcttgacacgtggtaccagcaaagaagactttgtcaaagcaaccttacaatctatcgcctatcaagtgcgagatgttattgataccatgcaggtggattcaggtattgacattcaacagctccgtgtggatggcggtgcagccatgaataatatgctcatgcaatttcaggctgatattttaggaattgatattgcccgtgctaaaaatttagaaacaacagctctaggagcagctttcttagcagggcttgctgtggggtattgggaagatatggatgctttgaaagaattaaatgccacaggccagctctttaaggctagcatgaatgaatcgcgcaaagaaaaattatacaagggttggaagcgcgctgttaaagcaactcaagttttcacccaagaagaagatgcagatgacgatgcaaaa

SEQ ID NO: 2844 - protein, 508 aa, Streptococcus pyogenes
MSQEKYIMAIDQGTTSSRAIIFNQKGEKVSSSQKEFPQIFPHAGWVEHNANQIWNSVQSVIAGAFIESSIKPSQIEAIGITNQRETTVVWDKKTGVPIYNAIVWQSRQTAPIAEQLKQDGHTKMIHEKTGLVIDAYFSATKIRWILDHVPGAQERAEKGELLFGTIDTWLVWKLTDGAVHVTDYSNAARTMLYNIKDLTWDDEILELLNIPKDMLPEVKSNSEIYGKTAAFHFYGGEVPISGMAGDQQAALFGQLAFEPGMVKNTYGTGSFIIMNTGDEMQLSSNNLLTTIGYGINGKVHYALEGSIFIAGSAIQWLRDGLKMIETSPESEQFALASTSDDEVYVVPAFTGLGAPYWDSNARGSVFGLTRGTSKEDFVKATLQSIAYQVRDVIDTMQVDSGIDIQQLRVDGGAAMNNMLMQFQADILGIDIARAKNLETTALGAAFLAGLAVGYWEDMDALKELNATGQLFKASMNESRKEKLYKGWKRAVKATQVFTQEEDADDDAK

SEQ ID NO: 2845 - DNA, 153 bp, Streptococcus agalactiae
ttgatgaatttgtttaccttcattggagaagttgcgaacggtgtcactccaaggtccagttgtattaataacaagcctagcttttatatcgataacttggtcagtcaacaaatcacgcgcacgtactcctataatttgattgttgtcatcaaa

SEQ ID NO: 2846 - protein, 51 aa, Streptococcus agalactiae
MMNLFTFIGEVANGVTPRSSCINNKPSFYIDNLVSQQITRTYSYNLIVVIK

SEQ ID NO: 2847 - DNA, 1827 bp, Streptococcus agalactiae
atggaattttcacgagaaacacgacgtttagccttacaaagaatgcaagatcgtactctggatttacttatcataggtgggggtatcacaggcgctggtgtcgctttacaagcagcagctagtggattagatactggacttattgaaatgcaagattttgcagaagggacaagtagtcgctcaacaaaattggtccatggtggtcttcgttacttgaagcaatttgatgtagaagttgtttctgatacagtatcagagcgtgcagtcgtgcagcaaattgcaccacacattcctaagccagatccaatgcttttaccggtttacgatgagccgggttctacttttagtatgtttcgccttaaagtggctatggatttatatgatttattagcaggtgtgacaaacacacccgcagccaataaagttttaagcgcagaagatgttcttaagcgtgagcctgatttacaaaaagaaggtttgctaggcggaggggtctatttagatttccgtaataacgatgcacgcctagtgattgaaaatattaaacgcgctaatagggatggagcttatattgccagtcatgtcaaagctgaggacttcttatttgatgacaacaatcaaattataggagtacgtgcgcgtgatttgttgactgaccaagttatcgatataaaagctaggcttgttattaatacaactggaccttggagtgacaccgttcgcaacttctccaatgaaggtaaacaaattcatcaattacgtccaactaagggagttcacttagttgtagatcgccaaaaattaaatatttctcaacctgtttatgttgatacaggcctgaatgatggtcgtatgatttttgttttgccacgtgaagataagacttattttggaactacagatactgattaccatggagacttagaacatcctacggtaactaaagaagatgttgactacctccttaatattgtaaacaaacgcttcccagaagcagagcttactattgatgatattgagagttcatgggcaggtttgcgtccactactatcagggaatagtgcctctgactataatggaggcaatagtggaaaactaagcgatgaaagttttgaagaattaattgattccgttaaagattatattgcacataaaaatcatcgtgaggatgttgaaaaagctatttctcatgtagaatctagtacttctgaaaaagaattggacccatcagctgtttctcgaggatcaagttttgagcgtgatgataatggcctattaacacttgctggtggtaaaattactgattatcgaaaaatggcagaaggtgccatggaaactattattaacattttggataaagaatataatcgcaagtttaaactaatcaattctaaaacctatcctgtttcaggaggagagattaacccatctaatgttgattctgaaattgaagcttatgctcaattgggcacactaagtggtttaagtattgaggatgcacgttatattgctaacctttatgggtcaaatgcaccaaaattatttgcattgacacgccaaattacagaagcagaaggtctgagcttggtagaaacgttgtcacttcactatgctatggattatgaaatggcgcttagcccaacggatttcttcttaagacgtacgaaccatatgcttttcatgagagataatttagattctttgattcagcctgttattgatgagatggctaaacattatcaatggtctgatcaagacaaaactttctatgaagaagaattacatgagactctaaaagacaatgacttggcagctttgaaggataat

SEQ ID NO: 2848 - protein, 609 aa, Streptococcus agalactiae
MEFSRETRRLALQRMQDRTLDLLIIGGGITGAGVALQAAASGLDTGLIEMQDFAEGTSSRSTKLVHGGLRYLKQFDVEVVSDTVSERAVVQQIAPHIPKPDPMLLPVYDEPGSTFSMFRLKVAMDLYDLLAGVTNTPAANKVLSAEDVLKREPDLQKEGLLGGGVYLDFRNNDARLVIENIKRANRDGAYIASHVKAEDFLFDDNNQIIGVRARDLLTDQVIDIKARLVINTTGPWSDTVRNFSNEGKQIHQLRPTKGVHLVVDRQKLNISQPVYVDTGLNDGRMIFVLPREDKTYFGTTDTDYHGDLEHPTVTKEDVDYLLNIVNKRFPEAELTIDDIESSWAGLRPLLSGNSASDYNGGNSGKLSDESFEELIDSVKDYIAHKNHREDVEKAISHVESSTSEKELDPSAVSRGSSFERDDNGLLTLAGGKITDYRKMAEGAMETIINILDKEYNRKFKLINSKTYPVSGGEINPSNVDSEIEAYAQLGTLSGLSIEDARYIANLYGSNAPKLFALTRQITEAEGLSLVETLSLHYAMDYEMALSPTDFFLRRTNHMLFMRDNLDSLIQPVIDEMAKHYQWSDQDKTFYEEELHETLKDNDLAALKDN

SEQ ID NO: 2849 - DNA, 123 bp, Streptococcus agalactiae
ttgatcgcaaaagctaatgacacagctggattcaagtgggcagggctaatattgccagataccaacgctgcaatagctacagcaagtccccatccaaatgtgataacaatccatccagaatta

SEQ ID NO: 2850 - protein, 41 aa, Streptococcus agalactiae
MIAKANDTAGFKWAGLILPDTNAAIATASPHPNVITIHPEL

SEQ ID NO: 2851 - DNA, 711 bp, Streptococcus agalactiae
ttgaaggagataataatggatatttttggagaattcttaggaacagctctcttagtcttacttggtaatggtgttgtagcaggtgttgttttgcctaaaacgaagaatcataattctggatggattgttatcacatttggatggggacttgctgtagctattgcagcgttggtatctggcaatattagccctgcccacttgaatccagctgtgtcattagcttttgcgatcaaaggtgatttagcttggggaacagctattctttatatgattgcacagattattggtgcaatgctaggttcacttcttgtttatttgcaatttagaccccattatgaggctgcagaaaatagagcagacatccttggaacttttgcaactggtccggctttgaaggataatttttccaattttttaagtgaagtattgggaacacttgttcttgtacttactatttttgccatcggaaaatacaatatgcctccaggagttggtacgatgagtgttggtatgttagtggttgggattggtctatcgctcggtggaacaacaggttatgctattaatcctgcacgtgattttggtcctcgtttattgcatgccttgttaccgatgaagaacaaaggtgattctgattggacttattcatggattccgatagtaggacctatggtaggagctattttagcagccttaatatttgctatgatg

SEQ ID NO: 2852 - protein, 237 aa, Streptococcus agalactiae
MKEIIMDIFGEFLGTALLVLLGNGVVAGVVLPKTKNHNSGWIVITFGWGLAVAIAALVSGNISPAHLNPAVSLAFAIKGDLAWGTAILYMIAQIIGAMLGSLLVYLQFRPHYEAAENRADILGTFATGPALKDNFSNFLSEVLGTLVLVLTIFAIGKYNMPPGVGTMSVGMLVVGIGLSLGGTTGYAINPARDFGPRLLHALLPMKNKGDSDWTYSWIPIVGPMVGAILAALIFAMM

SEQ ID NO: 2853 - DNA, 699 bp, Streptococcus pyogenes
atggatatctttggcgaatttttgggtacagccttattggttttactaggaaatggtgtggtagcaggggttgtcttgcccaaaacgaaaacccatgcttctggctggatcgtgattgcgactggctggggaattgcagttgctgtggcagtctttatcagtggcaaagttgcccctgcccacctcaatccagctgttagccttgcttttgccatgagtggaaccattgcctggtcaacagccattgcctatagccttgcccaactattgggagctatggttggttcaactctggtattccttcagttcaggccacattatctggctgctgagagtcaggctgatattttagggacatttgcgacaggtcctgctattcgagatactagctcaaacctattgagtgaaatctttgggacctttgtcttgatgcttggtattttggcatttggcttatatgatatgccagcaggactaggaaccctctgtgtaggtaccttggttattgggattgggttatccttaggaggaacgacaggttacgccattaacccagcacgtgatttaggacctcgtctagttcatgctattctaccactcaacaacaagggagattctgattggtcttatgcttggatacctgttgtaggaccaattattggagcggtcttagcagttttgcttttccaagtcatgtcc

SEQ ID NO: 2854 - protein, 233 aa, Streptococcus pyogenes
MDIFGEFLGTALLVLLGNGVVAGVVLPKTKTHASGWIVIATGWGIAVAVAVFISGKVAPAHLNPAVSLAFAMSGTIAWSTAIAYSLAQLLGAMVGSTLVFLQFRPHYLAAESQADILGTFATGPAIRDTSSNLLSEIFGTFVLMLGILAFGLYDMPAGLGTLCVGTLVIGIGLSLGGTTGYAINPARDLGPRLVHAILPLNNKGDSDWSYAWIPVVGPIIGAVLAVLLFQVMS

SEQ ID NO: 2855 - DNA, 1335 bp, Streptococcus agalactiae
atgacagaaaaatatgtaaataaagtaattgtcattttaggagcttcttttgctggtatgacttgtgcgcagaaattacgccaattaaatcctaattgggatatcgttttgattgataaagaaattcatccagattatgttccaaatggcttaaattggtattatcgtcacgaaattagtggtttaaatcaggccatgtggcagacagaagaagagcaacggttgcagaatatacgctgtctatttggtctaaaagttgagaaaattaataaagaagatagggaattaatgttatcagatggttcttctgtctattatgatcaattgatttgtgccatgggctcccaagcagaatcaacttatattgatggggctgatgcgcaaggtgttttaacaacaaaaacttatgcaactagtcaaaatgctaagcaggtattagataaaagtcataaggtagcagttgttggggcaggtatcatcggtttagatattgcttatagtttacatgaatcagggaaggcggtcactttgttagaagctcaagaaagaccagacttcaggcatacagatcctgatatgtcccttcctttacttgatgcgatggctgaatcaaaactacattttttccaaaatcaaaaggttgagaaaattactgtaacccgagaagaaaaactttgtttgcgaacgctaacaggagacacctttacagttgatgctgtcatattagctgttaattttcgtccggatagtcgtcttttaactgggttggttgatttaagtgttgataatagtgttgttgtaaatgattatttccaaacgagtgaccctaatatctatgctattggcgatttgatttggtcgtattttaaaggtcttaatagtgcttattatatgcccttaattaaccaagcaatccgttcggcacaaatgttggcataccatttatcgggacatgctgttccaaaattaaaaataacacgcgctacaggatctaaacactttggctattatagagctaacattggattaactgaattggaagctggtttttacgaggataccgttagtgttacttatttccctaaagaacagtatgatttaaggataaaattgattgctaaccaaaaaacgggccatttattgggggctcaattaatctcaaaggaaaattgtttggctactgccaatcagcttgttcaagctatatcgtgtgatatgacagattttgatctggcttttcaagatttcatttatacagctagagaatctgagatggcttatatgttgcatcaagcagctatcaacctttatgaaaagaggattgggctatgcgaa

SEQ ID NO: 2856 - protein, 445 aa, Streptococcus agalactiae
MTEKYVNKVIVILGASFAGMTCAQKLRQLNPNWDIVLIDKEIHPDYVPNGLNWYYRHEISGLNQAMWQTEEEQRLQNIRCLFGLKVEKINKEDRELMLSDGSSVYYDQLICAMGSQAESTYIDGADAQGVLTTKTYATSQNAKQVLDKSHKVAVVGAGIIGLDIAYSLHESGKAVTLLEAQERPDFRHTDPDMSLPLLDAMAESKLHFFQNQKVEKITVTREEKLCLRTLTGDTFTVDAVILAVNFRPDSRLLTGLVDLSVDNSVVVNDYFQTSDPNIYAIGDLIWSYFKGLNSAYYMPLINQAIRSAQMLAYHLSGHAVPKLKITRATGSKHFGYYRANIGLTELEAGFYEDTVSVTYFPKEQYDLRIKLIANQKTGHLLGAQLISKENCLATANQLVQAISCDMTDFDLAFQDFIYTARESEMAYMLHQAAINLYEKRIGLCE

SEQ ID NO: 2857 - DNA, 1344 bp, Streptococcus pyogenes
atgacattaacgacaaagaccatacatgttatcggggcatcctttgctggtctagcctttgttgataaatataaggacctcaatccagattcccaaatcattctcattgataaggaaagctgtcccaattatattccaaatggtatcaaccaattattcagaggagacattcaagacctgtctgatgctatgtggggaagagcctgcctagcagcacaaatagagtctaaccatcggtttattcaagcagaagtgttagctatcgaagctccctcaaacaccttgcttctcaaagacagtcaaggacgagtttttgaagaaggttatgaaacgcttgtttgtgccatgggtgctagcccccagtctcattatattgagacgtcacagaccaacaaagttttggtaaccaaatattatgaagaaagccaagctagtttaaaactgattgaggctagccaagaggtcttggttattggtgccggcttgattggcttagaccttgcctacagtttgtccttacaaggcaaacgggtcaaactgattgaagcagccgaacgtccagatttctatcagactgacgcagaactgatagcccctgtaatggcagaaatgtccactcaccatgtcacctttattaataataagcgtgttacggctattcatgagatagagggaaaagttgtcgctcataccgagcaaggggacaccttccaaggtgatttggctattttagccattaactttaggccaaatacacaccttttgcaaggacaagtggcttgtgctctggataagaccattttggttaatgaaaacttacagaccagccaggctaatatctatgccattggagacatggtttcattgcattttggtatattgggaatggattactatacacctttgattaaccaagcaatgaagacaggtcaggctctggctctgcatttagctggatatcctattcctccattacagacggtcaaggtattaggaagttctcactttgattattatcgcgcgagtgttggtgtgacagaagaagaagcagagctttatatggatacgtgtagctatttgtaccaaaatggggattctaaaaacctcttttggctgaaattaatagctagaaaaacggatgggattttaataggcgctcagctcctatccaaaaccaatgctcttgtcatcgccaatcaattaggtcaggctctggctctgaaagttacagacgctgacttagcatttcaagattttctctttttacaaggtcacagtgatttggcttatcatcttcatgaagcttgtctcaaattatttgaaaagaggctccgccatgaagat

SEQ ID NO: 2858 - protein, 448 aa, Streptococcus pyogenes
MTLTTKTIHVIGASFAGLAFVDKYKDLNPDSQIILIDKESCPNYIPNGINQLFRGDIQDLSDAMWGRACLAAQIESNHRFIQAEVLAIEAPSNTLLLKDSQGRVFEEGYETLVCAMGASPQSHYIETSQTNKVLVTKYYEESQASLKLIEASQEVLVIGAGLIGLDLAYSLSLQGKRVKLIEAAERPDFYQTDAELIAPVMAEMSTHHVTFINNKRVTAIHEIEGKVVAHTEQGDTFQGDLAILAINFRPNTHLLQGQVACALDKTILVNENLQTSQANIYAIGDMVSLHFGILGMDYYTPLINQAMKTGQALALHLAGYPIPPLQTVKVLGSSHFDYYRASVGVTEEEAELYMDTCSYLYQNGDSKNLFWLKLIARKTDGILIGAQLLSKTNALVIANQLGQALALKVTDADLAFQDFLFLQGHSDLAYHLHEACLKLFEKRLRHED

SEQ ID NO: 2859 - DNA, 111 bp, Streptococcus agalactiae
gtgccaaaatatgataaagaaattagacttagactcattaattctattaatagagcgcttggctcaacatactttaactcgagaagctcatcaaaatctgggactttggtt

SEQ ID NO: 2860 - protein, 37 aa, Streptococcus agalactiae
MPKYDKEIRLRLINSINRALGSTYFNSRSSSKSGTLV

SEQ ID NO: 2861 - DNA, 144 bp, Streptococcus agalactiae
ttggtaaaatattttgtgaatgtagaaaagcaaaagttgccagaacttctccttccctatactcaagagcaaaacgactcatatacaaaactaaggctgcgtctaaccgtttataaaaagcattacattgataatgtttcacaa

SEQ ID NO: 2862 - protein, 48 aa, Streptococcus agalactiae
MVKYFVNVEKQKLPELLLPYTQEQNDSYTKLRLRLTVYKKHYIDNVSQ

SEQ ID NO: 2863 - DNA, 1428 bp, Streptococcus agalactiae
atgcgaatagaagctctaatggaaaaagaaaggcgtgttcaatatcggctactttcttttttaagaggctctcctcaggcaatagcactgaagttagctttattagaaactggtttaagtcgagcaacttttcttaaatatatcaataatcttaatagctactttgaacaagaaaaagttaattgtcgaatcgtttattataaggataagttatttttagaagaggattataacttatccaatcaagaagtgttgaaagctctgatgaaagatagtattaaatacactatcttaatatctttatttaatcagcgtcagttcacaatcgttggtctttctcaagaattgatggttagtgaggctactttaaatcgtcatcttgctcatctcaatgaattgttagcggaatttgatattgctatttcacaaggaaaacagattggtgatgaattgcaatggcgttatttttattatgaattattcaagcaactatggtcttatgacaagtgccaaaatatgataaagaaattagacttagactcattaattctattaatagagcgcttggctcaacatactttaactcgagaagctcatcaaaatctgggactttggtttagtatttgtcatcatcgtctccttgctatggaaaaaatatctgataatctcaagcctattgtgaaacattatcaatgtaatgctttttataaacggttagacgcagccttagttttgtatatgagtcgttttgctcttgagtatagggaaggagaagttctggcaacttttgcttttctacattcacaaaatattttaccaatcaatacaatggaatacatcatgggatttggaggcccgattattgattgtgtaaccgaaacaatcatctactttaaaaaggagagtattttagctgacgagacatcagatcaggttatttaccaacttggtcagttatatagccattattatttctttaaaggtcatattttagttgaacaacctgatttagaacaaacgtatcgacttattgatcataatatgagggataagttgcatcatatttcaaagaagattattgcaaatgttaatcgaattagacctttaacagaagatggttgttctttgctgactttacatttgttggaattgcttattttctcgaaaaatagtcaaaaaatgccctttaggattggtctagatatgacaggtaatgctgtggaacagtcattgttggaatatcgcattcgacaacatttctctggtaataattctattcaagtcgaaccttatgacgaaggaaagggatttgatatggttatttatcagagtcactcaagaccttataaagccaaactaacctattgccttaataaaggtgcttcagagcgagaactacaggaaatagattcacttatttatgacaat

SEQ ID NO: 2864 - protein, 476 aa, Streptococcus agalactiae
MRIEALMEKERRVQYRLLSFLRGSPQAIALKLALLETGLSRATFLKYINNLNSYFEQEKVNCRIVYYKDKLFLEEDYNLSNQEVLKALMKDSIKYTILISLFNQRQFTIVGLSQELMVSEATLNRHLAHLNELLAEFDIAISQGKQIGDELQWRYFYYELFKQLWSYDKCQNMIKKLDLDSLILLIERLAQHTLTREAHQNLGLWFSICHHRLLAMEKISDNLKPIVKHYQCNAFYKRLDAALVLYMSRFALEYREGEVLATFAFLHSQNILPINTMEYIMGFGGPIIDCVTETIIYFKKESILADETSDQVIYQLGQLYSHYYFFKGHILVEQPDLEQTYRLIDHNMRDKLHHISKKIIANVNRIRPLTEDGCSLLTLHLLELLIFSKNSQKMPFRIGLDMTGNAVEQSLLEYRIRQHFSGNNSIQVEPYDEGKGFDMVIYQSHSRPYKAKLTYCLNKGASERELQEIDSLIYDN

SEQ ID NO: 2865 - DNA, 1557 bp, Streptococcus pyogenes
gtgatttggcttatcatcttcatgaagcttgtctcaaattatttgaaaagaggctccgccatgaagattgaagacttaatggataaggaacgaagggcccaatatcgtctcttggtgaccctttatcatgctaaagaaacgttaaggctaaaagacctaatgaggctatcaaacttgtctaaagtgaccctattaaaatacattgacaatctaaatcatttgtgtcgagaacaaggtttagcctgtcaattacttttagaaaaagacagtctgagcttaaaagaaaatggccagttccattgggaggatttggtagctctgcttctcaaagaatcggttgcctatcagatattgacctacatgtactgccatgaacactttaacatcaccaacttatccgttgaactgatggttagtgaagctactctaaacagacaattagctcacctcaaccagcttttatcagaatttgatctggcgctctcgcaaggcagacaactgggaagtgagcttcagtggcgttatttctattttgaattgttccgccataccttgaccagacaaggcatagacgccttggtcaatcagttagacgcttcgcatttggctaccttaattgagcggctgattggccagtcattatcggcagaagccttagaacaattattgatttggttggcgatttcgcaagcgcgaatgtcctttcaaaaaagctacaatgatcattttttaagagatagtgactttatgacatctaatattttctttaagcgcttagaaagcatgcttttacattacttaagacgctatgcccttgaatttgatgcttttgaagctaagagcctctttgtctttttgcatgcttatcctctacttcctattgccagcatgaagtatagtttgggttttggaggtcctattgctgatcacatttcagaagccttatggcttttaaagaaggctcatgtgattatccatcagacaaaggaggaaatcatttatggcttggggatatttttttccaaagcttacttttttaaaggagctatccttagtcaaccaaccaatagccaatacctttatcaattagtaggcgaagataaaagagcgcttttaagggttatcataaaccatttagtgctgcaaatggatcaggaaacggatttcagtcagcagttgagtgacgacattttagcattgttgattttttccattgagcgccaccatgagcctcttttagtagggcttgccttggggcaaaataaggtggaagcagccattgcggaattggccattagacgtcatttggggcatcgtagggattttcaattaatgccctatgatcatcagaaagtttatgattgtctgattacctatcagactgtctgtttaccgagacaagatttaccctattaccggttaaaacagtatagctccccctatgaactcactgctttagaagcttttctcaaagaccttttccagcaaaaaaatacacgagaagaggaactctcactcagcccagcagctaagtctagttttgcacacaaaactgtg

SEQ ID NO: 2866 - protein, 519 aa, Streptococcus pyogenes
VIWLIIFMKLVSNYLKRGSAMKIEDLMDKERRAQYRLLVTLYHAKETLRLKDLMRLSNLSKVTLLKYIDNLNHLCREQGLACQLLLEKDSLSLKENGQFHWEDLVALLLKESVAYQILTYMYCHEHFNITNLSVELMVSEATLNRQLAHLNQLLSEFDLALSQGRQLGSELQWRYFYFELFRHTLTRQGIDALVNQLDASHLATLIERLIGQSLSAEALEQLLIWLAISQARMSFQKSYNDHFLRDSDFMTSNIFFKRLESMLLHYLRRYALEFDAFEAKSLFVFLHAYPLLPIASMKYSLGFGGPIADHISEALWLLKKAHVIIHQTKEEIIYGLGIFFSKAYFFKGAILSQPTNSQYLYQLVGEDKRALLRVIINHLVLQMDQETDFSQQLSDDILALLIFSIERHHEPLLVGLALGQNKVEAAIAELAIRRHLGHRRDFQLMPYDHQKVYDCLITYQTVCLPRQDLPYYRLKQYSSPYELTALEAFLKDLFQQKNTREEELSLSPAAKSSFAHKTV

SEQ ID NO: 2867 - DNA, 1983 bp, Streptococcus agalactiae
atgacatttgacaccattgatcaattagcggttaatacagtccgcacgctttctattgatgctatccaagcagcaaattctgggcacccaggtcttcctatgggagctgcgcctatggcttatgtgctttggaataaattcttaaatgtaaacccaaaaacaagtcgcaattggacaaaccgtgaccgttttgtgctatcagctgggcatggttcagctcttctttatagcctacttcatttagctggctatgatttatcaattgatgatttaaaacaatttcgccaatggggatcaaaaacacctggacatccagaagttaaccatactgatggtgtagaagcaacaactggacctttagggcaaggtattgctaatgctgttggtatggcaatggctgaagctcatttggctgctaaatttaataaaccaggctttgatttagttgatcattacacttatacacttcatggtgatggttgtttgatggagggtgttagccaagaagctgccagtcttgctggacacttaaaacttggtaaattggtccttctttatgattcaaatgatatctcacttgatggtccaacatctcaatcatttacagaagatgttaaaggacgttttgaatcatatggttggcaacatatcttagttaaagatggtaatgatttagaagcgattgctgcagcaattgaagctgctaaagctgaaactgataaaccaaccattattgaagttaaaactattattggatttggcgcagagaaacagggaacatcttcagttcatggagcgccacttggtgcagaaggtattacttttgccaagaaggcttatgtatgggaatatccagactttactgttcctgctgaagttgcagatcgatttgcctcagatcttcaagcgcgtggtgcgaaggcagaagaggcatggaatgatctttttgctaaatatgaagttgagtatccagaattagcaactgaatacaaagaagcttttgctggccaagctgagacagttgaactgaaagctcatgacctaggttcatcagtggctagtcgtgtttcaagccaacaagctattcaacaattatcgactcaattaccgaacctctggggagggtcagcagacctctcagcttctaataacacaatggtagcagcagaaacagatttccaagcaagtaactacgctgggcgtaatatttggtttggtgtacgtgaatttgcaatggctgctgcaatgaatggaattgcgcttcacggtgggactcgtgtttatgggggtacgttctttgtcttctcaaactacttgttaccagcagtacgtatggctgcacttcaaaacttgccaactgtctatgttatgacacatgattctattgctgttggagaagatgggccaactcatgagccaatagaacaattagcatcagtgcgctcaatgcctaatttgaacgttatccgtcccgcagacggtaatgaaacaaacgctgcatggcaacgagctgtatcagagacagatcgaccaacgatgcttgttttaacacgtcaaaacttaccagttcttgaaggaacatcagaattagcccaagaaggggttaataaaggtgcttatattttatcagaagctaaaggtgaacttgatggtatcatcattgcaacaggttcagaagttaaattagctttagatactcaagacaaacttgagtcagagggcatccatgttcgcgtcgtatctatgccagcacaaaacatttttgatgaacaagaggcttcatatcaagagcaagtgcttccatcagctgttacaaaacgtcttgctattgaggcaggatcaagcttcggttggggtaaatatgttggtttaaatgggctaacacttactattgatacttggggagcatcagcaccaggtaacagaattttcgaagagtatggctttacagttgagaatgctgtatcgctatataaagaactt

SEQ ID NO: 2868 - protein, 661 aa, Streptococcus agalactiae
MTFDTIDQLAVNTVRTLSIDAIQAANSGHPGLPMGAAPMAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYVWEYPDFTVPAEVADRFASDLQARGAKAEEAWNDLFAKYEVEYPELATEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 2869 - DNA, 309 bp, Streptococcus agalactiae
ttgtttatgaagaaggagtgtcgtgatttttatcggcagatacagcatacttacaatgatatatctgtccgtgaagatgcagtgctatcatcaatactattatcagcatcgaatggtttgataaaaactagcgatgtacctcgtgttgcttatgagttaactcagcaattggaaaataatgagatagaaaaatctttcgagtcattagctacagttaaggaattgaaaaaatctgctaaaaaattgtctgagagatatgagcaaaataaggtaacaacgggattgctttctaaagtatttggaaatcat

SEQ ID NO: 2870 - protein, 103 aa, Streptococcus agalactiae
MFMKKECRDFYRQIQHTYNDISVREDAVLSSILLSASNGLIKTSDVPRVAYELTQQLENNEIEKSFESLATVKELKKSAKKLSERYEQNKVTTGLLSKVFGNH

SEQ ID NO: 2871 - DNA, 264 bp, Streptococcus pyogenes
atggaaaagaaacgacagcgcttatacgatgtgattagacaggcttatgattatccagaaaatcgtgaaaatgtggccttgtcgcagctacttttagcagcttctaatagattaattaaacacagtaacccacttcttgttgcctaccaactaaaccaagatgtggataattacttacttgataatgacattttacttccaaaatcgctttgccgttttaagcagtcattggaaaagtatattttagaggaagcctcatcagtc

SEQ ID NO: 2872 - protein, 88 aa, Streptococcus pyogenes
MEKKRQRLYDVIRQAYDYPENRENVALSQLLLAASNRLIKHSNPLLVAYQLNQDVDNYLLDNDILLPKSLCRFKQSLEKYILEEASSV

SEQ ID NO: 2873 - DNA, 732 bp, Streptococcus agalactiae
atgattaagtttgaacatgtttcgaaagtatacggagaaaaagaagctctcagtgatttaaccctctctgttaaagatggtgagatttttggattaataggtcacaatggagcaggaaaaacaacgacaattagtattctaacatctattattgatgcaacttatggccaagtctatattgatgacctacttttgacagaacatcgtgaccaaattaagaaaaaaataggttatgtaccggactcgccagatattttcttaaatttaaccgcagaggaatactggtactttttagctaaaatttatgacgttgccccagaagatattgaagcacgtatcacaaaattggtagacatatttgaactagaggagcaacgctataatcctattgaaagtttttcacatggtatgcgtcaaaaagtcattgttataggtgcccttcttccaaatcctgacatttggattctagatgagccgttaactggtttagaccctcaagcttcttttgatttgaaagaaatgatgaaagaacatgctaaaaatggaaaaacagttattttttcaacacatgtcttagcagttgcagaacagttatgcgacagaataggtattttgaaacaagggaaattaatctttgtcggtagcttaggtgagttaaaaatgaaatatccagataaagatttggaaactatctatttggaattagcaggacgtcaagctagtagggaggga

SEQ ID NO: 2874 - protein, 244 aa, Streptococcus agalactiae
MIKFEHVSKVYGEKEALSDLTLSVKDGEIFGLIGHNGAGKTTTISILTSIIDATYGQVYIDDLLLTEHRDQIKKKIGYVPDSPDIFLNLTAEEYWYFLAKIYDVAPEDIEARITKLVDIFELEEQRYNPIESFSHGMRQKVIVIGALLPNPDIWILDEPLTGLDPQASFDLKEMMKEHAKNGKTVIFSTHVLAVAEQLCDRIGILKQGKLIFVGSLGELKMKYPDKDLETIYLELAGRQASREG

SEQ ID NO: 2875 - DNA, 732 bp, Streptococcus pyogenes
atgatagaatttaaacatgtttcaaagttgtatggcgacaaagaagctctcagcgatttaaacgtcaccatcaatgacggtgaaatttttggccttatcggacataatggtgcaggtaaaaccacgaccatcagcattttgacttctattatcgaagcgagttatggcgaagtatttgtggatggtcaacttctgacagaaaatagagaagctatcaaaaaacaaattgcttatgtgccagattctcctgatattttcttgaatctaactccaaatgagtattggcagtttttagctaaaatttatggggtgtcagatgaggacagagaagaacggttagcacagctgacaacactttttgaactgaaggaagaagttaatcaaaccattgatagtttctcacatgggatgcgccaaaaagtgattgtgattggtgctcttgtatcaaatcctaacatctggattttggatgaaccattaacaggtttggatcctcaggcttcttttgaccttaaagaaatgatgaaagctcatgcagcttctggacatacagtcttattttcgactcacgtgctatcagtcgctgagcagttatgtgatcgtatcgggattctaaaaaaagggaaattgatttttgttggaacgattgatgagttgaaagaacaccatcctgacaaagacttggagagcatctaccttgaactcgctgggcgtaaggcgcaagaagagggg

SEQ ID NO: 2876 - protein, 244 aa, Streptococcus pyogenes
MIEFKHVSKLYGDKEALSDLNVTINDGEIFGLIGHNGAGKTTTISILTSIIEASYGEVFVDGQLLTENREAIKKQIAYVPDSPDIFLNLTPNEYWQFLAKIYGVSDEDREERLAQLTTLFELKEEVNQTIDSFSHGMRQKVIVIGALVSNPNIWILDEPLTGLDPQASFDLKEMMKAHAASGHTVLFSTHVLSVAEQLCDRIGILKKGKLIFVGTIDELKEHHPDKDLESIYLELAGRKAQEEG

SEQ ID NO: 2877 - DNA, 1602 bp, Streptococcus agalactiae
atgaattggtcacgtatctgggaactcgtaaaaattaatatcctttattcaaaccctcagactctatcggcactaagaaaaaagcaagaaaaacatcctaaaaaagaattttcagcttataaatccatgtttagaaatcagttatttcagattttgctcttttcaataatttatgtatttctctttgtatcacttgattttaaagaatatccgggctacttcacgttctacattggtatctttacactagtatccattatctactcttttattgcgatgtacagtgttttctatgagagtgacgatgttaaacaatatgcttatttgcctattaaatctgaagagctctatgttgctaaaatttttgcaacatttgggatgtctgtaacttttctaatgccaatcctaaccttaatgattgtggcttattggcgtataataggtggcccacttgcggtcctcctagcaatcataaattttgctattttatttttatcggtaacggtgatttcattgtatattaatagtttaataggccgtgccattattcgaagtgctaatcggaaacttatttctactatattaatttcactagctacatttggagcaatagttcccttattatttgtgaatatgacgagtcaaaagatggtacaagggaaattacaagatatcgctccaatcccttatgtcagaggttattatgatattgttacagcgccatttagtatggagagtctcctcaactattatctcccgctcttaatcattttattcttgataggtgctatttataaatgggttatgccacgctactatcaggagttgttgtatggacaggtcaagcagagaaaagtccatcgtcaaatcgattttagtaaacgtgagtcaattaataaaactcttgttaaacaccatttatcaagtttacaaaatgcgacattattgacaaatacatttttaatgccactattatatctagcaatgttcattgttccaattttgaataatggtaaagagattggtcgattttttaatgaaaattattttgggatagcttttctagcaggaatattaataggtagtttatgtgtgatgccagctagcattgtaggggtaggtatttctttagaaaaaagtaatttctactttataaaaagtttgcctatatcattttcgtatttcttgaagcataaatttgtaactttgataaccttacaacttgcagttcctacttttatttatttcttggtaggattctttctacttaaactatcaatcctcgttttattgagcttcattttaggtctagtcttcatgggacttatcgaaggccagtttatttatagacgtgactataaacatttgttcttgaattggcaagaggttacgcaactatttaatagagggttaggccaatggctgttagttggttcattgtttggaatgatgataataggtagttttcttattggaataagtattttttggtcaatggtatggaatactgtagctgtcaatatcataatccttatcattgggttgctcatattatcaatttgccaatacttactgctaaaaaatttttggaagaagcttgtt

SEQ ID NO: 2878 - protein, 534 aa, Streptococcus agalactiae
MNWSRIWELVKINILYSNPQTLSALRKKQEKHPKKEFSAYKSMFRNQLFQILLFSIIYVFLFVSLDFKEYPGYFTFYIGIFTLVSIIYSFIAMYSVFYESDDVKQYAYLPIKSEELYVAKIFATFGMSVTFLMPILTLMIVAYWRIIGGPLAVLLAIINFAILFLSVTVISLYINSLIGRAIIRSANRKLISTILISLATFGAIVPLLFVNMTSQKMVQGKLQDIAPIPYVRGYYDIVTAPFSMESLLNYYLPLLIILFLIGAIYKWVMPRYYQELLYGQVKQRKVHRQIDFSKRESINKTLVKHHLSSLQNATLLTNTFLMPLLYLAMFIVPILNNGKEIGRFFNENYFGIAFLAGILIGSLCVMPASIVGVGISLEKSNFYFIKSLPISFSYFLKHKFVTLITLQLAVPTFIYFLVGFFLLKLSILVLLSFILGLVFMGLIEGQFIYRRDYKHLFLNWQEVTQLFNRGLGQWLLVGSLFGMMIIGSFLIGISIFWSMVWNTVAVNIIILIIGLLILSICQYLLLKNFWKKLV

SEQ ID NO: 2879 - DNA, 1668 bp, Streptococcus pyogenes
ttgaactcgctgggcgtaaggcgcaagaagaggggtgatggcatgaattggtctactatttgggaacttatcaagataaacattctttattccaatccacaaagtttagctaacctcaaaaagcgtcaggaaaaacacccgaaagaaaacttcaaagcctataaaagcatgatgaggcaacaggccttaatgattgccatgtttttggtgatttacctttttatgtttattggtgtcgatttcagtcattatccaggacttttctcctttgacgttgctatgttttttatcatgtcaaccttgacagcctttagctctctttacaccattttttatgaaagtaatgacctaaaactttatattcacttaccagtaacgtcagaagaactctatattgcaaaaattgtctcgtcgctagggatgggtgctgtctttttgatgcctcttatctctcttctcttaattgcctattggcaactcttgggaaatcctttgtctattttagtagctatcgtgctctttttagtgttactagtgagttctatggtattagctatttatatcaatgcttgggtaggcaaaatcattgtaagaagtcgcaaacgaaaactcatttcaactatcatgatgtttgtctcaacttttggcgctttcgtcttaatttttgcgattaatattagtaacaacaagcgtacgatgacggatggcgtatttactgattacccaactattccctatttcaaaggattctatgatgttgttcaggcaccgttttctactgcggccctccttaacttttggttgccattgttacttatcctagctatggtatatggtattgtcacaaaagtgatgccaacttattatcgtgaggctttttatattagtaacgagaacaaagtcaagcaaactaaaaaaccagttaatcgtcctcatcagaatcaatcactggcgcagttgttgcgaaaacatcacctattaacgttacaaaatgcaactttactgacacaaacctatctcatgcccctgatgtatgtgatgctttttatcggtccaagtttgtcacgtggcacaggtttctttaagcatatttccccagattactttggggtagccttattatttggggttagtttgggtgtcatgtgtgcaacaccaaccagctttattggagtaggtatttcacttgaaaaggataactttacctttattaaaagcttaccaataacgttaaaaaaattcttgatggataaattttgcttgcttgtaggtctgcagctgattgtgcctatggtgatttatcttgtgtttggtctctttgtgttgcacctgcatcctcttctaacgattgctttttgtcttggctacgccctatcactgattgtgcaaggggaattgatgtatcgtcgtgactaccggcttctggatttaaaatggcaagacatgacgcaactctttaccagaggagatgggcaatggttaacaatgggacttatctttggtaatttaatagttgcaggtgtgctaggttttggagctgttatcattgccaatattatccaacaacctctgttgattagtattctattgagttgtctaatactaatggttttaggtcttgcgcaattatggattcaaaaaaccttctggaaaagcttagagaggctt

SEQ ID NO: 2880 - protein, 556 aa, Streptococcus pyogenes
LNSLGVRRKKRGDGMNWSTIWELIKINILYSNPQSLANLKKRQEKHPKENFKAYKSMMRQQALMIAMFLVIYLFMFIGVDFSHYPGLFSFDVAMFFIMSTLTAFSSLYTIFYESNDLKLYIHLPVTSEELYIAKIVSSLGMGAVFLMPLISLLLIAYWQLLGNPLSILVAIVLFLVLLVSSMVLAIYINAWVGKIIVRSRKRKLISTIMMFVSTFGAFVLIFAINISNNKRTMTDGVFTDYPTIPYFKGFYDVVQAPFSTAALLNFWLPLLLILAMVYGIVTKVMPTYYREAFYISNENKVKQTKKPVNRPHQNQSLAQLLRKHHLLTLQNATLLTQTYLMPLMYVMLFIGPSLSRGTGFFKHISPDYFGVALLFGVSLGVMCATPTSFIGVGISLEKDNFTFIKSLPITLKKFLMDKFCLLVGLQLIVPMVIYLVFGLFVLHLHPLLTIAFCLGYALSLIVQGELMYRRDYRLLDLKWQDMTQLFTRGDGQWLTMGLIFGNLIVAGVLGFGAVIIANIIQQPLLISILLSCLILMVLGLAQLWIQKTFWKSLERL

SEQ ID NO: 2881 - DNA, 1383 bp, Streptococcus agalactiae
atgtctagagaatacatcaccttgtcaaaaaatatcatcaaacaccttggtggacaaaataatattaacaatgtttaccattgtcaaacacgccttcgctttagtctcaatgatccgacgaaagtaaaccttgagcaattaaaaactttaaaagaggtaaaaactgtcgttatcagcggagggcaacatcagatagtgatagggactcatgtcgcaaaagtgtttgaagaaattaactccctcattgaaactaactcaacgactaaaatagaacaaaccaaaaaagccaaagcagttagtcgaattattgattttgtttctgggactttccaaccgattttacctgctttatcaggcgctggtatgattaaggcattgctagctttattactagtattcaaaatcttgacaccgtcatctcaaacatatatattactaaatctttttgcagatggtgttttctattttttacctatcttaatcgccatcacagctgctcaaaaattgaaagctaatcctattttagctttgggaactgttgtcatgctccttcaccctaattgggctaatttagtagcttctggtaaaccagtatccttattccatacgatcccattcacacttactaactatgcatcaagtgtcattcccattattctaattatttgtgttcaggcttatatagaaaaatatttaaagcaaattattcctaaatcactgcgtttagtgcttgttcctatgttaatatttctcagcatgggaattttgtcgttctctatattgggaccaatgggtactatcgctggccaatatttagctgttatttttacttttttatccaaatacgccagttgggcacctgcttttctagtaggagcatttgctcctatcctaatcatgtttggtgttcatagtggaattgctgcattaggaatcacacaactagcgaaattaggggttgattctatttttggaccaggcatgctctgctcaaatatcgcacaagcaactgcaggtacagtggtgactcttataacaaaagaaaaaaaacttaaagaaattgctggacctgctgccataacagcttatatgggaatcaccgaacctatcttatatggtgtcaaccttccgaaacgttatcctctaatagcctcacttattggtggtggtcttggaggactctatgccggtataatgaacgctcaccgcttcgctgtaggctcttctggtctaccaggtctgtttctttatatcagtcatacttcaacacatctttttattaccatgcttattgcagttatcattactgtaagcacaactgctatattgacattcattctagcacaatattacgaaaaacaagttagcatcagacaaagagac

SEQ ID NO: 2882 - protein, 461 aa, Streptococcus agalactiae
MSREYITLSKNIIKHLGGQNNINNVYHCQTRLRFSLNDPTKVNLEQLKTLKEVKTVVISGGQHQIVIGTHVAKVFEEINSLIETNSTTKIEQTKKAKAVSRIIDFVSGTFQPILPALSGAGMIKALLALLLVFKILTPSSQTYILLNLFADGVFYFLPILIAITAAQKLKANPILALGTVVMLLHPNWANLVASGKPVSLFHTIPFTLTNYASSVIPIILIICVQAYIEKYLKQIIPKSLRLVLVPMLIFLSMGILSFSILGPMGTIAGQYLAVIFTFLSKYASWAPAFLVGAFAPILIMFGVHSGIAALGITQLAKLGVDSIFGPGMLCSNIAQATAGTVVTLITKEKKLKEIAGPAAITAYMGITEPILYGVNLPKRYPLIASLIGGGLGGLYAGIMNAHRFAVGSSGLPGLFLYISHTSTHLFITMLIAVIITVSTTAILTFILAQYYEKQVSIRQRD

SEQ ID NO: 2883 - DNA, 1860 bp, Streptococcus pyogenes
atgacgtatcaagaaactgccaaggctattttagcggcggttggtggcaaaacaaatattcaacgtgtgacacactgtgtaacacgtctacgcttagtactgaaaaatgatgagaaagttaaagatcagcaagtcaaagccatttcaaatgtgattggcgtgatgcgcaaaaacggccagtaccaaattatcttgggcaatgatgtcaataattattaccaagcctttttaagcctagggcattttgacaatcaagatgaagatcattcttcaaaagcgaaaggaagtatccttgagcgcttgattgaaaccattgctggcgtgattacaccgctgattccagcccttcttggtggtggaatgctcaaagtggtgggaatcttgcttcctatgcttggcttagcgagtgcggactctcaaaccgttgcctttattaacttctttggcgatgcggcttattattttatgcctgtcatgattgcctattcagcagcggcgcgctttaaggtgacacctgttttagcagcgacgatcgcagggattttattgcatcctgcctttgttgcaatggtagcagaaggtaaaccattgactttatttggagcaccagtcactcctgctagctatggctcatctgttattcccattttgatgatggtttacttgatgcaatacattgaaaaatgggtcaatcgcttggtgccaagcgtgatgaaaagcttcttacagccaaccttaatcattttgatttctggctttttggctttagtggttgtaggtcctcttggtgtgattattggtcaagggttatctaataccatgctcgctatttatcatgtggctccgtggctagcacttgctattttgggagcgattatgccgcttgttgtcatgacggggatgcactgggcttttgcaccaatctttttggccgcttcggtcgcaacaccagatgtcttgattttaccagcaatgttggcttctaatttggctcaaggagccgcatctttggctgttgcctttaaaacaaagcagaaacaaacacgtcaagttgcccttgccgcggggatttcagctttgctggcaggtatcacggaaccggcactttatggggtcacactgaaatttaaaaagccactctatgcagccatgatttcaggtggtctggttggagcctttattggttttgtcaatattgcttcttatacctttgtcgtaccttctattattggtttaccacagtacatcaacccatcaggcggagctaattttacaaatgctttgattgccggaactgcgacgattgtgttagccttcagtttgacttggttcatgggaattgatgaagagtccccaaagcaagtgagtgttgcagcagatatgtcacaagttaagagcggcttgtcaaccaaacaaacgttgtatgctccaatgacaggtgagatgctttttctatcagaagttcctgatgaaaccttttcttccaagttattaggagaaggatttgccatattaccaagcgaaggtgaggtctatgccccctttgatggtgaagtcatcactttctttccaaccaagcatgctgttgccttaaaaaacacacgtggtgtggaagtcttgattcatgtcggtattgatacggttgagttaaaagggcaaggtttcgagcagttagtgtctgttggcgatgtcgtgaaacgaggccaggcacttctaaaaatggatattgatttcattacttcaaaaggctattcactcatcagtcctgtggtcgtgaccaattcggctgagcagttggagattattattcaagatgacaaaaaaatggtgactaaagaggacgctttgttagtcatttta

SEQ ID NO: 2884 - protein, 620 aa, Streptococcus pyogenes
MTYQETAKAILAAVGGKTNIQRVTHCVTRLRLVLKNDEKVKDQQVKAISNVIGVMRKNGQYQIILGNDVNNYYQAFLSLGHFDNQDEDHSSKAKGSILERLIETIAGVITPLIPALLGGGMLKVVGILLPMLGLASADSQTVAFINFFGDAAYYFMPVMIAYSAAARFKVTPVLAATIAGILLHPAFVAMVAEGKPLTLFGAPVTPASYGSSVIPILMMVYLMQYIEKWVNRLVPSVMKSFLQPTLIILISGFLALVVVGPLGVIIGQGLSNTMLAIYHVAPWLALAILGAIMPLVVMTGMHWAFAPIFLAASVATPDVLILPAMLASNLAQGAASLAVAFKTKQKQTRQVALAAGISALLAGITEPALYGVTLKFKKPLYAAMISGGLVGAFIGFVNIASYTFVVPSIIGLPQYINPSGGANFTNALIAGTATIVLAFSLTWFMGIDEESPKQVSVAADMSQVKSGLSTKQTLYAPMTGEMLFLSEVPDETFSSKLLGEGFAILPSEGEVYAPFDGEVITFFPTKHAVALKNTRGVEVLIHVGIDTVELKGQGFEQLVSVGDVVKRGQALLKMDIDFITSKGYSLISPVVVTNSAEQLEIIIQDDKKMVTKEDALLVIL

SEQ ID NO: 2885 - DNA, 801 bp, Streptococcus agalactiae
atgaaaagacattttgagacaactagaagaattgttattaaagtaggaaccagttccctcgtacagacaagcgggaaaattaatttaagtaaaatagaccatttagcatttgttatttctagtcttatgaatagaggcatggaggtgattttagtatcatctggtgctatggggtttggtttagacattttgaaaatggataagcgtcctcaagaaatatcacaacaacaagcagtttctagcgtaggacaagtagccatgatgagtctttattctcagatattttcgcactatcaaactcatgtttcccaaattttattaacacgtgacgttgtggtttttccagagagtttgcaaaatgtaacaaactcttttgagagtctgctctctatgggaattttgccaatcgtcaatgagaatgatgctgtcagcgtggatgagatggatcataaaacgaagtttggggataatgaccgtctctctgctgtcgttgctaaaattactaaagcagatttattaattatgctgtcagatattgatggtctttttgataaaaatcctaatatttatgatgatgctgttttacgtagtcatgtttctgaaatcaccgatgacatcatcaagtcagctggaggagcaggaagtaaatttggtactgggggcatgcttagtaaaattaaaagtgcacaaatggtgtttgataacaatggacaaatgatattgatgaatggcgccaatcctcgtgatattttaaaggtgttagatgggcataatattggaacttattttgctcaaggaaag

SEQ ID NO: 2886 - protein, 267 aa, Streptococcus agalactiae
MKRHFETTRRIVIKVGTSSLVQTSGKINLSKIDHLAFVISSLMNRGMEVILVSSGAMGFGLDILKMDKRPQEISQQQAVSSVGQVAMMSLYSQIFSHYQTHVSQILLTRDVVVFPESLQNVTNSFESLLSMGILPIVNENDAVSVDEMDHKTKFGDNDRLSAVVAKITKADLLIMLSDIDGLFDKNPNIYDDAVLRSHVSEITDDIIKSAGGAGSKFGTGGMLSKIKSAQMVFDNNGQMILMNGANPRDILKVLDGHNIGTYFAQGK

SEQ ID NO: 2887 - DNA, 825 bp, Streptococcus pyogenes
ttgggtatgatgaaacgacaatttgaagatgtaacacgtatcgtaattaaaattggcactagttcattagtgctaccaacaggtaaaattaatttagaaaaaatcgaccaactggcttttgtgatttcaagtttgatgaataagggcaaggaagttattttagtatcatcgggagcgatgggatttggactagatattttgaaaatggaaaaacgtccgaccaatcttgctaaacaacaggcagtttccagtgttggtcaggtagccatgatgagtctttattcacaaatttttgcatactaccaaaccaacgtgtcacaaattttattgacgagagatgtggtggttttcccagaaagtctagccaatgttaccaatgcttttgaaagtctgattagtttgggcattgtgccgattgttaatgaaaacgatgcggttagtgtggatgaaatggatcatgcgactaaatttggagataatgaccgtttatctgctgttgttgctggtattacaaaagctgatttattaatcatgttgtctgatattgatggcctttttgataaaaaccctactatttatgaggatgcgcagctacgcagccatgttgctaatattacgcaagaaatcattgcgtcagcaggtggtgcgggcagtaagtttggcacaggtgggatgctaagtaaggtgcagtctgctcagatggtatttgaaaacaaaggacagatggtcttgatgaatggagctaatcccagagatattttaagagtgcttgaagggcaaccactaggcacctggttcaagcagatagaagaggtaaggcatgac

SEQ ID NO: 2888 - protein, 275 aa, Streptococcus pyogenes
LGMMKRQFEDVTRIVIKIGTSSLVLPTGKINLEKIDQLAFVISSLMNKGKEVILVSSGAMGFGLDILKMEKRPTNLAKQQAVSSVGQVAMMSLYSQIFAYYQTNVSQILLTRDVVVFPESLANVTNAFESLISLGIVPIVNENDAVSVDEMDHATKFGDNDRLSAVVAGITKADLLIMLSDIDGLFDKNPTIYEDAQLRSHVANITQEIIASAGGAGSKFGTGGMLSKVQSAQMVFENKGQMVLMNGANPRDILRVLEGQPLGTWFKQIEEVRHD

SEQ ID NO: 2889 - DNA, 1251 bp, Streptococcus agalactiae
atgacgtatattgaaatattagggcaaaatgctaaaaaagctagtcaatcagtagcacgattaagtacagctagtaaaaatgagatactcagggacttagcgagaaacatagtggctgatactgaaaccattttgactgagaatgctcgcgatgttgttaaggcaaaagataatggtatctcagaaattatggtggaccgtctacgactaaacaaagaccgcatacaggcgatagcaaacggtatttatcaggtagcagatttggcagatccgattggtcaagttgttagtggttatacaaatttagatggtttaaaaatccttaaaaaaagagtgcctttaggggttattgcaatgatatttgaaagtcgtcccaatgtatcggtggatgcctttagtttagcttttaaaacagggaacgctattattttgcgtggtggtaaagatgctattttttcaaatactgccttggttaattgtatgcgccaaacattgcaagatacaggccacaacccagatatagtacaattagttgaagatactagtcacgttgtagcagaggagttaatgcaggcaacagactacgtggacgtcttaattccaagaggtggtgcaaaattaattcaaacggtgaaggaaaagtcaaagattcctgttatcgaaacaggtgttggaaatgttcatatctatattgatgaatttgcagatttagatatggcagctaagattgttattaatgctaaaacccaacgccctagtgtctgtaatgctgccgaagggttagttgttcatcaagctattgctaagggatttttatctcaattggagaaaatgctcaaagaatcgaaccagtcagttgaatttcgtgccgatgaggaagctttgcaacttttagaaaatgctgttgctgcaagtgagtctgattatgctactgaatttttagactatattatgtcagtaaaagtagtagattcttttgaacaagcaattagctggattaataaatacagtagtcatcactcagaagctatcattactaataatatcagtagggcagaaatttttcaggatatggtagatgcagcggcagtttatgttaatgcttcaacacgttttacagatggtttcgtttttggactcggagcagagattggtatttcgactcaaaaattacacgcgcgtggaccgatgggattagaagctttaacaagtacaaaatactatattaatggaactggtcaagtaagggaa

SEQ ID NO: 2890 - protein, 417 aa, Streptococcus agalactiae
MTYIEILGQNAKKASQSVARLSTASKNEILRDLARNIVADTETILTENARDVVKAKDNGISEIMVDRLRLNKDRIQAIANGIYQVADLADPIGQVVSGYTNLDGLKILKKRVPLGVIAMIFESRPNVSVDAFSLAFKTGNAIILRGGKDAIFSNTALVNCMRQTLQDTGHNPDIVQLVEDTSHVVAEELMQATDYVDVLIPRGGAKLIQTVKEKSKIPVIETGVGNVHIYIDEFADLDMAAKIVINAKTQRPSVCNAAEGLVVHQAIAKGFLSQLEKMLKESNQSVEFRADEEALQLLENAVAASESDYATEFLDYIMSVKVVDSFEQAISWINKYSSHHSEAIITNNISRAEIFQDMVDAAAVYVNASTRFTDGFVFGLGAEIGISTQKLHARGPMGLEALTSTKYYINGTGQVRE

SEQ ID NO: 2891 - DNA, 1248 bp, Streptococcus pyogenes
atgactgatatgagaaggttagggcaaagggcaaaacaagctagtcttttaatagcacctttgtcgacgcaaattaaaaatcgctttttaagcaccttagcaaaggcattagttgacgatacacagactctcttagccgctaaccaaaaagatttagcgaatgctaaagaacatggtatttctgacatcatgatggatcgcttgcgcttaacttcagaacggattaaagcgatagcacagggagttcaacaggttgctgacttagctgatccaatcggacaagtcattaagggctatactaacctcgatggccttaaaatcctccaaaagagagttcctctaggggtgattgcgatgatttttgagagtcgtccgaatgtttcagtggatgcttttagtctggcgttcaaaaccaataatgcgatcatcctaaggggaggaaaagatgcccttcactcaaataaagctttggtgaagttgatccgacaaagtctggaaaaatcagggatcaccccagatgctgtccagctagttgaggatccctcacatgctgtcgctgaagaattgatgcaggcaacggattatgtagatgttttgattccacgtggtggtgctaaattaattcagaccgttaaggaaaaagcaaaagtgcctgtcatcgaaacaggtgtggggaatgtgcatatctatgtggatgctcaagctgacttagatatagctactaagattgttatcaacgctaaaacaaagcgcccaagtgtttgcaatgcagctgagggattggtaattcacgaagctgtagcagcaaggtttattcctatgcttgaaaaagcgatcaatcaagttcagccagtagaatggcgggcagatgacaaggctttgccgttatttgagcaggcagtgcctgcaaaagcagaggattttgagaccgaatttttagattatatcatgtctgttaaggttgtttcctctttggaagaagctatttcttggataaatcagtatactagtcaccattccgaagctatcatcacaagggatattaaggcagcagagacctttcaagatttagtggatgctgctgctgtttatgtcaacgcttcaacacgatttaccgatggttttgtttttgggcttggtgctgaaattgggatttctactcaaaaaatgcacgcccgtgggccaatgggcttagaagccttgaccagcactaaattttatattaatggggatggacatatcagagaa

SEQ ID NO: 2892 - protein, 416 aa, Streptococcus pyogenes
MTDMRRLGQRAKQASLLIAPLSTQIKNRFLSTLAKALVDDTQTLLAANQKDLANAKEHGISDIMMDRLRLTSERIKAIAQGVQQVADLADPIGQVIKGYTNLDGLKILQKRVPLGVIAMIFESRPNVSVDAFSLAFKTNNAIILRGGKDALHSNKALVKLIRQSLEKSGITPDAVQLVEDPSHAVAEELMQATDYVDVLIPRGGAKLIQTVKEKAKVPVIETGVGNVHIYVDAQADLDIATKIVINAKTKRPSVCNAAEGLVIHEAVAARFIPMLEKAINQVQPVEWRADDKALPLFEQAVPAKAEDFETEFLDYIMSVKVVSSLEEAISWINQYTSHHSEAIITRDIKAAETFQDLVDAAAVYVNASTRFTDGFVFGLGAEIGISTQKMHARGPMGLEALTSTKFYINGDGHIRE

SEQ ID NO: 2893 - DNA, 945 bp, Streptococcus agalactiae
atgacaaacgattttcatcatattactgtgcttttgcacgagactgtggatatgcttgatattaagccggatggtatctatgtagatgctactttaggtggggcaggacacagcgaatatcttctttcacaattaggcccagatgggcacctttacgcatttgaccaagaccagaaggctattgacaatgctcatatacgtttaaagaaatatgtggataccggtcaagtaacctttatcaaagataatttcagaaatctatcttctaacttaaaagcattaggagtgtcggaaattaatggtatttgttatgatttaggtgtatcaagcccacagctggacgagcgtgaacgcggtttctcatataaacaagacgccccccttgatatgcgaatgaatagagagcagagtcttacagcttatgacgttgtgaacacttatagttatcatgatttagtaaggattttctttaagtatggcgaagataaattttcaaaacaaattgctcgaaaaattgagcaagtacgagctgaaaaaacaatatctacaacaacagaattggctgagattatcaaatcgtctaaatctgccaaagaactgaagaaaaaaggtcatccagctaaacaaatttttcaagctattcgtattgaagtcaatgacgaactaggagctgcagatgaatctatacaacaagcaatggacttattagctgttgatggtcgtatatctgtcatcacttttcattctttagaagatcgtcttactaagcaactttttaaagaagcatcaacagtagaagtacctaaaggtcttccttttataccagatgatttacaacctaagatggagctcgttaatcgtaaacccatcttaccaagtcaagaagaactagaagcgaacaatcgtgcccattcagcgaaattgagagtagcgcgtcgtattcga

SEQ ID NO: 2894 - protein, 315 aa, Streptococcus agalactiae
MTNDFHHITVLLHETVDMLDIKPDGIYVDATLGGAGHSEYLLSQLGPDGHLYAFDQDQKAIDNAHIRLKKYVDTGQVTFIKDNFRNLSSNLKALGVSEINGICYDLGVSSPQLDERERGFSYKQDAPLDMRMNREQSLTAYDVVNTYSYHDLVRIFFKYGEDKFSKQIARKIEQVRAEKTISTTTELAEIIKSSKSAKELKKKGHPAKQIFQAIRIEVNDELGAADESIQQAMDLLAVDGRISVITFHSLEDRLTKQLFKEASTVEVPKGLPFIPDDLQPKMELVNRKPILPSQEELEANNRAHSAKLRVARRIR

SEQ ID NO: 2895 - DNA, 1011 bp, Streptococcus pyogenes
atgaaatccttttctcttactttttcatttctaaaccttttgaagtatggtacaattaaagttatgacaaaagaatttcatcacgtgaccgtactccttcacgaaacagtggacatgcttgacataaagcctgatgggatttatgttgatgcgacgctaggtggctcaggccactcagcttatttgttgtccaaacttggtgaagaagggcacctctattgttttgaccaagaccaaaaggctattgacaatgcacaagttaccctcaaatcttatattgacaaaggacaggtaacttttattaaagataattttagacacctcaaagcacgtttaacagcgcttggagttgatgaaattgatggtatcttatatgaccttggtgtttccagcccgcaattggatgaaagagaacgagggttttcttataaacaagatgctccattggatatgcgcatggatcgtcagtcgctcttaacagcttacgaagtggtgaatacctatccattcaatgatttggttaagatttttttcaaatatggtgaagataaattctccaagcagatcgctcgaaaaattgaacaagcaagagctattaagcctattgagacaacaacagagttggcagaattgattaaggcagcaaagccagctaaagagttgaagaaaaaaggccaccctgctaaacagatttttcaagctattcgcattgaagtcaatgatgaattgggagcggccgatgaatctattcaggacgctatggaattattagcccttgatggtcgtatctcagttattaccttccattctctggaagatcgcctaaccaagcagttgtttaaagaagctagtacggtggatgtgccaaaagggcttcctctaattcctgaagatatgaaacctaagtttgaacttgtttcacgtaagccgatcttacctagtcattcagagttaacagctaataaaagggcacactcagccaagctacgtgttgccaaaaaaattcggaaa

SEQ ID NO: 2896 - protein, 337 aa, Streptococcus pyogenes
MKSFSLTFSFLNLLKYGTIKVMTKEFHHVTVLLHETVDMLDIKPDGIYVDATLGGSGHSAYLLSKLGEEGHLYCFDQDQKAIDNAQVTLKSYIDKGQVTFIKDNFRHLKARLTALGVDEIDGILYDLGVSSPQLDERERGFSYKQDAPLDMRMDRQSLLTAYEVVNTYPFNDLVKIFFKYGEDKFSKQIARKIEQARAIKPIETTTELAELIKAAKPAKELKKKGHPAKQIFQAIRIEVNDELGAADESIQDAMELLALDGRISVITFHSLEDRLTKQLFKEASTVDVPKGLPLIPEDMKPKFELVSRKPILPSHSELTANKRAHSAKLRVAKKIRK

SEQ ID NO: 2897 - DNA, 324 bp, Streptococcus agalactiae
atgacaaatgaaaaacgaactgaagcagtaacacaaactttacaacgtcacatcaagactttctctcgtattgagaaagctttttatggtgctattgtaattactgctattatcatggcagtcggtattatttacttgcaaagtaatagtttacaagttaaacaagaagtaaatcaattaaatagtaaaatcaacgataaacagacagaatttgacaatgctaaacaagaagtaaatgagctttctaatcgtgatcgaattactaaaattgctaaagatgctggtttaacaattcaaaacgacaatatttatcggaaggtggac

SEQ ID NO: 2898 - protein, 108 aa, Streptococcus agalactiae
MTNEKRTEAVTQTLQRHIKTFSRIEKAFYGAIVITAIIMAVGIIYLQSNSLQVKQEVNQLNSKINDKQTEFDNAKQEVNELSNRDRITKIAKDAGLTIQNDNIYRKVD

SEQ ID NO: 2899 - DNA, 351 bp, Streptococcus pyogenes
gtgttgccaaaaaaattcggaaataagcctatgacaaatgaaaaaagaactcaggtagttacaaatgccttgcaaaaacgaataaaaactttctctagaattgagaaggctttttatactgctatcattgtaacagcgattacgatggcagtaagtattatttacctgcaaagtcgtaagttgcagctacaacaagaaatcactagtttaaatagtcatatttcggatcaaaaactagagcttaataatgccaagcaagaagtaaatgagttatctcgccgtgatcgtattatagatattgctggtaaagcaggcttaagcaaccgtaataataatatcaagaaagtcgag

SEQ ID NO: 2900 - protein, 117 aa, Streptococcus pyogenes
VLPKKFGNKPMTNEKRTQVVTNALQKRIKTFSRIEKAFYTAIIVTAITMAVSIIYLQSRKLQLQQEITSLNSHISDQKLELNNAKQEVNELSRRDRIIDIAGKAGLSNRNNNIKKVE

SEQ ID NO: 2901 - DNA, 108 bp, Streptococcus agalactiae
ttggcttccttggataaattaaccccaaatttactatctgtaccaacgatgatgacaaagttgatgataaaaatgaaaaataggaaaatggttaaaatcatcagattt

SEQ ID NO: 2902 - protein, 36 aa, Streptococcus agalactiae
MASLDKLTPNLLSVPTMMTKLMIKMKNRKMVKIIRF

SEQ ID NO: 2903 - DNA, 2256 bp, Streptococcus agalactiae
gtgactttttttaaaaagctaaaaaaaatcttccttgattatgtgatccatataagagataggcgttcgccgcagaaaaatagggaaagagtaggtcaaaatctgatgattttaaccattttcctatttttcatttttatcatcaactttgtcatcatcgttggtacagatagtaaatttggggttaatttatccaaggaagccaagaaagtctatcaacaaagtatgacagtacaggcgaagcgtgggacaatttacgaccgtaatggaaatcctatcgctgaggatgctacgacctatagtctctacgctattatctcaaagaactatacgacagctacaggtcaaaaactatatgtacaaccttctcagtatgaaaaagtagctagtatcttagagaataaattgggcatgaagaaaaatcttgtcctaaaacaactcaatcaaaagaaattgtttcaagtttcctttggaagttcaggttcaggattgtcttataccaagatggctgacatcaagaaaacgatggaaaagtcagatatcaaaggaattggtttttctaccagtccggggcgtatttatccaaatgggatatttgcttcacaatttataggatttactcttcctcaggatgatggagatggaaaaaaattagttggtaatacaggccttgaagcggcacttaacaaggtattatcaggtactgatggtaaagtaacatacgaaaaagaccgtagtgggaatgttcttttaggtactgcaacaacagaacgtagggcggttaatggtaaggatatctacacaactttatcagagcctattcagactgttttagagactcagatggatgttttcgcagaaaaaaccaaaggaaaatttgcgagtgctacagttgtcaacgctaaaacgggtgaaattctagcaacgagtcagcgtcctacttataatccttctacccttaaaggttacgataagaaaaatttgggtacctataacacactactatatgataacttttttgaacctggttcaacaatgaaggtaatgactctagcctctgcaattgattctaagcattttaactctactgaagtgtataacagtgcacaatataaaattgcagatgcgattattcgagattgggatgtcaatgaagggttatcatctggtagttatatgacttttccacaagggtttgcacattccagtaacgttggtatggtaaccttggaacaaaaaatgggacgagataaatggttaaactatctttctaagtttaaatttggttacccaacacgttttgggatgcttcatgaaagtggaggtttgttcccatctgacaatgaagtaactatcgctatgagctcatttggtcaaggtattggtgtaacgcaagttcaaatgttgcgcgcatttacgtctatctcgaatgatggtgttatgttacaaccacagtttattagcagtatttatgatccaaatacagggacttctcgtacagcacgaaaagaagtcgttggaaaaccagtttccaaagaagcagctagtaaaacacgtgattatatggttactgttgggacagatccttattatggtacattatacgcagcaggtgccccagttattcaggtggggaatcaatcagttgcagtaaaatctggtactgcccaaatcgcccaggaaggtggtggtggttatctgcaaggaaaaaatgatactattaactcagttgtggctatggtgccatcggaaaatcctgacttcatcatgtatgttaccatccaacaacccgaaaaatttagtatcacattctggaaagatgttgttaatcctgttttagaacaagcaacagcaatgaaagaaacgatattaaaaccgggattgaatgactcagaacatcagacaaaatataaactatcaaaaatagttggtgaaaatccaggtcatgtagcggaagaattacgtcgtaatctggttcagccaattattttaggaaatggtagtaaagtttctaaagtatctaaaagaccaggagctaatcttgctgagaatgaacagctactagtattaacaaataaactgactgaattacctgatatgtatggttggtctaaagcaaacgttgaacagtttgctaaatggacaggtataaaagtgacctataaaggttcaacctcaggtaaagtaagaaaacaaagtattgatgttggaaaatccatcaataaaattaaaaaaatcaaaattacaataggagat

SEQ ID NO: 2904 - protein, 752 aa, Streptococcus agalactiae
MTFFKKLKKIFLDYVIHIRDRRSPQKNRERVGQNLMILTIFLFFIFIINFVIIVGTDSKFGVNLSKEAKKVYQQSMTVQAKRGTIYDRNGNPIAEDATTYSLYAIISKNYTTATGQKLYVQPSQYEKVASILENKLGMKKNLVLKQLNQKKLFQVSFGSSGSGLSYTKMADIKKTMEKSDIKGIGFSTSPGRIYPNGIFASQFIGFTLPQDDGDGKKLVGNTGLEAALNKVLSGTDGKVTYEKDRSGNVLLGTATTERRAVNGKDIYTTLSEPIQTVLETQMDVFAEKTKGKFASATVVNAKTGEILATSQRPTYNPSTLKGYDKKNLGTYNTLLYDNFFEPGSTMKVMTLASAIDSKHFNSTEVYNSAQYKIADAIIRDWDVNEGLSSGSYMTFPQGFAHSSNVGMVTLEQKMGRDKWLNYLSKFKFGYPTRFGMLHESGGLFPSDNEVTIAMSSFGQGIGVTQVQMLRAFTSISNDGVMLQPQFISSIYDPNTGTSRTARKEVVGKPVSKEAASKTRDYMVTVGTDPYYGTLYAAGAPVIQVGNQSVAVKSGTAQIAQEGGGGYLQGKNDTINSVVAMVPSENPDFIMYVTIQQPEKFSITFWKDVVNPVLEQATAMKETILKPGLNDSEHQTKYKLSKIVGENPGHVAEELRRNLVQPIILGNGSKVSKVSKRPGANLAENEQLLVLTNKLTELPDMYGWSKANVEQFAKWTGIKVTYKGSTSGKVRKQSIDVGKSINKIKKIKITIGD

SEQ ID NO: 2905 - DNA, 2253 bp, Streptococcus pyogenes
atgaaaaaatggcaaaaatatgttttagattatgttgtgcgcgataggagaactccagtcgaaaatcgcgttcgagttggacaaaatatgatgctcttaactatctttattttctttattttcattattaatttcatgattattattggaacagatcaaaagtttggagttagtttgtcagaaggggcgaagaaggtttatcaagaaaccgttacgatccaagctaagcgtgggaccatttatgatcgaaatggtacagctattgcagtggattctacgacttatagcatatacgcaattttggataaatcatttgtctcggcttcagatgaaaagttatatgtacaaccttctcagtatgaaacagtagctgatattttaaaaaagcatctgggaatgaaaaaaacagatgtaattaaacagcttaagcgtaaaggacttttccaagtctcgtttggaccgtcagggtctggcatttcatatagtactatgtctactattcaaaaggctatggaagatgccaaaatcaagggaattgctttcacaactagtcctggtcgtatgtatccaaatgggacatttgcttcagaatttataggcctagcatctctaacagaagataaaaagacaggtgttaagagtttagttggaaaaacaggtctagaagcttcttttgataaaattttatcaggtcaagatggtgttattacttatcaaaaagatcgaaatgggaccacactcttgggtacaggtaagactgtcaagaaagctattgatggcaaagatatttacacaacgctatctgagcctatccagaccttcttagaaacccagatggatgtttttcaagccaaatcaaatggtcagttggccagtgcaacacttgttaatgctaaaactggtgaaattttggcaacaacacaacgccccacttataatgctgatactctgaaaggacttgaaaatacgaactacaaatggtacagtgcacttcatcaaggaaattttgaaccaggttcaaccatgaaagtgatgactctggcagcggctattgatgataaagttttcaacccaaacgaaacctttagcaatgctaatggtttgacaattgcagatgctactattcaagactggtctattaacgaaggcatttccacaggacagtacatgaattatgcacaagggtttgccttctcaagtaacgttgggatgactaaacttgaacaaaaaatgggtaatgcaaaatggatgaattatttgacgaagttccgctttggttttcctactcgttttggtttaaaagatgaagacgcaggtatatttccttctgataatatcgtgactcaagctatgagcgcttttggtcaagggatttctgtaacccagattcaaatgcttagagcctttactgctatttctaataatggtgagatgttagagccacaatttatcagtcaaatttatgatcctaacacagcaagttttagaacggcaaataaagaaattgttggaaaacctgtatcaaaaaaagccgctagtgaaacaagacaatacatgattggtgtaggaacagaccctgagtttggaacactctattcaaaaacatttggaccaattattaaagtgggtgatttacctgttgctgttaaatcaggaacagcacaaattggttcagaagatggaagtggttatcaagatggtggattgactaactatgtctattcggttgtggcaatggtgccagctgataaaccagactttttgatgtatgttactatgactaaaccacaacattttggtccccttttttggcaagatgtggttaacccagtattggaagaagcatacttaatgcaagatacactaactaagccagtagtatcagatgctaatcgtcaaacaacttataaattaccaaactttgtaggaaagaatcctggtgagacatcaagcgagttgcgtcgaaaccttgtccagccagttgtccttggtactggcagcaagatcaaaaaagtatcgcatcagcccggtcaaacgttaacagaaaaccaacaagttctcatattatcagaccgttttgtggaggtaccagacatgtatggctggacaaaatccaatgttaaaacctttgctaaatggactggaatagacatcagctttaaaggaacagattctggtcgtgttatgaaacaaagtgttgatgttggtaagtccttgaaaaaaataaaaaaaatgaccattactttaggagat

SEQ ID NO: 2906 - protein, 751 aa, Streptococcus pyogenes
MKKWQKYVLDYVVRDRRTPVENRVRVGQNMMLLTIFIFFIFIINFMIIIGTDQKFGVSLSEGAKKVYQETVTIQAKRGTIYDRNGTAIAVDSTTYSIYAILDKSFVSASDEKLYVQPSQYETVADILKKHLGMKKTDVIKQLKRKGLFQVSFGPSGSGISYSTMSTIQKAMEDAKIKGIAFTTSPGRMYPNGTFASEFIGLASLTEDKKTGVKSLVGKTGLEASFDKILSGQDGVITYQKDRNGTTLLGTGKTVKKAIDGKDIYTTLSEPIQTFLETQMDVFQAKSNGQLASATLVNAKTGEILATTQRPTYNADTLKGLENTNYKWYSALHQGNFEPGSTMKVMTLAAAIDDKVFNPNETFSNANGLTIADATIQDWSINEGISTGQYMNYAQGFAFSSNVGMTKLEQKMGNAKWMNYLTKFRFGFPTRFGLKDEDAGIFPSDNIVTQAMSAFGQGISVTQIQMLRAFTAISNNGEMLEPQFISQIYDPNTASFRTANKEIVGKPVSKKAASETRQYMIGVGTDPEFGTLYSKTFGPIIKVGDLPVAVKSGTAQIGSEDGSGYQDGGLTNYVYSVVAMVPADKPDFLMYVTMTKPQHFGPLFWQDVVNPVLEEAYLMQDTLTKPVVSDANRQTTYKLPNFVGKNPGETSSELRRNLVQPVVLGTGSKIKKVSHQPGQTLTENQQVLILSDRFVEVPDMYGWTKSNVKTFAKWTGIDISFKGTDSGRVMKQSVDVGKSLKKIKKMTITLGD

SEQ ID NO: 2907 - DNA, 174 bp, Streptococcus agalactiae
ttgaaaaaccaacaacccagaaaagaacaaaaaaagcgtataagtatcctacttcaaggtaaaaaccaaaaatatttatcgcagatgtgccacttggtaacacatggacaaaataaaaaattagacccgcaattagttggagcgacattttttgctttggagtcaagccctcat

SEQ ID NO: 2908 - protein, 58 aa, Streptococcus agalactiae
MKNQQPRKEQKKRISILLQGKNQKYLSQMCHLVTHGQNKKLDPQLVGATFFALESSPH

SEQ ID NO: 2909 - DNA, 1008 bp, Streptococcus agalactiae
atgtttttaagtataatggcaggtgtcatagcatttgtcctgacagttattgccattccgcgcttcattaagttttaccaattgaagaaaattggcgggcaacaaatgcatgaagatgtcaaacaacatctagccaaagcaggtacgccgacaatgggaggaacggtatttttgattgttgctcttcttgtctcacttatttttagtattattttatctaaagaaaatagtggtaatttaggtgcaacttttggtattttatctgttgttctcatctatggaattattggttttttagatgattttttgaaaatttttaaacaaatcaatgagggcttgactccaaagcaaaaaatgtcgctccaactaattgcgggtctaattttttattttgtccatgtgttaccaagtggcacatctgcgataaatatttttggtttttaccttgaagtaggatacttatacgctttttttgttcttttctgggttgttggtttttcaaatgctgtgaacctaacagatggaattgatggtctagcttctatttcggttgttatcagtttgattacttatggaatcattgcttataatcaaacgcaatttgatattttattgattatcgttatcatgattggtgctttacttggcttttttgtctttaatcataaaccagctaaagtctttatgggagatgttggttcacttgcattgggtgctatgttagcagccatttcaattgccttacgtcaggaatggaccttgctttttatcggctttgtctatgtttttgagacgtcttcagtgatgttgcaagtagcatactttaagtatactaagaagaaaactggtgttgggaaacgtatcttccgcatgacaccatttcatcaccatttagaattaggtggtgtgtctggcaaaggtaataaatggagcgaatggaaagtagatgcttttttatgggctattggtattttcatgagcgctattacacttgctattttatatctt

SEQ ID NO: 2910 - protein, 336 aa, Streptococcus agalactiae
MFLSIMAGVIAFVLTVIAIPRFIKFYQLKKIGGQQMHEDVKQHLAKAGTPTMGGTVFLIVALLVSLIFSIILSKENSGNLGATFGILSVVLIYGIIGFLDDFLKIFKQINEGLTPKQKMSLQLIAGLIFYFVHVLPSGTSAINIFGFYLEVGYLYAFFVLFWVVGFSNAVNLTDGIDGLASISVVISLITYGIIAYNQTQFDILLIIVIMIGALLGFFVFNHKPAKVFMGDVGSLALGAMLAAISIALRQEWTLLFIGFVYVFETSSVMLQVAYFKYTKKKTGVGKRIFRMTPFHHHLELGGVSGKGNKWSEWKVDAFLWAIGIFMSAITLAILYL

SEQ ID NO: 2911 - DNA, 927 bp, Streptococcus pyogenes
ttgaaaaaaattggtgggcaacaaatgcatgaagatgtcaagcaacatttagctaaagctggaacaccgactatggggggaactgtttttcttttagtagctacggcagtatcgttattggttagtctattttcgatcaaaaacactcaaagtttagctttgatttcaggcattttatcaattgttgtcatttacgggattatcggatttttggatgattttttaaaaatttttaagcaaatcaatgaaggattgacagccaaacaaaagttagccttgcagttggttggaggattgatgttctattttttacatgttagtccaagtggcatttcctctattaatgtgtttggttatcagctgccgctgggaattttctacctattctttgttttgttttgggtggttggtttttcaaatgccgttaatttgacagatggtatcgatggcttagcttctatctcagtggtgattagtctagtgacttacggcgttattgcctacgttcagagtcaatttgatgttttgttactgattggagcaatgattggagccttgcttggcttcttctgctttaatcacaaacctgctaaagtatttatgggagatgtaggtagtttagcccttggagctatgttggctgccatttctattgcgcttcgtcaagaatggactctcctgattattgggatcgtttatgttcttgaaacaagttctgtgatgttgcaagtgtcctatttcaagtacaccaagaaaaaatatggagaaggtcgtcgtatttttagaatgacgcctttccaccaccatttggaattgggaggcttgtctggtaaaggcaagaagtggtcagaatggcaggtagatgcttttttgtggggagtaggaagtctagctagtttactagttttagctatcttatacgtgttc

SEQ ID NO: 2912 - protein, 309 aa, Streptococcus pyogenes
LKKIGGQQMHEDVKQHLAKAGTPTMGGTVFLLVATAVSLLVSLFSIKNTQSLALISGILSIVVIYGIIGFLDDFLKIFKQINEGLTAKQKLALQLVGGLMFYFLHVSPSGISSINVFGYQLPLGIFYLFFVLFWVVGFSNAVNLTDGIDGLASISVVISLVTYGVIAYVQSQFDVLLLIGAMIGALLGFFCFNHKPAKVFMGDVGSLALGAMLAAISIALRQEWTLLIIGIVYVLETSSVMLQVSYFKYTKKKYGEGRRIFRMTPFHHHLELGGLSGKGKKWSEWQVDAFLWGVGSLASLLVLAILYVF

SEQ ID NO: 2913 - DNA, 1341 bp, Streptococcus agalactiae
atgtcatttaaagattttaattttaaaccatacattcagagggctctcgatgagttaaaattcgtcgatccaactgatgttcaagctaaattgattccagttgttcgttcaggccgcgatcttgtgggggaatcgaaaactggttctggtaaaacccacacctttttacttcctatttttgagaagctagatgaaagtagtgatgatgttcaagttgttattactgcaccaagtagagagttgggaacacaaatttatcaggcaactaaacaaattgctgagcattcagagcaagaaatacgggtggttaactatgttggtggtactgacaaattacgtcaaattgaaaagttgaaagtaagccaacctcatattgtcattggaaccccaggacgaatttatgatttggtgaagtcaggtgatttagctattcataaggcgcatacttttgttgttgatgaagcagatatgactctagatatgggatttcttgataccgttgataagattgcagggtctttacccaaggatgtccaaattttagtcttttcagcaacgattccacaaaaattacagccatttttaaagaaatatttgaccaatcctgtaatggaaaaaatcaaaacagcaacagttatcgctgataccatcgataactggcttttgtccactaaaggacgtgataaaaatgcacaaattttggaactctctaaactaatgcagccctatcttgcaatgatatttgttaatacgaaagagcgtgcagacgaattacattcgtacctttctagtaatggcttaaaagtagctaaaattcatggtgggattgcacctcgtgaacgtaaacgtattatgaatcaggttaaaaacctcgaatttgaatatatcgttgcaacagatttagcagcgcgtggtattgatattgaaggtgttagccatgttatcaatgatgccatacctcaagacctatctttctttgtccaccgtgtcggtcgcacaggccgtaatggcttatctggtactgctataactttatatcagccaagtgacgattctgatattcgtgaacttgaaaaactaggtattaattttattcctaaagtcattaaaaacggtgaatttcaagatacatacgaccgtgatcgtcgtaataaccgtgaaaagtcctatcaaaaattagatacagaaatgattggacttgtgaaaaagaaaaagaaaaaaataaaaccaggttacaagaaaaaaattcaatggaaagttgatgaaaagcgtcgcaaagagcgtagagcaagtaatcgtgctaaggggcgtgcggagcgcaaagctaaaaaacaaagtttt

SEQ ID NO: 2914 - protein, 447 aa, Streptococcus agalactiae
MSFKDFNFKPYIQRALDELKFVDPTDVQAKLIPVVRSGRDLVGESKTGSGKTHTFLLPIFEKLDESSDDVQVVITAPSRELGTQIYQATKQIAEHSEQEIRVVNYVGGTDKLRQIEKLKVSQPHIVIGTPGRIYDLVKSGDLAIHKAHTFVVDEADMTLDMGFLDTVDKIAGSLPKDVQILVFSATIPQKLQPFLKKYLTNPVMEKIKTATVIADTIDNWLLSTKGRDKNAQILELSKLMQPYLAMIFVNTKERADELHSYLSSNGLKVAKIHGGIAPRERKRIMNQVKNLEFEYIVATDLAARGIDIEGVSHVINDAIPQDLSFFVHRVGRTGRNGLSGTAITLYQPSDDSDIRELEKLGINFIPKVIKNGEFQDTYDRDRRNNREKSYQKLDTEMIGLVKKKKKKIKPGYKKKIQWKVDEKRRKERRASNRAKGRAERKAKKQSF

SEQ ID NO: 2915 - DNA, 1341 bp, Streptococcus pyogenes
atgtcatttaaagattatcattttaagcaatacgttcagcaagcgctggaagaaattggctttgtcaatccaacagaggtccagaagcggctgattcctattgttaactccggtcgtgacttagttggggaatcaaaaacaggttcagggaaaacccacacctttttgttgcccatttttgaaaaacttgatgaagctaaagcagaagtgcaagtcgttattacagcacctagccgtgaattagcaactcaaatttttgatgcttgtaaacagattgctaagcacttccaagaagagattcgtttggccaactatgttggaggcacagacaaactccgtcagattgaaaaactaaaagacagccagccgcatattgtcatcgggaccccaggtcgtatttatgacttggtcaagtctggtgatttagcgattcataaagcaacgacctttgttgtggatgaggccgatatgaccatggacatgggctttttggatacggtagataagattgcagcttcgcttccaaaatctgttcagattttggtgttctcagcaactattccacagaaattacaaccctttttgaaaaaatacttgaccaatcctgttattgaacaaatcaagacaaagaccgttatcgcagataccattgataactggcttgtgtcgacaaaagggcgtgataagaatggtcaactgttagagattctcaaaaccatgcagccttatatggctatgctttttgtcaataccaaggaacgcgcagatgatttgcatgcctttttaacagctaatggcttaaaagtggctaagattcatgggggcattcctccaagagaacgtaagcgcatcatgaaccaagtcaaaaaactggactttgaatacattgttgccacagacttagcagcgcgtgggattgacattgaaggggtcagccatgtgatcaatgacgccatcccacaagacttgtctttctttgtccatcgtgtaggccgaacaggtcgaaatggtatggcaggaactgccattacactttaccagccaagtgacgactcagatatcaaagagctggaaaaaatggggattgcctttacaccgaaggtgctcaaaaatggagaatttcaagatacctatgaccgtgatcgccgtcaaaaccgtgaaaaagcctatcaaaaattagacacagaaatgattggtttggtcaaaaagaaaaagaaaaaagtcaaaccaggttacaagaaaaaaattcagtgggcggttgatgaaaaacgtcgcaaagaacgtcgtgctgaaaatcgtgctaagggccgcgctgagcgtaaggccaaaaaacaacatttt

SEQ ID NO: 2916 - protein, 447 aa, Streptococcus pyogenes
MSFKDYHFKQYVQQALEEIGFVNPTEVQKRLIPIVNSGRDLVGESKTGSGKTHTFLLPIFEKLDEAKAEVQVVITAPSRELATQIFDACKQIAKHFQEEIRLANYVGGTDKLRQIEKLKDSQPHIVIGTPGRIYDLVKSGDLAIHKATTFVVDEADMTMDMGFLDTVDKIAASLPKSVQILVFSATIPQKLQPFLKKYLTNPVIEQIKTKTVIADTIDNWLVSTKGRDKNGQLLEILKTMQPYMAMLFVNTKERADDLHAFLTANGLKVAKIHGGIPPRERKRIMNQVKKLDFEYIVATDLAARGIDIEGVSHVINDAIPQDLSFFVHRVGRTGRNGMAGTAITLYQPSDDSDIKELEKMGIAFTPKVLKNGEFQDTYDRDRRQNREKAYQKLDTEMIGLVKKKKKKVKPGYKKKIQWAVDEKRRKERRAENRAKGRAERKAKKQHF

SEQ ID NO: 2917 - DNA, 810 bp, Streptococcus agalactiae
atgtttaaaaaaataatattatctattgcaactatagccgcaaccgccagcctagcagtatcagttcaggcgtcagagaaagtagaacttaaagtagctacagattctgacacggcaccatttacttatcaaaaagacgggaaattcaaaggttatgatgttgatgttgtcaaagctgtttttaaaggtagtaagtacaaagtaaccttcaagacagttccttttgatactatttcaacaggtattgatgcagggaaatttgatttatcagctaatgatttttcatacaataaagaaagagcagaaaaatatctcttctcagatcctatatcccgttcaaattatgccgtagtagggaagaaggggagccattacaaatcattaagtgacctctctggaaaatcaaccgaagttttatctggcgttaactatgcacaggttctagaaaattggaataaaaatcatcctaataaaaaaccaataaaaatcaaatatgtttctgggacaactggtgttactagcagattaaaaaatattgagagtgggaaaattgactttatcctatatgatgccatttcatccgactatattgtaaaagaccaatcattaaacttaagcgtttctcctttgaaaggtaaaattggtaataataaggatggactagaatacctccttttaccaaaagataaaaaaggtaaaactctacagaaatttataaataagcgtattaaagttttgaaagaaaatggtactttggcacgtttaagtaaacaatatttcggtggagattacgtttcaaacattgataaa

SEQ ID NO: 2918 - protein, 270 aa, Streptococcus agalactiae
MFKKIILSIATIAATASLAVSVQASEKVELKVATDSDTAPFTYQKDGKFKGYDVDVVKAVFKGSKYKVTFKTVPFDTISTGIDAGKFDLSANDFSYNKERAEKYLFSDPISRSNYAVVGKKGSHYKSLSDLSGKSTEVLSGVNYAQVLENWNKNHPNKKPIKIKYVSGTTGVTSRLKNIESGKIDFILYDAISSDYIVKDQSLNLSVSPLKGKIGNNKDGLEYLLLPKDKKGKTLQKFINKRIKVLKENGTLARLSKQYFGGDYVSNIDK

SEQ ID NO: 2919 - DNA, 840 bp, Streptococcus pyogenes
atgattaaaaaacagtatttaggaagggcaacaattgccctagcatcgacccttgtgctagcagcttgtgggtcatcaaaaacagctgagtcaggaaatcaggggagttctaaagaagtcttatttgcaacggttggaacaacagctcccttttcttatgaaaaaggtggtcaactaactggctacgatatcgaggtggctaaagcagtctttaaaggatcggatgattacaaggtgtcctttaaaaaaacagaatggtcttctatctttacaggtttggactcaggaaaataccaaatgggtggtaacaacatttcctttaccaaagagcgttcagctaagtaccttttttcttatccaatcggatcaacaccttctgttttagttgttccaaaagacagtgatatcaagagctttgatgatatccaagggcatacgacacaagttgttcaagggactacaagtgttgcacagttagaagactttaataagaaacacagtgacaacccggttactctaaaattcaccaatgagaacattactcaaatgttaaccaatttgagtgaaggcaaggcagatttcaagatttttgacgctccaacggttaacgccattattaaaaatcaagggttagataatctcaaaacaattgaactcacctcaacagagcaaccatttatttattttatctttagtcaagatcaagagaaattgcaaagctttgttaacaagcgtattaaagagttgactgctgatggaactcttagcaagcttgccaaagagcaccttggcggtgattacgtgccatcagataaagagttgaaacttcctacagctaac

SEQ ID NO: 2920 - protein, 280 aa, Streptococcus pyogenes
MIKKQYLGRATIALASTLVLAACGSSKTAESGNQGSSKEVLFATVGTTAPFSYEKGGQLTGYDIEVAKAVFKGSDDYKVSFKKTEWSSIFTGLDSGKYQMGGNNISFTKERSAKYLFSYPIGSTPSVLVVPKDSDIKSFDDIQGHTTQVVQGTTSVAQLEDFNKKHSDNPVTLKFTNENITQMLTNLSEGKADFKIFDAPTVNAIIKNQGLDNLKTIELTSTEQPFIYFIFSQDQEKLQSFVNKRIKELTADGTLSKLAKEHLGGDYVPSDKELKLPTAN

SEQ ID NO: 2921 - DNA, 159 bp, Streptococcus agalactiae
ttgacacggttaattttcactactgcaaaaatcaaagctaaaatgagtccaaataaggctcctgctactgtcaataatagtgttatgggtaatcgctctaaaattgagggtattgcatctaaaacagccttccaactaaataatttccccgctggaacc

SEQ ID NO: 2922 - protein, 53 aa, Streptococcus agalactiae
MTRLIFTTAKIKAKMSPNKAPATVNNSVMGNRSKIEGIASKTAFQLNNFPAGT

SEQ ID NO: 2923 - DNA, 801 bp, Streptococcus agalactiae
atgaatcaatttatcttgacgggtggatggtcttggtataataatttggttagtcaggttccagcggggaaattatttagttggaaggctgttttagatgcaataccctcaattttagagcgattacccataacactattattgacagtagcaggagccttatttggactcattttagctttgatttttgcagtagtgaaaattaaccgtgtcaaaattttatatccgattcaagctttatttgttagttttttacgtgggactccaatacttgttcaattaatgctgagttattatggaattccacttttcttgaaatttttaaaccaaaaatatggttttgattggaacattaatgctataccggcttctgtatttgctattactgcatttgcttttaatgaagcggcttatacaagtgaaactatacgagcggcgattttgtcggttgatcaaggtgaaattgaggcagcacgtagtttagggatgacctcagcgcaagtttatcgtcgtgttattattccaaacgcagcagtagtcgcaacacctactttgataaacacgttaattggtctaactaagggaacctctttagcttttaatgctggtattgttgaaatgtttgcccaagcacaaattatgggtggtagcgattatcgctattttgaacgttatatctctgtggcacttgtttactgggcggttagtttcttaattgaacaattgggaaatgctattgaacgaaaaatggcaattaaggctccacgccatttaactgatgagattccaggaggagtacgc

SEQ ID NO: 2924 - protein, 267 aa, Streptococcus agalactiae
MNQFILTGGWSWYNNLVSQVPAGKLFSWKAVLDAIPSILERLPITLLLTVAGALFGLILALIFAVVKINRVKILYPIQALFVSFLRGTPILVQLMLSYYGIPLFLKFLNQKYGFDWNINAIPASVFAITAFAFNEAAYTSETIRAAILSVDQGEIEAARSLGMTSAQVYRRVIIPNAAVVATPTLINTLIGLTKGTSLAFNAGIVEMFAQAQIMGGSDYRYFERYISVALVYWAVSFLIEQLGNAIERKMAIKAPRHLTDEIPGGVR

SEQ ID NO: 2925 - DNA, 891 bp, Streptococcus pyogenes
ttgcttattgctataatacgaatttactattttacatgtgggtctaagagtgttagaatattaagacaaacaaatacaaaggggaaatacatgacatcagtgtttttaaccagtggttgggctttttatgattacctcatctcaccgattccacatgggaaactttttagttggcatgctgtttttgatgccattccaaatattatccaacggcttccaattacgcttggtttgacactatcaggagcaacctttggcttggttttggctttgatttttgcccttgtcaaaattaataaagtgaagctactataccctattcaagctatttttgtgagtttcttgcgaggaactcctattttggtacagttgatgttgacctactacggtattcccctctttctaaaatttctcaatcagaagtatggctttgattggaatgttaatgcaattccggcttctatttttgccattacagcctttgcttttaatgaagcagcctacgctagtgaaactattcgggcagccattttatcagtagatacaggtgaaattgaagcagcaaaaagtctaggcatgacttctgtgcaggtttaccgtcgtgtcattattcctaatgcaactgttgtggctattccaaccttgattaatgggttaattggcttaactaaaggaacatcgcttgcctttaatgcagggattgtcgaaatgtttgcccaggctcaaattctaggcggatcagattaccgttattttgaacgttatatctctgttgctcttgtctattggtctatcagtattttgatggagcaagtaggtcgcttgattgaaaacaagatggccatcaaagcaccagaacaagctagaaatgaaaagttaggagaattgcgt

SEQ ID NO: 2926 - protein, 297 aa, Streptococcus pyogenes
LLIAIIRIYYFTCGSKSVRILRQTNTKGKYMTSVFLTSGWAFYDYLISPIPHGKLFSWHAVFDAIPNIIQRLPITLGLTLSGATFGLVLALIFALVKINKVKLLYPIQAIFVSFLRGTPILVQLMLTYYGIPLFLKFLNQKYGFDWNVNAIPASIFAITAFAFNEAAYASETIRAAILSVDTGEIEAAKSLGMTSVQVYRRVIIPNATVVAIPTLINGLIGLTKGTSLAFNAGIVEMFAQAQILGGSDYRYFERYISVALVYWSISILMEQVGRLIENKMAIKAPEQARNEKLGELR

SEQ ID NO: 2927 - DNA, 741 bp, Streptococcus agalactiae
atgataaaattgagacaattgactaaatcattttctggtcaaaaagtgttagacaaacttgatttagatattgaaaaaggtcaagttgttgctctagtaggtgcttcaggtgcaggaaaatcaacctttcttcgtagtatgaattatttagaagagcctgattatggaacaattgaaattgatgattttaaagttgattttaaatcaatcagtaaagatgacatactaacattacgccgtaagttagccatggtttttcaacaattcaatctatttgagcgtcgtacagctttggataatgtaaaagaaggtttgaaaattgtcaaaaagatgtcagatcaagaggcaacacggattgcaagagacgaactggcaaaggtcggacttgcagatcgtgaaaaatattatccaagacatttatcaggtggacagaaacaacgtgttgctttggcacgcgcattagccatgaaacctgatgttcttcttttagacgaaccgacatcagcacttgatccagaattagttggagaagttgaaaaatctattgcagatgctgctaagcaggggcaaaccatggtacttgttagtcatgatatgaattttgtttaccaagtagcagataaagttttatttttggaaaaaggtcgtattttagagtctgggacgcctgaacaattatttaaccatcctttagaagaacgtacaaaagaattcttcgctagttataacaaatcgtaccta

SEQ ID NO: 2928 - protein, 247 aa, Streptococcus agalactiae
MIKLRQLTKSFSGQKVLDKLDLDIEKGQVVALVGASGAGKSTFLRSMNYLEEPDYGTIEIDDFKVDFKSISKDDILTLRRKLAMVFQQFNLFERRTALDNVKEGLKIVKKMSDQEATRIARDELAKVGLADREKYYPRHLSGGQKQRVALARALAMKPDVLLLDEPTSALDPELVGEVEKSIADAAKQGQTMVLVSHDMNFVYQVADKVLFLEKGRILESGTPEQLFNHPLEERTKEFFASYNKSYL

SEQ ID NO: 2929 - DNA, 744 bp, Streptococcus pyogenes
ttgatgattacaattagaaatttgagcaagacattctcagggcaaaaagttttagatagtttggctcttgatattgaaaaaggtcaagtgattgctttagttggtgcttcaggagcagggaaatcgaccttccttcgtagcctaaactatttggaaaaaccagattcaggctccattagcattggtgactttacggttgattttgagaccattaccacagagcaagtccttattttacgtcggaaacttgccatggtttttcaacaatttaatctttttgagcgtcgtacagcccttgagaatgtcaaagaaggtcttaaggtggtcaaaaaactgtctgaccaagaagcgactaaactggcgcaagcagaattggctaaggttggtttagcagatcgaaaacatcattacccacgtcatttatcagggggacaaaaacaacgggtagctttagcaagagctctggctatgaaaccagatgttttattactagatgagccgacctcggctcttgacccggaattagttggcgaagtggaaaagtctattactgatgctgctaaatccggacagaccatggttttagtgagtcacgacatgaattttgtttaccaagtggcagatagagtactctttttagatcaagggaaaatcttggaacaaggaacacctgaagaagtctttagacatcctcaaaaagaacgaaccaaagaattttttgcaagctattcaaaaacatacatt

SEQ ID NO: 2930 - protein, 248 aa, Streptococcus pyogenes
LMITIRNLSKTFSGQKVLDSLALDIEKGQVIALVGASGAGKSTFLRSLNYLEKPDSGSISIGDFTVDFETITTEQVLILRRKLAMVFQQFNLFERRTALENVKEGLKVVKKLSDQEATKLAQAELAKVGLADRKHHYPRHLSGGQKQRVALARALAMKPDVLLLDEPTSALDPELVGEVEKSITDAAKSGQTMVLVSHDMNFVYQVADRVLFLDQGKILEQGTPEEVFRHPQKERTKEFFASYSKTYI

SEQ ID NO: 2931 - DNA, 912 bp, Streptococcus agalactiae
atgtatgatactttaataataggttcaggtcctggtggtatgacagcagcgctttacgctgcacgttcaaaccttaaagttgggttaattgaacaaggtgctccaggtggacagatgaataatactgctgaaattgagaactatccaggctacgatcatatctcaggtccagaattatcaatgaagatgtatgagccgttggaaaaatttgaagtagagcatatttatggtatagttcaaagagttgagaacgatggtgatgtaaagcgtgttatcaccgaagatgaatcgtatgaagccaaaacagtaatccttgctaccggagctaaaaacagccttttaggagttccgggtgaagaggaatatactagtcgtggcgtttcttactgtgcggtttgtgatggtgcatttttccgtgatcaggatcttttagttgtgggtggcggtgattctgctgttgaagaagctgtcttcttaactcaatttgctaaaagtgttactattattcaccgacgtgatcaattgagagctcaaaaagtacttcaagaccgagcttttgctaacgaaaaaataaaatttgtatgggattcagtggtcaaagagattaaaggaaatgagattaaagtatctggtgtaactgttgaaaatctaaagactggagaaatctcagagatgactttcggaggtgttttcatttacgttggtttgaaaccacattctagcatggtctcagaattaggtattacggacgagactggctgggtcttaactgatacaaatatgaaaacatcaattccaggactatatgctattggggatgttcgtcaaaaagatctacgtcagattgcgactgctgttggtgaaggtgctatcgctggacagggtgtctataactatataactgagcatttc

SEQ ID NO: 2932 - protein, 304 aa, Streptococcus agalactiae
MYDTLIIGSGPGGMTAALYAARSNLKVGLIEQGAPGGQMNNTAEIENYPGYDHISGPELSMKMYEPLEKFEVEHIYGIVQRVENDGDVKRVITEDESYEAKTVILATGAKNSLLGVPGEEEYTSRGVSYCAVCDGAFFRDQDLLVVGGGDSAVEEAVFLTQFAKSVTIIHRRDQLRAQKVLQDRAFANEKIKFVWDSVVKEIKGNEIKVSGVTVENLKTGEISEMTFGGVFIYVGLKPHSSMVSELGITDETGWVLTDTNMKTSIPGLYAIGDVRQKDLRQIATAVGEGAIAGQGVYNYITEHF

SEQ ID NO: 2933 - DNA, 915 bp, Streptococcus pyogenes
atgtacgatacattaattattggttcaggaccagcaggaatgactgccgctttatacgctgctagaagtaatttatctgttgccattattgaacaaggggcacctggtggtcagatgaacaacacttttgatatagagaattacccgggatatgatcatatatctggaccagaattagctatgaaaatgtacgaacctttagagaagtttaacgttgaaaacatttatggtattgttcaaaaaatagaaaattttggtgactataagtgtgtgttgactgaagatgctagttatgaagctaaaacggttattattgcaacgggagctaaataccgtgtactaggtgttccaggtgaagaatactatactagtcgaggagtttcttattgtgcagtatgtgatggtgcgtttttccgtgaccaggatcttttggtcgttggtggtggtgactcagcagttgaagaagctatttatcttactcagtttgctaaaaaggtaaccgttgttcatcgccgtgatcaactaagagctcagaaaatcttgcaggaccgtgccttcgctaatgacaaagttgactttatctgggattcagttgtcaaagaaattcaaggtaacgacattaaggtctccaatgtcctaatcgaaaatgtgaaaacaggccaagtcactgaccacgcttttggaggtgtgtttatctatgttggtatgaatcctgttacaggtatggtaaaggatctagaaattaccgattcagaaggttggattatcacagatgatcatatgaggacaagtattcctggtatttttgcgattggagatgttcgtcaaaaagaccttcgccaaatcacgacagctgttggagatggtgcaattgcagggcaaggtgtttatcactaccttgaaagtttctcttca

SEQ ID NO: 2934 - protein, 305 aa, Streptococcus pyogenes
MYDTLIIGSGPAGMTAALYAARSNLSVAIIEQGAPGGQMNNTFDIENYPGYDHISGPELAMKMYEPLEKFNVENIYGIVQKIENFGDYKCVLTEDASYEAKTVIIATGAKYRVLGVPGEEYYTSRGVSYCAVCDGAFFRDQDLLVVGGGDSAVEEAIYLTQFAKKVTVVHRRDQLRAQKILQDRAFANDKVDFIWDSVVKEIQGNDIKVSNVLIENVKTGQVTDHAFGGVFIYVGMNPVTGMVKDLEITDSEGWIITDDHMRTSIPGIFAIGDVRQKDLRQITTAVGDGAIAGQGVYHYLESFSS

SEQ ID NO: 2935 - DNA, 1458 bp, Streptococcus agalactiae
atgtataaagacgatagtttaacactacatactgatttatatcaaatcaatatgatgcaagtttattttaataaaggtattcacaataaaagagcggtgtttgaagcttactttcgcaaggttccatttgaaaatggttatgctgtttttgcaggtttagagcgtattgttcgttatttagaaaatctgagcttttctgatagtgatttatcctatttagaagagttaggttatcctgaagaatttttagattacttaaaaaatttaaaaatggaactgactgtcaaatcagccaaggaaggtgaccttgtatttgctaatgaaccattagttcaaattgaaggtcctttagcacaatgtcagttagtagagacagcgattttaaatatcatcaactaccagacacttgttgctacaaaagcagctcgtattcgttctgttattgaagatgaaccgctattagagtttgggacacgacgtgctcaagaaatggatgcagccatttggggtactagggcagcgattattggtggtgctaacgcaacgagcaatgttcgtgctggtaaaatctttaatattccagtatcaggaacgcatgcacatgctttagttcaaacttatggcgatgattaccaggcatttaaagcttacgcagaaactcataaagattgcgtctttttagtggatacttatgatacccttcgtgtaggtgtgcctaatgctattcgagttgcaaaagagatgggcgaaaagattaatttcttgggagttcgccttgattcaggtgatttagcttatttgtctaagaaagttcgtcagcagttagatgacgccggttttcctaatgcaaagatttatgcttcgaatgatctagatgaaaatacaatcctcaacctaaaaatgcaaaaagctaaaattgatgtttggggtgtcggaacaaaattaattacagcctatgatcagcctgcgctaggtgctgtttataaaattgtttctattgagactgacgccggtagtatgcgagatacaattaaactatcaaacaatgctgaaaaagtatcaacacctgggaaaaagcaagtttggcgtatcaccagtcgagctaaagggaaatctgagggtgattacatcacatttgcagacactgatgtgacacaattagatgaaattgaaatgtttcatccaacttatacttatatcaataaaacagtccgtgattttgacgcagtacccttactggtagatatctttgacaaagggaaattagtttatcaattaccaagtcttcaagaaattcaagagtacggacgcaaagaatttgatcagctttgggatgagtataaacgtgttctgaatccacaggattacccagttgatttggcacgcgatgtttggcaaaataaaatggacctgattgatcgtatccgtaaagaagctttggcaaaaggagaagtaaga

SEQ ID NO: 2936 - protein, 486 aa, Streptococcus agalactiae
MYKDDSLTLHTDLYQINMMQVYFNKGIHNKRAVFEAYFRKVPFENGYAVFAGLERIVRYLENLSFSDSDLSYLEELGYPEEFLDYLKNLKMELTVKSAKEGDLVFANEPLVQIEGPLAQCQLVETAILNIINYQTLVATKAARIRSVIEDEPLLEFGTRRAQEMDAAIWGTRAAIIGGANATSNVRAGKIFNIPVSGTHAHALVQTYGDDYQAFKAYAETHKDCVFLVDTYDTLRVGVPNAIRVAKEMGEKINFLGVRLDSGDLAYLSKKVRQQLDDAGFPNAKIYASNDLDENTILNLKMQKAKIDVWGVGTKLITAYDQPALGAVYKIVSIETDAGSMRDTIKLSNNAEKVSTPGKKQVWRITSRAKGKSEGDYITFADTDVTQLDEIEMFHPTYTYINKTVRDFDAVPLLVDIFDKGKLVYQLPSLQEIQEYGRKEFDQLWDEYKRVLNPQDYPVDLARDVWQNKMDLIDRIRKEALAKGEVR

SEQ ID NO: 2937 - DNA, 1452 bp, Streptococcus pyogenes
atgtataaagatgatagtttaactctccatactgatttgtatcagattaatatgatgcaagtttattttgagcagggcattcataatcgtcatgcggtgtttgaagtctatttccgcaaggaaccttttaacaatggttatgctgtttttgccggtttacagcgcatggtggagtacctagagcaatttcaattttcagaaacagatttggcttaccttgaagaactgggttatccagaaaactttttgacctaccttaaagagttacgattagaattgaccatccgttcagctaaagaaggagatttggtttttgctaatgagccgattgtgcaagtagaaggccctctaggtcagtgtcagttggtcgaaacagctcttttaaacattgttaacttccagaccttgattgctacaaaggctgctcgtattcgttctgtgattgaggatgaaccccttttggaatttggcacccgtcgtgcacaggaactagatgctgcgatttggggaacccgcgcagcgatgattggtggagcagatgcaacaagtaatgtgagagcaggtaaacgctttgatatccctgtttcaggtacgcatgctcatgctttagtgcaagcctatggtaatgattatgatgctttcatggcttatgctaagacccataaagattgtgtatttcttgttgacacctatgatacacttaaagtaggtgtgccaacagctatccgagtagccaaagaaatgggtgacaagattaattttctaggtgttcgattggactctggtgacttggcttacctctcaaaaacagtccgtcagcagttagacgacgctggttttaccgaggctaagatctatgcttctaatgacctcgatgaaaataccatcctcaacttaaaaatgcaaaaggccaaaattgatgtttggggtgttgggaccaaactgatcacagcctatgatcagcctgccttaggtgctgtttataagattgtctctattgagcaagaagatggcagcatgcgtgatacgatcaaattatcaaataatgcagaaaaagtatccacaccaggtaaaaaacaagtttggcgcatcaccagtcgtgaaaaaggcaaatcagaaggcgactatatcacgtttactgatattaatgttaatgaattaactgagattgagatgttccatccgacctatacctatattaagaaaaccgttaaagaatttgatgcaattcctctcttagttgatatttttgtcaagggagaattagtttaccagctaccgaccttagctgaaatcaaggcttatgctaaaaaagaatttgacaagctttgggatgaatacaagcgtgtcttaaatcctcaagactacccagtagacttagcccgtgatgtgtggcaaaacaagatggccttaattgataacattcgcaaagatgcttatggaaagagtgaa

SEQ ID NO: 2938 - protein, 484 aa, Streptococcus pyogenes
MYKDDSLTLHTDLYQINMMQVYFEQGIHNRHAVFEVYFRKEPFNNGYAVFAGLQRMVEYLEQFQFSETDLAYLEELGYPENFLTYLKELRLELTIRSAKEGDLVFANEPIVQVEGPLGQCQLVETALLNIVNFQTLIATKAARIRSVIEDEPLLEFGTRRAQELDAAIWGTRAAMIGGADATSNVRAGKRFDIPVSGTHAHALVQAYGNDYDAFMAYAKTHKDCVFLVDTYDTLKVGVPTAIRVAKEMGDKINFLGVRLDSGDLAYLSKTVRQQLDDAGFTEAKIYASNDLDENTILNLKMQKAKIDVWGVGTKLITAYDQPALGAVYKIVSIEQEDGSMRDTIKLSNNAEKVSTPGKKQVWRITSREKGKSEGDYITFTDINVNELTEIEMFHPTYTYIKKTVKEFDAIPLLVDIFVKGELVYQLPTLAEIKAYAKKEFDKLWDEYKRVLNPQDYPVDLARDVWQNKMALIDNIRKDAYGKSE

SEQ ID NO: 2939 - DNA, 819 bp, Streptococcus agalactiae
atgactttgcaagatcaaattatcaaagaactcggtgtaaaacctgttattaatccaagtcaagaaatccgtcgttccgtagaatttttaaaagactatctattaaaacatagttttctaaagacctatgtactgggtatttcaggggggcaagattcaactttagcaggacgtctagctcaactagcagttgaagagttgcgtgctgatacaggggaaaactatcaatttatagctattcgtttaccatatggtattcaggccgatgaagaagatgcacaaaaagcattagattttatcaagccagatattgctttgaccattaatattaaagaagctgttgatggccaagttagagctcttaatgcagcaggagtagagattacagactttaataaaggaaatattaaagctcgtcaaagaatgattagtcaatatgcagttgcaggtcaatatgctggagcggttattggtactgatcatgctgcagaaaatattacaggttttttcaccaaatttggtgatggaggtgctgacttattacctctctttagacttaataaaagtcaggggaaacagttattagctgaacttggtgctgataaagccttgtacgaaaagattccaaccgcagatttagaagaaaataaaccaggaatcgctgatgaaatagcccttggagtaacctaccaagaaattgatgcttatcttgaagggaaggtggtttcggacaagtctcgaggtatcattgaaaattggtggtataagggtcaacataaacgtcatcttccaatcacaatttttgatgatttctggaaa

SEQ ID NO: 2940 - protein, 273 aa, Streptococcus agalactiae
MTLQDQIIKELGVKPVINPSQEIRRSVEFLKDYLLKHSFLKTYVLGISGGQDSTLAGRLAQLAVEELRADTGENYQFIAIRLPYGIQADEEDAQKALDFIKPDIALTINIKEAVDGQVRALNAAGVEITDFNKGNIKARQRMISQYAVAGQYAGAVIGTDHAAENITGFFTKFGDGGADLLPLFRLNKSQGKQLLAELGADKALYEKIPTADLEENKPGIADEIALGVTYQEIDAYLEGKVVSDKSRGIIENWWYKGQHKRHLPITIFDDFWK

SEQ ID NO: 2941 - DNA, 864 bp, Streptococcus pyogenes
ttgataacattcgcaaagatgcttatggaaagagtgaatgacatgacactacaagaagagataattcgacaattaggcgtcaaggctagcattgacccacaagaagaaattcggaaagccgttgattttttaaaagcttatttgcgtaagcactcatttttaaaaacttatgtcttaggcatttcgggaggtcaggattctaccctcgcaggaaagctagcccaaatggccattgcagagttacgggaggaagcaagtgatcaagcttaccaatttatagctgttcgcttgccttatggggttcaggctgatgaagcagatgcgcaaaaagccttggcttttattgcaccagatcagacccttaccattaatatcaaggcagctgtggacggtcaagtagaggctctacaagcagcaggcgttgagatttctgatttcaataaaggtaatattaaagcacgtcagcgaatgatcagtcaatatgccattgctggccaaatggctggtgctgttattggaacggatcatgcggcagaaaacatcactggtttctttactaaatttggtgatggtggagcagatattcttcccctctttaggcttaacaaacgtcaaggaaaggctcttttgaaagttttaggagcagatgctgctttgtatgaaaaagttccaactgctgatttagaagatcaaaaaccaggcttggctgatgaggttgctctaggggtgacctatcaagacatcgacgactatttggaagggaagctgatttccaaagtagctcaagcaactattgaaaaatggtggcataaaggacaacacaagcgtcacctgccaatcaccatttttgatgatttttggaaa

SEQ ID NO: 2942 - protein, 288 aa, Streptococcus agalactiae
LITFAKMLMERVNDMTLQEEIIRQLGVKASIDPQEEIRKAVDFLKAYLRKHSFLKTYVLGISGGQDSTLAGKLAQMAIAELREEASDQAYQFIAVRLPYGVQADEADAQKALAFIAPDQTLTINIKAAVDGQVEALQAAGVEISDFNKGNIKARQRMISQYAIAGQMAGAVIGTDHAAENITGFFTKFGDGGADILPLFRLNKRQGKALLKVLGADAALYEKVPTADLEDQKPGLADEVALGVTYQDIDDYLEGKLISKVAQATIEKWWHKGQHKRHLPITIFDDFWK

SEQ ID NO: 2943 - DNA, 1332 bp, Streptococcus agalactiae
atgtcaaaattaactcaaacatttacagataagttatttgctgattaccaagcaaatacaaaatttagcgctattgaaaatgcagtaactcacaatggtttattgaagtctctagagactcgtcaaagtgagattgagaacgactatgtcttttcaattgatttgaccaaagatgaagtttctaatcagaaacaatcaggacgttgctggatgtttgctgcactgaatacatttcgtcataaactgatttcagattttaaacttgagaattttgaattatctcaggcacatacatttttctgggataagtatgaaaaatcaaattggtttatggaacaaattattgcgactgcaaatcaggaattgagtagtcgtaaggtgaaattcctattagatgtacctcaacaagatggaggacaatgggacatggtggttgctctgtttgagaaatatggtgtcgttcctaaaacagtttatcctgaatctgtttcatcaagtgctagtcgtgaactaaatcaatatttgaataaactcttacgccaagatgcacagattctacgagaattaatagcacagggagcagatggggcaactgttcaaaataaaaaggaagaattgcttcaagaaatttttaactttttagcaatgaaccttggcttgccaccgcaatcttttgattttgcttatcgtgataaagacaatcattatcagtctgataaaaatattacaccgaaagcattttatcaaaaatatgttaatcttgacctatcagattatgtttctattatcaatgctccaactgtagataagccttatggacaatcctatacagttgagatgcttggaaatgttgtcggagggccagctgttaaatatttaaaccttgatatgaaacggtttaaagagttagcgattgcgcaaatgaaatcaggagaaactgtgtggtttggttcagacgtaggtcaagtatcaaatcgtcaaaagggtatcctagcaactacgacttatgattttaattcatctatggatattaaacttagccaagacaaagcgggccgcctagattatagtgaaagtttaatgacacatgctatggtcttaacgggagtagaccttgatgaatctggacaacctttaaaatggaaagttgagaactcttggggagagaaagttggtaaggatggttattttgtagcttcagatgcttggatggatgaatatacttaccaaatagtcgttcgtaaagaattgcttactaaagaagaattagaggcttacaacgcagagccaattactttagcgccgtgggatccgatgggagcattagctaat

SEQ ID NO: 2944 - protein, 444 aa, Streptococcus agalactiae
MSKLTQTFTDKLFADYQANTKFSAIENAVTHNGLLKSLETRQSEIENDYVFSIDLTKDEVSNQKQSGRCWMFAALNTFRHKLISDFKLENFELSQAHTFFWDKYEKSNWFMEQIIATANQELSSRKVKFLLDVPQQDGGQWDMVVALFEKYGVVPKTVYPESVSSSASRELNQYLNKLLRQDAQILRELIAQGADGATVQNKKEELLQEIFNFLAMNLGLPPQSFDFAYRDKDNHYQSDKNITPKAFYQKYVNLDLSDYVSIINAPTVDKPYGQSYTVEMLGNVVGGPAVKYLNLDMKRFKELAIAQMKSGETVWFGSDVGQVSNRQKGILATTTYDFNSSMDIKLSQDKAGRLDYSESLMTHAMVLTGVDLDESGQPLKWKVENSWGEKVGKDGYFVASDAWMDEYTYQIVVRKELLTKEELEAYNAEPITLAPWDPMGALAN

SEQ ID NO: 2945 - DNA, 1335 bp, Streptococcus pyogenes
atgtcagcattaacagagacatttacagaacaattatttgctcattacgaagccaatgcaaaattttcagctattgagaatgccgttacgcataatggtttgctaaaatcattagaaacccgtcaaagtgaagtggacaatgattttgtgttttctattgatttaactaaagataaggtatctaaccaaaaggcttctggtcgttgctggatgtttgctgccttgaacactttccgacacaaattaatcacagaatttaagttagaaaattttgaactgtcacaagctcatactttcttttgggataagtatgaaaaagctaactggtttatggagcaggtcattgctacagctgaccaagaattaaccagtcgtaaagttaagtttctcttggatgttccacaacaagatggtggtcagtgggacatggtggtttccttgtttgagaagtatggagtggtgccaaaatctgtttacccagaatcaatctcatcaagtaacagtcgtgaattaaaccagtatttgaataaattattgcgccaagatgctcaaattcttcgtgacctgattgcgtcaggtgctaaggcagaccaagttgaggatcgaaaagcagagcttcttcaggaaatttttaacttcttggccatgacccttggtttaccacctcgtcattttgattttgcctaccgtgataaagatgaccactatcatgttgagaaaggtttgacaccgcaagcgttttacgacaaatttgttggcttaaagctttctgattatgtgtctgttattaatgcgccaactgctgataagccttatggcaaatcatacactgttgagatgctaggaaatgtggtcggtagtcgtgaggttcgctacctcaaccttgatatgaaacgtttcaaagaactagctatcaagcagatgcaggctggtgagtccgtttggtttggctctgatgtgggtcaagtttcagatcgtcaaaaaggcattttagcaactaatacttacgattttgaagctagtatggatatcaatcttagtcaagataaggctggacgtttggattatagtgaaagtttgatgacacatgctatggttttaacaggtgttgacttagatgaaacaggaaaaccgttaaaatggaaggttgaaaattcatggggtgagaaggttggtgacaaaggttactttgttgcttcagatgcttggatggatgaatatacctatcaaattgttgtccgtaaagaattcttaacagctgacgagttagcggcttatgaaaaagagccacaagtactagctccttgggatccaatgggtgctttagcacaatac

SEQ ID NO: 2946 - protein, 445 aa, Streptococcus agalactiae
MSALTETFTEQLFAHYEANAKFSAIENAVTHNGLLKSLETRQSEVDNDFVFSIDLTKDKVSNQKASGRCWMFAALNTFRHKLITEFKLENFELSQAHTFFWDKYEKANWFMEQVIATADQELTSRKVKFLLDVPQQDGGQWDMVVSLFEKYGVVPKSVYPESISSSNSRELNQYLNKLLRQDAQILRDLIASGAKADQVEDRKAELLQEIFNFLAMTLGLPPRHFDFAYRDKDDHYHVEKGLTPQAFYDKFVGLKLSDYVSVINAPTADKPYGKSYTVEMLGNVVGSREVRYLNLDMKRFKELAIKQMQAGESVWFGSDVGQVSDRQKGILATNTYDFEASMDINLSQDKAGRLDYSESLMTHAMVLTGVDLDETGKPLKWKVENSWGEKVGDKGYFVASDAWMDEYTYQIVVRKEFLTADELAAYEKEPQVLAPWDPMGALAQY

SEQ ID NO: 2947 - DNA, 2250 bp, Streptococcus agalactiae
gtgattacaattaaaaaggaatctgttatcaaactattgaagtatgcttttggcattataatgggatttattatcttagctattgtaataggtgggctcctatttgcatactacgttagtcgttctccgaaattaaccgatcaagctttaaaatccgttaactctagtttggtttatgatggtaataataaacttattgccgatttaggctcagaaaagcgtgaaagtgttagtgcggatagcattccactaaatttggttaacgctatcacttctatcgaagataaacgtttctttaaacatagaggtgtcgatatttatcgtattttaggtgcagcttggcataatcttgttagtagtaatacgcaaggtggttcaacccttgatcaacagttgattaaactggcttacttttctaccaataaatctgaccaaacgttaaaacgtaaatcacaggaagtttggcttgcgcttcaaatggagcgtaaatacaccaaagaagaaattcttactttctatattaataaagtttatatgggaaatgggaattatggtatgagaacaacagctaaatcatactttggtaaagacctaaaggaattatctattgcacaacttgctttgctcgctggtattcctcaagcacctacacaatatgacccttataaaaacccagaatctgctcaaacaagacgtaataccgttcttcagcagatgtatcaagataaaaacatttctaaaaaggaatacgaccaagctgttgcaactccagtaactgatggcttaaaagaattaaagcaaaaatctacttatccaaaatatatggataactacttaaaacaagttattagtgaagttaaacaaaaaactggtaaagatatctttactgctgggctaaaagtgtatactaatatcaacactgatgcacaaaaacaactatatgacatctacaacagtgacacttacatcgcttatccaaacaatgaattacaaatagcatctaccatcatggatgcgactaatggtaaagtcattgcacaattaggcgggcgtcatcagaatgaaaatatttcatttgggacaaatcaatctgtcttaacagaccgcgattggggttctacaatgaaacctatctcagcttatgcacctgctattgatagtggtgtctataattcaacaggtcaatcattaaacgactcagtttactactggcctggtacttctactcaactatatgactgggatcgtcaatatatgggttggatgagtatgcagaccgctattcaacaatcacgtaacgtccctgctgtcagagcacttgaagccgctggattagacgaagcaaaatctttccttgaaaaattaggcatatactatccagaaatgaactattcaaatgctatttcaagtaacaacagtagcagtgatgcaaaatatggtgcaagtagtgagaaaatggcagcggcttactcggcttttgcaaacggcggaacttactataaaccgcaatatgttaataaaattgaatttagcgatggaaccaatgatacttatgcagcgtctggtagccgtgcgatgaaagagactactgcctacatgatgacggatatgctgaaaacagtactaacatttggtactggtactaaagcagctatccctggtgttgcacaagctggtaagactggtacttccaactatacggaagatgagttagctaaaattgaagcaactactggtatctacaatagcgccgttggtacaatggctcctgatgaaaactttgtcggctatacttctaagtacacaatggcaatttggactggttataaaaatcgccttacaccactttatggtagccaactggatattgctactgaggtttatcgtgcaatgatgtcctacctaactggcggatacagtgcagattggacaatgccagaagggctctatcgaagcggaagctacttgtatatcaatgggacaactacaaccggcacttactcttcttctgtctataagaatatctatcaaaattctggacagtcaagtcaaagcagtagttcaacatcctctgagaaacaaaaagaggataagaatacagcaaatgatgccaattcatcatccccacaagtcgaaacacctaataatggtaatgctactacccctaataattccaatcaaactgtgccaggaactggacatggtaatggtaatggtaatggtaacaacaatacagtacctaacggtaat

SEQ ID NO: 2948 - protein, 750 aa, Streptococcus agalactiae
MITIKKESVIKLLKYAFGIIMGFIILAIVIGGLLFAYYVSRSPKLTDQALKSVNSSLVYDGNNKLIADLGSEKRESVSADSIPLNLVNAITSIEDKRFFKHRGVDIYRILGAAWHNLVSSNTQGGSTLDQQLIKLAYFSTNKSDQTLKRKSQEVWLALQMERKYTKEEILTFYINKVYMGNGNYGMRTTAKSYFGKDLKELSIAQLALLAGIPQAPTQYDPYKNPESAQTRRNTVLQQMYQDKNISKKEYDQAVATPVTDGLKELKQKSTYPKYMDNYLKQVISEVKQKTGKDIFTAGLKVYTNINTDAQKQLYDIYNSDTYIAYPNNELQIASTIMDATNGKVIAQLGGRHQNENISFGTNQSVLTDRDWGSTMKPISAYAPAIDSGVYNSTGQSLNDSVYYWPGTSTQLYDWDRQYMGWMSMQTAIQQSRNVPAVRALEAAGLDEAKSFLEKLGIYYPEMNYSNAISSNNSSSDAKYGASSEKMAAAYSAFANGGTYYKPQYVNKIEFSDGTNDTYAASGSRAMKETTAYMMTDMLKTVLTFGTGTKAAIPGVAQAGKTGTSNYTEDELAKIEATTGIYNSAVGTMAPDENFVGYTSKYTMAIWTGYKNRLTPLYGSQLDIATEVYRAMMSYLTGGYSADWTMPEGLYRSGSYLYINGTTTTGTYSSSVYKNIYQNSGQSSQSSSSTSSEKQKEDKNTANDANSSSPQVETPNNGNATTPNNSNQTVPGTGHGNGNGNGNNNTVPNGN

SEQ ID NO: 2949 - DNA, 2163 bp, Streptococcus pyogenes
gtgattacaattaaaaatccaaaaatccttaagtggctaaagtatgtattaagtgcaattcttagccttattatccttgttattattattggtggtcttttgtttaccttctacattagcagtgctccgaaactgtcagaagcccagttaaaatcaacaaactctagcttggtttatgacggtaataacaatctgattgctgatttgggttctgaaaagcgtgaaaatgtaacagctgatagtatccctattaatctagttaatgctattacctcaattgaagataaacgtttctttaaccatcgtggagtagatctttatcgtatttttggtgctgcctttcataatctaacgagtcagaccactcaaggggggtcaacgcttgatcagcaactcattaaactagcctatttttctactaatgaatctgatcaaaccttaaaacgtaaggctcaagaagtttggcttgctcttcaaatggagcgaaaatatactaaacaagaaatcctgactttttacatcaacaaagtatatatgggtaatggcaactatggtatgctgacagccgctaagtcttattatggcaaggatcttaaggatttatcttatgcccaactagccctattggctggaatccctcaagctcctagtcaatatgatccttaccttcatcctgaagctgctcaaaatcgccgtaacgtcgtgttgcaacagatgtacatggaaaaacatctgacgaaagcagaatatgaaactgccatcgcaactcccgtcgctgaaggtctacaatcactccaacagcgctcaacttatccaaaatatatggataattatctaaaacaagttattgaagaagtcaaaaaagaaacgaataaagatatttttaccgctggtttaaaagtttataccaatattatccccgatgcgcagcagactctttataatatttatcattctggtgattatgtttactatccagaccaagatttccaagttgcttcaacgattgttgatgtgacaaatggtcatgttattgctcagcttggcggacgtaatcaagatgaaaatgtttcatttgggactaaccaagctgttttaactgatcgtgactggggttctaccatgaagccaatcacagcctatgctcctgctattgaatctggtgtttatacttctactgctcagtcgactaatgactcagtctattattggcctggaaccactacccaattgtttaactgggaccttagatataacggatggatgacaatccaagctgctattatgctatcgcgaaatgtcccagcagtccgagcactggaagccgcaggacttgactatgctcgatctttcttaagcagtttaggtattaactatcccgaaatgcactactcaaacgctatctcaagtaataacagtagctcagataaaaaatatggtgcaagtagtgaaaaaatggccgctgcatacgctgcttttgcaaatggtggtatttatcataaaccaaggtatgtcaataaagtggaatttagtgatggtacaagtaaaacttttgatgaaaaaggaaaacgtgccatgaaagaaaccacggcctatatgatgacagatatgttaaaaactgttctcacttatggtacaggtactgctgctgccattcctggtgttgcgcaagctggtaaaacagggacttctaactacactgatgaggaactagctaaaattggtgaaaaatacggcctttatccagattatgttggtacattagcgccagacgaaaactttgttggctttactaagcgctacgccatggctgtttggacaggttacaaaaaccgcttgaccccagtatacggatcaagtctagagattgcatctgacgtttatcgtagcatgatgacttacttaacaaatggttacagtgaagattggacgatgccaaatggtctttatcgcagtggtggattcctctacttaagcggaacctatgcgagcaacaccgactatactaattcggtttacaacaatctttacagcaataacacgacaacagcttctagccaaacgacttcagatgatactagtagtagcaatgatacaagtaattcaaccaatacagacaacaatggcagtcatccatctaccgatgataaaaagacaactcat

SEQ ID NO: 2950 - protein, 721 aa, Streptococcus agalactiae
VITIKNPKILKWLKYVLSAILSLIILVIIIGGLLFTFYISSAPKLSEAQLKSTNSSLVYDGNNNLIADLGSEKRENVTADSIPINLVNAITSIEDKRFFNHRGVDLYRIFGAAFHNLTSQTTQGGSTLDQQLIKLAYFSTNESDQTLKRKAQEVWLALQMERKYTKQEILTFYINKVYMGNGNYGMLTAAKSYYGKDLKDLSYAQLALLAGIPQAPSQYDPYLHPEAAQNRRNVVLQQMYMEKHLTKAEYETAIATPVAEGLQSLQQRSTYPKYMDNYLKQVIEEVKKETNKDIFTAGLKVYTNIIPDAQQTLYNIYHSGDYVYYPDQDFQVASTIVDVTNGHVIAQLGGRNQDENVSFGTNQAVLTDRDWGSTMKPITAYAPAIESGVYTSTAQSTNDSVYYWPGTTTQLFNWDLRYNGWMTIQAAIMLSRNVPAVRALEAAGLDYARSFLSSLGINYPEMHYSNAISSNNSSSDKKYGASSEKMAAAYAAFANGGIYHKPRYVNKVEFSDGTSKTFDEKGKRAMKETTAYMMTDMLKTVLTYGTGTAAAIPGVAQAGKTGTSNYTDEELAKIGEKYGLYPDYVGTLAPDENFVGFTKRYAMAVWTGYKNRLTPVYGSSLEIASDVYRSMMTYLTNGYSEDWTMPNGLYRSGGFLYLSGTYASNTDYTNSVYNNLYSNNTTTASSQTTSDDTSSSNDTSNSTNTDNNGSHPSTDDKKTTH

SEQ ID NO: 2951 - DNA, 597 bp, Streptococcus agalactiae
atggttaactatccacatcagcttattcggaaaacaacagttacaaaatcaaagaaaaagaaaatcgattttgccaaccgtggtatgtcatttgaagctgctatcaatgcaaccaatgactactatttgtctcacgaattagctgtcattcataagaaaccaacgccagtacaaatcgtcaaggtagattatcctaaacgtagtcgtgctaagattgtagaagcttattttagacaagcttctactactgattattctggtgtttacaaaggttactatattgactttgaagccaaagaaacccggcagaaaactgctatgcctatgaaaaattttcatgctcaccaaatagagcacatggcaaatgtattacagcaaaaagggatttgctttgtcttgcttcatttttccacacttaaggaaacctatctactccctgctaatgagttaatttcattttatcagattgataaaggcaataaatcaatgcctattgattatatcagaaaaaatggatttttcgtaaaggagagtgcctttcctcaagtcccttacttagatattattgaagaaaaattattaggcggtgattacaat

SEQ ID NO: 2952 - protein, 199 aa, Streptococcus agalactiae
MVNYPHQLIRKTTVTKSKKKKIDFANRGMSFEAAINATNDYYLSHELAVIHKKPTPVQIVKVDYPKRSRAKIVEAYFRQASTTDYSGVYKGYYIDFEAKETRQKTAMPMKNFHAHQIEHMANVLQQKGICFVLLHFSTLKETYLLPANELISFYQIDKGNKSMPIDYIRKNGFFVKESAFPQVPYLDIIEEKLLGGDYN

SEQ ID NO: 2953 - DNA, 597 bp, Streptococcus pyogenes
atggttaattatcctcataatcttattcgacaaaaagtaagttccgttcaaaagcaaaataaggtggacttcgccaatagaggtatgtcctttgaagctgctatcaacgcgacaaatgattattatttatctcgtcaaatagctgtcattcacaaaaaacctactcctgtccaaattgtcaaagtggattaccctaaacgcagtcgggcaaaaatcgttgaagcgtactttagacaagcttcaacgactgactattgcggcgtttataaaggacattatgttgattttgaagcaaaagaaaccaggcaaaaaacagctatgcccatgaaaaatttccatttacatcagattgaacatatggcttgcgttttacatcaaaaaggaatctgctttgtccttcttcacttttccacactgaaggagacttactacctacctgctcaagccttgatttcattttatcagatagataatggcagtaaatcgatgcccattgattatatcagaaaaaatggctttaaggtagcatttggagcctttccacaagtcccttatttaaacataattgaacaaaattttttaggcggtgattacaat

SEQ ID NO: 2954 - protein, 199 aa, Streptococcus pyogenes
MVNYPHNLIRQKVSSVQKQNKVDFANRGMSFEAAINATNDYYLSRQIAVIHKKPTPVQIVKVDYPKRSRAKIVEAYFRQASTTDYCGVYKGHYVDFEAKETRQKTAMPMKNFHLHQIEHMACVLHQKGICFVLLHFSTLKETYYLPAQALISFYQIDNGSKSMPIDYIRKNGFKVAFGAFPQVPYLNIIEQNFLGGDYN

SEQ ID NO: 2955 - DNA, 516 bp, Streptococcus agalactiae
atgaagtcaactattcttgtaacaggttacaaaaattttgaattagggattttccaggataaggatcctcggattactattataaaaaaggctattgataaggattttagacgcttcttggaaaatggagcagactggtttatttttatgggaaatttagggtttgagtactgggctttggaagttgctcttgatttacaaaaagaatatgattttcaaattgcgacaatttttacctttgagaaccatggccaaaattggaatgaggctaataaagctaagttggcactctttaagcaagttgactttgttaaatatactttcccaagctatgaaaacccgggtcaatttaaacaatacaatcattttctcattaacaacacacaaggtgcatatcttttttatgattctgaaaatgaaactaatttaaaatttttgctagaaatgatggagaaaaaggaagcttatgatatttctttcctaacttttgatcgcttaaatgaaatatatgaggaa

SEQ ID NO: 2956 - protein, 172 aa, Streptococcus agalactiae
MKSTILVTGYKNFELGIFQDKDPRITIIKKAIDKDFRRFLENGADWFIFMGNLGFEYWALEVALDLQKEYDFQIATIFTFENHGQNWNEANKAKLALFKQVDFVKYTFPSYENPGQFKQYNHFLINNTQGAYLFYDSENETNLKFLLEMMEKKEAYDISFLTFDRLNEIYEE

SEQ ID NO: 2957 - DNA, 513 bp, Streptococcus pyogenes
atgactgcgattctaattacaggttaccgaagctttgaaatagggatttttgaccataaagacccacgagtttcaattattaaacaggctattcgtaaagatttaataggttatttggaaaatggtgtggattggtttatctttacagggaacttgggttttgaacaatgggctttggaagtagctaatgagctaaaagaggagtatcccttgcagatagctactatattcttgtttgaaacgcatggagataggtggaatgaaaaaaataaagaagttttaagtcagtttagggctgttgactttgtaaaatattactttccaaattacgaacaaccgacgcaatttagtcaatattatcagtttttattagaaaagacagaaggggcttatgttttttatgacacagaaaacgagaccaacttaaaatattttctcaagaaagcaaaagatatgccgcattatcagttgctattgctaacctttgatcggctaaatgatatgtcacaaagc

SEQ ID NO: 2958 - protein, 171 aa, Streptococcus pyogenes
MTAILITGYRSFEIGIFDHKDPRVSIIKQAIRKDLIGYLENGVDWFIFTGNLGFEQWALEVANELKEEYPLQIATIFLFETHGDRWNEKNKEVLSQFRAVDFVKYYFPNYEQPTQFSQYYQFLLEKTEGAYVFYDTENETNLKYFLKKAKDMPHYQLLLLTFDRLNDMSQS

SEQ ID NO: 2959 - DNA, 96 bp, Streptococcus agalactiae
atggaaaaatcaagcgtaaaacgttctcatatccgaaaaaacgatcattcctcatatatttcatttaagcgatcaaaagttaggaaagaaatatca

SEQ ID NO: 2960 - protein, 32 aa, Streptococcus agalactiae
MEKSSVKRSHIRKNDHSSYISFKRSKVRKEIS

SEQ ID NO: 2961 - DNA, 351 bp, Streptococcus agalactiae
ttgactggtttggagaatagaatggcaagtattatttatagcccaaaagatatttttgagcaagattttaaagttagtatgcggggatatgacaagaaagaagtcgatgtatttctggatgatgtcatcaaagattacgaaaattatcttgagcaaattgagaagctccaaatggaaaatagacgtctacaacaagctttagacaaaaaagaaagcgaagcttcaaatgtaagaaattcagggacagctatgtataatcaaaaaccgattgcccaatctgcaaccaattttgatattttaaaacgcattagccgccttgagaaagaagtttttggaagacaaattagagaa

SEQ ID NO: 2962 - protein, 117 aa, Streptococcus agalactiae
MTGLENRMASIIYSPKDIFEQDFKVSMRGYDKKEVDVFLDDVIKDYENYLEQIEKLQMENRRLQQALDKKESEASNVRNSGTAMYNQKPIAQSATNFDILKRISRLEKEVFGRQIRE

SEQ ID NO: 2963 - DNA, 324 bp, Streptococcus pyogenes
atgacaagtattatttatagtcctaaagatatttttgagcaagaatttaagactagtatgcgagggtttgataagaaagaagttgatgaatttcttgataatgtaattaaagattatgaaaatttcaatgctcaaattgaagctttaaaagctgagaatgaagccttaaaaaaggcgaagtttcaagctagaaatacagtttcagcgactgttcaacaaccagtaccgcaaccgactcgtgttgctcaatcagctactaattttgacatcttgaaacgtattagtaaattggaaaaagaggtttttggtaaacaaattattgag

SEQ ID NO: 2964 - protein, 108 aa, Streptococcus pyogenes
MTSIIYSPKDIFEQEFKTSMRGFDKKEVDEFLDNVIKDYENFNAQIEALKAENEALKKAKFQARNTVSATVQQPVPQPTRVAQSATNFDILKRISKLEKEVFGKQIIE

SEQ ID NO: 2965 - DNA, 1152 bp, Streptococcus agalactiae
atgaaagaatcattcaaattaatagcaactgctgctgctggtttagaagccattgttggtagagaaatcagaaacctaggaattgactgccaagttgagaacggtagagtccgtttccacggagatatcaaaacaatcattgaaacgaacctatggctacgagctgccgatcgtataaagattattgtaggagagtttccagcacctacttttgaggaactttttcagggtgtatatggccttgactgggaaaattatttaccgttaggggcaaaatttcctattgctaaagcaaagtgtgtcaagtcaaaattgcacaatgaacctagtgtacaagccatttctaaaaaagctgttgctaagaaacttcaaaaagtctttcaccgtcctgaaggagttcccttacaagaaaatggagctgaatttaaaatagaagtttctattttaaaagataaagcgactgtcatgattgatacgactggatcaagtctcttcaaacgtggctaccgtgcagaaaaaggtggtgcaccaattaaagaaaacatggcagcagctattattcaattatctaattggttccctgataagccattgattgatccaacttgtggttcaggtactttttgtattgaagctgctatgattggaatgaatatagctcctggttttaatcgtgattttgcctttgaggcgtggccatgggtagatcaaagtcaagtacaaaaggttcgtgatgaagctgagagtaaagcaaactatgatattgatttagatatttcaggttttgatttagacggtcgtatggtagaaattgctagaaaaaatgcagaagaagcaggacttggagatgttatcaaattgaaacaaatgcgtcttcaagatttaaaaacagataaaattaacggtgttattatctccaacccaccatatggtgaacgactcctggatgacaaagcagtggacattttgtataatgagatgggacaaacatttgcgcctttaaaaacttggagcaagtttatcctaactagtgacgaaggatttgaaaaaaaatacggctcacaagctgataaaaaacgtaagctttacaatggtactttaaaagttgatttgtaccaatattacggtgaacgtgtgagacgtcaagtaaaa

SEQ ID NO: 2966 - protein, 384 aa, Streptococcus agalactiae
MKESFKLIATAAAGLEAIVGREIRNLGIDCQVENGRVRFHGDIKTIIETNLWLRAADRIKIIVGEFPAPTFEELFQGVYGLDWENYLPLGAKFPIAKAKCVKSKLHNEPSVQAISKKAVAKKLQKVFHRPEGVPLQENGAEFKIEVSILKDKATVMIDTTGSSLFKRGYRAEKGGAPIKENMAAAIIQLSNWFPDKPLIDPTCGSGTFCIEAAMIGMNIAPGFNRDFAFEAWPWVDQSQVQKVRDEAESKANYDIDLDISGFDLDGRMVEIARKNAEEAGLGDVIKLKQMRLQDLKTDKINGVIISNPPYGERLLDDKAVDILYNEMGQTFAPLKTWSKFILTSDEGFEKKYGSQADKKRKLYNGTLKVDLYQYYGERVRRQVK

SEQ ID NO: 2967 - DNA, 1152 bp, Streptococcus pyogenes
atgaaagaaacatttagattagtcgcaactgcagccgcaggtttagaagctgtcgttggtaaagaagtcagagcactaggctttgattgtcaggttgaaaatgggaaagtttattttgaaggtgatgtagaagcgattgttaaaacaaatctttggttacgtgcagcagatcgtatcaaaattatcgtaggacaatttcctgctagaacctttgaagaattattccaaggtgtctttgccttggattgggaaaattatttaccgctaggagctaaatttccaatctcaaaagccaaatgtgttaagtctaaattgcataacgagccaagtgttcaggcgattaccaaaaaggccgttgttaagaaactgcaaaagcatttccacaggccagaaggagttcctcttcaagaagttgggtcaacgtttaacattgaggtatctattttaaaagaccaagccactattatgattgacacgacaggatctagcctatttaaacgagggtatcgcgttcaaaaaggtggagcaccgatcaaggaaaatatggcagctgctatcttggccttatctaactggtttccagataaacctctggttgatcccacctgtggatcgggaacgttttgcatcgaggcagccatgattgggatgaatattgctccaggatttaaccgttcgtttgcttttgaagaatggagctgggtagataaagatatggtgcaacaagttcgtgatgatgctgaacaagaagctaattatgaaatcgaattagatatttctggctttgatatcgatggccgcatgattgagattgctaaaagtaatgctgaagaagctggtttatctgatgtgattacctttaagcaaatgcgtctgcaagactttcgaacagacaaggttaatggtgtagtgatatcaaatcctccttatggagaacggttgcttgatgacaaagcggttgacatcttgtataatgaaatgggacaaacctttgcaccattgaaaacatggagcaaatttatccttacaagtgatgaactttttgaactaaaatacgggcaaaaagctgataaaaaacgtaaactttataacggcaccctaaaagttgatttgtaccaattttatggggaaagggtaaagcgacatctgata

SEQ ID NO: 2968 - protein, 384 aa, Streptococcus pyogenes
MKETFRLVATAAAGLEAVVGKEVRALGFDCQVENGKVYFEGDVEAIVKTNLWLRAADRIKIIVGQFPARTFEELFQGVFALDWENYLPLGAKFPISKAKCVKSKLHNEPSVQAITKKAVVKKLQKHFHRPEGVPLQEVGSTFNIEVSILKDQATIMIDTTGSSLFKRGYRVQKGGAPIKENMAAAILALSNWFPDKPLVDPTCGSGTFCIEAAMIGMNIAPGFNRSFAFEEWSWVDKDMVQQVRDDAEQEANYEIELDISGFDIDGRMIEIAKSNAEEAGLSDVITFKQMRLQDFRTDKVNGVVISNPPYGERLLDDKAVDILYNEMGQTFAPLKTWSKFILTSDELFELKYGQKADKKRKLYNGTLKVDLYQFYGERVKRHLI

SEQ ID NO: 2969 - DNA, 1461 bp, Streptococcus agalactiae
atgtcagaagatcaaaaacacccattttttgaaccaaaaaaagaaactgatggtcttgaatttaaagatgctaaagaaatgacagtagaagaggctgttagaaaagattctgaaattaaggctggtattaccgaagaagatagtattcttgataaatacatcaaacaacatcgtgatgaagtagcttcacaaaagtttgagacaaaatcaagcgattttgcaaaccttgatacggcatctttagatgattttatcaagaaacagcgcgaagaattatcagcgatgttagctgcagaagagctttctaaaaagttggataattcagtctctcaagaacaagatacagaagctaatgctgtctcacctaaagaagaatcttcacaagaacaagaaaatagtgtaaccccagttcctcctctgaatacggaagcagaaccaactgcaacagaaccagattcgactattgctgattcagaggagtataaatcctcttctaagaagcgtggaggtatcgtaggaacattgattgctcttattttacttctaatagtagcaatctttggttacaactatttcaagaataataattcgacaaattctcaaactgcaacaagtcaaagttctagttctaaggctacgacgacttcatcagaagaagataaaaaagctagtcagaacttagataatttcaacaaatcttatgctaacttttttgttgatgataagaaaacccaactcaaaaatagcgaatttgataaattgtcagaattagaaaagaaagttgatgctttaaaaggaactaaatactacggtaaagtaaaagttaaatttgatagtctaaaacgtcaaattgatgctgttaaagctgttaacgacaagtttaagtcgcctgctgtagttgatggtaagaagagtgaaaaattagaggtaaaagatggagcgaattttgactctttagatagtaaaactcttaatactggtaatgctagtctagatagtttacttcactccatcgtttcaactggtcgtaatcaggtaaaacaatccgaagaacaggcttcgtctaataaggtttcagacactcaaataactgaacaaccaaacgtaactaacggtcaatcttcctcatcagctgctacaataaataatcaggcagctggcactgcatcaggtaatttggaacgtaaccgtagtcgagtaccgtataataatgctgctattgcggatacaggaaatcctgcctggatatttaacccaggagtattagagaaaatcgtggccacttcacaggcgcgaggctatttctctggaaataactatattcttgaacctgtaaatattatcaatggtaatggttattacaatatgtttaaattagatggcacttatttgttctctatcaatgccaagacaggttactttgtaggtaacgctcctggaagagctgatagtttagattat

SEQ ID NO: 2970 - protein, 487 aa, Streptococcus agalactiae
MSEDQKHPFFEPKKETDGLEFKDAKEMTVEEAVRKDSEIKAGITEEDSILDKYIKQHRDEVASQKFETKSSDFANLDTASLDDFIKKQREELSAMLAAEELSKKLDNSVSQEQDTEANAVSPKEESSQEQENSVTPVPPLNTEAEPTATEPDSTIADSEEYKSSSKKRGGIVGTLIALILLLIVAIFGYNYFKNNNSTNSQTATSQSSSSKATTTSSEEDKKASQNLDNFNKSYANFFVDDKKTQLKNSEFDKLSELEKKVDALKGTKYYGKVKVKFDSLKRQIDAVKAVNDKFKSPAVVDGKKSEKLEVKDGANFDSLDSKTLNTGNASLDSLLHSIVSTGRNQVKQSEEQASSNKVSDTQITEQPNVTNGQSSSSAATINNQAAGTASGNLERNRSRVPYNNAAIADTGNPAWIFNPGVLEKIVATSQARGYFSGNNYILEPVNIINGNGYYNMFKLDGTYLFSINAKTGYFVGNAPGRADSLDY

SEQ ID NO: 2971 - DNA, 1467 bp, Streptococcus pyogenes
gtgtcagaagaaagcaaagaagtcgaagtaacaaaagaatcgcaaacattggggcttaatgaagccaagtcaatgacaattggtgaagctgtacgcaaacagtcagagataaaagcaggtgttactaaggatgatagtattttagataagtacattaagcaacaccgtgacgaagtttcttctcaaaagtttgatgctaagtatacagagcttgatacagctagtttagataactttatcaaaaaacaaagagaagcattgagtaaagccggtcttgttgatgacgaacctgtgtctgcggagtctgctgagcaagatagcactttggttgaagaagtagctgaagacttagctccaatggagactactgcggtggtaactgggattccggtggaagcgacagtccctgtgttagatctagatccatcagagagggtcattccagaaccacagatgaccaaggaagaaccaaaaagagatcagtttctttctgaagatagccaccatccagccaaacaaaacacgaaaaaaggttggttaatagctttatttctgctattattggccattcttgcagttgtatttggttggaaccatttcttgagacaagacagtggtaaaacaactcaaacagcaagtaaacagacaaagacctctttgcagaccgacagtgctaaaaaagcaacgcgcttgaaggctgctgctaaagctttcgaaaaactatatggtactttttatacagatgccacaaagagcaaattaaaaaatagtgcctttgctactttgccagatttagaagctgccttgaaagctttggaaggctctgcttactatgataaggcgaaagcaaaagtcgattcccttaagaaagctattgctgctattacagcggttaacggtaaatttgtttccgatgttgttgtagatggtgaaaaggtttcggctgaagtcaaggctgatgctaattttgatgatttatcaagtgcaaccttgacaataggaaatgcaaatcttgatgctgtcttgcaggcaagcatcacagaaggtcgtcagcaactagccagcaaggctgaggccgctaaagcagctaatgagcaagcagtccaggatcaagcagctcaaggacaaagtacatcagtagcaccatctggctatggcttgacaagttatgatcctgcaagcttacaacggcatttatcacgtgtaccttacaatcaagatgttattgctgacagagctaacccatcttgggcatttaatccaggagttcttgaaaaaattgtagcaacctcacaagctagaggttatatttcaggcaaccaatatattttagagccggttaatattattaatggcaatggttactataatatgtttaagcctgatggcacttatctgttctctattaattgtaagacgggttattttgtaggaaatggcaaaggttatgctgatgctttagattac

SEQ ID NO: 2972 - protein, 489 aa, Streptococcus pyogenes
VSEESKEVEVTKESQTLGLNEAKSMTIGEAVRKQSEIKAGVTKDDSILDKYIKQHRDEVSSQKFDAKYTELDTASLDNFIKKQREALSKAGLVDDEPVSAESAEQDSTLVEEVAEDLAPMETTAVVTGIPVEATVPVLDLDPSERVIPEPQMTKEEPKRDQFLSEDSHHPAKQNTKKGWLIALFLLLLAILAVVFGWNHFLRQDSGKTTQTASKQTKTSLQTDSAKKATRLKAAAKAFEKLYGTFYTDATKSKLKNSAFATLPDLEAALKALEGSAYYDKAKAKVDSLKKAIAAITAVNGKFVSDVVVDGEKVSAEVKADANFDDLSSATLTIGNANLDAVLQASITEGRQQLASKAEAAKAANEQAVQDQAAQGQSTSVAPSGYGLTSYDPASLQRHLSRVPYNQDVIADRANPSWAFNPGVLEKIVATSQARGYISGNQYILEPVNIINGNGYYNMFKPDGTYLFSINCKTGYFVGNGKGYADALDY

SEQ ID NO: 2973 - DNA, 480 bp, Streptococcus agalactiae
atgacaaaagaagttgtcgtagagagttttgaattagatcacaccatcgttaaagcaccctacgttcgtttaatttcagaagaagttggaccggtcggagacatcattactaactttgatatccgccttattcagcctaatgaaaatgctattgatactgctggtttacatactatcgagcaccttctggcgaagttaatccgccaacgaattaatggtttgattgattgttctccttttggttgtagaactggttttcacatgattatgtggggaaaacaggatgctactgaaattgctaaagtcatcaaatctagtctagaggctattgctggtggggtcacttgggaagacgttcctggaacaaccattgaatcttgtggaaattataaagaccacagtctccactctgctcaagaatgggcgaaattaattctttcccaagggatttctgacaatgcttttgagcgccacattgtc

SEQ ID NO: 2974 - protein, 160 aa, Streptococcus agalactiae
MTKEVVVESFELDHTIVKAPYVRLISEEVGPVGDIITNFDIRLIQPNENAIDTAGLHTIEHLLAKLIRQRINGLIDCSPFGCRTGFHMIMWGKQDATEIAKVIKSSLEAIAGGVTWEDVPGTTIESCGNYKDHSLHSAQEWAKLILSQGISDNAFERHIV

SEQ ID NO: 2975 - DNA, 480 bp, Streptococcus pyogenes
atgacaaaagaagttatcgtcgaaagttttgagctagatcatactattgtaaaggccccttatgttcgtcttatttctgaagaatttggacccaagggcgatcgtattacaaattttgatgttcgcctagtgcagcctaaccaaaattctattgaaacagccggtttgcataccattgaacacttacttgccaagctcatccgccaacgcattgatgggatgattgattgctctccttttggctgtcgaacaggttttcaccttatcatgtggggaaaacacagttctactgatattgccaaggtgattaaatccagcctagaagaaattgcaactgggattacttgggaagatgttcctggaacaactcttgaatcctgtgggaactataaggatcatagcctctttgccgccaaagaatgggctcaattgattattgatcaagggatttcagacgatccttttagtcgccatgtcatc

SEQ ID NO: 2976 - protein, 160 aa, Streptococcus pyogenes
MTKEVIVESFELDHTIVKAPYVRLISEEFGPKGDRITNFDVRLVQPNQNSIETAGLHTIEHLLAKLIRQRIDGMIDCSPFGCRTGFHLIMWGKHSSTDIAKVIKSSLEEIATGITWEDVPGTTLESCGNYKDHSLFAAKEWAQLIIDQGISDDPFSRHVI

SEQ ID NO: 2977 - DNA, 1605 bp, Streptococcus agalactiae
atgtttaatattatattagcaatggtttgtgcactcattggtttgattattggttatgtggctatttcaatgaaaatgaaatcatcaaaagaagctgcagaactaactcttttaaatgcagaacaagatgccgttgatttacgtggtaaagcagaaattgaagcagaacacatccgtaaagcagcggaacgtgaaagtaaagctcaccaaaaagaattacttttagaagcaaaagaagaggctagaaaatatcgtgaagagatcgaaaaggaatttaaatctgatagacaagagttgaaacagatggaggcacgtttaacagatcgtgcatcatctcttgatcgtaaagatgaaaatctatctaacaaagaaaaaatgttagatagcaaagaacaaagtctaaccgataaatctagacatattaatgagcgcgaacaggaaattgctactttagaaacaaaaaaagtagaagaattgtcacgcatcgcagagcttagtcaagaagaagctaaagatatcattttagctgataccgaaaaagatttagctcatgatattgcgacacgtattaaagaagcagaacgtgaagtaaaagatcgatcaaacaagatagcaaaagacttgctagcccaagctatgcaacgtttagctggtgaatatgttactgaacaaacaattacaactgttcatctccctgatgataatatgaagggacgtatcattggtcgtgaaggacgtaatattcgtactctggaaagtttgacaggtattgatgttatcatagatgatacgccagaagtcgttgtcttatcaggtttcgaccccattcgtcgtgaaattgctcgtatgactttagaatctttgattcaagatggacgtatccatccagctcgtattgaagagttggttgaaaaaaatcgtttggaaatggatcaacgtatccgtgagtatggtgaggcagcagcttatgagattggtgcaccaaatctgcatcctgatttgataaaaattatgggacgtttgcagttccgtacatcatatggtcaaaatgtacttcgtcattcagttgaagttggtaaacttgcaggtattttggctggagaactaggagaaaatgttgatttagctcgtcgggctggattcctccatgatatggggaaagctattgatcgcgaagttgaaggcagtcacgttgaaattggtatggaatttgctcgtaagtacaaagagcatccgattgttgttaatactattgcaagccaccatggtgatgtagaacctgacagcgttattgcagtaattgttgctgctgcagacgcccttagttcagcacgaccaggtgcgcgtaatgagtcaatggaaaattatatcaaacgtctgcgtgatttagaagaaattgctaatggctttgagggagtgcaaaatgcctttgcacttcaagccggacgtgaaattcgtatcatggtacaacctggtaaagtttctgatgatcaagtagttattatgtcgcataaggtacgtgaaaaaatcgaacaaaacttggattatccaggtaatattaaggtaacagttattcgtgaaatgcgagctgttgattttgcaaaa

SEQ ID NO: 2978 - protein, 535 aa, Streptococcus agalactiae
MFNIILAMVCALIGLIIGYVAISMKMKSSKEAAELTLLNAEQDAVDLRGKAEIEAEHIRKAAERESKAHQKELLLEAKEEARKYREEIEKEFKSDRQELKQMEARLTDRASSLDRKDENLSNKEKMLDSKEQSLTDKSRHINEREQEIATLETKKVEELSRIAELSQEEAKDIILADTEKDLAHDIATRIKEAEREVKDRSNKIAKDLLAQAMQRLAGEYVTEQTITTVHLPDDNMKGRIIGREGRNIRTLESLTGIDVIIDDTPEVVVLSGFDPIRREIARMTLESLIQDGRIHPARIEELVEKNRLEMDQRIREYGEAAAYEIGAPNLHPDLIKIMGRLQFRTSYGQNVLRHSVEVGKLAGILAGELGENVDLARRAGFLHDMGKAIDREVEGSHVEIGMEFARKYKEHPIVVNTIASHHGDVEPDSVIAVIVAAADALSSARPGARNESMENYIKRLRDLEEIANGFEGVQNAFALQAGREIRIMVQPGKVSDDQVVIMSHKVREKIEQNLDYPGNIKVTVIREMRAVDFAK

SEQ ID NO: 2979 - DNA, 1605 bp, Streptococcus pyogenes
atggttaatattattttattaattgtttctgccctcattggtttaatattaggttatgcacttatttcgattagactcaagtctgcgaaggaagctgcagagttgactcttttaaacgctgaacaagaagctgttgatattcgtggcaaagcagaagtagatgctgaacacatcaaaaaaacagctaaacgtgaaagtaaagcaaatcgtaaagaattacttttagaagcaaaagaagaggcaagaaaatatcgtgaagagattgaacaagaatttaagtctgaaagacaagagcttaaacaactcgagacacgcttagcggagcgctccttaactcttgaccgtaaagatgaaaacctatcaagtaaagaaaaggtactagatagtaaagaacaaagtctgaccgataaatctaaacacattgatgagcggcaacttcaagtggaaaaacttgaagaggagaaaaaagcagaactggaaaaagttgctgcgatgacgattgcagaagcgcgtgaagtgattttaatggagacggaaaacaaactgacccatgaaattgcgacgcgcattcgagatgccgaacgtgacatcaaggaccgaacagttaaaacagccaaggacttgttagcgcaagccatgcaacgccttgctggtgagtatgtgactgaacaaactattaccagtgtccatctcccagacgacaacatgaagggccgaattattggacgtgaaggccgtaatattcgtactttagagagcttgactggcattgacgttattattgacgatactcctgaagttgttatcttatcaggatttgatcctattcgacgtgaaattgctcgtatgaccttggaatctctgattgctgatggtcgcatccatccagctcgtatcgaggaattggttgagaaaaatcgtcttgaaatggataatcgtattcgtgagtacggtgaagctgcagcctatgagattggtgcaccaaaccttcatcctgatttgattaaaatcatgggacgcctgcaattccgtacctcgtttggtcaaaatgtcctacgtcactctgttgaggttggtaagttagctggtattttagctggtgagttaggtgaaaatgttgctcttgcccgccgtgctggtttcttgcatgatatgggtaaagctattgaccgtgaggttgaaggcagtcacgttgagattggaatggaatttgcacgtaaatacaaagaacatccagttgttgtcaacactattgctagccaccacggagatgtggagccagattctgtgatcgctgtgctagtagctgcagcagacgctctcagttcggctcgtccaggcgctcgtaatgagtcaatggagaattacatcaagcgtcttcgtgatttagaagaaatcgcgacaagttttgatggggtacaaaatagttttgctctacaagctggacgtgagattcgtattatggttcaacctgaaaaaatttcagatgatcaggttgtcattttgtcgcataaagtaagagaaaaaattgaaaacaatctagattacccaggaaatattaaagtaactgttattcgtgagatgagagcggttgattatgccaag

SEQ ID NO: 2980 - protein, 535 aa, Streptococcus pyogenes
MVNIILLIVSALIGLILGYALISIRLKSAKEAAELTLLNAEQEAVDIRGKAEVDAEHIKKTAKRESKANRKELLLEAKEEARKYREEIEQEFKSERQELKQLETRLAERSLTLDRKDENLSSKEKVLDSKEQSLTDKSKHIDERQLQVEKLEEEKKAELEKVAAMTIAEAREVILMETENKLTHEIATRIRDAERDIKDRTVKTAKDLLAQAMQRLAGEYVTEQTITSVHLPDDNMKGRIIGREGRNIRTLESLTGIDVIIDDTPEVVILSGFDPIRREIARMTLESLIADGRIHPARIEELVEKNRLEMDNRIREYGEAAAYEIGAPNLHPDLIKIMGRLQFRTSFGQNVLRHSVEVGKLAGILAGELGENVALARRAGFLHDMGKAIDREVEGSHVEIGMEFARKYKEHPVVVNTIASHHGDVEPDSVIAVLVAAADALSSARPGARNESMENYIKRLRDLEEIATSFDGVQNSFALQAGREIRIMVQPEKISDDQVVILSHKVREKIENNLDYPGNIKVTVIREMRAVDYAK

SEQ ID NO: 2981 - DNA, 147 bp, Streptococcus agalactiae
gtggaagtatccattccggaagtaggttcatctaaaaatagtaattggggcttaccaaccaaagttaaaacaaaagctaaaagtcgtttttgccctccagataaagtctctgtaaattgttgcaagtgcgtatcactccactgtaga

SEQ ID NO: 2982 - protein, 49 aa, Streptococcus agalactiae
MEVSIPEVGSSKNSNWGLPTKVKTKAKSRFCPPDKVSVNCCKCVSLHCR

SEQ ID NO: 2983 - DNA, 714 bp, Streptococcus agalactiae
atgattatagtaaaggagaaccaaatggcaaaagatataattaaggttgatcatatatttaaaagcatcgggcaaaaaacgattttagaagatatatcatttagtatagcttctaaccaatgtgtagcattgattggacctaatggtgcagggaaaacaactctgatgtcaactttgttaggtgatattagtatttcttcaggatcattgacgatttttaatctgcctgcacaccacaataggttaaaatataaggtggccatcttaccacaagaaaatgtattgccctcaaagtttacagtgagagaactcattgatttccaaaggtgtttatttccagaagtgctgccaatgtctctgattttagactatctacagtggagtgatacgcacttgcaacaatttacagagactttatctggagggcaaaaacgacttttagcttttgttttaactttggttggtaagccccaattactatttttagatgaacctacttccggaatggatacttccacacgtcaacgattttgggagctgattgcgacactaaaaaaagaaggtgtcacaattgtctattctagtcattatatcgaagaggtagaacatacagctgataggattttagtacttcataaaggaaagttattacgcgatacaacccccctttgccatgaagcaagaaaaaaccgaaaagttattcaccgttccgct

SEQ ID NO: 2984 - protein, 238 aa, Streptococcus agalactiae
MIIVKENQMAKDIIKVDHIFKSIGQKTILEDISFSIASNQCVALIGPNGAGKTTLMSTLLGDISISSGSLTIFNLPAHHNRLKYKVAILPQENVLPSKFTVRELIDFQRCLFPEVLPMSLILDYLQWSDTHLQQFTETLSGGQKRLLAFVLTLVGKPQLLFLDEPTSGMDTSTRQRFWELIATLKKEGVTIVYSSHYIEEVEHTADRILVLHKGKLLRDTTPLCHEARKNRKVIHRSA

SEQ ID NO: 2985 - DNA, 177 bp, Streptococcus agalactiae
ttgattacagagtgtgaagccaagagtgatagtataacgtttgttactggggaggctgaagctgtatggaaaatactggcagataatggttgtcctattgaagctattgagatgaccaatagaactttgttaaatcgtatttttgagactactaaggaggtaaaacatgagaatctt

SEQ ID NO: 2986 - protein, 59 aa, Streptococcus agalactiae
MITECEAKSDSITFVTGEAEAVWKILADNGCPIEAIEMTNRTLLNRIFETTKEVKHENL

SEQ ID NO: 2987 - DNA, 738 bp, Streptococcus agalactiae
atgagaatctttaaagcattattgaaaatggaatttcttttgacaaaacgtcaacttgccaatctcattatggctataggtatgccagtggctttttttctatttttttcaggatttatgggcgaaggactcactaaagccatcgaagctatctacgttcgtaattatatgataacgatggcaggattctcaagtcttagctttgctttttttacttttccattttctatgaaagatgatcaactctcaaaccgaatgcaattattaagacactcaccagtaccaatgtggcaatattatctagcaaaaattattcgtattttattttactattgcctagcaataactgttgttttcctaactgggcatattttaaggcaagttagtatgccaatagaacaatggatgcagagctttttattgctattaggaggagcaacatgttttattccttttggattgctcgtctcctactttaaaaatactgaactaatgtcaatggtagccaatatttgttatatgtcattagctgttcttggtggcatgtggatgccaattacaatgttcccaaaatggttgcaagctttatcaaagttaacccctacttaccatttgactcaagttatccttagtccgtttgctaatagttttgctggtttttctcttattattctgataggctatggtattataatgttagttatcgcttatctactatctcagaagaggcattcaatt

SEQ ID NO: 2988 - protein, 246 aa, Streptococcus agalactiae
MRIFKALLKMEFLLTKRQLANLIMAIGMPVAFFLFFSGFMGEGLTKAIEAIYVRNYMITMAGFSSLSFAFFTFPFSMKDDQLSNRMQLLRHSPVPMWQYYLAKIIRILFYYCLAITVVFLTGHILRQVSMPIEQWMQSFLLLLGGATCFIPFGLLVSYFKNTELMSMVANICYMSLAVLGGMWMPITMFPKWLQALSKLTPTYHLTQVILSPFANSFAGFSLIILIGYGIIMLVIAYLLSQKRHSI

SEQ ID NO: 2989 - DNA, 1083 bp, Streptococcus agalactiae
ttgaaaaataaaaaaaataactatgatttaatgtattttattccgttagtatttttgatttaccccataggagggattctctattatcactaccctttttggactttattttttacgctagcttttgtaggagcatatttatactctgttattatcaggggcgaatcaaagtatcacatgattgcctggtctacaatgttgacatatattttctacatgacaatttttataaatagtggtttcatctggtatatttactttctgagtaatttactcgtctatcgctttagagataaattgaagtcttttagattcattagttttgcttgtactctagccacagtggtatttttatgcttctttaaggcatcagactttggtgatagaatcatgtttctaattgttcctattttttgtatcggttacatgtggattgctattgaaaatagaaatagcgaagaacaaagagaaaaaattgcagagcaaaatcagtatatcaatattttgtcagctgaaaatgaacgtaaccgtatagggcgtgatttgcatgatagtttaggacatacatttgctatgatgacactaaagacagaactagcgttaaagttgttagaaaaaaggaactatgataaggtacaaaaagaactatcagaattaaatcatattagtcatcaatcgatgagtgaggtccgtcaaattgtttctaacctcaagtatcgtacagtagtggaagaaattgatgagttgtaccgcttgtttcaattatctaacattaagttaacagttgttaataagttagagacgtcacaactaagtccagtaacacaatctacaatcacaatgatattaaaggaattatccaataatattgttaagcatgctgaagctgatagcgtggagttgagtttagtaaggcaaggtgctactataaatattgagatgattgataatggttgtggttttacaaaccttgacggagatgagttgcatagtattcaagagagattaactatcgttgaagggacactaacgattttgtcccgaagtaaaccaactcatattcaggtggtattgaaagaggta

SEQ ID NO: 2990 - protein, 361 aa, Streptococcus agalactiae
MKNKKNNYDLMYFIPLVFLIYPIGGILYYHYPFWTLFFTLAFVGAYLYSVIIRGESKYHMIAWSTMLTYIFYMTIFINSGFIWYIYFLSNLLVYRFRDKLKSFRFISFACTLATVVFLCFFKASDFGDRIMFLIVPIFCIGYMWIAIENRNSEEQREKIAEQNQYINILSAENERNRIGRDLHDSLGHTFAMMTLKTELALKLLEKRNYDKVQKELSELNHISHQSMSEVRQIVSNLKYRTVVEEIDELYRLFQLSNIKLTVVNKLETSQLSPVTQSTITMILKELSNNIVKHAEADSVELSLVRQGATINIEMIDNGCGFTNLDGDELHSIQERLTIVEGTLTILSRSKPTHIQVVLKEV

SEQ ID NO: 2991 - DNA, 1002 bp, Streptococcus pyogenes
atgaaaaaacgttactatgctcttgtttggctctactcaaccattaccattttatctattgtttttgtggtcatggataatttaggaatcacttttaactaccttcgcaatcatttatggcaggtcgaacgtctagggttttcgattttattgttgattgtttctgtgactttattattgttgttattgtggattattatggatgataacagtaagcgtaacatcaaccaaaatctaaaatatattctcaataatcgacgactctatctagatgagacatcagaaatcaatactaatttaagtcgactttctaaaaaaatgtctcacctgactgctaacatgcaaaagaaagaaagtgcttatattcttgatagccaagaagttgtaaaacaagagcgcaaacgaattgcaagagatttacatgacacagtcagtcaagagctattcgcttcgtcattgattttatcaggaatttcgatgagtttggaacaactggacaaaacacaattacaaacacagttaacaacggttgaagcaatgttgcaaaatgctcaaaatgatctacgcattctccttttgcatcttagacctaccgagctagctaatcggactttatctgagggccttcatatgattcttaaggaattaacagataaaagtgatattgaagtcatttataaggaaaccattgctcagcttcctaaaacaatggaagataatctttttagaattgcccaagaattcattagcaacacgttaaaacatgctaaagctagtcgaattgaagtttatctcaatcaaacctcaacagaattacaattgaagatgattgatgatggtgtaggatttgatatggatcaggtaagggatttgagttatggtctgaagaatattgaagaccgtgtcaatgatttagcaggaaacctacatttaattagtcaaaaaggcaaaggagtttccatggatattagactgccgatagtgaagggagatgacgatgag

SEQ ID NO: 2992 - protein, 334 aa, Streptococcus pyogenes
MKKRYYALVWLYSTITILSIVFVVMDNLGITFNYLRNHLWQVERLGFSILLLIVSVTLLLLLLWIIMDDNSKRNINQNLKYILNNRRLYLDETSEINTNLSRLSKKMSHLTANMQKKESAYILDSQEVVKQERKRIARDLHDTVSQELFASSLILSGISMSLEQLDKTQLQTQLTTVEAMLQNAQNDLRILLLHLRPTELANRTLSEGLHMILKELTDKSDIEVIYKETIAQLPKTMEDNLFRIAQEFISNTLKHAKASRIEVYLNQTSTELQLKMIDDGVGFDMDQVRDLSYGLKNIEDRVNDLAGNLHLISQKGKGVSMDIRLPIVKGDDDE

SEQ ID NO: 2993 - DNA, 462 bp, Streptococcus agalactiae
atgaaattacttgttgctgaggatcagtccatgctacgagatgctatgtgccaattacttttgatggaagaaagtgtttctactattgatcaagctggaaatggtggagaagctattgccattttatccaataaagccatagatgttgcaatattggatgttgagatgccgatattatcaggtttagatgtcttagagtgggttagaaaataccagaatgttaaggtcataattgtaacaacctttaagcggtcaggttatttccaaagggctattcgttcaaatgtagatgcttatgttttgaaagaccgctcagtagctgatttgatgaaaacgattcaaaaagttttatctgggggtaaagaatattcgcctgaattaatggaaaacgttatatctaatcctttgagtgagcaagaaataaaaattctttccctaattgctcaagggaagaccagcaaa

SEQ ID NO: 2994 - protein, 154 aa, Streptococcus agalactiae
MKLLVAEDQSMLRDAMCQLLLMEESVSTIDQAGNGGEAIAILSNKAIDVAILDVEMPILSGLDVLEWVRKYQNVKVIIVTTFKRSGYFQRAIRSNVDAYVLKDRSVADLMKTIQKVLSGGKEYSPELMENVISNPLSEQEIKILSLIAQGKTSK

SEQ ID NO: 2995 - DNA, 645 bp, Streptococcus pyogenes
atgacgatgagtaagataaaagtgatattggtcgatgatcatgaaatggtccgcatgggactcaagagttttttgaatttacaagctgatattgatgtcgttggtgaggcctctaatggacgtgaaggggttgatttggcattggctttgaagccagatgttttggttatggatctagtgatgccagagttaggcggtgttgaggcaactttagaagtcctaaaaaaatggaaagaggctaaggtacttgtgttaacttcctatctagataatgaaaagatataccctgtcattgatgcaggagcgaagggttatatgttaaaaacatcgagtgcggctgaaattttaaatgccattcgcaaggtttcaaagggagagttagctattgaaacagaagttgacaaaaaaattaaggcgcatgatcaacaccctgacttgcatgaggaactaacagcgcgtgagtatgacattttacaccttttagctaaagggtatgataatcagaccatcgctgatgaactctttatttccttaaaaaccgtcaaaacacatgtgtccaatattctagccaagttagaagttggtgaccgaacccaagcggttgtctatgcttttcgacatcatttagtcccccaagacgataat

SEQ ID NO: 2996 - protein, 215 aa, Streptococcus pyogenes
MTMSKIKVILVDDHEMVRMGLKSFLNLQADIDVVGEASNGREGVDLALALKPDVLVMDLVMPELGGVEATLEVLKKWKEAKVLVLTSYLDNEKIYPVIDAGAKGYMLKTSSAAEILNAIRKVSKGELAIETEVDKKIKAHDQHPDLHEELTAREYDILHLLAKGYDNQTIADELFISLKTVKTHVSNILAKLEVGDRTQAVVYAFRHHLVPQDDN

SEQ ID NO: 2997 - DNA, 702 bp, Streptococcus agalactiae
atgcaaaaatttaaagaacgttttgatacgcttagtgatgcaattttggccattgctatgacgattttagttttggagataaaaactccggctacgatgggtgatattggtgactttacacggaacataggtttatttattgttagctttgttgttgtttttaatttttggtacgaaagggcacaaaatagcctagatgctcaaaagactaatgatgaaattatagctcttgatatcattgaacacctaggtatttgtttgattcctctctttactaaatttatgatttcttttgagaatcataattttgctgttatggcttatggactcttaacgttattagttggtctcacatcagacattattcggattcgtttggcaagttatgatttagtgaccattcctagtgaattgaaagagcgggttataaaagtcatgacaacttttgccattcgttcagttgtggttcgctttatcatcattatcctcgcttattttctacctgaggtagggatatttgcatatttagtcataccgctctttatgttttggcgtcgctctagagcaggaaaatactatgctaaaaagggcattgaggcaccatcttatatcaagctttttatccaaattggagagagagctcctgaggattttactaattcaagtagtggaataggtggggtaaaaagactctataaaaaa

SEQ ID NO: 2998 - protein, 234 aa, Streptococcus agalactiae
MQKFKERFDTLSDAILAIAMTILVLEIKTPATMGDIGDFTRNIGLFIVSFVVVFNFWYERAQNSLDAQKTNDEIIALDIIEHLGICLIPLFTKFMISFENHNFAVMAYGLLTLLVGLTSDIIRIRLASYDLVTIPSELKERVIKVMTTFAIRSVVVRFIIIILAYFLPEVGIFAYLVIPLFMFWRRSRAGKYYAKKGIEAPSYIKLFIQIGERAPEDFTNSSSGIGGVKRLYKK

SEQ ID NO: 2999 - DNA, 627 bp, Streptococcus agalactiae
atgtctgaacgtggtttgctaattgttttctcaggaccatctggtgttggtaaggggacagttaggcaagaaattttttcaacccctgaccataaatttgattattccgtttcaatgactactcgtccacaacgcccaggcgaagttgatggagttgattatttcttccgtacacgtgaagagtttgaagcgttgattaaagaaggtcaaatgcttgagtatgcggagtatgttggtaactactatggaactcctttaagttatgtcaacgagactttagacaaagggattgatgtttttcttgaaatagaagttcagggagcgcttcaagttaaatcgaaggttccggacggtgttttcattttcttaacaccaccagatttagaggaattagaagagcgtttagtaggacgtgggacagatagtccagaagtgattgcccaacgtattgaacgtgccaaagaagaaattgctttgatgagggagtatgactatgctgttgtcaatgatcaagtgtcattagcagcagaacgtgttaaacgtgtcattgaagcagaacattatcgtgtggatcgtgttattgggcgttataccaacatggtcaaagaaactgataaaaaattaagt

SEQ ID NO: 3000 - protein, 209 aa, Streptococcus agalactiae [sequence omitted]

SEQ ID NO: 3001 - DNA, 633 bp, Streptococcus pyogenes
atgtctgaacgcggtttgttaatcgtcttttctggcccttcaggtgtcggaaaaggaacggtaagacaagaaattttttcaacgccagatcataaatttgaatattcggtttcaatgacgactcgtccgcaaagaccgggcgaggttgatggggttgattatttcttccgcacacgtgaagaatttgaagaactcattaaaactggtcaaatgctagagtatgctgaatatgttggtaattactatggcacccctttaacttatgttaatgagactcttgataagggaattgatgtctttttagaaattgaagttcaaggagctcttcaggttaagtcaaaagtaccagatggtgtttttgtttttttaacaccaccagatttagatgaattagaagaccgcctggttggtcgtggtacagatagtcaagaagtcatagctcaacgtattgaaagagcaaaagaagaaattgcccttatgcgcgaatacgattatgcagttgttaatgatgaagttgccttggcagctgagcgggttaagcgtatcattgagacagaacactttcgtgtggagcgcgtgattggtcgttatgataaaatgattaaaataacaaaaaattcctttaaagctaaa

SEQ ID NO: 3002 - protein, 211 aa, Streptococcus pyogenes
MSERGLLIVFSGPSGVGKGTVRQEIFSTPDHKFEYSVSMTTRPQRPGEVDGVDYFFRTREEFEELIKTGQMLEYAEYVGNYYGTPLTYVNETLDKGIDVFLEIEVQGALQVKSKVPDGVFVFLTPPDLDELEDRLVGRGTDSQEVIAQRIERAKEEIALMREYDYAVVNDEVALAAERVKRIIETEHFRVERVIGRYDKMIKITKNSFKAK

SEQ ID NO: 3003 - DNA, 312 bp, Streptococcus agalactiae
atgatgttaaaaccttctatcgacactttgttggataaagttccttcaaaatattctttagttattttacaagctaagcgtgctcatgaattggaagctggtgagaaagccactcaagattttaaatctgtgaaatcaacacttcgcgctttagaagaaatcgagtcaggtaatgttgtaattcacccagatccatcagcaaaacgtgcctcagttcgcgctcgtatcgaagctgaacgccttgctaaagaagaagaagaacgtaaaatcaaagagcaaattgctaaagaaaaagaagacggcgaaaaaatt

SEQ ID NO: 3004 - protein, 104 aa, Streptococcus agalactiae
MMLKPSIDTLLDKVPSKYSLVILQAKRAHELEAGEKATQDFKSVKSTLRALEEIESGNVVIHPDPSAKRASVRARIEAERLAKEEEERKIKEQIAKEKEDGEKI

SEQ ID NO: 3005 - DNA, 315 bp, Streptococcus pyogenes
atgatgttaaaaccttccattgataccttattagataaagtaccatccaagtattcacttgtgattttacaagccaaacgtgcccatgaactagaagctggtgccactccaactcaagaatttaaatcagtgaagtcaacacttcaggcacttgaagaaattgaatcaggaaacgttgtgattcacccagatccttcagctaaacgtgaagctgtccgtgctaagattgaggcagaacgcttggccaaagaggaagaggaacgtaaaatcaaagaacaaattgccaaagaaaaagaagaagaaggagaaaaaatc

SEQ ID NO: 3006 - protein, 105 aa, Streptococcus pyogenes
MMLKPSIDTLLDKVPSKYSLVILQAKRAHELEAGATPTQEFKSVKSTLQALEEIESGNVVIHPDPSAKREAVRAKIEAERLAKEEEERKIKEQIAKEKEEEGEKI

SEQ ID NO: 3007 - DNA, 2388 bp, Streptococcus agalactiae
atggcaagaaaattagcacaggttattgttgatattcctctgatgcagacagataaaccattttcgtatgccattcctaaagatttggaagatttggtacaagtaggagtacgcgttcatgttccttttggaagaggaaatcgtcttttgcaaggctttgttgtcggtttcagagatgatgatgaattagagactaaggatattgcggaggtcctagattttgaacctgttttaaatcaggaacaactagacttagctgatcagatgcgccatactgtcttttcttataaaatatctattttgaaatcaatgttaccaagtcttttgaattcgcaatatgataaactcttgttagcaacagacacattaccatcagaagatagagaagatctatttggtcataaaacggaaattgtcttttcaagtttgtcttctcaagatgccaaaaaagcaggcagattaattcaaaaaggtttcatagaagttcaatatttagccaaagataagaaaacaataaaaacagaaaagatttacaaaatcaacagaactctgttagaaaagagccaaatagcagcaagagcgaaaaagagactggagttgaaagaattcctgttagaaaatcctcaaccagggcgcctcacagctttaaacaaacaattttcatctcctgtggttaattttttcagagaagaaggaatcattgaagtcattgaaaaagaagctagtagatctgataattattttaaaggaatcctaaaaacggattttttggatttaaatcaggaacaagctaaagtagttaaaatagttgttgaccaaattggtaaggaacagaataaacccttcttgttggaggggattacagggtctggtaagacagaggtatatcttcatatcattgataacgttttaaagttgggaaaaacagcgattgttctcgttccagaaatttctttaactccccagatgacgaatcgttttatttctcgttttggaaagcaagttgctattatgcactcgggcttgtcagaaggtgaaaaatttgatgagtggcgaaagataaaatcaggtcaagctaaagttgtcgttggagctcgttcagcaatttttgctcctttggaaaatatcggagccatcattatagatgaggaacatgaatcaacttataagcaagaatctaacccaaggtatcatgcgcgcgatgtggccttgctacgtgcagaatattataaagctgtgttactaatgggatcagcaactccaagtatcgaaagccgagctagagctagtcgggatgtttataaatttttagaattaaaacatcgtgctaatcctaaagcacgtattcctcaggttgaaattattgattttagaaattttattggtcaacaagaagttagtaatttcacatcatatttactagataaaatccgagatagattagataagaaagagcaagtggttcttatgctcaatcgtagaggttattctagttttattatgtgtcgagactgcggctacgttgatcaatgtcctaattgtgacatttctctgactttacatatggctacaaagaccatgaattgtcattattgtgggtttgaaaagcctattccaagaacatgtccaaattgcaatagtaaaagtatctcttactatggtactggaacccaaaaagcttatgaagaacttttgaaagttatcccagacgcaaagattttacggatggatgttgatacgacaaggcaaaaaggcggtcatgagtctattttgaagcgtttcggaaatcatgaagctgatattttattgggaacacagatgattgctaagggattggattttccaaatgttactttagttggagtactaaatgcagatacttctctgaatttacctgattttcgatcatcagagcgaacttttcagctattaactcaagtggctggacgtgctgggcgtgctgaaaaagaaggagaggttgtcattcaaacttataatcctaatcattatgctattcaattagcccaaaagcaagattttgaagctttttatcaatatgaaatgaatatccgtcgacaacttggttatcctccttattattttacagttggtttaacattatcgcataaagatgaagagtggttaatacgaaaatcttatgaagtattaagtttattgaagcaaggctttagtgataaagtaaagttgttaggtccaacgccaaaaccaattgcaagaacacataacctttatcactaccaaattattatcaagtatcgatttgaggacaaccttgaacttgttttgaatcgcttattagacatgactcaagacaaggagaatagagatcttcgcttagcaatagaccacgaaccgcaaaatatgatg

SEQ ID NO: 3008 - protein, 796 aa, Streptococcus agalactiae
MARKLAQVIVDIPLMQTDKPFSYAIPKDLEDLVQVGVRVHVPFGRGNRLLQGFVVGFRDDDELETKDIAEVLDFEPVLNQEQLDLADQMRHTVFSYKISILKSMLPSLLNSQYDKLLLATDTLPSEDREDLFGHKTEIVFSSLSSQDAKKAGRLIQKGFIEVQYLAKDKKTIKTEKIYKINRTLLEKSQIAARAKKRLELKEFLLENPQPGRLTALNKQFSSPVVNFFREEGIIEVIEKEASRSDNYFKGILKTDFLDLNQEQAKVVKIVVDQIGKEQNKPFLLEGITGSGKTEVYLHIIDNVLKLGKTAIVLVPEISLTPQMTNRFISRFGKQVAIMHSGLSEGEKFDEWRKIKSGQAKVVVGARSAIFAPLENIGAIIIDEEHESTYKQESNPRYHARDVALLRAEYYKAVLLMGSATPSIESRARASRDVYKFLELKHRANPKARIPQVEIIDFRNFIGQQEVSNFTSYLLDKIRDRLDKKEQVVLMLNRRGYSSFIMCRDCGYVDQCPNCDISLTLHMATKTMNCHYCGFEKPIPRTCPNCNSKSISYYGTGTQKAYEELLKVIPDAKILRMDVDTTRQKGGHESILKRFGNHEADILLGTQMIAKGLDFPNVTLVGVLNADTSLNLPDFRSSERTFQLLTQVAGRAGRAEKEGEVVIQTYNPNHYAIQLAQKQDFEAFYQYEMNIRRQLGYPPYYFTVGLTLSHKDEEWLIRKSYEVLSLLKQGFSDKVKLLGPTPKPIARTHNLYHYQIIIKYRFEDNLELVLNRLLDMTQDKENRDLRLAIDHEPQNMM

SEQ ID NO: 3009 - DNA, 2409 bp, Streptococcus pyogenes
atgtccatgacagaaaaggagaagcaaatggaaaaagtagctcatgtgattgtagatattccattgatgcaaacggacaagccattttcttatggtattccaaaagagttagtttctctcgtgcagcttggttctcgtgtgcatgttccttttggaaaagggaatcgtttgttgcaaggctttattattggttttggccaagaagattcaagctctcttaaactgattcagaccgttttagatcctgagccagtcctaaaccaagagcaattgacccttgctgatcagcttcgaaaaacagttttttcttataaaatcacgctcttaaaagcaatgattcctaatcttcttaactctaactatgataaagtgctaaggccagagtcaggtctaaaaaagtctgatagggactttctttttgaaggaaaaccatctgtcttatattctaccttagaccgcgagaaggaaaaaatagctcttaagggcatacaagctgggcatattactgttagttatttagccaaagacaagaaaaacctaaagacagaaaaatattatcacgtcgacttagacgccttagcggtacatcccatctctagtcgtgccaaaaagcgtcaattattaaaagactatctgctaacccatacgaaggaagctaaacttgcaacgctttatcaagccttttctagagatgtggtggcttactttgtgacaaatcacttaattcgtattgacgaacgtccaattgatcgcagtgagtcctattttgaccagatcaaaccatcttcttttttaaccttaaatgaacagcaggcgtcagctgttactgaaattgttgaacaaattgggaaaccgagtaaaccttttttgattgaagggattacaggttcgggtaagacagaagtttatcttcatatcatcgaagcggttttaaaacaggataagacagccattgttttagtgccagaaatttcgttgactcctcagatgacctctcgttttatttcccgtttcggaaagcaagtggctattatgcattcaggcttatcagatggtgaaaagtttgatgagtggcgcaagataaaaacaggacaggctaaggttgtggttggtgcccgctctgctattttctccccactagagcggattggtgcaattattatcgatgaggagcatgaatcaacctataaacaagaaagcaaccctagataccatgccagagaggttgccctgctcagagctaaacaccatcaagcagttgtggttatgggctctgctacgccaagtattgaaagccgagcaagggctagtaagggtgtctatcattttattcaattaacgcaaagagcaaaccctcttgctaagattccagaagtaacgattgttgattttcgtgattatattggacagcaagcagttagtaattttaccccatatttgattgataagattaaagaacgtttggttaaaaaagaacaagttgtcttaatgttaaatagacgtggttattctagttttgtgatgtgtcgggactgtggttatgtggacaaatgtcccaactgtgatatctctttaacccttcacatggatactaaaactatgaattgccattactgtgggtttcaaaaacctatcccaattacttgtcctgagtgtcatagcaatagtatccgctattatggcactggaactcaaaaagcttttgatgaattgcaaggggttattccagaagctaagatcttgagaatggatgttgacaccacacgaaaaaaaagaagtcacaaaaccatactagatagttttggtcgccaggaagcagatattttgttagggacgcaaatgattgccaaaggactggattttccaaatgtgactttagttggggtactaaatgcagatacttccttaaatttgccggattttcgagcgtcagaaaaaacgtttcaattgttaacacaggttgctggtcgggcaggccgtgcccataagccaggagaggtcttgattcaaacttataatcccgatcactatgctattcaattagctaagaaacaagattttgaagctttttaccgttatgagatgtctattcgtcatcaaatggcttatcccccttactactttacagtgggtattacgctttcgcatcgtttagaagcatcggttgtaaaaaaagcttatcaagttacagaactgctaaagagtcacttatcggataatattaaaatattaggaccgactcctaagccaattgctagaacacacaatttataccactatcaaattttgttaaaataccgttttgaagataacctagaagagacgctcaatcgtattcttgattggagtcaagaagcagataatcgtcatttaaaactaattattgattgtgaaccgcaacaattttta

SEQ ID NO: 3010 - protein, 803 aa, Streptococcus pyogenes
MSMTEKEKQMEKVAHVIVDIPLMQTDKPFSYGIPKELVSLVQLGSRVHVPFGKGNRLLQGFIIGFGQEDSSSLKLIQTVLDPEPVLNQEQLTLADQLRKTVFSYKITLLKAMIPNLLNSNYDKVLRPESGLKKSDRDFLFEGKPSVLYSTLDREKEKIALKGIQAGHITVSYLAKDKKNLKTEKYYHVDLDALAVHPISSRAKKRQLLKDYLLTHTKEAKLATLYQAFSRDVVAYFVTNHLIRIDERPIDRSESYFDQIKPSSFLTLNEQQASAVTEIVEQIGKPSKPFLIEGITGSGKTEVYLHIIEAVLKQDKTAIVLVPEISLTPQMTSRFISRFGKQVAIMHSGLSDGEKFDEWRKIKTGQAKVVVGARSAIFSPLERIGAIIIDEEHESTYKQESNPRYHAREVALLRAKHHQAVVVMGSATPSIESRARASKGVYHFIQLTQRANPLAKIPEVTIVDFRDYIGQQAVSNFTPYLIDKIKERLVKKEQVVLMLNRRGYSSFVMCRDCGYVDKCPNCDISLTLHMDTKTMNCHYCGFQKPIPITCPECHSNSIRYYGTGTQKAFDELQGVIPEAKILRMDVDTTRKKRSHKTILDSFGRQEADILLGTQMIAKGLDFPNVTLVGVLNADTSLNLPDFRASEKTFQLLTQVAGRAGRAHKPGEVLIQTYNPDHYAIQLAKKQDFEAFYRYEMSIRHQMAYPPYYFTVGITLSHRLEASVVKKAYQVTELLKSHLSDNIKILGPTPKPIARTHNLYHYQILLKYRFEDNLEETLNRILDWSQEADNRHLKLIIDCEPQQFL

SEQ ID NO: 3011 - DNA, 933 bp, Streptococcus agalactiae
atgacaaaattattattcatggggacccctgatttttcagcgacggttttaaaaggtattttagcagatggtaagtatgatgttttagctgttgtgacgcaaccagatcgtgctgtaggtcgtaaaaaagaaattaaaatgacccctgtaaaagaagtggccttggaaaacaacattcctgtgtatcagccggaaaaactatctggaagtccagaattagaacaactaatgaccctaggtgcagatggtattgtaacagctgcttttggtcaattcttaccaacaaagcttttggaatcggtaggttttgcaattaatgtacatgcttctctattgccaaaatatcgtggtggggcaccaattcattatgccattattaatggcgaaaaagaagctggggttaccatcatggaaatggttgcaaagatggatgcaggggatatggtatcaaaagcttccgttgagataactgatgaagacaatgtagggacaatgtttgatagactcgccgttgttggtcgtgaccttttattagatacgcttccaggttatctatcaggtgatattaagccgataccacaaaatgaagaagaggtaagtttttctcctaatattagtccagatgaagagagaattgattggaataaatcatcgcgcgacatttttaaccatgttcgagggatgtatccatggccagttgcacatacccttttggagggaaatcgttttaaactttatgaagtaacaatgtcagaaggaaagggctcaccgggtcaagtgatcgctaagacaaagaactcattgacagtagcaactggtgacggagctattgaactcaaatcagttcaaccagcagggaaacctcgtatggatataaaagactttttaaatggtgttggtcgtaatttagaaataggagataaatttggcgaa

SEQ ID NO: 3012 - protein, 311 aa, Streptococcus agalactiae
MTKLLFMGTPDFSATVLKGILADGKYDVLAVVTQPDRAVGRKKEIKMTPVKEVALENNIPVYQPEKLSGSPELEQLMTLGADGIVTAAFGQFLPTKLLESVGFAINVHASLLPKYRGGAPIHYAIINGEKEAGVTIMEMVAKMDAGDMVSKASVEITDEDNVGTMFDRLAVVGRDLLLDTLPGYLSGDIKPIPQNEEEVSFSPNISPDEERIDWNKSSRDIFNHVRGMYPWPVAHTLLEGNRFKLYEVTMSEGKGSPGQVIAKTKNSLTVATGDGAIELKSVQPAGKPRMDIKDFLNGVGRNLEIGDKFGE

SEQ ID NO: 3013 - DNA, 933 bp, Streptococcus pyogenes
atgataaaattattatttatgggaactccccaattttcagcaactgtattgaagggcttgctagataatcctgcctatgagattttaggagtggttactcagcctgatcgagctgttggacgcaaaaaagatattaaggtaacacctgtaaagcaattagctcttgagcatggaatatcaatctatcagccggaaaaattatcaggctctcaagaactcattgagattatgggacttggtgcagatggtattattacagcagcatttggccaatttttaccaacaatattacttgattcagtttcatttgctattaatgtacatgcatcattgttacctaaatatcgaggtggagcacctatccattatgctattatgaatggagataaagaggccggcgttactattatggaaatgattaaagaaatggatgcaggtgacatggtcgctaaagcaagcactccaattcttgaaaccgataatgtaggtactctttttgagaaattagccatcattggtcgagacttacttttggatagtttgccagcttatctttctggagaattaaaacctattcctcaagatcacagccaagctactttttcacctaatatctctccagaacatgaaaaattagattggacaatgtctaatcaagaagtgttcaatcatattcgaggtatgaacccttggccggtagcgcatacgtttttagaggggcaacgtttaaaaatttacgaagctcaactagctgaaggagagggattacctggacaagttgttgtcaaaaccaaaaaatctttggtaatagctactggacaaggtgctttgtccttgatcgttgtgcaaccggctggtaaacctaaaatgtcaataatagactttttaaacggcattggtagaaaacttgaagtaggggacatcattggcaga

SEQ ID NO: 3014 - protein, 311 aa, Streptococcus pyogenes
MIKLLFMGTPQFSATVLKGLLDNPAYEILGVVTQPDRAVGRKKDIKVTPVKQLALEHGISIYQPEKLSGSQELIEIMGLGADGIITAAFGQFLPTILLDSVSFAINVHASLLPKYRGGAPIHYAIMNGDKEAGVTIMEMIKEMDAGDMVAKASTPILETDNVGTLFEKLAIIGRDLLLDSLPAYLSGELKPIPQDHSQATFSPNISPEHEKLDWTMSNQEVFNHIRGMNPWPVAHTFLEGQRLKIYEAQLAEGEGLPGQVVVKTKKSLVIATGQGALSLIVVQPAGKPKMSIIDFLNGIGRKLEVGDIIGR

SEQ ID NO: 3015 - DNA, 1320 bp, Streptococcus agalactiae
ttggcgaatgattggaaaaagagtgcgcgtggtttagctttaatgactttagaggaagtttttgataaaggagcttattctaatatcgcacttaataagagtttaaaaaaatctagactatcagataaagatcgtgccttagtaacagaaattgtctatggaactgtggctagaaaaataacgctagaatggtatctatcacactttatagttgatcgtgataagcttgaattatgggtatatcatctcttgctactgagcctttatcaactactctatctggacaacatcccagatcacgctattgttaatgatgctgtcactattgctaagaatcgaggcaataaaaagggtgctgaaaagttaattaatgccgttttacgaagagtaagttcggagacgctccctgaaattgcatcaataaaacgccaaaacaaacgttactctgttgcttattccatgccagtgtggctcgtaaaaaaattaattgaccaatatggtgagacaagagctttagctattatggagagtttatttgagcgaaataaagccagtcttcgtgtgactgacttatcgcaaaaacaaactatcaaagaaactttaaatgttagagattcacatattgcagagacagctttagttgcagactcaggaaattttgcatcgacatcatttttccaagatggcctcattactatccaagatgaatctagtcaattagttgctccaacactcaaagtctcaggtaatgaccaagtattggatgcatgtagtgcaccaggaggaaaaacaagtcatatcgcctcatatttgactacaggggcagtaactgctttagatttgtatgatcataaattggaattggttatggaaaatgcaaaacgcctaggtctgtcagataagataaaaactaaaaagttagatgcaagtaaagctcatgagtattttcttgaggatacttttgacaaaattttagtagacgcaccttgttcaggtatcgggctaattcgccgtaaaccagatattaagtacaataaagctaatcaagactttgaagcactccaagagattcaattgtctatcctatctagcgtttgtcaaacgctacgtaaaggtggtataataacctatagcacttgtaccatttttgaggaagaaaattttcaagttattgaaaaattcttagaaaaccaccccaattttgagcaagtagaactgagtcatacacaagaggatattgtaaagagaggctgtattagtataagccctgaacaatatcatacagatggcttttttattggacaagtcaaacgtatcttg

SEQ ID NO: 3016 - protein, 440 aa, Streptococcus agalactiae
MANDWKKSARGLALMTLEEVFDKGAYSNIALNKSLKKSRLSDKDRALVTEIVYGTVARKITLEWYLSHFIVDRDKLELWVYHLLLLSLYQLLYLDNIPDHAIVNDAVTIAKNRGNKKGAEKLINAVLRRVSSETLPEIASIKRQNKRYSVAYSMPVWLVKKLIDQYGETRALAIMESLFERNKASLRVTDLSQKQTIKETLNVRDSHIAETALVADSGNFASTSFFQDGLITIQDESSQLVAPTLKVSGNDQVLDACSAPGGKTSHIASYLTTGAVTALDLYDHKLELVMENAKRLGLSDKIKTKKLDASKAHEYFLEDTFDKILVDAPCSGIGLIRRKPDIKYNKANQDFEALQEIQLSILSSVCQTLRKGGIITYSTCTIFEEENFQVIEKFLENHPNFEQVELSHTQEDIVKRGCISISPEQYHTDGFFIGQVKRIL

SEQ ID NO: 3017 - DNA, 1320 bp, Streptococcus pyogenes
ttggcagataattggaaaaaaagtacgcgaggcaaagccctccttgtcattgaagctatttttgatcagggggcttacacaaacatagcgcttaatcagcaactaagcaataaagctttatctgctaaggacagagctctattaactgagattgtatatggtaccgtttcacgtaaaattagcttggaatggtatttagcccattatgtcaaagaccgagataaattggacaaatgggtttattatctccttatgctcagtctttatcaactgacttatttagataagttaccagcgcatgccattgttaacgatgcggttggtattgccaaaaatcgtggcaataaaaaaggtgcagagaagtttgtcaatgctattttacgtcaattcaccagccatcctctcccagatatggaaacaattaagcgtcgaaataagtattattcggtcaagtattcactgcctgtttggttggttaaaaagttagaagaccaatttggttctgacagatcagtggccatcatggaaagtttatttgtgcgtagtaaggctagtattcgcgtgacagaccctttgaagctagaggaagttgctgaggctttagatgcagaacgttcccttttatcagcaactggtttaaccaaagcgtcaggtcattttgcagccagtgattatttcacaaatggggacatcactattcaagatgaaagcagtcagcttgtagctcctactttaaacattgacggtgacgacataattcttgatgcgtgtagcgctccagggggcaagacctctcatatagcatcttacttaaaaacaggtaaagttattgccttagatctctatgatcataaactagagttggtgaaggaaaatgctaaccgcttaggagttgctgataacattgagacaagaaaactagatgccagagaggttcatcgtcattttgaaaaggatagctttgataagattttggtggatgctccttgctcaggaattggtttgattcgtcgaaaacccgatatcaaatataataaagaaagtcaaggtttcaatgctctgcaagctatccagctagagatattgtctagtgtttgtcaaaccttgcgtaaaggtggtataataacatacagtacttgcactatttttgatgaggagaatcgtcaagtcatcgaagcatttttacagagtcatcctaattttgaacaagtaaaactgaaccatacacaagcagatattgtcaaggatggttatcttattatcacaccagaacaataccagactgatggcttctttattggacaagtcagacgagtcttg

SEQ ID NO: 3018 - protein, 440 aa, Streptococcus pyogenes
LADNWKKSTRGKALLVIEAIFDQGAYTNIALNQQLSNKALSAKDRALLTEIVYGTVSRKISLEWYLAHYVKDRDKLDKWVYYLLMLSLYQLTYLDKLPAHAIVNDAVGIAKNRGNKKGAEKFVNAILRQFTSHPLPDMETIKRRNKYYSVKYSLPVWLVKKLEDQFGSDRSVAIMESLFVRSKASIRVTDPLKLEEVAEALDAERSLLSATGLTKASGHFAASDYFTNGDITIQDESSQLVAPTLNIDGDDIILDACSAPGGKTSHIASYLKTGKVIALDLYDHKLELVKENANRLGVADNIETRKLDAREVHRHFEKDSFDKILVDAPCSGIGLIRRKPDIKYNKESQGFNALQAIQLEILSSVCQTLRKGGIITYSTCTIFDEENRQVIEAFLQSHPNFEQVKLNHTQADIVKDGYLIITPEQYQTDGFFIGQVRRVL

SEQ ID NO: 3019 - DNA, 735 bp, Streptococcus agalactiae
atggaaatatctcttttaacagatattgggcaacgtcgttccaataatcaagattttattaatcaatttgaaaataaagccggcgtcccactaatcatcttagcagatggtatgggaggacatcgtgcaggaaatattgctagcgagatgactgtaactgatctaggaagtgattgggcggagacagatttttctgagttatcagaaattcgtgattggatgcttgtctctattgaaacagagaatcgcaaaatatatgaattaggtcagtcagatgattacaaaggtatgggaactaccattgaagcagttgccattgtaggagataatattattttcgcacatgtaggagattcacgtatcggtatcgttcgtcaaggagagtatcatttattgacgagtgatcattctcttgttaatgaattggtaaaagctggccaattaacagaagaagaagctgctagtcatcctcaaaaaaatattattacgcaatcaattggtcaagccaatccagtcgaacctgatttaggagttcatctacttgaagaaggtgactaccttgtagttaatagtgatggactaactaatatgttgagtaatgccgatattgctacagtactaacacaagaaaaaaccttagatgataagaatcaagatttaatcactctagcaaaccatagaggaggtcttgataatatcactgtggcactagtttacgttgaaagtgaggcggtt

SEQ ID NO: 3020 - protein, 245 aa, Streptococcus agalactiae
MEISLLTDIGQRRSNNQDFINQFENKAGVPLIILADGMGGHRAGNIASEMTVTDLGSDWAETDFSELSEIRDWMLVSIETENRKIYELGQSDDYKGMGTTIEAVAIVGDNIIFAHVGDSRIGIVRQGEYHLLTSDHSLVNELVKAGQLTEEEAASHPQKNIITQSIGQANPVEPDLGVHLLEEGDYLVVNSDGLTNMLSNADIATVLTQEKTLDDKNQDLITLANHRGGLDNITVALVYVESEAV

SEQ ID NO: 3021 - DNA, 738 bp, Streptococcus pyogenes
atgaagatttcattaaaaacagacattgggcaaaaacgctcaaacaatcaagattttatcaataagtttgataataaaaaaggcatcactttagtgattttagcagacggtatgggtggccacagagctggaaatattgccagtgagatgacagtcacagacctgggaagagaatgggtaaaaacagacttcacagagttaagtcagattagagattggttatttgaaactatccagtcagaaaatcaacggatttatgatctaggccaatcagaagactttaaaggaatgggaacgactgttgaagcagtagctttagttgaatctagcgccatttatgctcatattggtgattcacggattggtcttgtccatgatgggcattataccttattgaccagtgatcattctttagtgaatgagttggttaaggcaggacagatcacagaagaagaagctgctagccatccacaaagaaatattatcactcaatctattggtcaagcttccccagtagagcctgatttaggagtgagggttttggagccaggggattatcttgtcattaacagtgatggtctaaccaatatgatttcaaatgatgaaattgtgactatcttgggcagtaaggttagtcttgatgaaaaaaaccaagaaatgattgacttagctaacctaagaggaggcctagataatattacaatcgctttggttcataacgaaagtgaggacgtcgaa

SEQ ID NO: 3022 - protein, 246 aa, Streptococcus pyogenes
MKISLKTDIGQKRSNNQDFINKFDNKKGITLVILADGMGGHRAGNIASEMTVTDLGREWVKTDFTELSQIRDWLFETIQSENQRIYDLGQSEDFKGMGTTVEAVALVESSAIYAHIGDSRIGLVHDGHYTLLTSDHSLVNELVKAGQITEEEAASHPQRNIITQSIGQASPVEPDLGVRVLEPGDYLVINSDGLTNMISNDEIVTILGSKVSLDEKNQEMIDLANLRGGLDNITIALVHNESEDVE

SEQ ID NO: 3023 - DNA, 1953 bp, Streptococcus agalactiae
atgattcagattggcaaattatttgctggtcgttatcggatccttaaatcaatcggacgaggtggaatggcggatgtttatctagctcgagatctaattttagataatgaagaggtcgcaataaaagtattgcgaaccaattatcaaacagatcagattgcggttgctcgcttccagagagaagcacgagcaatggctgagctgacacatcctaatattgtcgctattcgtgatataggtgaagaagacggacagcagttcttagtaatggaatatgttgatggattcgatttaaaaaagtatattcaagacaatgcacccctatcaaataatgaagttgttcgaatcatgaatgaagtcctttcagccatgtcactggcacatcagaaaggtatcgtacaccgtgatttaaaacctcaaaatattttattaactaaaaaagggactgtaaaagttacagatttcggtattgcggtagcgtttgctgaaactagtttaacgcaaacgaattctatgttaggtagtgttcattatttatcgccagagcaggcgcgtggttcaaaagcgactgttcagagtgatatttatgccatgggaatcatgctttttgaaatgttaactggccatattccttatgatggggatagtgcagttactattgccctacagcacttccaaaaaccactaccatcaatccttgcagaaaataaaagcgttccacaagctttggaaaacattgtcattaaagcaacagctaaaaagctaacagatcgctataagacaacttatgagatgggacgtgatttatcaactgctctaagctcgacacgtcaccgtgaaccaaaacttgtttttaatgatactgagagtactaagacactacccaaagtaacatctacagtatcatctctaacgacagaacaactgttgcgtaatcaaaaacaggccaaaacaacagaaaaaataactcctgattctgcgagtaacgataaaacgaagtctaaaaagaaggcttctcatcgacttcttggtacaatcatgaaattattctttgcactctgtgttgtaggaataattgtatttgcttataaaattttagtaagtcctacgactattcgtgttccagatgttagcaacaaaacagtagctcaagcaaaaatgacattggaaaattctggattgaaagtaggagctattcgtaatattgagagtgatagtgtttcagaaggacttgtcgtaaaaacagaccctgctgcaggacgttctcgcagagaaggggctaaagttaatctttatattgccactccaaacaagagtttcactctaggtaattataaggaacataattacaaagatatcctcaaagatcttcaaggcaaaggtgttaaaaaatctttaatcaaggttaagcgtaaaattaataatgattatactactggtacaatcttagcacagtcgcttccagaaggaacatcttttaatcctgatggtaataagaaattaacacttacggttgctgttaatgatccaatgattatgcctgatgtaacaggtatgactgttggagaagtaatagaaaccttgacagacctcggattagatgcagataatcttgtcttctatcaaatgcaaaatggcgtttatcaaacagtagtaacacctccatcttcaagtaagatagcaagtcaggatccttattacggaggagaagttggattaaggagaggagataaagttaagctgtatcttcttggttctaaaacaacgaataactcatcatctacgccaatagattcttcggcttcaagctcaacaggaacaactacctcggattctgtaagctcatcaacggatgctagcacttctgatagtagtagcacttctacaagtagttcaacactaccaagtgatagtacaactaatacaggaacagctaacaatccattaactcaa

SEQ ID NO: 3024 - protein, 651 aa, Streptococcus agalactiae
MIQIGKLFAGRYRILKSIGRGGMADVYLARDLILDNEEVAIKVLRTNYQTDQIAVARFQREARAMAELTHPNIVAIRDIGEEDGQQFLVMEYVDGFDLKKYIQDNAPLSNNEVVRIMNEVLSAMSLAHQKGIVHRDLKPQNILLTKKGTVKVTDFGIAVAFAETSLTQTNSMLGSVHYLSPEQARGSKATVQSDIYAMGIMLFEMLTGHIPYDGDSAVTIALQHFQKPLPSILAENKSVPQALENIVIKATAKKLTDRYKTTYEMGRDLSTALSSTRHREPKLVFNDTESTKTLPKVTSTVSSLTTEQLLRNQKQAKTTEKITPDSASNDKTKSKKKASHRLLGTIMKLFFALCVVGIIVFAYKILVSPTTIRVPDVSNKTVAQAKMTLENSGLKVGAIRNIESDSVSEGLVVKTDPAAGRSRREGAKVNLYIATPNKSFTLGNYKEHNYKDILKDLQGKGVKKSLIKVKRKINNDYTTGTILAQSLPEGTSFNPDGNKKLTLTVAVNDPMIMPDVTGMTVGEVIETLTDLGLDADNLVFYQMQNGVYQTVVTPPSSSKIASQDPYYGGEVGLRRGDKVKLYLLGSKTTNNSSSTPIDSSASSSTGTTTSDSVSSSTDASTSDSSSTSTSSSTLPSDSTTNTGTANNPLTQ

SEQ ID NO: 3025 - DNA, 1896 bp, Streptococcus pyogenes
atgattcagattggcaaattatttgctggtcgttatcgcattctgaaatctattggccgcggtggtatggcggatgtttatttagcaaatgacttgatcttggataatgaagacgttgcaatcaaggtcttgcgtaccaattatcaaacagatcaggtagcagttgcgcgtttccaacgagaagcgcgggccatggctgaattgaaccatcccaatattgttgccatccgggatataggtgaagaagacggacagcaatttttagtaatggaatatgtggatggtgctgacctaaagagatacattcaaaatcatgctccattatctaataatgaagtggttagaattatggaagaagtcctttctgctatgactttagcccaccaaaaaggaattgtacacagagatttaaaacctcaaaatatcctactaactaaggagggtgttgtcaaagtaactgatttcggcatcgcagtagcctttgcagaaacaagcttgacacaaactaattcgatgttaggcagtgttcattacttgtctccagaacaggctcgcggctccaaagcgacgattcaaagtgatatttatgcgatggggattatgctctttgagatgttgacaggccatatcccttatgacggcgatagtgctgttacgattgccttgcaacattttcaaaagcctcttccatctattatcgaggagaaccacaatgtgccacaagctttggagaatgttgttattcgagcaacagccaagaaattaagtgatcgttacgggtcaacctttgaaatgagtcgtgacttaatgacggcgcttagttataatcgtagtcgggagcgtaagattatctttgagaatgttgaaagtaccaaacccctccccaaagtggcctcaggtcccaccgcttctgtaaaattgtctccccctaccccaacagtgttaacacaggaaagtcgattagatcaaactaatcaaacagatgctttacagccccccaccaaaaagaaaaaaagtggtcgttttttaggtactttattcaaaattcttttttctttctttattgtaggtgtagcactctttacttatcttatactaactaaaccaacttctgtgaaagttcctaatgtagcaggcactagtcttaaagttgccaaacaagaactgtatgatgttgggctaaaagtgggtaaaatcaggcaaattgagagtgatacggttgctgagggaaatgtagttagaacagatcctaaagcaggaacagctaagaggcaaggctcaagcattacgctttatgtgtcaattggaaacaaaggttttgacatggaaaactacaaaggactagattatcaagaagctatgaatagtttgatagaaacttatggtgttccaaaatcaaaaatcaaaattgagcgcattgtaactaatgaatatcctgaaaatacagtcatcagtcaatcgccaagtgcgggtgataaatttaatccaaacggaaagtctaaaattacgctcagtgttgctgttagtgatacgatcactatgcctatggtaacagaatatagttatgcagatgcagtcaataccttaacagctttaggtatagatgcatctagaataaaagcttatgtgccaagctctagctcagcaacgggctttgtgccaattcattctcctagttctaaagctattgtcagtggtcaatctccttactatggaacgtctttgagtctgtctgataaaggagagattagtctttacctttatccagaagaaacacactcttctagtagctcatcgagttcaacgtcaagttcaaacagttcttcaataaatgatagtactgcaccaggtagcaacactgaattaagcccatcagaaactacttctcaaacacct

SEQ ID NO: 3026 - protein, 632 aa, Streptococcus pyogenes
MIQIGKLFAGRYRILKSIGRGGMADVYLANDLILDNEDVAIKVLRTNYQTDQVAVARFQREARAMAELNHPNIVAIRDIGEEDGQQFLVMEYVDGADLKRYIQNHAPLSNNEVVRIMEEVLSAMTLAHQKGIVHRDLKPQNILLTKEGVVKVTDFGIAVAFAETSLTQTNSMLGSVHYLSPEQARGSKATIQSDIYAMGIMLFEMLTGHIPYDGDSAVTIALQHFQKPLPSIIEENHNVPQALENVVIRATAKKLSDRYGSTFEMSRDLMTALSYNRSRERKIIFENVESTKPLPKVASGPTASVKLSPPTPTVLTQESRLDQTNQTDALQPPTKKKKSGRFLGTLFKILFSFFIVGVALFTYLILTKPTSVKVPNVAGTSLKVAKQELYDVGLKVGKIRQIESDTVAEGNVVRTDPKAGTAKRQGSSITLYVSIGNKGFDMENYKGLDYQEAMNSLIETYGVPKSKIKIERIVTNEYPENTVISQSPSAGDKFNPNGKSKITLSVAVSDTITMPMVTEYSYADAVNTLTALGIDASRIKAYVPSSSSATGFVPIHSPSSKAIVSGQSPYYGTSLSLSDKGEISLYLYPEETHSSSSSSSSTSSSNSSSINDSTAPGSNTELSPSETTSQTP

SEQ ID NO: 3027 - DNA, 693 bp, Streptococcus agalactiae
atgaaaaaatttcagttttttctacttgttgaagccgttgtcttagttatgggattaatgaaaattttatctgatgactggacaagttttatttttattctcgctttgattcttttagccttaagattttataacaacgatagtcgtcataattttctgttaacgacaagtttgttattactatttttaatctttatgcttaacccttacattattgcagccgttgtttttgcagttttgtatgttctaatcaatcatttctcgcaagttaagaaaaaaaatcgttatgctttgattcaatttaagaatcatcaattagatgttaagacaacacgaaaccaatggttaggtactgatcaacacgaaagtgacttttatgcttttgaagatattaatattataagaatctctgggactgatacaattgatttaacaaatgttattgtatctgggcaggataatgttattataattcaaaaagtttttggtgatactaaagtattggttcctttagacgttgccgtaaaggctgatattagttctgtttacggtagtgtacagtactttgattttgaggagtatgatctaagaaatgaatctataaaattgtcacaagaggaagaatattaccttttgaaacgtgtcaaattagttgtaaacactatcgctgggaaagttgaggttagtcgtaaa

SEQ ID NO: 3028 - protein, 231 aa, Streptococcus agalactiae
MKKFQFFLLVEAVVLVMGLMKILSDDWTSFIFILALILLALRFYNNDSRHNFLLTTSLLLLFLIFMLNPYIIAAVVFAVLYVLINHFSQVKKKNRYALIQFKNHQLDVKTTRNQWLGTDQHESDFYAFEDINIIRISGTDTIDLTNVIVSGQDNVIIIQKVFGDTKVLVPLDVAVKADISSVYGSVQYFDFEEYDLRNESIKLSQEEEYYLLKRVKLVVNTIAGKVEVSRK

SEQ ID NO: 3029 - DNA, 684 bp, Streptococcus pyogenes
atgcaattttccaggaattctgataaaatacaaagaaataaggggaaactaatgaaaaaatttcaattctttttacttatcgagtgtatactgctagctatgggtatcatgacaatcttggataatgatttatcaagttttatcctaattctagttcttatcttattagcattacgcttttataaccaagatagccgcaataattttttactaactgtcagtttattgtttctttttttaattttcatgcttaatccctacattatcatggctgttcttttggggatagtttacattttcattaaccatttttcacaagtcaaaaagaagaatcgctttgccttgattcgtttcaaggaagaaaagattgaagtgaacaataccaagcatcaatggattggtactgctaattatgaaagtgattattattgttttgatgacattaacatcattcgaatctcaggaaatgacacggttgacttaaccaatgttattgtgacaggaatggataatatcattgtgatacgtaaaatttttggaaatacgactatattggtacctattgatgtcactgttactttagatgttagttccatatacggaagcgttgatttttttagatgtcagcaatatgatttgcgcaacgaatctattaagtttaaagaaacggataaccaatccctt

SEQ ID NO: 3030 - protein, 228 aa, Streptococcus pyogenes
MQFSRNSDKIQRNKGKLMKKFQFFLLIECILLAMGIMTILDNDLSSFILILVLILLALRFYNQDSRNNFLLTVSLLFLFLIFMLNPYIIMAVLLGIVYIFINHFSQVKKKNRFALIRFKEEKIEVNNTKHQWIGTANYESDYYCFDDINIIRISGNDTVDLTNVIVTGMDNIIVIRKIFGNTTILVPIDVTVTLDVSSIYGSVDFFRCQQYDLRNESIKFKETDNQSL

SEQ ID NO: 3031 - DNA, 1017 bp, Streptococcus agalactiae
atgaaaaagcaccactactttttagctttcttctatggaagtgtcattatatttgccatttgttttgtcattattgatagtttgggtgttaatttggtgcacctctatcaaacgtctcgtttgtggctgattgaacaattgattttctctattttctttctatctttagcggtaactatccttttattgctaacttggtttttattagatgataatagtaaacgtcaaattaaccataatttacgtcgcattttaaataaccaatcaataaatgttaccgatgatggtactgaaatatcgaccaatattcaacggctctctaaaaaaatgaatttaatgacagcaagtctacaatctaaggaaaatagtcgtattttaaaaagccaagaaattgtgaaacaagaacgtaagcgtattgcacgtgatttacacgacacagttagtcaggatttgttcgctgcttccatggttttgtcagggatagcacagaatgtttctcagctagacgttgatcaggttggctcgcaattattagcagtagaagaaatgcttcagcatgcacaaaatgatttgagaattctgctacttcatttgaggccagttgaattagaaaataagaccctatctgaaggattcagaatgatattgaaagaattgaccgataagagcgacattgaagttgtttatcatgaatcaattctaaccttacccaaaaagattgaagacaatatttttagaattggtcaagaatttatcagtaatactttaaagcattcacaagccagtcgtctcgaagtttaccttaatcaaacagagaatgaattgcagttaaaaatgattgataatggtattggatttgatatggattctgtctatgatttaagttatgggttaaaaaatattgaagatcgagtagaagatttagcaggaaatttacagcttctcagtcagcctggtaaaggagttgctatggatataagattacctttagtaaatcagagtgaggataaaaatgga

SEQ ID NO: 3032 - protein, 339 aa, Streptococcus agalactiae
MKKHHYFLAFFYGSVIIFAICFVIIDSLGVNLVHLYQTSRLWLIEQLIFSIFFLSLAVTILLLLTWFLLDDNSKRQINHNLRRILNNQSINVTDDGTEISTNIQRLSKKMNLMTASLQSKENSRILKSQEIVKQERKRIARDLHDTVSQDLFAASMVLSGIAQNVSQLDVDQVGSQLLAVEEMLQHAQNDLRILLLHLRPVELENKTLSEGFRMILKELTDKSDIEVVYHESILTLPKKIEDNIFRIGQEFISNTLKHSQASRLEVYLNQTENELQLKMIDNGIGFDMDSVYDLSYGLKNIEDRVEDLAGNLQLLSQPGKGVAMDIRLPLVNQSEDKNG

SEQ ID NO: 3033 - DNA, 651 bp, Streptococcus agalactiae
gtgaggataaaaatggataaaataaaaattgtacttgttgatgaccatgagatggttcgtctcggtttaaaaagttttttaaacttacaagctgatgttgaagtaataggtgaggcctcaaatggtttagaaggcataaaaaaagcactggagttacgtccagacgttgttgttatggacttagtaatgcctgaaatggacggtgtagaagcaaccttagcattattgaaggattggccagaagctgccattttagtcttaacatcttacttggataatgaaaaaatttaccctgttattgaagcaggtgccaaaggctatatgttaaagacctcaagcgcagcagagattcttaatgccattcgtaaagtttcaaggggagaacaagctattgaaaatgaagtagataagaaaattaaggctcatgataaatgtccagctttacatgagggcttaacagcaagggaacgtgatatccttaatttattagccaaaggttatgacaatcaaaggattgctgatgaattatttatctcgttaaagactgttaaaactcatgtttctaatattttgggaaaactaaatgtagcagatcgaactcaagcagttgtctatgctttccaacaccatttggtaccacaagatgatgaa

SEQ ID NO: 3034 - protein, 217 aa, Streptococcus agalactiae
MRIKMDKIKIVLVDDHEMVRLGLKSFLNLQADVEVIGEASNGLEGIKKALELRPDVVVMDLVMPEMDGVEATLALLKDWPEAAILVLTSYLDNEKIYPVIEAGAKGYMLKTSSAAEILNAIRKVSRGEQAIENEVDKKIKAHDKCPALHEGLTARERDILNLLAKGYDNQRIADELFISLKTVKTHVSNILGKLNVADRTQAVVYAFQHHLVPQDDE

SEQ ID NO: 3035 - DNA, 1398 bp, Streptococcus agalactiae
atggacgcaaaaactaaatataaagcaaaaaaaataaaggcagtgttttttgatattgatgacacgcttcgtgttaaagatacaggttatatgccaccatcaatcttaaaagtttttaaagctttgaaagataaaggaatcgttgtaggtattgcttcaggaagagcacgatatggcgttccaaaagaagttcaagatttaaatgccgattattgtgtaaaattaaatggagcttacgttaaggacaaggataagaatattatcttccatcgtcctattccagctgaatatgtagagcaatataagaaatgggcggacactgttggtattaagtacggtttagctggtcgtcatgaggcagttttatcagatcgtgatgatttggtaaatgatgcgattgatattgtgtattctgatctcgaagttaatccagatttcaataaagaacatgatatttatcagatgtggacatttgaagataaaggagatagccttcatctacctgaaccgttagctgaacatcttcgcttgatacgttggcatgatcattcttcagatgttgtgttaaaaggaacatcgaaggctttaggtgtttctaaagttgttgaacatttgggcttaaagccagagaatatcttggttttcggagatgagctcaatgatttagaactctttgattatgctggactagctgtggcgatgggagtgtcacacccagaagctcaaaaaaaagcagattttatcacaaaaaaagtagaagaagatggcattttgtatgccctggaggaactaggtttgatagaaaaagaattaacatttccacaagtagatattgaaaatacagaaggtcctgtggctgtcattaaaacaaatcacggggatatgactgtaaaactcttcccggatcatgctcctaaaacggtagcaaactttattggtttagctaaacaaggttattatgatggtattatcttccatcgtattattccagattttatgattcagggtggtgatccaactggtacaggtatgggtggtgaatctatctatggggaaagttttgaagacgaattttccgaggaattatataatgttcgcggagctctttcaatggctaatgctggaccaaatacgaatggcagccaatttttcatcgtccaaaatacaaaaattccttatgcgaaaaaggaattagagcgaggtggttggccaacaccaattgctgagttgtatgctggacaaggtggtacaccgcatctagatcgtcgccacagtgtatttggacaattagtagaccaaagttcttttgaggtacttgatgagattgcggcagtagagactggttctcaagacaaaccattggaagatgttgttattttaacgattgaggttaaagaa

SEQ ID NO: 3036 - protein, 466 aa, Streptococcus agalactiae
MDAKTKYKAKKIKAVFFDIDDTLRVKDTGYMPPSILKVFKALKDKGIVVGIASGRARYGVPKEVQDLNADYCVKLNGAYVKDKDKNIIFHRPIPAEYVEQYKKWADTVGIKYGLAGRHEAVLSDRDDLVNDAIDIVYSDLEVNPDFNKEHDIYQMWTFEDKGDSLHLPEPLAEHLRLIRWHDHSSDVVLKGTSKALGVSKVVEHLGLKPENILVFGDELNDLELFDYAGLAVAMGVSHPEAQKKADFITKKVEEDGILYALEELGLIEKELTFPQVDIENTEGPVAVIKTNHGDMTVKLFPDHAPKTVANFIGLAKQGYYDGIIFHRIIPDFMIQGGDPTGTGMGGESIYGESFEDEFSEELYNVRGALSMANAGPNTNGSQFFIVQNTKIPYAKKELERGGWPTPIAELYAGQGGTPHLDRRHSVFGQLVDQSSFEVLDEIAAVETGSQDKPLEDVVILTIEVKE

SEQ ID NO: 3037 - DNA, 1410 bp, Streptococcus pyogenes
ttggaggaaagtatggacgcaaaactaaaatacaaagctaaaaaaatcaaaatggtgttctttgatattgatgataccttgagggtcaaagatacgggttatatgcctgagtcgattcaaagagtatttaaggctttgaaggcaaaaggcatcttggttggtattgcttcaggtcgcgctcggtacggtgttccacaagaagttcaagatttacatgctgactattgtgtcaaattaaatggagcttatgtcaaagacgatgctaaaactattattttccaagctccgattccagcagatgttgttgtggcctataaaaaatgggcggatgatatgggcattttttatggaatggcgggtcgtcatgaagcggtgttgtccgctcgaaatgacatgattagcaatgctattgataatgtctacgctcaactagaggtctgtccggattataatgagtatcatgatgtttaccagatgtggactttcgaggacaagggagatggcttgcagttgcctgctgaattagcagagcaccttcgtttggtcagatggcacgataactcatcagatgttgtcttgaaaggtacgtcaaaagcgctaggtgtttcaaaagtagttgaccatttaggattaaaacctgaaaatattttggtttttggagatgaactcaatgacctagagttatttgactatgctggtatcagtattgcaatgggagtatcacatccattactgcaagaaaaagcagattttatcacaaaaaaagttgaagaagatggcattttatatgccttggaggaattaggattgattgacaaagaattacagtttccacaattggatttgccaaaccataaaggaccaaaagcaaccattaaaacaaaccatggcgatatgaccctggtcttgttcccagatcatgctcctaaaacagtagccaatttcttaggtttggctaaagaagggtactatgatgggattatcttccaccgtattattcctgaatttatgattcaagggggcgatccaacaggaacaggaatgtgtggacaatccatctatggtgaaagttttgaagatgaattttcggatgaactctataatctccgtggggccttgtcgatggctaatgcgggaccaaatactaacggcagtcagttctttattgttcaaaatagtaagattccttatgccaaaaaagaactagaacgtggtggttggccggctccaattgcagcttcttacgctgcaaatggtggaactcctcaccttgatcgtcgtcatacggtctttggtcagcttgtggacgaaacttcattccaagttttggatttgattgctggcgttgaaactggcgcacaggataaacctaaagaagacgttatcattgaaacaatcgaggtatttgac

SEQ ID NO: 3038 - protein, 470 aa, Streptococcus pyogenes
LEESMDAKLKYKAKKIKMVFFDIDDTLRVKDTGYMPESIQRVFKALKAKGILVGIASGRARYGVPQEVQDLHADYCVKLNGAYVKDDAKTIIFQAPIPADVVVAYKKWADDMGIFYGMAGRHEAVLSARNDMISNAIDNVYAQLEVCPDYNEYHDVYQMWTFEDKGDGLQLPAELAEHLRLVRWHDNSSDVVLKGTSKALGVSKVVDHLGLKPENILVFGDELNDLELFDYAGISIAMGVSHPLLQEKADFITKKVEEDGILYALEELGLIDKELQFPQLDLPNHKGPKATIKTNHGDMTLVLFPDHAPKTVANFLGLAKEGYYDGIIFHRIIPEFMIQGGDPTGTGMCGQSIYGESFEDEFSDELYNLRGALSMANAGPNTNGSQFFIVQNSKIPYAKKELERGGWPAPIAASYAANGGTPHLDRRHTVFGQLVDETSFQVLDLIAGVETGAQDKPKEDVIIETIEVFD

SEQ ID NO: 3039 - DNA, 372 bp, Streptococcus agalactiae
ttgaggttaaagaataaaatgaagattggcgataagttaaagggaacagtcactggcattaggccttatggagcctttgtttctcttgaggatggtaggactggacttatccatatttctgaaattaaaacaggttacattgataatatttatgatgttcttagtgtaggtgatgaagtctatgttcaggttatagatgtagatgaatttacacaaaaagcaagtttatcgcttcggacccttgaagaagagagacatcatattcagcatcgtcatcgattttctaacaatcgtcttaagataggtttcaaaccacttgaggaaaatttacctagttgggttgaggaaggtctagcctacttgaataataaa

SEQ ID NO: 3040 - protein, 124 aa, Streptococcus agalactiae
MRLKNKMKIGDKLKGTVTGIRPYGAFVSLEDGRTGLIHISEIKTGYIDNIYDVLSVGDEVYVQVIDVDEFTQKASLSLRTLEEERHHIQHRHRFSNNRLKIGFKPLEENLPSWVEEGLAYLNNK

SEQ ID NO: 3041 - DNA, 375 bp, Streptococcus pyogenes
atgaaaattggcgacaaactgcatggcaccatcactgggattaaaccatacggagcctttgttgcccttgaaaatgggacaacaggtctcattcatatttcagaaataaaaacgggatttattgacgatattgatcaattattggctataggcaaccaggttttagtacaagtaattgatattgatgaatatagtaaaaagccaagtttatctatgcggaccttagcagaagaaaaacagcattttttccatcgtcatcgttattccaacagtcggcacaagattggctttaggccacttgaagagcagttacctcagtggattgaagaaagcctgcagtttttaaaaaagaacactaaaaagagtctggaacct

SEQ ID NO: 3042 - protein, 125 aa, Streptococcus pyogenes
MKIGDKLHGTITGIKPYGAFVALENGTTGLIHISEIKTGFIDDIDQLLAIGNQVLVQVIDIDEYSKKPSLSMRTLAEEKQHFFHRHRYSNSRHKIGFRPLEEQLPQWIEESLQFLKKNTKKSLEP

SEQ ID NO: 3043 - DNA, 774 bp, Streptococcus agalactiae
atgacaaatgaaaaaggtattgtattcaacattcaacattttagtattcacgatggtccaggtattcgaacaaccgttttcttaaagggttgtcctcttagatgtccttggtgtgctaatcccgagtcgcaaaaaatggttccagaaacaatgagagatgccattactaatgaaagcgtcatcgtgggcgaagaaaaatcggttgatgatattattgaagaagttttaaaagatattgatttttacgaagaatctggtgggggcataacgctatctggcggtgaaatatttgcacaatttgaatttgccaaggcaattttaaaacgtgctaaatcactgggaatccacacggctattgaaacaactgcttatactagacatgaacaattcatagatcttatccaatacgttgattttatttacaccgatttaaaacattacaatagcctcaaacaccaagaaaagacgatggttaagaatgcttcaatcatcaaaaacattcattatgcttttgccaacggtaaaacgattgtgctacgtattcctgtcatacctaattttaacgattcattagaagatgctgaagaatttgcttgtttatttgatcgcctagatatccgtcaagtgcaactcttacctttccaccaatttgggcaaaacaaatatcaattacttaatcgtcaatatgaaatggaagagatcgctgcactacacccagaggatctactcgattatcaagctatttttagcaagtataatattcactgctacttt

SEQ ID NO: 3044 - protein, 258 aa, Streptococcus agalactiae
MTNEKGIVFNIQHFSIHDGPGIRTTVFLKGCPLRCPWCANPESQKMVPETMRDAITNESVIVGEEKSVDDIIEEVLKDIDFYEESGGGITLSGGEIFAQFEFAKAILKRAKSLGIHTAIETTAYTRHEQFIDLIQYVDFIYTDLKHYNSLKHQEKTMVKNASIIKNIHYAFANGKTIVLRIPVIPNFNDSLEDAEEFACLFDRLDIRQVQLLPFHQFGQNKYQLLNRQYEMEEIAALHPEDLLDYQAIFSKYNIHCYF

SEQ ID NO: 3045 - DNA, 771 bp, Streptococcus pyogenes
atgactgatcgcggtattgttttcaacatccaacattttagtattcatgacggtcctggtattcggacaaccgtttttttaaaaggttgccccttgagatgtccatggtgtgccaatcccgaatcccaacaaaaagcgcctgagcagatgttaacaagtgatgggcttaatactaaaatagttggagaggaaaaaaccgtggacgaggtgatcgaagaagtccttaaagaccttgatttctacgaagagtcaggtgggggcatgaccctgtcagggggggaaatctttgctcagtttgactttgccttagccctgttaaaagcagccaaagcagcaggtcttcacaccgcaattgaaaccaccgcctttgccaaacacgagcaatttgtcacccttgttgactacgtggactttatctataccgatttgaaacattataatcagctcagacaccaaaaagtgactggggttcgtaatgacttgattatcaagaatattcattatgcctttcaagctggaaaagaaatcgtcttgcgcatccctgttattccccaatttaatgattccctagacgatgctaaagccttctcagagctctttaatcagcttgagattgaccaagtgcaactgttacctttccatcaatttggagaaaacaagtacaaacttctaggtagggagtatgagatggctgaggtcaaggcttatcatcccgaagatttagcagactatcaggctgttttcctcaaccataatattcattgctatttt

SEQ ID NO: 3046 - protein, 257 aa, Streptococcus pyogenes
MTDRGIVFNIQHFSIHDGPGIRTTVFLKGCPLRCPWCANPESQQKAPEQMLTSDGLNTKIVGEEKTVDEVIEEVLKDLDFYEESGGGMTLSGGEIFAQFDFALALLKAAKAAGLHTAIETTAFAKHEQFVTLVDYVDFIYTDLKHYNQLRHQKVTGVRNDLIIKNIHYAFQAGKEIVLRIPVIPQFNDSLDDAKAFSELFNQLEIDQVQLLPFHQFGENKYKLLGREYEMAEVKAYHPEDLADYQAVFLNHNIHCYF

SEQ ID NO: 3047 - DNA, 534 bp, Streptococcus agalactiae
atgaatagattagaaaatattattagtttagtatcccagtaccaaaaaatagatgttaatacactctcggagttgttgcaagtttctaaagtaacgatacgtaaagatttagataaactagaaggcaaagggcttttgcatagagagcacggttatgcagttttaaacagtggggatgaccttaatgttaggttatcttttaaccataaaactaaaaaagaaattgctgccttagctgcaaatatggtgtctgacaatgacactatcttaatagaatcaggctctacttgtgctcttttagcagaaaatatctgtcagacaaagcgaaatgtcactattttgaccaactcttgctttattgctaactatttacgagagtatgattcatgccaaattgtcttacttggtggtgagtatcaatcaagttcacaggttacggtaggtcctctcttgaaaaagatgatttcactttttcatgtctcgttagcttttgttgggactgatggttttgatccmaaaactaggatttatggg

SEQ ID NO: 3048 - protein, 178 aa, Streptococcus agalactiae
MNRLENIISLVSQYQKIDVNTLSELLQVSKVTIRKDLDKLEGKGLLHREHGYAVLNSGDDLNVRLSFNHKTKKEIAALAANMVSDNDTILIESGSTCALLAENICQTKRNVTILTNSCFIANYLREYDSCQIVLLGGEYQSSSQVTVGPLLKKMISLFHVSLAFVGTDGFDPKTRIYG

SEQ ID NO: 3049 - DNA, 747 bp, Streptococcus pyogenes
atgatgaatcgattagaacgtattattcaactggtttcccagaagaaaaaaatagatgttaacagtttatcagagcaattagacgtttcgaaagtaaccattcgaaaagaccttgataagcttgaaagtaagggcttgttgcgacgggaacatggctatgcggtgctaaacagtggcgatgacctcaatgtacgcttgtcctacaattacaacataaagcgacggattgcagaaaaagcagctgaattggtacaagacaacgataccattatgattgaatctggctcaacctgtgcccttttggcagaagtgctttgccagaccaaacgaaatattaaagtcattaccaattcgtgcttcattgccaactacattcgtcaatatagtagctgtcaaatcattttactgggcggttattaccagcccaattcagaggtgactgttggtcctttattgaaagaaatgatatccctttttcatgtcaatcgtgtctttgttggaacagacggtttcaacaaagatcttggctttatgggcaaggacatgatgcgctcagaaggggtgcgttacatggcagatgctgctgaggaagtggtgattctgaccgattccagcaagttttcaaaaaccagtctggtacaccagttgtcattagctgatgtcaatcgcgtcattacagaccaagcactagacaagcaaacacaagagttattaagtgctagtggtcttgttcttgattttgtttct

SEQ ID NO: 3050 - protein, 249 aa, Streptococcus pyogenes
MMNRLERIIQLVSQKKKIDVNSLSEQLDVSKVTIRKDLDKLESKGLLRREHGYAVLNSGDDLNVRLSYNYNIKRRIAEKAAELVQDNDTIMIESGSTCALLAEVLCQTKRNIKVITNSCFIANYIRQYSSCQIILLGGYYQPNSEVTVGPLLKEMISLFHVNRVFVGTDGFNKDLGFMGKDMMRSEGVRYMADAAEEVVILTDSSKFSKTSLVHQLSLADVNRVITDQALDKQTQELLSASGLVLDFVS

SEQ ID NO: 3051 - DNA, 246 bp, Streptococcus agalactiae
ttgatccmaaaactaggatttatgggtagagatttaatgcgttctgaagttgcacaagagatggcgaatgctgccgatgaagtcattattttaacagattctagtaagtttaatcagactgcattggtggaacagcttccgttgtcaactgtatcacaagttattacagataaacatccaaattcggaaattgctaatttgttccaagaagcagagattaccattcaatctttattacaagtacca

SEQ ID NO: 3052 - protein, 82 aa, Streptococcus agalactiae
  misc_feature (1)..(82): Xaa = Any Amino Acid
MIXKLGFMGRDLMRSEVAQEMANAADEVIILTDSSKFNQTALVEQLPLSTVSQVITDKHPNSEIANLFQEAEITIQSLLQVP

SEQ ID NO: 3053 - DNA, 987 bp, Streptococcus agalactiae
atgagtatgaaattagagcgtcaaaaattgttagctaaagtagcttacctttactatatggaagggaaaagccaatctgagattgccaatgaattaggaatttatcgtacaacaataagtcgtatgttagccaaagcgagagaagaaggtcttgttagaatcgaaatttcagattttaatccagaaatttttcagttagaatcctattttaaaagtaaatatcaccttaaagatattgagattgtttcttcgcgaaaagatagcgatacttcagagatagagaaggatttagcacatgtagctgcagctatgattcgaaaaaaaattaaagagaatgacaaggtggggattgcttgggggaggacacttagtaaagtagttgaagcaatgcgtcctcatccggtttctcaagtttcttttgttcctttggccggaggtccaagtcatattaatgcacgctatcacgttaatactctggtttacgaaatgtcaaggcgtttccaaggaagttgtactttcattaatgcaactctagttcaagaaaacgctaatttagcgaaaggaatattaacttcaaaatattttgaggggctaatggataattgggaaaaacttgatgtggcaattgtgggcgttggtggtaaacctaaaagcaatgaacaacagtggcttgaccttttaaatcaagatgattttcaatgcttggatgaagaagcagctgtaggtgaaattacttgtcgtttttttaatcattcaggtgatcctgtgaatcaacatttagctaaaaggacaataggaattaccttagaacaactacagaaagttcctaatagaatagcggttgctcatggcaattataaggctgcggcactcttagccgttttaaaaaaggggtatattaatcatttagttactgatttttccacagccttaaatattttaagattagataaagacacctttgtggatactatatatcaaaagagc

SEQ ID NO: 3054 - protein, 329 aa, Streptococcus agalactiae
MSMKLERQKLLAKVAYLYYMEGKSQSEIANELGIYRTTISRMLAKAREEGLVRIEISDFNPEIFQLESYFKSKYHLKDIEIVSSRKDSDTSEIEKDLAHVAAAMIRKKIKENDKVGIAWGRTLSKVVEAMRPHPVSQVSFVPLAGGPSHINARYHVNTLVYEMSRRFQGSCTFINATLVQENANLAKGILTSKYFEGLMDNWEKLDVAIVGVGGKPKSNEQQWLDLLNQDDFQCLDEEAAVGEITCRFFNHSGDPVNQHLAKRTIGITLEQLQKVPNRIAVAHGNYKAAALLAVLKKGYINHLVTDFSTALNILRLDKDTFVDTIYQKS

SEQ ID NO: 3055 - DNA, 978 bp, Streptococcus pyogenes
atgaaagaagaacgcagacggctccttgccaaggtggcttacttgcattatgttcaaggcaagagccaaaccttgatttcaaaggaaatgaatatctaccgaacaacggtttgtcggatgttagcaaaagccaaggaagaaggcattgttcggattgaaattgccgactatgatgctgatttatttgctttagaagaatacgtgcgacagcagtatggcttggaaaaactagaccttgtgcccaaccaggttgaagataccccaatggataccttgacaaatgttgctaaaacagcagctgaggtttttagacatgttgttaaagatggcgataagatcggtctgtcctggggagcgactctttcttgcttgatggatgagttaaatccaaaagcgatgaaagatgtgtttatttatcctttggcaggaggacctagccatattaatgccaaataccatgtcaataccctggtttaccgcttggctcgcatctttcatggtaatagcgcttttatgaacgctatggtcattcaagaagacaaacacttggctaagggaatcttacaatctaaatactttaacgacattttaacaagctgggaccagttagatcttgccttagtaggaattggtggggagcctaatagccttgagcagagccaatggcgtgatttattaaccagctcagatcatgaccaactcaaatatgaaaaagccgttggtgaagtttgttgccgtttctttgatcaggcaggtcagccagtttacactggcctacaggatcgaactattggtatttcactagaacagttgaggcgtgtccccaaaacaatggctgttgcaacaggtaaacacaaggctaaggcaatattggcagccttaaaagcaggttttatcaattatctagtgacggataaagagaccatgctagctgttttagcgttagatgaagatattgatcttaataacgttcttctt

SEQ ID NO: 3056 - protein, 326 aa, Streptococcus pyogenes
MKEERRRLLAKVAYLHYVQGKSQTLISKEMNIYRTTVCRMLAKAKEEGIVRIEIADYDADLFALEEYVRQQYGLEKLDLVPNQVEDTPMDTLTNVAKTAAEVFRHVVKDGDKIGLSWGATLSCLMDELNPKAMKDVFIYPLAGGPSHINAKYHVNTLVYRLARIFHGNSAFMNAMVIQEDKHLAKGILQSKYFNDILTSWDQLDLALVGIGGEPNSLEQSQWRDLLTSSDHDQLKYEKAVGEVCCRFFDQAGQPVYTGLQDRTIGISLEQLRRVPKTMAVATGKHKAKAILAALKAGFINYLVTDKETMLAVLALDEDIDLNNVLL

SEQ ID NO: 3057 - DNA, 327 bp, Streptococcus agalactiae
gtgcttatggaaatcatagtcgcagaccaaattattatggggctcattttgaatgctggggatgctaaacaacatatctatcaagccttaaaacttgcaaaagaaggaaattttgcagaaagtaagattgaaatagaactagcagatagtgcactcctagaagctcataatcttcaaacacaattccttgcacaagaagcaggagggacaaggacagatatctcagcactctttattcattctcaggatcatttgatgacaagtattactgagattaacttgattaaagaaattattgatttacgccaggaattacatattcaaaaa

SEQ ID NO: 3058 - protein, 109 aa, Streptococcus agalactiae
MLMEIIVADQIIMGLILNAGDAKQHIYQALKLAKEGNFAESKIEIELADSALLEAHNLQTQFLAQEAGGTRTDISALFIHSQDHLMTSITEINLIKEIIDLRQELHIQK

SEQ ID NO: 3059 - DNA, 318 bp, Streptococcus pyogenes
atgcaagttattgtaccagaccaaatcattatgggcttaattttaaatgcaggcgatgccaaacaacatatctaccaagctctgaaatgtgctaaagaggacgattatgccactagtgaaaaagaaatggccttagcagatgatgccttattagaagcccacaatttacagacccagtttcttgcccaagaagctagtggtaataagtcagagattacagctctttttgttcactcacaggatcacttgatgacgaccattacagaaattaatctcatcaaagagattattgaccttcgtaaagaattggcaactaaa

SEQ ID NO: 3060 - protein, 106 aa, Streptococcus pyogenes
MQVIVPDQIIMGLILNAGDAKQHIYQALKCAKEDDYATSEKEMALADDALLEAHNLQTQFLAQEASGNKSEITALFVHSQDHLMTTITEINLIKEIIDLRKELATK

SEQ ID NO: 3061 - DNA, 318 bp, Streptococcus agalactiae
atgataaaaattggtttattctgtgcagcaggtttttcaacaggtatgttagtaaacaatatgaaaatcgcagcggataaagaagggatagaggcacatattgaagcttattcacaaggaaaaattgcagattatgctaaagatttagatgttgcattacttggtccacaagttagctatactctagataaatcaaaatcaatctgtgatgaatacggtgtaccgatagcagttattccaatggcagattatggtatgttggatggtgtaaaagttttgaaacttgctttgagtttattggaaacaagaaaagaggct

SEQ ID NO: 3062 - protein, 106 aa, Streptococcus agalactiae
MIKIGLFCAAGFSTGMLVNNMKIAADKEGIEAHIEAYSQGKIADYAKDLDVALLGPQVSYTLDKSKSICDEYGVPIAVIPMADYGMLDGVKVLKLALSLLETRKEA

SEQ ID NO: 3063 - DNA, 327 bp, Streptococcus pyogenes
atgactaaaaaggagattgacatgattaaaattggattgttttgtgcagcaggattttcaaccggtatgttggtgaacaacatgaaagtagctgctgaaaaaaaaggcattgattgtcagattgaagcctatgctcaagggaaattagcggactatgcaccattacttgatgtggcacttttaggcccacaggttgcctatactctggataaatcagaagctatttgtaaagacaatgatatccctattgcagttatcccaatggctgattatggaatgttagacggcaacaaggtgcttgatttagcccttagccttgttaaagaa

SEQ ID NO: 3064 - protein, 109 aa, Streptococcus pyogenes
MTKKEIDMIKIGLFCAAGFSTGMLVNNMKVAAEKKGIDCQIEAYAQGKLADYAPLLDVALLGPQVAYTLDKSEAICKDNDIPIAVIPMADYGMLDGNKVLDLALSLVKE

SEQ ID NO: 3065 - DNA, 1299 bp, Streptococcus agalactiae
atgtcaaagtttgatagtcagaaaataattactccgattatgaagtttgtcaatatgcgagggattattgcactcaaagatggcatgctagcaattctaccactaacagttgttgggagtctctttttaatattagggcagcttccatttaaaggtcttaatcaagccatagctaatgtttttggaccagaatggacagaaccatttatgcaagtttattcaggaacttttgcgattatgggcttgatttcctgttttgcaattgcttatgcttatgctaaaaatagtagtgtagaaccgttacctgctggcgttttatcactttcgtctttctttattttaatgaaatcatcttatattcctgtaaaaggagaagcaatagcggatgctatttctaaggtttggtttggcggtcaggggattattggagcaattattattggcttagtagttggtgctatctatacatggtttatccaacatcatattgttataaaaatgccagagcaagtaccacaggcaatagcaaaacaatttgaagctatgattccagcttttgttatctttcttttatcgatgattgtttatttgattgctaaggtaacaactggaggtacctttattgagatgatttatgatatcattcaagtaccgttgcaaggcttaacaggctcactttatggagcaattgggattgctttctttatttcattcttatggtggtttggtgtccatggccaatctgtggtgaatggtattgtgactgctttgttactatccaatttagatgccaataagtctttattagcagcaaatcgcttaacattagataatggcgctcacattgtaacacagcagtttttggatagtttcttgattttatcgggctcaggaataacttttggactagttattgcgatgctttttgcagcaaaatcaaaacaatacaaggcacttgggaaagtggccgcttttcccgcaattttcaatgttaacgagccaatcgtctttggctttccaatcgtaatgaatcctgtgatgtttctgccttttattttagtaccagttttggcagctttaattgtttatggagctattgcggttggttttatgcaaccattctcaggtgttactttaccatggagtactccagcaattatttctggattcatggtaggtggttggcaaggtgcactcgtccaaatagtcattttagctatctcaactgctgtttacttcccattctttaaaatccaagataatattacttacaaaaatgaatgtgaaatggaaagggga

SEQ ID NO: 3066 - protein, 433 aa, Streptococcus agalactiae
MSKFDSQKIITPIMKFVNMRGIIALKDGMLAILPLTVVGSLFLILGQLPFKGLNQAIANVFGPEWTEPFMQVYSGTFAIMGLISCFAIAYAYAKNSSVEPLPAGVLSLSSFFILMKSSYIPVKGEAIADAISKVWFGGQGIIGAIIIGLVVGAIYTWFIQHHIVIKMPEQVPQAIAKQFEAMIPAFVIFLLSMIVYLIAKVTTGGTFIEMIYDIIQVPLQGLTGSLYGAIGIAFFISFLWWFGVHGQSVVNGIVTALLLSNLDANKSLLAANRLTLDNGAHIVTQQFLDSFLILSGSGITFGLVIAMLFAAKSKQYKALGKVAAFPAIFNVNEPIVFGFPIVMNPVMFLPFILVPVLAALIVYGAIAVGFMQPFSGVTLPWSTPAIISGFMVGGWQGALVQIVILAISTAVYFPFFKIQDNITYKNECEMERG

SEQ ID NO: 3067 - DNA, 2454 bp, Streptococcus agalactiae
atgaccaaacaattactcactcaaaaatatacaaatgatgttcaacaaaattctcaaaagcattttggctatttgacagagcgcatgtattcttatcgcgataaggttcttgataagaaaccattcatagatgcagaacgtgctatcttggtaactgaagcctatcaaaagcatcaggaaaaacctaatgttttaaagagagcttacatgttgcaaaatattttggaaaaaatgacaatctatattgacgatgagacaatgattgtcggtaaccaagcttcatctgataaagatgctcctatttttccagaatacactctagaatttgttgtaaatgaactagacctttttgaaaaacgagatggtgatgtcttttacattacagaagaaaccaaagaacaaattagaaatattgcacctttctgggaaaataataatttacgggctcgtgcgggcgttatgcttccagaagaagttcaagtttatatggagacaggcttctttgggatggaaggtaagatgaattctggggatgctcacttagctgtcaactatcagaagttactagaagaagggcttattggctttgaaaaaaaagcaagaaaagctaaagctgacttagatttaacaaagcctgagagtattgacaaatatcatttctatgattctattttaattacaatagaagctgttaaaacctatgcagagcgttttgctatcctagcaaaaaaacaagctaaaacagcaaatgctaagagacgtcaggaattgttagatatcgctagtatttgtgaacgagtgccctattacccagctgaaacgtttgcagaagccgttcaatcggtttggtttattcagtgtattcttcaaatagaatcaaacggtcattctctatcttatggacgctttgatcaatacatgtatccatatgttaaatctgacttagaagctggacgtgagactgaggattcgatcgttgagcgcctaactaacctatggattaaaacaataactattaataaggttcgtagccaagctcatacgttttcgtctgctggtagtcctctttaccaaaatgtaacgattggaggacaaacacgacataaggaagatgctgttaatcctttatcatttctagtactaaaatcagtcgctcagacacacttaccacagcctaatctaacggttcgttatcatgctaacctagacaagtcattcatgaatgaagctattgaagttatgaaattaggctttggtatgccagcttttaataatgatgaaattattattccatcatttattaaaaaaggagtttccgaagaagatgcctatgattattcagcgattggttgtgtcgaaacagcagttcctgggaaatggggttatcgttgtaccggcatgagctatatcaacttccctaaagtgttattaattacaatgaatgacggtattgacccggcttctgggaagagatttgcgccttcttatgggcatttcacccagatgacctcatataaagaacttaaagaagcttgggacaaaacacttcgttacttaactcgaatgagcgttattgttgaaaatgctattgatattagtctcgaaagagaagtacctgatattctttgttcagctttaactgatgattgtattggacgaggtaagcacttaaaagaaggtggtgcagtatatgactacatatctggtctacaagttggaatcgctaatctttcagactcacttgctgcgcttaaaaaattagtatttgaagaaaaacgcctaaccacattagaagtatggcaagcattgcagagtgattacgcaggtccgcgtggtgaagaaattcgtcaaatgttgatcaatgaagcaccaaaatatggaaatgatgatgactacgcggatagtttagtacgtgagtgttatgatgtttatgttgaagaaattgctaaatatcccaacacacgctatggacgtggaccaatcggtggtattcgctattcaggaacgtcctctatttcagcaaatgtaggccaaggacgaggtactttagcaactccagatggtaggcatgcaggaactccattagctgaaggttgttcaccatctcataatatggacaaaaagggacctacctctgttttgaaatcagtttcgaagttaccaactgatgagattgtcggcggtgtactccttaaccaaaaagtcaaccctcaaaccttggcaaaagaagaagataaacaaaaattaattgccttacttagaacattcttcaatcgccttcatggttaccatatccagtataatgttgtctcacgtgagactttgattgatgctcagaagcaccctgaaaaacaccgcgatttgattgtgcgtgtagcaggttattctgcattctttaatgtcctatctaaggcaactcaagatgatattattgcacgtacagaacatgctctt

SEQ ID NO: 3068 - protein, 818 aa, Streptococcus agalactiae
MTKQLLTQKYTNDVQQNSQKHFGYLTERMYSYRDKVLDKKPFIDAERAILVTEAYQKHQEKPNVLKRAYMLQNILEKMTIYIDDETMIVGNQASSDKDAPIFPEYTLEFVVNELDLFEKRDGDVFYITEETKEQIRNIAPFWENNNLRARAGVMLPEEVQVYMETGFFGMEGKMNSGDAHLAVNYQKLLEEGLIGFEKKARKAKADLDLTKPESIDKYHFYDSILITIEAVKTYAERFAILAKKQAKTANAKRRQELLDIASICERVPYYPAETFAEAVQSVWFIQCILQIESNGHSLSYGRFDQYMYPYVKSDLEAGRETEDSIVERLTNLWIKTITINKVRSQAHTFSSAGSPLYQNVTIGGQTRHKEDAVNPLSFLVLKSVAQTHLPQPNLTVRYHANLDKSFMNEAIEVMKLGFGMPAFNNDEIIIPSFIKKGVSEEDAYDYSAIGCVETAVPGKWGYRCTGMSYINFPKVLLITMNDGIDPASGKRFAPSYGHFTQMTSYKELKEAWDKTLRYLTRMSVIVENAIDISLEREVPDILCSALTDDCIGRGKHLKEGGAVYDYISGLQVGIANLSDSLAALKKLVFEEKRLTTLEVWQALQSDYAGPRGEEIRQMLINEAPKYGNDDDYADSLVRECYDVYVEEIAKYPNTRYGRGPIGGIRYSGTSSISANVGQGRGTLATPDGRHAGTPLAEGCSPSHNMDKKGPTSVLKSVSKLPTDEIVGGVLLNQKVNPQTLAKEEDKQKLIALLRTFFNRLHGYHIQYNVVSRETLIDAQKHPEKHRDLIVRVAGYSAFFNVLSKATQDDIIARTEHAL

SEQ ID NO: 3069 - DNA, 2415 bp, Streptococcus pyogenes
atgactgaaacaaaaagcccttattttggacatttaacagacagaatgactcactatcgtgaagctgtgttagacaagaaaccttatattgatgctgagcgtgctattttagccactgaagcctatcaaaaacaccaaaataagccagcaaacctcaaacgcgcttacatgcttcaaactattttggaaaacatgaccatctatattgaggatgaaagcctcattgctggtaaccaagcctcttcaaacaaggatgcaccgattttcccagaatacactctggaatttgtcctcaacgaacttgatctttttgaaaaacgagatggggatgtcttctacattaccgaagaaaccaagcaacagctccgagacattgccccattctgggaaaacaataacctgcgtgctcgctgcggtgtcttgctaccagaagaagtgcaagtgtacatggaaacaggtttctttggcatggaaggcaagatgaactctggggatgctcatttagcggttaattaccaaaaactcttggagcatggcttaaagggatttgaagaacgggcacgagctgccaaagctgcgcttgatttgaccattcctgaaaacattgacaaataccatttttacgactctgtttttattgtcattgatgcagtcaaaacttatgctaaacgctatgccaagttggctagagaactagcaaaaacggctaaaccagaacgtcaagcagaattgttagacatcgcgcgcatttgtgataaagtaccttacgaaccagcgaaaacctttgcagaggctgtgcaatctgtctggttcattcagtgtattttgcaaattgaatcaaatgggcattccctatcttatggccgctttgaccagtacatgtatccttatgtcaaagctgatttggaggctggccgtgaaacagaagacacaattgttgaacgtttgaccaacctctggattaagaccttgaccattaataaagtacggagccaagcccacaccttctcatcagcaggtagtccactttaccaaaacgtgacaatcggcggtcaaacacgcgataaaaaagatgcggtcaacccactgtcttaccttgtcctacggagtgtggctcaaaccaaattgccacaacctaacttgactgttcgttaccacaaaggcctagacaatacctttatgaacgaatgtatcgaggtcatgaaacttggttttggtatgccagccatgaacaacgatgaaatcatcattccatctttcatcaaaaaaggtgtctcagaagaagatgcttatgattactcagccattggctgtgtggaaacagcagttcctggaaaatggggctaccgttgcacggggatgagttacatcaacttccctaaaatcttgctgattaccatgaatgacgggattgacccagcatcaggcaagcgctttgcaaaaggacacggtcacttcaaagacatgacctcttatgaagaattaaaagcagcatgggatgccaccctgcgcgaaattacccgcatgagcgtcattgttgaaaatgccattgacctcggtcttgaacgtgaagtaccagatattctttgctcagccttgacagatgattgtatcggtcgtggcaagaccttaaaagaaggcggagctgtttacgactatatctcaggccttcaagttggtattgccaacctatcagactccctagcagcgctgaaaaaattagtgtttgaagaaggtcgcttgaccccagaggaactctggaaggcccttgaaagtgactttgctggagaacgcggagaagacatccgccaaatgctcatcaatgacgcaccaaaatatggtaatgatgatgactacgcagatagtttagtcgtcgaagcttacgacacctacattgatgaaattgccaaatacccaaatacccggtatggccgtggcccaatcggaggtatccgctattctgggacatcatcaatctcagccaatgtcggacaaggaaaagggaccttggcgacaccagacggtcgccatgcaggcacaccactagcagaaggctgttcaccagaacacagcatggacaaaaaaggcccgacttcagtattgaaatctgttgctaaattaccaacagatgagattgtcggaggagtgctactcaaccaaaaagttaacccacaaaccctggccaaagaagaagacaaactgaaattaatggccttacttcgtaccttctttaatcgcctacacggttatcatatccagtacaatgtcgtgtcacgtgagaccttgattgatgcccaaaaacatcctgaaaagcaccgcgacctcattgtccgtgttgccggctactcagctttcttcaatgtgctctcaaaagcaacccaagatgacattattgaacgtacagaacacacactt

SEQ ID NO: 3070 - protein, 805 aa, Streptococcus pyogenes
MTETKSPYFGHLTDRMTHYREAVLDKKPYIDAERAILATEAYQKHQNKPANLKRAYMLQTILENMTIYIEDESLIAGNQASSNKDAPIFPEYTLEFVLNELDLFEKRDGDVFYITEETKQQLRDIAPFWENNNLRARCGVLLPEEVQVYMETGFFGMEGKMNSGDAHLAVNYQKLLEHGLKGFEERARAAKAALDLTIPENIDKYHFYDSVFIVIDAVKTYAKRYAKLARELAKTAKPERQAELLDIARICDKVPYEPAKTFAEAVQSVWFIQCILQIESNGHSLSYGRFDQYMYPYVKADLEAGRETEDTIVERLTNLWIKTLTINKVRSQAHTFSSAGSPLYQNVTIGGQTRDKKDAVNPLSYLVLRSVAQTKLPQPNLTVRYHKGLDNTFMNECIEVMKLGFGMPAMNNDEIIIPSFIKKGVSEEDAYDYSAIGCVETAVPGKWGYRCTGMSYINFPKILLITMNDGIDPASGKRFAKGHGHFKDMTSYEELKAAWDATLREITRMSVIVENAIDLGLEREVPDILCSALTDDCIGRGKTLKEGGAVYDYISGLQVGIANLSDSLAALKKLVFEEGRLTPEELWKALESDFAGERGEDIRQMLINDAPKYGNDDDYADSLVVEAYDTYIDEIAKYPNTRYGRGPIGGIRYSGTSSISANVGQGKGTLATPDGRHAGTPLAEGCSPEHSMDKKGPTSVLKSVAKLPTDEIVGGVLLNQKVNPQTLAKEEDKLKLMALLRTFFNRLHGYHIQYNVVSRETLIDAQKHPEKHRDLIVRVAGYSAFFNVLSKATQDDIIERTEHTL

SEQ ID NO: 3071 - DNA, 666 bp, Streptococcus agalactiae
atggaatttttacttgacactttaaatttagaagctataaaaaaatggcatcatatactgccactagcaggtgtaacttcaaatcccaccattgctaagaaagaaggagatatacattttttccaacgcattcgtgatgttcgagaaattattggacgtgaagcaagtttgcatgttcaagtagtggccaaagattatcaaggaatattggatgatgctgctaaaatacgccaagaaacggacgatgacatttatatcaaagtcccagttacgccagatggattagcagcaattaaaacgttaaaagcagaaggttataatattacagccacagcaatatacaccagtatgcaaggtcttttggctatatcagctggagcagactacctagcaccttactttaaccgaatggagaaccttgatattgatgcgacacaagttattaaggaattagcgcaagcaatagagcggacaggttcttctagcaaaattttagcagctagttttaaaaacgcttcacaagtaacgaaggccttatcacagggtgctcaatcaatcaccgcgggaccagatatttttgaatcagtctttgcgatgccatctattgcaaaagctgttaacgactttgcagatgattggaaagccagtcaacactcagaacatatt

SEQ ID NO: 3072 - protein, 222 aa, Streptococcus agalactiae
MEFLLDTLNLEAIKKWHHILPLAGVTSNPTIAKKEGDIHFFQRIRDVREIIGREASLHVQVVAKDYQGILDDAAKIRQETDDDIYIKVPVTPDGLAAIKTLKAEGYNITATAIYTSMQGLLAISAGADYLAPYFNRMENLDIDATQVIKELAQAIERTGSSSKILAASFKNASQVTKALSQGAQSITAGPDIFESVFAMPSIAKAVNDFADDWKASQHSEHI

SEQ ID NO: 3073 - DNA, 666 bp, Streptococcus pyogenes
atggaatacatgttagacactttagatttagaagctattaaaaaatggcatcacattttgcctctcgcaggtgtgacctcaaacccttctattgccaaaaaagaaggtgagattgatttctttgaacggattcgagaagtccgtgctattatcggtgacaaggcttctattcatgttcaagtgatcgcccaagattacgaaggcatcttaaaagatgctgctgaaatccgcaggcaatgtggagatagtgtgtatgtcaaagtacctgtaaccacagagggccttgcagccattaaaaccttgaaagccgaaggctatcacatcacagcaaccgctatttatacgaccttccaaggactattagccattgaagctggcgctgattatttggctccttactataaccgtatggaaaatcttaatattgatccagaagctgtcatagaacaattagcagaagctattaaccgcgagaatgctaatagtaagattttggcagcaagctttaaaaatgtggctcaggttaataaatcctttgctctaggagcacaagccatcactgctggcccagatgtgtttgaagcaggatttgccatgccatctattcaaaaagcggttgacgattttggcaaggattgggaagccattcatcaccgcaagagcatt

SEQ ID NO: 3074 - protein, 222 aa, Streptococcus pyogenes
MEYMLDTLDLEAIKKWHHILPLAGVTSNPSIAKKEGEIDFFERIREVRAIIGDKASIHVQVIAQDYEGILKDAAEIRRQCGDSVYVKVPVTTEGLAAIKTLKAEGYHITATAIYTTFQGLLAIEAGADYLAPYYNRMENLNIDPEAVIEQLAEAINRENANSKILAASFKNVAQVNKSFALGAQAITAGPDVFEAGFAMPSIQKAVDDFGKDWEAIHHRKSI

SEQ ID NO: 3075 - DNA, 1092 bp, Streptococcus agalactiae
ttgagaatgaaagttttcgcaagtccatcgcgctatatacaaggaaaggatgctttattccaaagtattgaacatatcaaatctttaggtcagactccacttatcctttgtgatgatgttgtttataatatcgttggagaaaggtttttatcttatctacaagacgatttgttaccacatcgtgtttcctttaacggagaagcatctgataatgaaatcaatcgtgtcgttgctgttgcgaaagaaaagaatagtgaccttattattggacttggtggtggaaaaactattgactctgcaaaggcaattgcagataaagttaatttaccagtggtcattgcaccaacagtagcttcaacagatgccccaacatcagcgttatcagtaatctatacagatgaaggagcttttgaaaaatatattttttattcaaagaatccagacttagttttagttgatactcaagtaattgcccaagcgccaaaacgtttactagcttctgggatagcagatggcttagctacttgggttgaagcgagagcagtcttacaaaaaaatgggatagcgatggctggcggtagacagactttagcgggcgtggcaattgcccaagcatgtgagcgtactttatttaatgatagtttacaagctttagcggcttgtgatgccaaagtggttacaaaagctttagaaaatgttattgaagctaataccttacttagtggtttaggttttgaaagtgcaggattagctgcagctcatgctattcataatggttttactgccttgagtggagatattcatcacttaacccatggtgaaaaagttgcctatggaacgttgacgcaacttttcctcgaaaatagaccaaaggaagaaattgatcgctacattaatctttaccaagcgattggaatgccaactacacttgcagaactccatttgggtgatgcaacatatgaagaacttttaaaagttggtcagcaagcaacaattgaaggtgaaacaatacatgaaatgccattcaaaattagtgcagaggatgtcgctgcagccctgttaacggttgaccgttatgtttcaaatcatcaa

SEQ ID NO: 3076 - protein, 364 aa, Streptococcus agalactiae
MRMKVFASPSRYIQGKDALFQSIEHIKSLGQTPLILCDDVVYNIVGERFLSYLQDDLLPHRVSFNGEASDNEINRVVAVAKEKNSDLIIGLGGGKTIDSAKAIADKVNLPVVIAPTVASTDAPTSALSVIYTDEGAFEKYIFYSKNPDLVLVDTQVIAQAPKRLLASGIADGLATWVEARAVLQKNGIAMAGGRQTLAGVAIAQACERTLFNDSLQALAACDAKVVTKALENVIEANTLLSGLGFESAGLAAAHAIHNGFTALSGDIHHLTHGEKVAYGTLTQLFLENRPKEEIDRYINLYQAIGMPTTLAELHLGDATYEELLKVGQQATIEGETIHEMPFKISAEDVAAALLTVDRYVSNHQ

SEQ ID NO: 3077 - DNA, 1086 bp, Streptococcus pyogenes
atgaaagtatttgcaagtccatctcgttacattcaaggtaaaaatgccttgtttaccaatgttaaaaccctaaaacaactaggggatagccccattttactgtgtgatgacgtggtgtatggcatcgtcggagaaagatttgaaagctatttgatagataatggcatgactcctgttcacgtagcctttaatggcgaagcctcagataatgaaatcagccgcgtggttgccattgccaaggaaaatggcaatgatgttattattggacttggtggtggaaaaaccattgacagtgctaaggctatcgctgacttacttgctgttccggtgattattgccccaaccattgcttcaacagatgccccaacctcagccttatcggttatttacaccgatgaaggagcctttgaaaaatacattttctattcaaagaatccagatcttgtattggttgacacacaagtgatctgtcaggcaccaaaacgcttattggcgtcagggattgcagatgggttagcaacatgggtagaggcgcgtgctgttatgcaaaaaaatggagacaccatggcaggtggcaatcaaaccttggcaggagttgccattgccaaagcctgtgagcagaccttgtttgcagatggcctaaaagcgatggctagctgtgacagacaagtcgtgaccccggccttggaaaatgtcattgaagccaatacacttcttagtgggcttggttttgaaagtgcgggtctggctgctgcacatgccattcacaatggctttacagcgctgacaggtgctattcatcaccttacccatggtgaaaaagtcgcctatggcacgttgacccaactcttcttggaaaatcgttcgcgtgaagaaattgaccgctacatcgacttttaccaagctattggcatgccaacaaccctcaaagaaatgcatttagacacggctactcaagaggatttcttaaaaattggccgtcaagcaaccatggcaggcgaaaccatccatcaaatgccatttgttatcagtccagaagatgtagcagcggctttggttgctgttgatgcctatgttacgagtcga

SEQ ID NO: 3078 - protein, 362 aa, Streptococcus pyogenes
MKVFASPSRYIQGKNALFTNVKTLKQLGDSPILLCDDVVYGIVGERFESYLIDNGMTPVHVAFNGEASDNEISRVVAIAKENGNDVIIGLGGGKTIDSAKAIADLLAVPVIIAPTIASTDAPTSALSVIYTDEGAFEKYIFYSKNPDLVLVDTQVICQAPKRLLASGIADGLATWVEARAVMQKNGDTMAGGNQTLAGVAIAKACEQTLFADGLKAMASCDRQVVTPALENVIEANTLLSGLGFESAGLAAAHAIHNGFTALTGAIHHLTHGEKVAYGTLTQLFLENRSREEIDRYIDFYQAIGMPTTLKEMHLDTATQEDFLKIGRQATMAGETIHQMPFVISPEDVAAALVAVDAYVTSR

SEQ ID NO: 3079 - DNA, 924 bp, Streptococcus agalactiae
atgtcaaaaatttataattctattacagacttaatcggaaatacacccattattcaattacatcatattgttccagaaggagctgcagaggtgtacgttaagttagaatcctttaacccaggttcatctgtcaaagatcgtatcgctctagctatgattgaagatgcagagcaaaaagggattcttaaagccggagatacaatcgtagaacctacatctggtaatacaggtatcggtttggcttgggtaggaaaagctaaagggtataatgttattattgttatgccagaaaccatgtcaattgaacgtcgtaaaatcattcaagcctatggtgctcaattagtactaacacctggtagtgaagggatgaagggagctattgctaaggcaaaagaaatttctgcagagcaaaatgcttggctacccctgcaatttaataatcaagccaatccagaaatccacgaaaaaacgactggtagggaaattatcgagacttttggtgaaaaaggtttagatgcttttatcgcaggtgtgggaactggtgggacaattactggtgtctctcgtgcattaaaaaaagtcaatcctgatgtcgctatttatgctgtagaagctgatgaatctgcaatcctttctggtgagcaacctgggcctcataaaatacaagggatttctgcaggtttcattccagaaacattggctacagattcttatgatcatatcattcgcgttacatctgacgatgctattgaaacaggacgtatcatcggcggactagaaggtttcctcgcaggaatttctgcttcagctgctatttatgctgctattgaagtggccaaacaactaggaaaagggaaaaaggttttagctcttctccctgataatggcgaacgttacttatcaacaagcctgtatgattttgaa

SEQ ID NO: 3080 - protein, 308 aa, Streptococcus agalactiae
MSKIYNSITDLIGNTPIIQLHHIVPEGAAEVYVKLESFNPGSSVKDRIALAMIEDAEQKGILKAGDTIVEPTSGNTGIGLAWVGKAKGYNVIIVMPETMSIERRKIIQAYGAQLVLTPGSEGMKGAIAKAKEISAEQNAWLPLQFNNQANPEIHEKTTGREIIETFGEKGLDAFIAGVGTGGTITGVSRALKKVNPDVAIYAVEADESAILSGEQPGPHKIQGISAGFIPETLATDSYDHIIRVTSDDAIETGRIIGGLEGFLAGISASAAIYAAIEVAKQLGKGKKVLALLPDNGERYLSTSLYDFE

SEQ ID NO: 3081 - DNA, 939 bp, Streptococcus pyogenes
atgactaaaatttacaaaactataacagaattagtaggtcaaacacctattatcaaacttaaccgtttaattccaaacgaagctgctgacgtttatgtaaaattagaagcttttaacccaggatcttctgttaaagatcgtattgctttatcgatgattgaagctgctgaagctgaaggtctgataagtcctggtgacgttattatcgaaccaacaagtggtaatacaggtattggtcttgcatgggtaggtgctgctaaagggtatcgagtcattattgttatgcccgaaactatgagcttggaaagacggcaaatcattcaggcttatggtgcagagcttgtcttaacacctggagcagaaggtatgaaaggggctattgcaaaagctgaaactttagcaatagaactaggtgcttggatgcctatgcaatttaataaccctgccaatccaagcatccatgaaaaaacaacagctcaagaaattttggaagcttttaaggagatttctttagatgcattcgtatctggtgttggtactggaggaacactttctggtgtttcacatgtcttgaaaaaagctaaccctgaaactgttatctatgctgttgaagctgaagaatctgctgtcttatctggtcaagagcctggaccacataaaattcaaggtatatcagctggatttatcccaaacacgttagataccaaagcctatgaccaaattatccgtgttaaatcgaaagatgctttagaaactgctcgactaacaggagctaaggaaggcttcctggttgggatttcttctggagctgctctttacgccgctattgaagtcgctaaacagttaggaaaaggcaaacatgtgttaactattttaccagataatggcgaacgctatttatcgactgaactctatgatgtaccagtaattaagacgaaa

SEQ ID NO: 3082 - protein, 313 aa, Streptococcus pyogenes
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKANPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 3083 - DNA, 642 bp, Streptococcus agalactiae
atgaactataaaacgataaaatcagacggaattgtcgaagaagaaattaaaaaatcgcgatttatttgtcatctaaagcgagtagagtccgaagaggaggggcgtaattatattacgcaaatcaagaaagcgcactacaaagccaatcattcgtgttcagctatggttattggcgaaaaaggggatataaaacgatctagtgatgatggagaacctagtggtacagcaggtatccctatgctaaccgtacttgaaaagcaaggcctgacaaatgttgttgccgtcgttacacggtattttggaggtatcaaattaggcgcaggggggcttattcgtgcctactctggtagcgtagctaataccatcaaagagatcggggtagtagaagttaaagaacaaattggtattcgtattcaattaacttatcctcaatatcaaacttttgacaacttcctaaaagagcaccaccttcaggagtttgaaacagaatttttagaagctgtaacctgtaaaatatacgttgaccctaaggaatttgaacacacaataactaatttgacagagttctaccaaggaaaagctttgttaactgaagaagggagtcaaattgttgaaattccctttaaggctgaaaccgataaa

SEQ ID NO: 3084 - protein, 214 aa, Streptococcus agalactiae
MNYKTIKSDGIVEEEIKKSRFICHLKRVESEEEGRNYITQIKKAHYKANHSCSAMVIGEKGDIKRSSDDGEPSGTAGIPMLTVLEKQGLTNVVAVVTRYFGGIKLGAGGLIRAYSGSVANTIKEIGVVEVKEQIGIRIQLTYPQYQTFDNFLKEHHLQEFETEFLEAVTCKIYVDPKEFEHTITNLTEFYQGKALLTEEGSQIVEIPFKAETDK

SEQ ID NO: 3085 - DNA, 645 bp, Streptococcus pyogenes
ttgtacaatttttttatggaacattttaagacaatcaaagccagtggttttttcgaagaaagtattaaaaaatctcgtttcatttgtcatatcaaacgagtgagcactgaagaagatggtaagaattttgttaatgctatcaaaaaagaacattacaaagctaatcattcctgctttgcgatgattatcggtaacaacagacagatcaagcgctcaagtgatgatggtgaaccttcaggaactgctggaatacctatcctttctgtgttagaaaagcagtgtttaacaaatgtagtagttgtggtaacgcgttactttggtggtattaaattaggaacaggtgggttaatcagagcatactctaacatgaccgcaacagctattaaacgatttggcatcattgaagttaaacagcagataggactagaaatcacactttcttatccccaatatcaactatactctaacttgctagatcaattggctttaaccgaaacagaaactaagttttcagacacgataaagacaacactttattgtgatactgaacgtgtggaaaatctcattgatactttaacaaattattatcatggtcagataagctgtgagaaaatcggatccaaagttattgaattcccctgtgat

SEQ ID NO: 3086 - protein, 215 aa, Streptococcus pyogenes
LYNFFMEHFKTIKASGFFEESIKKSRFICHIKRVSTEEDGKNFVNAIKKEHYKANHSCFAMIIGNNRQIKRSSDDGEPSGTAGIPILSVLEKQCLTNVVVVVTRYFGGIKLGTGGLIRAYSNMTATAIKRFGIIEVKQQIGLEITLSYPQYQLYSNLLDQLALTETETKFSDTIKTTLYCDTERVENLIDTLTNYYHGQISCEKIGSKVIEFPCD

SEQ ID NO: 3087 - DNA, 1287 bp, Streptococcus agalactiae
atggaaaattatttaggtaggctttggacaaaagcacaattatctgagcaacttagaaaaattgcaattagcttgccatcttttataaagaaaggaagcgactatatttgtacccgatgctctagttctgttgctaaaaattgccaattaccaactggaaattattattgtagagaatgtatagtttttggaagagttactagtaatgaaaatttatattatttcccacaaaaaacattttctaaaacgaattctttaaaatggaaaggggaactgacaccttatcaaaatgaggtttcagaagagttgttgaaaggtatttcaagtaaggaaaatcttcttgttcatgctgtgacaggggctggtaaaacagaaatgatataccactctgtcgccaaagtaattgatactggaggaagcgtttgtattgccagtcctagaattgatgtttgtttagaattgtataagcgactttcaaacgattttagatgtgccataacattaatgcatggagaatctccttcttatcagagatcccctttaactattgccacaacacatcaattgttaaaattttatcatgcttttgatttgctaattgttgatgaagttgatgcttttccgtatgtcgacaacccgatactataccagggtgtaaaacaggccttaaaggaaaacggaacaagtatttttctgactgcaacttcaacgactgagttagaaagaaaagttgcaagaaaagaactaaaaaaattgcatctagctaggagatttcatgccaatccgttagtgatacccgagatggtttgggtaagtggtatccagaaaagcttgcagacacaaaaactacctcccaaattatatcagttgataaataaacagcgacaaacgagatatcctttgttattatttttcccccatatttcagaaggtcaggtattcaccgaaattttaagacaagcctttcctatggaaaaaattggttttgtttcaagtaagagcacatctaggttaaagttagtgcaagattttcgagataacaaattgtctatcctagtgtcaactaccattctagagagaggagtaactttccctagcgtcgacgtttttgttatacaagcaaatcatcatttgtttacgaaaagttccttggtacaaatttcaggaagagttggaagagcattagaaaggcccgaagggctcctttacttccttcatgatgggaaaagtaaatcgatgcaccaagctataaaggagattaaaaacatgaatcatataggaggattt

SEQ ID NO: 3088 - protein, 429 aa, Streptococcus agalactiae
MENYLGRLWTKAQLSEQLRKIAISLPSFIKKGSDYICTRCSSSVAKNCQLPTGNYYCRECIVFGRVTSNENLYYFPQKTFSKTNSLKWKGELTPYQNEVSEELLKGISSKENLLVHAVTGAGKTEMIYHSVAKVIDTGGSVCIASPRIDVCLELYKRLSNDFRCAITLMHGESPSYQRSPLTIATTHQLLKFYHAFDLLIVDEVDAFPYVDNPILYQGVKQALKENGTSIFLTATSTTELERKVARKELKKLHLARRFHANPLVIPEMVWVSGIQKSLQTQKLPPKLYQLINKQRQTRYPLLLFFPHISEGQVFTEILRQAFPMEKIGFVSSKSTSRLKLVQDFRDNKLSILVSTTILERGVTFPSVDVFVIQANHHLFTKSSLVQISGRVGRALERPEGLLYFLHDGKSKSMHQAIKEIKNMNHIGGF

SEQ ID NO: 3089 - DNA, 1323 bp, Streptococcus pyogenes
atggagtctattgaaaatagttatggacggttgttgctagaaagccagttaccagattcagcaaagcagcttgctcaacctttaaaaagtgtagtaatattgagaggaaaaatgatttgtcaacgttgtcactatcagcttgatgaagaagcacgattgccaagtggagcctattattgccgattttgtcttgtctttggacgaaatcaatcagataaattgctctatgctatcccacctatgcattttccaaaaggtaattatctggtttggggtggtcaactaactgcttatcaagagatgatttcccaacaattattaatcaatatgcaaaatcaaaaaacaacattagttcatgctgtaactggtgcaggaaaaacagaaatgatttatgctgcgattgaggcggtaattaacacaggtggctgggtttgcattgccagcccaagagtagatgtttgtgtagaggtggctactcgtttatcccaagccttctcctgcagcatctgtttaatgcacgcagagtctcttccttatcaaagagctcctattatagtagccacaacgcatcagctgctaaaatttcacaaggcttttgatctcttaattattgatgaagtagacgcattcccttttgtaaataatattcaacttcattatgctgcaagtcaggctttaaaagaaggtggcgcaaagattttattaactgcaacttcaactagaactttagaaagaaaggtaaacaagggagaagtagtcaagctgacattggcgagacgctttcataataggccattagttattccaaaatttataagaagttttaatctatttaaaatgatacatcggcaaaaacttcctcttaaaattttaaaatacttaaaaaaacaaagaaaaacaggctatccccttttaatttttctacccactattataatggcagaatctgttacagcaatcttaaaagagttattgcccgccgaacaaatagcttgtgtttctagtcaatcacaaaacaggaaagaagatatcacagcttttcgtcaagggaaaaaaacgattttaattacaacatcaattttagaaaggggtgtgacatttccccaaattgatgtttttgttcttgggtctcatcatcgtgtctatagttcccaaagtcttgttcaaattgctggacgagttggaagatctatagacagaccagacggaacgttatatttctttcatgaaggtatcagtaaagcaatgctactagcaagaaaagagattaaagaaatgaattataaagggtattcgcatgatctgtctactatgtcaacaaat

SEQ ID NO: 3090 - protein, 441 aa, Streptococcus pyogenes
MESIENSYGRLLLESQLPDSAKQLAQPLKSVVILRGKMICQRCHYQLDEEARLPSGAYYCRFCLVFGRNQSDKLLYAIPPMHFPKGNYLVWGGQLTAYQEMISQQLLINMQNQKTTLVHAVTGAGKTEMIYAAIEAVINTGGWVCIASPRVDVCVEVATRLSQAFSCSICLMHAESLPYQRAPIIVATTHQLLKFHKAFDLLIIDEVDAFPFVNNIQLHYAASQALKEGGAKILLTATSTRTLERKVNKGEVVKLTLARRFHNRPLVIPKFIRSFNLFKMIHRQKLPLKILKYLKKQRKTGYPLLIFLPTIIMAESVTAILKELLPAEQIACVSSQSQNRKEDITAFRQGKKTILITTSILERGVTFPQIDVFVLGSHHRVYSSQSLVQIAGRVGRSIDRPDGTLYFFHEGISKAMLLARKEIKEMNYKGYSHDLSTMSTN

SEQ ID NO: 3091 - DNA, 663 bp, Streptococcus agalactiae
atgacttgtttgttatgtcatgaaatagatttatcgcaattaacttttgtggaacttatgcttctaaaaccaaagcaaaacgtaatttgtcaaacgtgcaagggtagttttgaagcacttagtagggagatgggttgccaaacatgttgcaagcaaattccccaaaaacaatgtcaagattgtatttattggggtaaaaaaggtatagaggtaaatcatttttccctttatagatacaatgaagcaatgaaaaaaaatttttctctttttaaatttcaaggggattatttgttgaaagatgtttttacaaaagaaataaaagctgctctaaaaaagtataagggctacactatagtgccagttcccttgagtcatgaaggataccaaaataggcaatttaatcaagtgattgcttttctacaatcggcaaatataccttacaaaaatattctttctaaaaaagatggaggtaagcaatcggctaataataaagaagaaagactcaaacaagttcagcaatttacattaaaaaatgaggctgagttaggggacaaccttttaattgttgatgatatttatacaacaggcgcaacaatagcacaaatcaggaaactattagaagaaaaaggtataaaaaatataaaaagtttttcattagcacgc

SEQ ID NO: 3092 - protein, 221 aa, Streptococcus agalactiae
MTCLLCHEIDLSQLTFVELMLLKPKQNVICQTCKGSFEALSREMGCQTCCKQIPQKQCQDCIYWGKKGIEVNHFSLYRYNEAMKKNFSLFKFQGDYLLKDVFTKEIKAALKKYKGYTIVPVPLSHEGYQNRQFNQVIAFLQSANIPYKNILSKKDGGKQSANNKEERLKQVQQFTLKNEAELGDNLLIVDDIYTTGATIAQIRKLLEEKGIKNIKSFSLAR

SEQ ID NO: 3093 - DNA, 663 bp, Streptococcus pyogenes
atgatctgtctactatgtcaacaaattagtcaaacaccaataagtattacagaaatcatctttttaagacgtatctcttcaccgatttgtcaacaatgtcaaaaaagctttcaaaagataggaaaaagtgtttgtgcgacatgttgtgcaaactcagatataatagcttgtcgagattgtctaaaatgggaaaacaaaggatacaatgtaaatcatagaagcttatattgttataatgctgctatgaaagcatacttcagtcaatataagtttcaaggagactatttattaagaaaagtttttgcagtagaacttgccgatgttatcaccaagtactataaaggctatatcccagtcccggttcctgtaagtcccggttgttttcgagaaagacaatttaatcaagtgagcgctattcttgaggcagctaatgttagctacctttctctttttgaaaagctagataatactcaccaatcttccagaacaaaaaaagagagattattagtagaaaaatcttatcgactactaaaagtatcaaacattcctgataaaatccttatagtagatgatatttatactactggtagtacaattatcgctcttagaaaacaattggctaaagtagcaaatagtgacattaaaagtttgtcaattgcacgt

SEQ ID NO: 3094 - protein, 221 aa, Streptococcus pyogenes
MICLLCQQISQTPISITEIIFLRRISSPICQQCQKSFQKIGKSVCATCCANSDIIACRDCLKWENKGYNVNHRSLYCYNAAMKAYFSQYKFQGDYLLRKVFAVELADVITKYYKGYIPVPVPVSPGCFRERQFNQVSAILEAANVSYLSLFEKLDNTHQSSRTKKERLLVEKSYRLLKVSNIPDKILIVDDIYTTGSTIIALRKQLAKVANSDIKSLSIAR

SEQ ID NO: 3095 - DNA, 552 bp, Streptococcus agalactiae
atgattaaatacagtattcgtggtgaaaacatcgaagtaacagaagctattcgtgagtatgttgagaccaaactctctaaagttgaaaaatactttaatgaagcacaagaattagatactagagtcaacctcaaagtatacagagagaagaccgcaaaagttgaagtaacaatcttaatagattctattactttacgagcagaagatgtttcacaagatatgtatgggtcaattgacttagttgttgataaaattgagcgtcaaattcgtaaaaataaaactaaaattgcgaaaaaatatcgtgaaaagattccagcaagtcaagttttcacaacagaatttgaggctgagccagatgaagaagcagtaagccaaagaattgtacgtactaagaatgttaatctaaaaccaatggatgttgaggaagcattgttgcaaatggaacttttaggtcatgatttctttatctatacagatgcagaagataatacgacaaatgtcctttacaagcgtgaagatggcgaactaggtttaattgaagctaaaggaaat

SEQ ID NO: 3096 - protein, 184 aa, Streptococcus agalactiae
MIKYSIRGENIEVTEAIREYVETKLSKVEKYFNEAQELDTRVNLKVYREKTAKVEVTILIDSITLRAEDVSQDMYGSIDLVVDKIERQIRKNKTKIAKKYREKIPASQVFTTEFEAEPDEEAVSQRIVRTKNVNLKPMDVEEALLQMELLGHDFFIYTDAEDNTTNVLYKREDGELGLIEAKGN

SEQ ID NO: 3097 - DNA, 546 bp, Streptococcus pyogenes
atgattaagttcagtattcgtggagaaaatatcgaagtgacagaagctattcgcgattatgtagaatcaaagcttactaaaatcgaaaaatattttgctaaagaccaagaaatagatgcacgtgttaatttaaaagtttatcgggagagatcttcaaaagttgaggtaacgatcccattagattcagtaacccttcgtgctgaagatgtttcacaggatatgtacggctctattgatttagttgttgataagatcgaacgccaaattagaaaaaataaaaccaaaattgctaaaaaacatcgcgaaaaggttccaactggtcaagtctttacaactgagtttgaagctgaagaagtcgatgagataccagaagtacaagttgtacgtactaaaaatgtgacattaaaaccaatggatgttgaagaagcgcgtttacagatggaactattgggacatgatttctttatctacactgattctgaagatggcgcaacaaacattttataccgtcgcgaagatggaaacctaggattaatagaagctaaa

SEQ ID NO: 3098 - protein, 182 aa, Streptococcus pyogenes
MIKFSIRGENIEVTEAIRDYVESKLTKIEKYFAKDQEIDARVNLKVYRERSSKVEVTIPLDSVTLRAEDVSQDMYGSIDLVVDKIERQIRKNKTKIAKKHREKVPTGQVFTTEFEAEEVDEIPEVQVVRTKNVTLKPMDVEEARLQMELLGHDFFIYTDSEDGATNILYRREDGNLGLIEAK

SEQ ID NO: 3099 - DNA, 144 bp, Streptococcus agalactiae
atgaacgaatgtgcagggtggatttacattgtaaatccgtcaatgacaaaaaacaataaatctgtcagcgagacagaaaagagcaaagctcaaacttttaatgagagtttgatcctggctcaggacgaacgctggcggcgtgcc

SEQ ID NO: 3100 - protein, 48 aa, Streptococcus agalactiae
MNECAGWIYIVNPSMTKNNKSVSETEKSKAQTFNESLILAQDERWRRA

SEQ ID NO: 3101 - DNA, 348 bp, Streptococcus agalactiae
  misc_feature (1)..(348): n = a, c, g, or t
atggcaattatttaccttatcgttgcagtgtttgctggtgaggcttatattgcaaaagaaataagtaacggtgtcaatggtcttgtttatgccctccaactagctgggcaatttgcggcaggtgtattcgttattttagcaggtgtacgccttatcctaggtgaaattgtaccagcctttaagggaatctcagaaaaattggttccaaattcaaaaccagccttggattgtccaattgtttacccttatgcacctaatgcagtattgattggttttatctcaaagtttgttggtggattggttagtatgatagtcatgattgtgactggcactannnnnttaattaat

SEQ ID NO: 3102 - protein, 116 aa, Streptococcus agalactiae
  misc_feature (1)..(116): Xaa = Any Amino Acid
MAIIYLIVAVFAGEAYIAKEISNGVNGLVYALQLAGQFAAGVFVILAGVRLILGEIVPAFKGISEKLVPNSKPALDCPIVYPYAPNAVLIGFISKFVGGLVSMIVMIVTGTXXLIN

SEQ ID NO: 3103 - DNA, 1023 bp, Streptococcus agalactiae
atgacaaaaccaattatcttaacaggtgatagaccgacaggaaagttgcatattggacattatgtaggtagcttaaaaaatagagttctacttcaaaatgagggtagctatactttatttgtctttttagcagaccaacaagcactgacagaccatgctaaagatccgcaaactattgttgaatcaattggtaatgttgcacttgattatttagctgttgggttagatccaaacaagtcgactttattcattcaaagtcaaattcctgagttagcagaattaagtatgtattatatgaacttggtttcacttgcacgtttagaacgtaatccaactgtaaaaacagaaattgctcaaaaaggttttggtgagtctattccagcaggattcttagtttatcctgttgcacaagcagctgatataaccgcttttaaagctaaccttgttcctgtagggactgaccaaaaaccaatgattgaacaaacacgtgaaatagttagatctttcaatcatgcttataattgtcaggttttagttgaaccagagggaatctatccagaaaatgatgcagcaggtcgtctgccagggttagatggtaatgcaaaaatgtctaagtcattaaataatggaatctttttagcagatgatatggatacagttaagaaaaaagttatgagtatgtatactgatccaaaccacattaaagtagaagaaccaggacaaatcgaaggtaatatggtatttcattaccttgatgtttttggaagagatgaagaccaaaaagagattactgctatgaaagaacactatcaaaaaggtggacttggggatgttaaaacaaaacgttatctacttgatatcttagagcgtgaattatcacctattagagaacgtcgcctcgaatatgctaaagatatgggacaagtttatcaaatgttacaaaaaggtagtgagaaagctcaagctgttgcagcctctactttggatgaggttaaatcagccatgggtttgaactattttaaa

SEQ ID NO: 3104 - protein, 341 aa, Streptococcus agalactiae
MTKPIILTGDRPTGKLHIGHYVGSLKNRVLLQNEGSYTLFVFLADQQALTDHAKDPQTIVESIGNVALDYLAVGLDPNKSTLFIQSQIPELAELSMYYMNLVSLARLERNPTVKTEIAQKGFGESIPAGFLVYPVAQAADITAFKANLVPVGTDQKPMIEQTREIVRSFNHAYNCQVLVEPEGIYPENDAAGRLPGLDGNAKMSKSLNNGIFLADDMDTVKKKVMSMYTDPNHIKVEEPGQIEGNMVFHYLDVFGRDEDQKEITAMKEHYQKGGLGDVKTKRYLLDILERELSPIRERRLEYAKDMGQVYQMLQKGSEKAQAVAASTLDEVKSAMGLNYFK

SEQ ID NO: 3105 - DNA, 1023 bp, Streptococcus pyogenes
atgatgacaaaacctattattttaactggagatagaccaactggaaaattacatttaggtcattatgtcggaagtcttaaaaatcgtgtctttttacaaaatgaaaacaagtataagatgtttgttttcttggccgatcaacaggcactgacggatcatgctaaagaatccgaattaattcaagaatctattggaaatgttgccttggattacctctctgtcggtttggatccgaagcaatcaacgatttttattcaaagtcagattccagagctagctgaattgagcatgtattatatgaatctggtatcattagcacgtttggaaagaaatcccactgttaaaaccgaaattgctcagaaaggttttggcgaaagtattccatctggttttttggtttatccagtatcacaggccgctgatattacagcatttaaagcgaatttagtacctgtaggtaacgaccagaaaccgatgattgaacaaacacgtgaaattgtgagaagttttaatcatacttaccatacagactgtttagtagaacctgaaggtatttatccagaaaatgaaaaagctggacgcttacctggtcttgatggcaatgccaaaatgtctaagtcattgggaaatggaatctatctctcagatgatgcagataccgttcgcaaaaaagtgatgagcatgtatactgatccaaatcatattaaaatagaagatcctggtcaaattgaagggaatatggtctttcattatttggatatttttgctagaaaagaagatcaagctgatatcgaagcaatgaaagagcattatcaaataggtggtttaggagatgtgaaaacgaaacgctaccttttagatattttagaacgtgaattagcacctattcgtgaaagacgtttggagtacgctaaagatatgggagaggtgttccgtatgttacaagaaggtagtcaaaaagcaagaactgtggcagccaagactttatcagaagtgaagtcagcaatgggtattaattatttt

SEQ ID NO: 3106 - protein, 341 aa, Streptococcus pyogenes
MMTKPIILTGDRPTGKLHLGHYVGSLKNRVFLQNENKYKMFVFLADQQALTDHAKESELIQESIGNVALDYLSVGLDPKQSTIFIQSQIPELAELSMYYMNLVSLARLERNPTVKTEIAQKGFGESIPSGFLVYPVSQAADITAFKANLVPVGNDQKPMIEQTREIVRSFNHTYHTDCLVEPEGIYPENEKAGRLPGLDGNAKMSKSLGNGIYLSDDADTVRKKVMSMYTDPNHIKIEDPGQIEGNMVFHYLDIFARKEDQADIEAMKEHYQIGGLGDVKTKRYLLDILERELAPIRERRLEYAKDMGEVFRMLQEGSQKARTVAAKTLSEVKSAMGINYF

SEQ ID NO: 3107 - DNA, 954 bp, Streptococcus agalactiae
ttggtaaaagaacatcaaaaaatcgtagttgccttaggtggcaacgctattctatcaacagatgcttcagcaaaagcacaacaagaagcattaatcaacacatcaaaatcactggtcaaactgattaaagaaggccatgatgtcattgttactcatggaaatggtccccaagttggtaacttattgctacagcaagcagcttcagattctgaaaagaatccagcaatgcctttggatacttgtgttgccatgacagaaggaagtattggtttttggttacaaaatgctcttaacaatgaattacaagaacaaggcattgacaaagaggttgcaacagtggtaactcaagttattgtagatgaaaaagatcaagctttcactaatccaacaaaacctattggcccattcttatctgaagaagatgccaagaaacaagcccaagaaacaggttcaaaatttaaagaagatgctggccgtggatggcgtaaagtcgttccttcaccaaaaccggttggtatcaaagaagcttctgttattagacggttagtggactctggtgtggttgttattagcgcaggtggcggaggtgtaccagttattgaagatgctaatacaaaggcattaaaaggggttgaagctgttattgacaaagactttgccagtcaaactttatcagaacttgttgatgctgacttattcatcgtcttaactggcgttgacaacgtttttgttaattttaataaacctaatcaagaaaaattagaagaagttactgtttcacaaatgaaacaatatatcactgaaaatcaatttgcccctggaagtatgctaccaaaggtcgaagctgcgattgcttttgttgaaaataaacctgaatcacgagctattattacttcacttgaaaatattgataatgttttagcccaaaatgcagggacacaaattgttgcaaat

SEQ ID NO: 3108 - protein, 318 aa, Streptococcus agalactiae
MVKEHQKIVVALGGNAILSTDASAKAQQEALINTSKSLVKLIKEGHDVIVTHGNGPQVGNLLLQQAASDSEKNPAMPLDTCVAMTEGSIGFWLQNALNNELQEQGIDKEVATVVTQVIVDEKDQAFTNPTKPIGPFLSEEDAKKQAQETGSKFKEDAGRGWRKVVPSPKPVGIKEASVIRRLVDSGVVVISAGGGGVPVIEDANTKALKGVEAVIDKDFASQTLSELVDADLFIVLTGVDNVFVNFNKPNQEKLEEVTVSQMKQYITENQFAPGSMLPKVEAAIAFVENKPESRAIITSLENIDNVLAQNAGTQIVAN

SEQ ID NO: 3109 - DNA, 948 bp, Streptococcus pyogenes
atgacgaaacaaaaaatcgtagtcgcacttggaggaaatgctattctttcaacagatgcgtcagcaaaagcacaacaagaagccttgatttccacatcaaaatcactggttaaattaattaaagaaggtcatgaagtcatcgtgacccacggcaatggcccacaagttggtaatctcttgttacaacaagcagcagcagattctgaaaagaatccggctatgcctttggatacttgtgttgccatgacagaaggtagcatcggtttttggttagttaatgccctcgataatgaattgcaagcccaaggtattcaaaaagaagtggcagctgttgtcactcaagtgatcgtggatgccaaagacccagcttttgaaaacccaacaaaaccaattggtccatttcttaccgaagaagatgccaaaaaacaaatggcggagtctggtgcaagtttcaaagaagatgcaggtcgtggctggcgtaaggttgtgccatcaccaaaaccagttggtattaaagaagccaatgtcatcagaagtctcgttgattctggcgttgttgtggttagtgctggtggtggcggtgtgcccgttgtggaagatgctactagcaagaccctgactggtgtggaagctgttattgacaaggactttgctagtcaaaccctttcagaattggtggacgcagacctctttatcgttttgacaggagttgataatgtttacgtcaacttcaacaaacctgaccaagccaaattggaagaagtgactgtctctcaaatgaaagaatacatcacacaagaccaatttgcaccaggtagtatgttaccaaaagtggaagctgccattgcttttgttgaaaacaaaccaaatgctaaagccattatcacatcgctcgaaaatattgacaatgtactatcagcaaacgctggaacacaaattatcgcaggg

SEQ ID NO: 3110 - protein, 316 aa, Streptococcus pyogenes
MTKQKIVVALGGNAILSTDASAKAQQEALISTSKSLVKLIKEGHEVIVTHGNGPQVGNLLLQQAAADSEKNPAMPLDTCVAMTEGSIGFWLVNALDNELQAQGIQKEVAAVVTQVIVDAKDPAFENPTKPIGPFLTEEDAKKQMAESGASFKEDAGRGWRKVVPSPKPVGIKEANVIRSLVDSGVVVVSAGGGGVPVVEDATSKTLTGVEAVIDKDFASQTLSELVDADLFIVLTGVDNVYVNFNKPDQAKLEEVTVSQMKEYITQDQFAPGSMLPKVEAAIAFVENKPNAKAIITSLENIDNVLSANAGTQIIAG

SEQ ID NO: 3111 - DNA, 1437 bp, Streptococcus agalactiae
atgaggtataaaatggaaaaagaaaaaaaattaggtcttttaccactaacaatgcttgtcattggctctcttatcggtggcggaatctttgatttaatgcaaaatatgagttccagagccggtttggtaccaatgcttattgcttgggtaattactgctatcgggatggggactttcgttttaagttttcaaaatttatctgaaaaaaggccggacctaacagctggaatctttagttacgctaaagaggggtttggaaactttatgggatttaactctgcatggggttattggttatcagcttggcttggaaatgttgcctacgctgcactcttattcagttcactcggttatttctttaaattctttggtaatggaaataatatcatctcaattattggagcaagtatagttatttgggttgtccatttcttaattttaagaggtgttaatacagctgcatttattaataccatagttacctttgcaaaattagtacctgttattattttcttaatttcagcgttattagctttcaaatttaacatttttagtcttgatatctggggaaatggattacatcaatcaattttcaaccaagtcaattcaactatgaaaaccgctgtttgggtatttattggtattgagggcgccgttgtcttctcaggtcgtgctaaaaaacactctgatattggtaaagcaagtatcctagcattattcactatgatttcactttatgtattgatttctgttttatcacttggtatcatgtcacgtccagaacttgcaaacttaaaaacaccagctatggcttacgttctagaaaaggctgttggtcactggggcgctatcttagttaaccttggtgttatcatttcagtatttggcgctattcttgcttggactttatttgcagcagaattaccatatcaagctgctaaagaaggtgcttttcctaaattctttgcaaaagaaaataaaaacaaagctccaatcaattcactcttagtcactaatctttgtgtacaagcattcttaatcacgttcttattcacacaaagtgcttatcgttttggtttcgcattagcatcatctgctatcttaattccttatgcttttacagcactatatcaattacaattcacactccgtgaggataagtcaactccaggacatcaaaagaatttaattatcggtatcctcgctacaatctatgctgtttaccttatctacgctggtggttttgattacttacttttgacaatgattgcttacactctaggtatgattctctatattaaaatgagaaaagatgacaagcttcctatctttgtgggatatgaaaaaattagtgccattgtcattctagcgctttgcttattatgtattattgaaattatgactggacaaattgacattgctgcaatcctagcaggt

SEQ ID NO: 3112 - protein, 479 aa, Streptococcus agalactiae
MRYKMEKEKKLGLLPLTMLVIGSLIGGGIFDLMQNMSSRAGLVPMLIAWVITAIGMGTFVLSFQNLSEKRPDLTAGIFSYAKEGFGNFMGFNSAWGYWLSAWLGNVAYAALLFSSLGYFFKFFGNGNNIISIIGASIVIWVVHFLILRGVNTAAFINTIVTFAKLVPVIIFLISALLAFKFNIFSLDIWGNGLHQSIFNQVNSTMKTAVWVFIGIEGAVVFSGRAKKHSDIGKASILALFTMISLYVLISVLSLGIMSRPELANLKTPAMAYVLEKAVGHWGAILVNLGVIISVFGAILAWTLFAAELPYQAAKEGAFPKFFAKENKNKAPINSLLVTNLCVQAFLITFLFTQSAYRFGFALASSAILIPYAFTALYQLQFTLREDKSTPGHQKNLIIGILATIYAVYLIYAGGFDYLLLTMIAYTLGMILYIKMRKDDKLPIFVGYEKISAIVILALCLLCIIEIMTGQIDIAAILAG

SEQ ID NO: 3113 - DNA, 1341 bp, Streptococcus pyogenes
atggcgtcaaatcacatgaacgaacaagaaagagaacaggcaaagtttagcttgagcggtgccactctttacgggatcaatgccgttatcggctctggtatttttctcttacctagggccatttataagggccttggccctgcatccatcgctgttatgtttggaacagctattttgaccatcatgttggcagtttgttttgcagaagtctctggttattttgggaaaaacggcggagccttccaatattccaaacgagcttttggtgattttattggctttaacgttggcttccttggttggaccgttaccatcttcgcttgggcagccatggcagctgggtttgccagaatgtttatcattactttccctgcctttgaaggttggcacattccacttagtattgggttaatcatcttactatctttgatgaatatcgctggtttgaaaacctctaaaattgtcaccatcacagccaccattgctaagttaattccaatcgttgccttttgtgcctgtacccttttcttcatcaaaaacgggcttcctaactttaccccatttgttcagttggaaccagggactaacctcttaggggctatctccaatactgctgtttatatcttctatggctttatcggttttgaaaccctctctattgtcgctggggaaatgcgtgaccctgaaaaaaatgtaccgcgtgctcttttaggatcaatcagtatcgtctctgtcttatatatgctgattatcggtggaaccattgccatgcttggctctcaaatcatgatgaccaatgcacctgttcaagatgcctttgttaaaatgataggccctgctggcgcttggatggtctcaatcggtgctttaatttccattacaggtcttaacatgggagaatccatcatggtgccacgttacggtgctgccattgctgatgaagggctcttaccagctgctattgccaagcaaaatcaaaatggcgcgccactcgttgctatcttggtttcaggagcaattgccattgtactcctgcttactggctcatttgaaagcttagcaaaactcagtgttgttttccgcttcttccaatacattccaacagcactagccgttatgaaattacggaaggacgatcccgatgctaatgtgatcttccgagtaccatttggccctattatcccaattcttgcagttatcgttagtttagttatgatttggggtgacaacccaatgaactttgtttatggtgcagttggtgtcatcattgcaagtagtgtgtactaccttatgcacggacgtaaccaccaaatggaccaaatgccccctaaggaacaaatc

SEQ ID NO: 3114 - protein, 447 aa, Streptococcus pyogenes
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCACTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMIGPAGAWMVSIGALISITGLNMGESIMVPRYGAAIADEGLLPAAIAKQNQNGAPLVAILVSGAIAIVLLLTGSFESLAKLSVVFRFFQYIPTALAVMKLRKDDPDANVIFRVPFGPIIPILAVIVSLVMIWGDNPMNFVYGAVGVIIASSVYYLMHGRNHQMDQMPPKEQI

SEQ ID NO: 3115 - DNA, 1011 bp, Streptococcus agalactiae
atgacacaagtatttcaaggacgtagtttcttagcagaaaaagatttttctcgtgaggaatttgaatatcttattgatttttcagctcatttaaaagaccttaaaaaacgtggtgttcctcatcattatcttgaaggtaaaaatattgctctcttatttgaaaaaacatctactcgtactcgcgcagcctttacaactgcagcaattgacctaggcgctcatccggaataccttggtgcaaatgatattcaacttggtaaaaaagaatcaacagaagatactgctaaggttttaggacgtatgtttgatggtattgaattccgtggttttagccaaagaatggttgaagagcttgctgaattttctggagtacctgtctggaatggtttaacagatgaatggcatccaacacaaatgctagctgactaccttactatcaaagaaaacttcggtaaacttgaaggtattactcttgtttactgtggtgacggacgtaacaatgttgccaactcgcttttagtggctgggactttgatgggggtcaatgtacacatcttttctccaaaagaacttttccctgctgaagagattgttaaattggctgaagaatatgccaaagagtccggggctcacgttctcgttactgataatgtagacgaagctgtaaagggagcagatgtcttttacactgatgtctgggtatcgatgggagaagaagataagttcaaagaacgcgttgaacttcttcaaccatatcaagtaaacatggaactgattaaaaaagctaataatgataatcttatcttcttacactgcttacctgcattccatgatacaaataccgtttacggcaaagacgtcgctgaaaaatttggcgtcaaggaaatggaagttactgatgaagtcttccgtagcaaatatgctcgtcatttcgaccaagctgaaaatcgtatgcacactattaaagctgtaatggctgcaacccttggaaatcttttcattccaaaagtt

SEQ ID NO: 3116 - protein, 337 aa, Streptococcus agalactiae
MTQVFQGRSFLAEKDFSREEFEYLIDFSAHLKDLKKRGVPHHYLEGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYLTIKENFGKLEGITLVYCGDGRNNVANSLLVAGTLMGVNVHIFSPKELFPAEEIVKLAEEYAKESGAHVLVTDNVDEAVKGADVFYTDVWVSMGEEDKFKERVELLQPYQVNMELIKKANNDNLIFLHCLPAFHDTNTVYGKDVAEKFGVKEMEVTDEVFRSKYARHFDQAENRMHTIKAVMAATLGNLFIPKV

SEQ ID NO: 3117 - DNA, 1011 bp, Streptococcus pyogenes
atgacacaagtatttcaaggacgtagcttcctagcagaaaaagattttacacgcgctgaattagaataccttattgatttttcagcacatttgaaagatttgaaaaaacgtggtgtgcctcatcactacttagaaggtaaaaacattgccctcttgtttgaaaaaacatcaactcgtacgcgtgcagcttttacaacagcagccattgacctaggtgctcacccagaatacctcggtgccaatgacatccaacttggtaaaaaagaatcaacagaagacactgctaaagtattgggtcgtatgtttgatgggattgaattccgtggctttagccaacgcatggttgaagaattggcagaattctcaggtgtgccagtttggaatggtttgactgatgaatggcacccaacccaaatgcttgctgactattttacagtgaaagaaaactttggcaaacttgaaggccttacccttgtttactgtggtgacgggcgtaataacgttgccaattcccttcttgtgactggtgctatccttggtgttaatgttcatatcttctcaccaaaagaacttttcccagaagaagagattgtgacattggctgaaggctatgctaaagaaagtggcgctcgtatccttatcacagaagatgctgacgaagctgttaaaggcgcagacgtgctttacacagatgtttgggtatcaatgggtgaagaagacaaattcaaagaacgtgttgaattgcttcaaccatatcaagtcaacatggaccttgttcaaaaagcaggaaatgacaagcttatcttcttgcactgcttgccagctttccatgacacaaataccgtttatggtaaagacgttgctgaaaaattcggcgtgaaagaaatggaagtcactgatgaagtcttccgcagcaaatacgctcgtcattttgaccaagctgaaaaccgcatgcacactatcaaagcggttatggcagcaacccttggtaacctctttattccaaaagtg

SEQ ID NO: 3118 - protein, 337 aa, Streptococcus pyogenes
MTQVFQGRSFLAEKDFTRAELEYLIDFSAHLKDLKKRGVPHHYLEGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYFTVKENFGKLEGLTLVYCGDGRNNVANSLLVTGAILGVNVHIFSPKELFPEEEIVTLAEGYAKESGARILITEDADEAVKGADVLYTDVWVSMGEEDKFKERVELLQPYQVNMDLVQKAGNDKLIFLHCLPAFHDTNTVYGKDVAEKFGVKEMEVTDEVFRSKYARHFDQAENRMHTIKAVMAATLGNLFIPKV

SEQ ID NO: 3119 - DNA, 429 bp, Streptococcus agalactiae
atgaagctattagtcaatcacttgccttaccaaagagctgcaagcctatatattcgcttttctgttttcgttatcgaaagaaatataaaaatggaagaagaattcgatgataatgacgagcaagatactatttatgctgttctttatgatgggaaacagccagtttcaacaggacgctttcttcctgaaactcaaacagaagctcgtttgactcgaattgcgactttaaaaggttatcgtggtaacggctatggtaccaaaattattatagcactagaaaattatgcaaaagaaaatggttatcactatctaactatacatgctgaattgacagcaaaagatttctaccagacacttgggtatcaagctactgggaatatttatatggaagacggggaagcctgtcaaacactcgaaaaatatttaatt

SEQ ID NO: 3120 - protein, 143 aa, Streptococcus agalactiae
MKLLVNHLPYQRAASLYIRFSVFVIERNIKMEEEFDDNDEQDTIYAVLYDGKQPVSTGRFLPETQTEARLTRIATLKGYRGNGYGTKIIIALENYAKENGYHYLTIHAELTAKDFYQTLGYQATGNIYMEDGEACQTLEKYLI

SEQ ID NO: 3121 - DNA, 426 bp, Streptococcus pyogenes
atggcagataaatttgatgccaatgacgaaacaagaacggtttatgcagtcgtttatgacaatgaccagcccgtttcaacaggacaatttttagctgaaacgaaaatagaagcacgattgacacgcattgtaaccttagcagattattgtggttgcggttatggtgccaaagtcactgaagcgctcgaaacttataccagacgagaaggcttttaccaactaaccattcacagtgaactgacagcacaaaccttttatgaaaacctaggttatcagtcctatggtcccaagtgtttagaagatggtgagtattgtcagtcccttgcaaaaaccattcttaaatgggagaagaatatggacatagcaatgctaattgcgattgttggtggtctattaggctgctatctctatctcacaaaaaataat

SEQ ID NO: 3122 - protein, 142 aa, Streptococcus pyogenes
MADKFDANDETRTVYAVVYDNDQPVSTGQFLAETKIEARLTRIVTLADYCGCGYGAKVTEALETYTRREGFYQLTIHSELTAQTFYENLGYQSYGPKCLEDGEYCQSLAKTILKWEKNMDIAMLIAIVGGLLGCYLYLTKNN

SEQ ID NO: 3123 - DNA, 1230 bp, Streptococcus agalactiae
atgactcaaacacatccaattcatgttttctcagaaattggaaaacttaaaaaagttatgctacaccgtccaggtaaagaaatagaaaatctgatgcctgattatttagagagactcttgtttgatgatatcccatttttggaagatgcacaaaaagaacacgatgcgtttgcacaagcacttcgcaacgaaggagtcgaagtactttaccttgaaaatcttgctgccgagtcgttaacaaaccaagaaattcgtgaacagtttatcgatgagtacattggcgaagcaaatgttcgcggtcgtgctactaaaaaagctattcgagaattattactcaatatcaaagataataaagaacttatcgaaaaaactatggcaggtatccaaaagtctgagctacctgaaatcccatcttctgaaaaaggtctaactgatcttgtcgaatctaattatccatttgccatagatccgatgccaaatctttactttacacgtgatccatttgcaactattgggaatggagtttcattaaatcatatgttctctgaaacacgtaatcgcgaaactttatacggtaaatatatctttacacatcacccagagtacggtggaaaagtccctatggtctatgaacgtgaagaaacaactcgtattgaaggtggagatgagcttgtcctttctaaagatgtccttgccgttggtatctctcaacgtactgatgctgcctctattgaaaaactcttagtcaatatttttaaacaaaatttaggttttaaaaaggttttagcatttgaatttgcaaataatcgtaaatttatgcaccttgacacagtctttacaatggttgactatgacaagtttacaattcacccagaaattgaaggcgatcttcgcgtttactctgtaacttacgaaaaccaagatcttcatattgaagaagaaaaaggtgatttggcagatcttctagcgaaaaacctaggagttgagaaagtggaattgattcgttgtgggggtgacaacttagtcgctgctggacgtgaacaatggaatgatggttcaaatacattaactatagcaccaggtgtcgttatcgtttacaacagaaatacaatcacaaatgcaatcttagagtccaaaggattgaaattaattaagattaatggaagtgaattagttcgtgggcgtggtggaccacgctgcatgtcaatgccatttgaacgtgaagacctt

SEQ ID NO: 3124 - protein, 410 aa, Streptococcus agalactiae
MTQTHPIHVFSEIGKLKKVMLHRPGKEIENLMPDYLERLLFDDIPFLEDAQKEHDAFAQALRNEGVEVLYLENLAAESLTNQEIREQFIDEYIGEANVRGRATKKAIRELLLNIKDNKELIEKTMAGIQKSELPEIPSSEKGLTDLVESNYPFAIDPMPNLYFTRDPFATIGNGVSLNHMFSETRNRETLYGKYIFTHHPEYGGKVPMVYEREETTRIEGGDELVLSKDVLAVGISQRTDAASIEKLLVNIFKQNLGFKKVLAFEFANNRKFMHLDTVFTMVDYDKFTIHPEIEGDLRVYSVTYENQDLHIEEEKGDLADLLAKNLGVEKVELIRCGGDNLVAAGREQWNDGSNTLTIAPGVVIVYNRNTITNAILESKGLKLIKINGSELVRGRGGPRCMSMPFEREDL

SEQ ID NO: 3125 - DNA, 1233 bp, Streptococcus pyogenes
atgactgctcaaacaccaattcatgtttattctgaaattggaaaattaaaaaaagtgttgctccacagacccggtaaagaaattgaaaatcttatgccagactacttggaacgcttgttgtttgatgatattccattcttagaggatgcccaaaaagaacatgatgcttttgcccaagctttgcgtgacgaaggtattgaagtcttgtaccttgagaccttagctgcagaatctcttgtcactccagaaattcgcgaagctttcatcgatgaatacctaagtgaagctaatatccgtggaagagctactaaaaaagccattcgtgaattgttgatggctatcgaagacaatcaagaattgattgaaaaaaccatggcaggagttcaaaaatctgaacttccagagatcccagcatctgaaaaaggcttgactgacttggttgaatccaattacccatttgccatcgacccaatgccaaacctttatttcacacgggacccattcgcaactatcggtacaggtgtttctcttaaccacatgttctcagaaacccgtaaccgtgaaaccctttatggtaaatacattttcactcatcacccaatttatggtggtggtaaagtgcctatggtttatgaccgtaatgaaaccactcgcattgaaggtggggacgaacttgttctttcaaaagatgtgcttgcggttggtatttctcaacgtacagatgctgcttctattgaaaaattgttggttaacatctttaaacaaaaccttggcttcaagaaagtattggcctttgaatttgcaaataaccgtaaatttatgcacttagacactgtctttaccatggttgactatgacaaattcaccattcacccagaaattgaaggcgaccttcgtgtttactctgtcacttacgacaatgaagaacttcatatcgttgaagaaaaaggtgatttagcagaacttcttgctgctaaccttggtgttgaaaaagttgaccttatccgttgtggtggtgacaacttagtagcagcaggtcgtgaacaatggaacgatggttctaataccttgaccatcgcaccaggtgtggttgtggtttataaccgtaacaccattaccaatgccattcttgaatctaaaggcttgaagttgatcaagattcacggaagtgaattggttcgcggtcgtggtggacctcgttgtatgtcaatgccatttgaacgtgaagatatt

SEQ ID NO: 3126 - protein, 411 aa, Streptococcus pyogenes
MTAQTPIHVYSEIGKLKKVLLHRPGKEIENLMPDYLERLLFDDIPFLEDAQKEHDAFAQALRDEGIEVLYLETLAAESLVTPEIREAFIDEYLSEANIRGRATKKAIRELLMAIEDNQELIEKTMAGVQKSELPEIPASEKGLTDLVESNYPFAIDPMPNLYFTRDPFATIGTGVSLNHMFSETRNRETLYGKYIFTHHPIYGGGKVPMVYDRNETTRIEGGDELVLSKDVLAVGISQRTDAASIEKLLVNIFKQNLGFKKVLAFEFANNRKFMHLDTVFTMVDYDKFTIHPEIEGDLRVYSVTYDNEELHIVEEKGDLAELLAANLGVEKVDLIRCGGDNLVAAGREQWNDGSNTLTIAPGVVVVYNRNTITNAILESKGLKLIKIHGSELVRGRGGPRCMSMPFEREDI

SEQ ID NO: 3127 - DNA, 618 bp, Streptococcus agalactiae
atggacagaaaccttgaaacagaacttaaacagttactgtctgatagtcattctttagcaaaaaaatatttgcaagagaaagaattcagtcaaaacagagttatccaaacttatcgcaaagcatatcaaacctttaaaactaaaaaaggtgcacgttcaagtatcgaagcattattgaagcgagttaattcaggaaacgaaattactagtataaatcctctagttgatatctataatgccgctagccttaggtttggattacctattggtgctgaggatagtgatacatttagaggtgatttaaaactaactattaccaatggtggtgatgaattttacttgattggcgaagattttaacagaccaactctttcaggtgagcttgcctatgttgatgatgttggagcagtttgccgctgttttaattggcgtgatggaaaacgtactatgattaccgataatactcagaatgcttttttagttatcgaattaattgataatggaagagaaattatttttaaagaagcgttggactttatcgccaccaatacaaatcgttttctaaaagctaaaacacagaccatcatattagataaagaacacagtgaaataacgcta

SEQ ID NO: 3128 - protein, 206 aa, Streptococcus agalactiae
MDRNLETELKQLLSDSHSLAKKYLQEKEFSQNRVIQTYRKAYQTFKTKKGARSSIEALLKRVNSGNEITSINPLVDIYNAASLRFGLPIGAEDSDTFRGDLKLTITNGGDEFYLIGEDFNRPTLSGELAYVDDVGAVCRCFNWRDGKRTMITDNTQNAFLVIELIDNGREIIFKEALDFIATNTNRFLKAKTQTIILDKEHSEITL

SEQ ID NO: 3129 - DNA, 714 bp, Streptococcus pyogenes
atggttgaatttgtagcagatcaaagtttttgggaactttttccaggtgccaaactaggtgtcgtcttattaaaggatgttcagaaccaagcagagtcaccagaagatgtcaaacagctcttagcagacagccatgagttagcaaaagcttatttaacagcagacaattttagtgataatcaggtggttcaagtctaccgcaaggcctatcaacactttaaaaccaaaaaaggagctcgctctagcattgaagcccttctcaagcgggtgtcaaatggtcaaagcattccgtctattaacccactagtggatatttataatgcggctagtctacgttttggtttacctgctggagccgaagatagtgacagttttatcggagatttgcgtctgacgataacagatggtggtgacgacttttacttgattggggatgctgacaacaacccaaccttgccaaatgaactctgttataaagatgatattggagcgttttgtcgttgccttaactggcgagatggcgaacgcaccatggtgacagaacacaccaaaaatgcatttctgatcatcgaagctcttgatcaagaaggtcaaaatagattgcaagaagctctgaaattcattgaaggcagcgcaaaaatgtaccttcatgcaatcacttctgtgcatgtgttggataaagacaatccacacgtgccactttttacagaaaac

SEQ ID NO: 3130 - protein, 238 aa, Streptococcus pyogenes
MVEFVADQSFWELFPGAKLGVVLLKDVQNQAESPEDVKQLLADSHELAKAYLTADNFSDNQVVQVYRKAYQHFKTKKGARSSIEALLKRVSNGQSIPSINPLVDIYNAASLRFGLPAGAEDSDSFIGDLRLTITDGGDDFYLIGDADNNPTLPNELCYKDDIGAFCRCLNWRDGERTMVTEHTKNAFLIIEALDQEGQNRLQEALKFIEGSAKMYLHAITSVHVLDKDNPHVPLFTEN

SEQ ID NO: 3131 - DNA, 93 bp, Streptococcus agalactiae
ttgattaagattactccaattttagaagttggaaacaaattccagtacgatgaatcaacaataaatttagtcatgaaggcctctcaatttttt

SEQ ID NO: 3132 - protein, 31 aa, Streptococcus agalactiae
MIKITPILEVGNKFQYDESTINLVMKASQFF

SEQ ID NO: 3133 - DNA, 678 bp, Streptococcus agalactiae
gtgattacaaaagaacaatatttttatttcagacaactagatgattttaaacactttactattgaacaatttgaccatattgtgagccacattaaacatcgtacagctctaaaaaatcataccttattttttgaaggtgattaccgtgaaaaactgtttttaatccagtcaggacatgtaaaaattgaacaatcagacgcttctggttctttcatttatacagattatgttagacaaggtacggtttttccttatggaggtctctttttggatgatgattaccatttttcagcagtggctattacggatattgagtatttttctctgccaatggctttatacgaagaatactctcttcaaaatatcaatcaaatgaagcatctttgtcggaaatattctaagctattacgagttcatgaaatacgacttcgtaatatggtgacttcaagtgccagtatgagagttatccaatcgcttgcaactctacttttgcaagttcctacagaaaggggacatttaccttttcctattacaacgattgaaattgccaatatgagcggaactactcgcgagacagttagtcatgttttaaaggaattacgccaaaaagatatcgttgaaatgaaaggaaagaagcttctctataataataaaaattatttcaagaaattcattgaa

SEQ ID NO: 3134 - protein, 226 aa, Streptococcus agalactiae
MITKEQYFYFRQLDDFKHFTIEQFDHIVSHIKHRTALKNHTLFFEGDYREKLFLIQSGHVKIEQSDASGSFIYTDYVRQGTVFPYGGLFLDDDYHFSAVAITDIEYFSLPMALYEEYSLQNINQMKHLCRKYSKLLRVHEIRLRNMVTSSASMRVIQSLATLLLQVPTERGHLPFPITTIEIANMSGTTRETVSHVLKELRQKDIVEMKGKKLLYNNKNYFKKFIE

SEQ ID NO: 3135 - DNA, 678 bp, Streptococcus pyogenes
gtgattcgaagagaagattatcaataccttagaaaactaaacgattttcgctacttttctattgaacaatttgacaaaattgtagggcagatggaattccgaaaagctaaaaaggaccatatccttttttttgagggagataaaagagataagctttttctagtgacctctggttatttcaaggtggagcagtccgatcaatcaggaaccttcatgtatacggatttcatcagacacggcaccatttttccttacggtggcctctttacagatgattattaccatttttcagtggtagccatgacagacgtgacttatttttactttccagtcgatttatttgaagattattcgcttgaaaatcgtctacaaatgaaacacttatatagtaagatgtctaagctgctcgagttacatgagttgagggtccgaaacttgattacatcaagtgctagttctcgtgtgattcaatctctggcgattttgctggttgaaatgggtaaagacagtgataccttaccttttcaattaacaacaacagatattgctcaaataagtgggacgacaagagaaacagttagccatgtgcttagagatttgaagaagcaagaattgattaccataaaaggtaagtatttgacttatctagataaagactattttttacaatacacaaag

SEQ ID NO: 3136 - protein, 226 aa, Streptococcus pyogenes
VIRREDYQYLRKLNDFRYFSIEQFDKIVGQMEFRKAKKDHILFFEGDKRDKLFLVTSGYFKVEQSDQSGTFMYTDFIRHGTIFPYGGLFTDDYYHFSVVAMTDVTYFYFPVDLFEDYSLENRLQMKHLYSKMSKLLELHELRVRNLITSSASSRVIQSLAILLVEMGKDSDTLPFQLTTTDIAQISGTTRETVSHVLRDLKKQELITIKGKYLTYLDKDYFLQYTK

SEQ ID NO: 3137 - DNA, 1482 bp, Streptococcus agalactiae
ttgatgtcaaattgggatactaagtttttgaaaaaaggttttacttttgatgatgttctgcttattcctgctgaaagccatgttttaccaaatgaagttgatatgaagacaaagttggctgataatttgacattaaacattccaatcattacagctgcaatggatacagttacagatagtaagatggctattgctattgcacgtgctggtgggcttggtatcattcataaaaatatgtcaatagttgatcaagcagaagaagttcgtaaagttaaacgctcagaaaatggtgttattattgacccattcttcttgacaccagataatactgtctctgaagctgaggaattgatgcaaaactatcgcattagtggagttcctattgtagagacactcgagaatcgtaaattagttggaattattactaaccgtgatatgcgtttcatttctgattataaacaactaatctcagagcacatgacaagtcaaaatcttgtaacagctcctattggtacagatcttgaaactgcagagcgtattcttcatgagcatcgtattgaaaagctacctttagtagatgatgagggacgtctttcaggacttattactattaaggatatcgaaaaagttattgaatttcctaaggcagcaaaagatgaatttggacgtctcttagttgcaggtgcagtaggtgtaacctctgatacttttgaacgtgcagaagctttgtttgaagcaggtgcagatgctattgtcattgatacagcacatggacattcagctggtgtgctccgtaaaattgctgaaattcgtgctcacttccctaatcgcacattgattgcgggaaatattgctacagcagaaggagcgcgtgcactttatgatgcaggtgtggatgtcgttaaagttggtattggtccaggttcaatttgtacgactcgtgtcgttgctggggtaggtgttcctcagattacagctatttacgatgcagcggctgttgcgcgtgagtacggtaagactatcattgctgatggtggtattaaatattcaggtgatattgtaaaagcacttgcagcaggtggaaatgcagttatgctaggttcaatgtttgcaggaacagatgaagcgccaggagaaacagaaattttccaagggcgtaagttcaagacataccgtggtatgggctcaattgcagcaatgaaaaaaggttcaagcgatcgttatttccaaggttctgtaaacgaggctaacaaattggttccagaaggtattgaaggtcgtgtagcatacaaaggttcagtagccgatattgttttccaaatgcttggtggcattcgctctggtatgggatatgtaggtgcagcgaacataaaagaacttcatgataatgctcaatttgttgaaatgtcaggagctggcttgaaagaaagccatccccatgatgttcaaattacaaatgaggcaccaaattattcagtacac

SEQ ID NO: 3138 - protein, 494 aa, Streptococcus agalactiae
MMSNWDTKFLKKGFTFDDVLLIPAESHVLPNEVDMKTKLADNLTLNIPIITAAMDTVTDSKMAIAIARAGGLGIIHKNMSIVDQAEEVRKVKRSENGVIIDPFFLTPDNTVSEAEELMQNYRISGVPIVETLENRKLVGIITNRDMRFISDYKQLISEHMTSQNLVTAPIGTDLETAERILHEHRIEKLPLVDDEGRLSGLITIKDIEKVIEFPKAAKDEFGRLLVAGAVGVTSDTFERAEALFEAGADAIVIDTAHGHSAGVLRKIAEIRAHFPNRTLIAGNIATAEGARALYDAGVDVVKVGIGPGSICTTRVVAGVGVPQITAIYDAAAVAREYGKTIIADGGIKYSGDIVKALAAGGNAVMLGSMFAGTDEAPGETEIFQGRKFKTYRGMGSIAAMKKGSSDRYFQGSVNEANKLVPEGIEGRVAYKGSVADIVFQMLGGIRSGMGYVGAANIKELHDNAQFVEMSGAGLKESHPHDVQITNEAPNYSVH

SEQ ID NO: 3139 - DNA, 660 bp, Streptococcus agalactiae
atgaaaaattatggaaaaattttaaaagagttgagagaggacaaaggtatatccctaagttctctagccaaaagtgctcaattatcaaaatcaactctatcacgttttgaaaatggtgagacacaaataggtattgataaatttattaaagctttacaaacgttggaggttggggtaactatcaatgaagtatccattctagattcaaaagttaaggctggaacttctaatactgatttagagcaattaactttactggaatcttatcgagataatgaagatatcatgagaattttcagtttccaaaaacaacaatcctgtgatagaatagaaagcaatgttctcaaaatattggctaaactttttatttcaaatttagggttaaatatgaggctgcctcaagatgagattaacctggtagttacttatctgaatggtgtgacacagtacaatgatttttatttcaaagtcatctgctattttcaagatattttacctgaagatgttattttaaataagattagtaatatgactaaagaacagttaccttattctaaatcactggtcaatttattgataaaacaagtcattatagctttggaaaaagatagtgttgataaagctatagtatttgctgatcttgctaataaagttagtcaa

SEQ ID NO: 3140 - protein, 220 aa, Streptococcus agalactiae
MKNYGKILKELREDKGISLSSLAKSAQLSKSTLSRFENGETQIGIDKFIKALQTLEVGVTINEVSILDSKVKAGTSNTDLEQLTLLESYRDNEDIMRIFSFQKQQSCDRIESNVLKILAKLFISNLGLNMRLPQDEINLVVTYLNGVTQYNDFYFKVICYFQDILPEDVILNKISNMTKEQLPYSKSLVNLLIKQVIIALEKDSVDKAIVFADLANKVSQ

SEQ ID NO: 3141 - DNA, 864 bp, Streptococcus agalactiae
ttggaaggtttacttattgcattgattcccatgtttgcgtggggaagtattggatttgttagtaataaaattggaggacgtccaaatcaacaaacatttggaatgactttaggagcattgctatttgcgattatcgtatggttatttaaacagccagagatgactgcctcattgtggatttttggtatcttaggtggtatcctatggtcagtcggccaaaatggtcaattccaagcaatgaaatatatgggagtctctgttgctaatccactgtcaagtggtgcacaattagtaggtggaagcctagttggtgctttagtctttcatgaatggactaagccaatccaatttattttaggattgacagcgttgacattattagttatcggcttctatttctcaagtaaacgtgatgtctcagaacaagctttggcaacacatcaagagttttcaaaaggatttgctacaattgcttattcaactgtaggttacatctcatacgcagttttatttaataacattatgaagttcgacgctatggccgttattttacccatggctgttggaatgtgtctaggtgcaatttgtttcatgaagtttcgtgttaactttgaggctgttgttgttaaaaatatgattacaggtctcatgtggggcgttggtaatgtcttcatgttattggcagcagctaaagcagggctagcaattgcttttagtttttctcaacttggagtaattatctctattattggtggtattttatttttaggtgagacaaaaacgaagaaagagcagaagtgggttgtcatgggtatcctttgttttgttatgggtgctatattacttggtattgttaaatcttat

SEQ ID NO: 3142 - protein, 288 aa, Streptococcus agalactiae
MEGLLIALIPMFAWGSIGFVSNKIGGRPNQQTFGMTLGALLFAIIVWLFKQPEMTASLWIFGILGGILWSVGQNGQFQAMKYMGVSVANPLSSGAQLVGGSLVGALVFHEWTKPIQFILGLTALTLLVIGFYFSSKRDVSEQALATHQEFSKGFATIAYSTVGYISYAVLFNNIMKFDAMAVILPMAVGMCLGAICFMKFRVNFEAVVVKNMITGLMWGVGNVFMLLAAAKAGLAIAFSFSQLGVIISIIGGILFLGETKTKKEQKWVVMGILCFVMGAILLGIVKSY

SEQ ID NO: 3143 - DNA, 861 bp, Streptococcus pyogenes
ttggaaggtattttttatgcacttattcccatgtttacatggggaagcattggatttgttagtaacaaaattggaggaaaaccttcgcaacaaactctaggaatgacttttggggctttattattttcattagctgtttggttaattgttagacctgagatgacactgcaactttggctttttggaatattgggtggttttatctggtcaattggtcaaactggtcaatttcatgccatgcaatacatgggagtctccgttgccaatcctttgtcaagtggctctcaacttgttctgggaagtttgattggtgtcctcgtttttcatgaatggacaagacctatgcaatttgtagtaggaagtctagcactattacttctgattgttggtttttacttttctagtaaacaagatgatgctaatgcacaagtcaatcaccttcataatttttcaaaaggatttagggcgctcacttattcaacaattggttacgtgatgtatgctgtattatttaataacatcatgaaatttgaagttttgtcagtcattttacccatggcagtaggtatggttttaggagctataactttcatgtcatttaaaatttccattgaccagtatgtgattaaaaatagcgttgttggattactttggggcattgggaatatttttatgcttttagctgcatcaaaagcaggacttgctattgcctttagtttctcacaattaggtgctatcatttcgattgtcggaggcattttattcctaggcgaaaccaaaaccaaaaaagaaatgcgttgggttgtcacaggaattatttgttttatcgtaggtgctattttattaggtgtggtcaaatct

SEQ ID NO: 3144 - protein, 287 aa, Streptococcus pyogenes
LEGIFYALIPMFTWGSIGFVSNKIGGKPSQQTLGMTFGALLFSLAVWLIVRPEMTLQLWLFGILGGFIWSIGQTGQFHAMQYMGVSVANPLSSGSQLVLGSLIGVLVFHEWTRPMQFVVGSLALLLLIVGFYFSSKQDDANAQVNHLHNFSKGFRALTYSTIGYVMYAVLFNNIMKFEVLSVILPMAVGMVLGAITFMSFKISIDQYVIKNSVVGLLWGIGNIFMLLAASKAGLAIAFSFSQLGAIISIVGGILFLGETKTKKEMRWVVTGIICFIVGAILLGVVKS

SEQ ID NO: 3145 - DNA, 1107 bp, Streptococcus agalactiae
atgtggataaaaaatatttctttaaaacattatcgtaattatgaagaagcacaagtagatttttcacccaacctcaatattttcattggccgcaatgctcaaggaaagacaaattttttagaagcaatctacttcttggctttgactcgaagtcaccgtacccgttctgataaagaacttgtacattttaaacaccatgatgtacaaattacaggtgaggtaatccgcaaaagtggccatcttaacttagatattcaattatctgaaaaaggaagaatcactaaagttaaccatcttaaacaggcaaaattatctgattatattggggctatgactgtcgtactttttgcccctgaagatcttcaattagttaaaggtgcacctagtctaagacgaaaatttttagatatagatattggacaaattaagccaacgtacttagctgaactttcaaattacaatcatgtattaaaacaaagaaacacttatctaaaaactactaataacgtcgacaaaacttttttaacagtccttgatgaacaattagctgattatggaagtcgtgtcattgaacaccgttttgattttatccaagccctaaatgatgaagcggacaaacatcactacattatcagtactgagttagaacatttatctattcactacaaatcgtcaatagagtttacagataagtcaagtattagggaacattttttaaaccaattatctaaaagccactcaagagacatctttaagaaaaacacaagcatcggacctcatcgtgatgatattactttctttattaatgatatcaatgctacttttgctagccaagggcaacaaagaagccttattttatcattgaaattagcagaaattgagctaataaaaaccgttaccaacgattatccgattctcttacttgacgacgtcatgagtgaacttgacaaccatcgtcaactaaaactcttagagggaatcaaagagaatgttcaaacatttattactacaacaagtttagaacatttaagtgctttacctgatcaactcaaaatctttaacgttagtgatggtactattagtattaatgaaaaaaaagcaacagat

SEQ ID NO: 3146 - protein, 369 aa, Streptococcus agalactiae
MWIKNISLKHYRNYEEAQVDFSPNLNIFIGRNAQGKTNFLEAIYFLALTRSHRTRSDKELVHFKHHDVQITGEVIRKSGHLNLDIQLSEKGRITKVNHLKQAKLSDYIGAMTVVLFAPEDLQLVKGAPSLRRKFLDIDIGQIKPTYLAELSNYNHVLKQRNTYLKTTNNVDKTFLTVLDEQLADYGSRVIEHRFDFIQALNDEADKHHYIISTELEHLSIHYKSSIEFTDKSSIREHFLNQLSKSHSRDIFKKNTSIGPHRDDITFFINDINATFASQGQQRSLILSLKLAEIELIKTVTNDYPILLLDDVMSELDNHRQLKLLEGIKENVQTFITTTSLEHLSALPDQLKIFNVSDGTISINEKKATD

SEQ ID NO: 3147 - DNA, 1104 bp, Streptococcus
atgtggattaaagagttagagttaaaacattatcgcaattatgaccacctgcttgcctcattttcgtcgggtttaaatgtctttatcggtaataatgctcaaggaaaaaccaattttctcgaggcaatctattttctatcacttactagaagtcatcgcacgagggctgataaagaattgattcattttgatcactcaactgtttctcttactggtaagattcagcgtattagtggtactgttgatttagaaatcaatctatcagataaaggacgtgtgacaaagattaatgcgctaaagcaagcaaaattatctgattatattggaacgatgatggttgtgctttttgcaccagaagatttgcaactagttaagggagcacctagccttcgtcgcaaatttatcgacattgaccttggtcaaattaagcctgtttacttatctgagttatcccattataaccacgtgcttaaacagcgtaatagctatttaaaaagtgcccaacaaattgatgccgcttttctagctgttctagatgagcaattagctagctatggagcccgtgtcatggaacatcgtattgattttatcaatgcgttagagaaagaagcaaatactcatcaccaagccatctcaaatggtttagaaagtctctctctctcctatcagtcgtcagttgtctttgacaaaaaaactaatatttaccaacaatttttacaccaacttgaaaaaaatcatcagaaagatttcttccgtaaaaacactagcgttggtccacatcgcgatgaattagccttttacattaacgggatgaatgctaactttgctagtcaaggtcagcaccgcagccttatcctttccttaaaaatggctgaagttagtttaatgaaggccttgactggagataatcccattcttttactagacgatgtcatgagcgagctagacaatacacgacaaacaaagttacttgaaacagtaattaaagaaaatgtccaaacctttatcacaacaacaagtttggatcacctgtcacagttgccagaaggtatccgtatttttcacgtgacaaaaggaaccgttcaaattgattctgatattcac

SEQ ID NO: 3148 - protein, 368 aa, Streptococcus pyogenes
MWIKELELKHYRNYDHLLASFSSGLNVFIGNNAQGKTNFLEAIYFLSLTRSHRTRADKELIHFDHSTVSLTGKIQRISGTVDLEINLSDKGRVTKINALKQAKLSDYIGTMMVVLFAPEDLQLVKGAPSLRRKFIDIDLGQIKPVYLSELSHYNHVLKQRNSYLKSAQQIDAAFLAVLDEQLASYGARVMEHRIDFINALEKEANTHHQAISNGLESLSLSYQSSVVFDKKTNIYQQFLHQLEKNHQKDFFRKNTSVGPHRDELAFYINGMNANFASQGQHRSLILSLKMAEVSLMKALTGDNPILLLDDVMSELDNTRQTKLLETVIKENVQTFITTTSLDHLSQLPEGIRIFHVTKGTVQIDSDIH

SEQ ID NO: 3149 - DNA, 351 bp, Streptococcus agalactiae
atggattataaattatttgatgaatatattactttacaatcacttctaaaagagattggtatcattcaaagtggcggagccattaaaaaatttttagcggataatcgagtattgtttaacggtgaccttgaaaataggcgtggaaagaaactccgcctgggggatattattactattcctgatcaaaatatcgagatcattataaggaagccatcagatcaagaaattgaagaacgtaatatagaaatagctgaaaaacagcgtgtttcagcaatcgttaaagaaatgaataaaaacaccaacaaaggtaaatcaaaaactagcaaaaaaccagttcgctttccagggaca

SEQ ID NO: 3150 - protein, 117 aa, Streptococcus agalactiae
MDYKLFDEYITLQSLLKEIGIIQSGGAIKKFLADNRVLFNGDLENRRGKKLRLGDIITIPDQNIEIIIRKPSDQEIEERNIEIAEKQRVSAIVKEMNKNTNKGKSKTSKKPVRFPGT

SEQ ID NO: 3151 - DNA, 435 bp, Streptococcus pyogenes
ttgaatgacaaaatggagatgacaatgatatacaaattatttacagaatttatcaccctacaagcccttcttaaagaattaggaattatccaaagtggtggcgctatcaagggatttctcgctgaaacaaccgttctatttaatggtgaagatgagaaacgtcgaggcaaaaaaatcagagtaggggataagatttctctacctgaccaagacttaattatcactattgttgagcctagtcaagaagaaaaagaacaatttgccgaagaaatggctgaaaagacacgtgtagcggctctagtgaaacaaatgaaccaagctaacaaaaagacttcttctaaacataacaatcgtcaatctactaccaaaaaatcactaagagcaactaagaaaactaaaggtaaaccaactgcacctgtccgcttcccaggtatc

SEQ ID NO: 3152 - protein, 145 aa, Streptococcus pyogenes
LNDKMEMTMIYKLFTEFITLQALLKELGIIQSGGAIKGFLAETTVLFNGEDEKRRGKKIRVGDKISLPDQDLIITIVEPSQEEKEQFAEEMAEKTRVAALVKQMNQANKKTSSKHNNRQSTTKKSLRATKKTKGKPTAPVRFPGI

SEQ ID NO: 3153 - DNA, 1242 bp, Streptococcus agalactiae
atgaaaatagttgaaggcgtttctctacatttaattaaaaaccaacaatttaagactaatcatcttacttttcgattttcaggtgattttaataataaaacagtagcacgtagatcgctcgttgctcaaatgttagttactgcaaatgctaagtatcctaaggtacaagaatttcgagaaaagttagcttccttatatggcgctagtttatcaactaagatttctactaagggtcttgttcacattgttgatattgatattgtatttgttaaaaatacctttactttagaacaagaaaatatcgttgaacaaattattacattcttggaggatatgctgttttctcctttaatttctttagaacagtatcaaacatctatttttgatactgagaagaaaaaccttattcaatatttagaggctgatattgaagataatttttatagcagtgacttagcactaaaatctttattctacaataataagacacttcgtttacctaagtatggtacagcatctttagtggaatcagaaaattcatttacagcttatcaagaatttcagaagatgcttaaggaagatcaattagatatttttgtcgtaggggattttgatgactatcgaatgattcaggcttttaatcgtatggcatttgagccacgtcacaaagtattagcttttgattatacgcagacttatgaaaatataacgagaagtcaagtagaagataaggacgttaatcaatctattatgcaattggcttatcatcttccaataacttataaagatgaagattattttgctttaatagtatttaacggtttatttggtgcttttgcccactccttgttgtttacagaaattcgagaaaagcaaggtttagcctatactataggtagtcaatttgacagctttacaggtctctttacgatatatgcaggtattgataaagagaatcgtgagcgttttttgaagcttattaataagcaattcaataatattaagatgggcaggttttcttctacattattgaaacaaacaaaagatatattgaaaatgaactatgttttagcttctgataatcctaaggtcatagttgaccacatttatcatgaacattatttagatcagtttcatacttcagcactattcattgacaaagtagacgatgtaacaaaatcagatattgtcagcgtagcaacaaaattaaaattacaagctttttattttttggaaggaaac

SEQ ID NO: 3154 - protein, 414 aa, Streptococcus agalactiae
MKIVEGVSLHLIKNQQFKTNHLTFRFSGDFNNKTVARRSLVAQMLVTANAKYPKVQEFREKLASLYGASLSTKISTKGLVHIVDIDIVFVKNTFTLEQENIVEQIITFLEDMLFSPLISLEQYQTSIFDTEKKNLIQYLEADIEDNFYSSDLALKSLFYNNKTLRLPKYGTASLVESENSFTAYQEFQKMLKEDQLDIFVVGDFDDYRMIQAFNRMAFEPRHKVLAFDYTQTYENITRSQVEDKDVNQSIMQLAYHLPITYKDEDYFALIVFNGLFGAFAHSLLFTEIREKQGLAYTIGSQFDSFTGLFTIYAGIDKENRERFLKLINKQFNNIKMGRFSSTLLKQTKDILKMNYVLASDNPKVIVDHIYHEHYLDQFHTSALFIDKVDDVTKSDIVSVATKLKLQAFYFLEGN

SEQ ID NO: 3155 - DNA, 1242 bp, Streptococcus pyogenes
atgaaaattgttcagggagtacaacttcatctgattaagaccaaacagtttaaaaccaatcatattacctttcgtttttcaggtgatttgaaccaaaaaacagtagcaaaaaaagtcttagtggcacagatgttagcaacagctaatgagtgttatccaactgttaggcagtttagagaaaaattagcacgactttatggagctagcttgtcaactaacgtgttaacaaaagggttagttcatattgtggatatcgatattacttttattcaagatagatatgcttgcaatggggaaaaaatactagatgaaatgattcagtttttaaaagatatcttgttctcacccctattatccatcgcccagtatcagcctaaagtttttgagactgaaaaaaataatttgattaactacatcgagtcagatagagaggattctttttactacagctctcttaaggtaaaagaattgttttattgtaataagaatctacaaatgtcagaatatggtagcccagaactaattgcaaaagagactgcctatactagctatcaagaatttcataaaatgctcaatgaagatcagattgatattttcattttaggagattttgatgattatcgcgttgttcagctaattcatcaatttccacttgataaccgaaataaaaacctaaatttctttcatttacaaaattctgtcaatattattaaagaatctattgaaaaaagagcagttcatcaatctattttacaattagcttatcacttcccttcagtttttggacaacgtgactattatgctttagttcttttaaatgggttgttaggctcttttgcacattcccgtctctttataaaaattagagaagaagaaggacttgcttatagtatagggtgtcgttttgatagttatacaggattatttgaaatttatactggaattgacagtcaacatcgcactaaaacgttacaactaatcatccaagaattaaatgccattaaaatgggacgattctcagaacaattgattaaaaagaccagatcgatgttgttgaataatgccttattatcagaagattataataaaaatataattgaaagaatatacagatcttcttacattgattcttcttattctattaaaaattggattaaaggggttaatgaagttaataaagcagatatcattaaagtagctaatcttttaaagcttcaaactgtctattttttagaaggaata

SEQ ID NO: 3156 - protein, 414 aa, Streptococcus pyogenes
MKIVQGVQLHLIKTKQFKTNHITFRFSGDLNQKTVAKKVLVAQMLATANECYPTVRQFREKLARLYGASLSTNVLTKGLVHIVDIDITFIQDRYACNGEKILDEMIQFLKDILFSPLLSIAQYQPKVFETEKNNLINYIESDREDSFYYSSLKVKELFYCNKNLQMSEYGSPELIAKETAYTSYQEFHKMLNEDQIDIFILGDFDDYRVVQLIHQFPLDNRNKNLNFFHLQNSVNIIKESIEKRAVHQSILQLAYHFPSVFGQRDYYALVLLNGLLGSFAHSRLFIKIREEEGLAYSIGCRFDSYTGLFEIYTGIDSQHRTKTLQLIIQELNAIKMGRFSEQLIKKTRSMLLNNALLSEDYNKNIIERIYRSSYIDSSYSIKNWIKGVNEVNKADIIKVANLLKLQTVYFLEGI

SEQ ID NO: 3157 - DNA, 1281 bp, Streptococcus agalactiae
atgacagttaataaaataacttatcagaaccttcaggaggaagtatataagttaacattagagagcggactaaatgtataccttattccaaagccatcatttaaggaaactgttggagtattgacagcaaattttggatcactccatacaaaatatacgaggaatggttgtgtagaacattatccggcaggaattgctcacttcttagaacataaattatttgaactggataaaggacaagacgctgcaactcaatttactaaatatggcgccgagagtaacgcctttacaacttttgataaaactagtttttatttttcaactataagtcacattacaaactgcttagatatactacttgactttgtattgacaacaaactttacagaagagtcaattactaaagaaaaagatattatcaaacaagaaattgaaatgtatcaagatgacccagaatataggctttatcaaggagtgttatcgaacctttaccccaactctccattagcatttgatatcgctggagattaccaatcaatctctcaaataaccttaaccgatttacaagaaaatcacaaagacttttatcagttgtctaatatgaatttagttcttgttggacaatttagtccacaagaaattataacttaccttcaaaaaaattctcatttcacaagttactcacagaatattgaccgagattctattagccttgagcctgttataaaaaacaactcttgccatatgacagtgacaaaacctaaattagctattggttatcgaaaatcaaatcatatgatacatggttcttacctaaaagagaaaatcggattacagctattttttgcaatgcttttaggatggacttctacaattaaccaagactggtacgaatctggtcaaattgatgattcttttgatatagaaattgaagttcatccagattttgagtgcgttattatttctttagatacgacagagccaattgctttttcaactcagttgaggttattgctaaaaaatgctttgcaatcatctgatcttaccgaaagccacttaaaaaacgttaagagagagctctatggcgattttttaagaagcttagattctattgaaaatctcgcaatgcaattcgtcacctatttatatgatggaaaaacgatgtatttggatttgccatctatcgttgaagaattagatttggaagatgtcattacgattggtaaggatttcttagataatgctgacacatctgacttcgttatttttccaaaatcttcg

SEQ ID NO: 3158 - protein, 427 aa, Streptococcus agalactiae
MTVNKITYQNLQEEVYKLTLESGLNVYLIPKPSFKETVGVLTANFGSLHTKYTRNGCVEHYPAGIAHFLEHKLFELDKGQDAATQFTKYGAESNAFTTFDKTSFYFSTISHITNCLDILLDFVLTTNFTEESITKEKDIIKQEIEMYQDDPEYRLYQGVLSNLYPNSPLAFDIAGDYQSISQITLTDLQENHKDFYQLSNMNLVLVGQFSPQEIITYLQKNSHFTSYSQNIDRDSISLEPVIKNNSCHMTVTKPKLAIGYRKSNHMIHGSYLKEKIGLQLFFAMLLGWTSTINQDWYESGQIDDSFDIEIEVHPDFECVIISLDTTEPIAFSTQLRLLLKNALQSSDLTESHLKNVKRELYGDFLRSLDSIENLAMQFVTYLYDGKTMYLDLPSIVEELDLEDVITIGKDFLDNADTSDFVIFPKSS

SEQ ID NO: 3159 - DNA, 1287 bp, Streptococcus pyogenes
atgacaaaattagtaaagataaactatcctaatattgacgaagacctttactatgtaaaattagaaaatggtttaactgtttattttataaaaaaaatagggtttttagaaaaaacagctatgttgacagtaggtttcggttctcttgacaataagttgacagtcgatgacgaatcacgagatgctccagcaggtattgcacactttttagaacataaactctttgaagatgaatcaggtggagatatttcattaaagtttacacagctaggagcagagacaaatgcctttacaactttcaaccaaacgagtttcttcttttcaacagctagtaaatttcaggaaaatttggaactccttcaatattttgttctttctgctaatataacagatgaatctgttagtagagaaaaaaaaataatcgggcaagaaattgatatgtatcaagatgatgctgactaccgtgcatatagtggaatccttcagaacttatttccaaaaacaagtttagctaatgatattgctggctcaaaagcatccattcaaaagatcacgaaaatattattggaaacgcatcatacttatttttaccaacctactaatatgagtctattcattgtcggtgatattgatattgacgaaacttttttagctattcaaaggtttcaaaccacattatcctatccagatagaaaaagggtaactgttgatcctttacactattatcctgtcattaaatcatcttctgttgacatggatgttactactgccaagctggttgttggttttcgagggtatctgaccttaactcagcattcactattaacgtatcgtattgccttgaagctatttttatcaatgcttataggttggacttctaaaatctatcatacgctatatgaagatggtaaaatagacgattcatttgatgtggatgttgaaattcatcataattttcaatttgtattaatatcacttgatacaccagagcctatcgcaatgtctaactatatccgtcaaaaattagctactataaagatatcaaaagagtttacaaatgagcacttaaatctattaaaaaaagaaatgtatggtgactttattcagagtttagactctatagaacatttaacccatcagttcagtctatacctgtctgattctgataaagaaacatattttgatattccaaaaattatagaaagactcactctaaaagatgttgttacaattggaaaagcattttttgaaaaagctgatgcttcagacttcacagtcttcccaaaa

SEQ ID NO: 3160 - protein, 429 aa, Streptococcus pyogenes
MTKLVKINYPNIDEDLYYVKLENGLTVYFIKKIGFLEKTAMLTVGFGSLDNKLTVDDESRDAPAGIAHFLEHKLFEDESGGDISLKFTQLGAETNAFTTFNQTSFFFSTASKFQENLELLQYFVLSANITDESVSREKKIIGQEIDMYQDDADYRAYSGILQNLFPKTSLANDIAGSKASIQKITKILLETHHTYFYQPTNMSLFIVGDIDIDETFLAIQRFQTTLSYPDRKRVTVDPLHYYPVIKSSSVDMDVTTAKLVVGFRGYLTLTQHSLLTYRIALKLFLSMLIGWTSKIYHTLYEDGKIDDSFDVDVEIHHNFQFVLISLDTPEPIAMSNYIRQKLATIKISKEFTNEHLNLLKKEMYGDFIQSLDSIEHLTHQFSLYLSDSDKETYFDIPKIIERLTLKDVVTIGKAFFEKADASDFTVFPK

SEQ ID NO: 3161 - DNA, 561 bp, Streptococcus agalactiae
atgtttccaaaaggagaatttatgatgaagaaagaaaatattccgaatctattaactgtagtcagaattttaatgattccgttatttatagtattaacttcagtaacaacaagtacaacttggcatattgttgcagctattgtatttgctattgcaagtttgaccgattacctagatggttatctagcacgtaaatggcaagtagtaacaaattttgggaaatttgcagacccattagctgataaaatgctagttatgagtgcttttatcatgttagttggactagacttagcaccagcttgggtttcagctattatcatttgtagagagttagcagttacaggtttgcgtttacttttagttgaaacaggtggaacagtacttgctgcagctatgccagggaaaataaagacggctactcaaatgtttgcagttatttttttgttagtacattggatgacacttggtaacatcatgttatacattgctctattctttaccttgtattcaggctacgactattttaaaggtgcaggcttcttatttaaggatacttttaaa

SEQ ID NO: 3162 - protein, 187 aa, Streptococcus agalactiae
MFPKGEFMMKKENIPNLLTVVRILMIPLFIVLTSVTTSTTWHIVAAIVFAIASLTDYLDGYLARKWQVVTNFGKFADPLADKMLVMSAFIMLVGLDLAPAWVSAIIICRELAVTGLRLLLVETGGTVLAAAMPGKIKTATQMFAVIFLLVHWMTLGNIMLYIALFFTLYSGYDYFKGAGFLFKDTFK

SEQ ID NO: 3163 - DNA, 540 bp, Streptococcus pyogenes
atgataaaaaaagaaaatattcctaatctattaactcttgttcgaatcgcaatgattcctttctttctttttattacttcctcatctaataaggtggggtggcatatttttgcagctgtgatttttgcaattgccagttttaccgattatctagatgggtatcttgcgcgtaagtggcatgtagccagtaattttggaaagtttgccgatcctctagcagataagatgcttgtcatgagtgcctttatcatgttagttggacttggcttagttcctgcgtgggtgtcagctgttattatttgccgagaattggcagtaactggtcttcgattactacttgttgaaaccggaggaaaggtccttgcagctgctatgccgggaaaaatcaaaacagcgacacaaatgttgtctattattttattactttgccattggatattcctaggaaacgtcttactctatattgctctttttttcactatttattctggatatgattattttaaaggagcaagctttctttttaaggatacgtttaaa

SEQ ID NO: 3164 - protein, 180 aa, Streptococcus pyogenes
MIKKENIPNLLTLVRIAMIPFFLFITSSSNKVGWHIFAAVIFAIASFTDYLDGYLARKWHVASNFGKFADPLADKMLVMSAFIMLVGLGLVPAWVSAVIICRELAVTGLRLLLVETGGKVLAAAMPGKIKTATQMLSIILLLCHWIFLGNVLLYIALFFTIYSGYDYFKGASFLFKDTFK

SEQ ID NO: 3165 - DNA, 837 bp, Streptococcus agalactiae
atgacaaatattattaccgttaataatctcttttttaaatatgatagtaatcaaacacattatcaattggagaatgtatcgtttcatgtgaaacaaggagaatggctatctattattggtcataatggttctgggaaatccactactgttcgtttaatagatggacttttagaggcggagtctggccagattatcattgatggacaagagttaaccgaagataatgtctgggagttacgtcacaagattggcatggtatttcaaaatcctgataaccaatttgtaggggcaactgttgaagatgacgtcgcctttggtttggaaaataaaggtattcctttgaaagacatgaaagaaagagtggaccaagcacttgatttggtaggaatgtctgaatttaaaatgagggagcctgcacgtttatctggaggacaaaagcagcgtgtagccattgcaggagctgtagctatgcgtccacaagttatcatcttggatgaggcgactagtatgcttgatcctgagggacgattggaactgataagaacgatacgagctattcgtcaaaaatataatcttactgttatttcaattacacacgacttagatgaagttgcattgagtgatcgtgtcatcgttatgaaaaatggtaaagttgagtcgacatccactccaaaagcgttatttggtcgtggaaatcgtttgattagtttaggtttagatgttccctttacaagtaggttaatggcagaactggctgctaatggtcttgatatagggacagagtatcttacagagaaggaattagaagaacaattatgggaattgaatttaaaaatg

SEQ ID NO: 3166 - protein, 279 aa, Streptococcus agalactiae
MTNIITVNNLFFKYDSNQTHYQLENVSFHVKQGEWLSIIGHNGSGKSTTVRLIDGLLEAESGQIIIDGQELTEDNVWELRHKIGMVFQNPDNQFVGATVEDDVAFGLENKGIPLKDMKERVDQALDLVGMSEFKMREPARLSGGQKQRVAIAGAVAMRPQVIILDEATSMLDPEGRLELIRTIRAIRQKYNLTVISITHDLDEVALSDRVIVMKNGKVESTSTPKALFGRGNRLISLGLDVPFTSRLMAELAANGLDIGTEYLTEKELEEQLWELNLKM

SEQ ID NO: 3167 - DNA, 888 bp, Streptococcus pyogenes
atgattattttaaaggagcaagctttctttttaaggatacgtttaaataacatgtcagctattattgaacttaaaaaagttacatttaattaccataaagaccaagaaaaaccaacattagatggcgtatcgtttcatgtgaaacaaggtgagtggctgtctatcattggccataatggatctggtaaatcaacgactattcggttaattgatggattattggaaccagaatcagggtctattattgttgatggagatctactaaccataactaatgtttgggaaattcgtcataaaattggtatggtctttcaaaaccctgataatcagtttgttggagcaactgttgaagatgatgttgcttttgggcttgaaaataaaggtattgcacatgaagatataaaagagagggttaatcatgctttagagttagtcggcatgcagaactttaaagaaaaagaaccagcccgtttatctggtggccaaaaacagcgcgtagctattgcaggtgcagttgctatgaagcctaaaattattattttagatgaagctactagtatgcttgaccctaaaggacgattagagttaatcaaaactataaaaaacatccgtgacgactaccagctgactgttatttccattactcatgacttagatgaagttgctcttagtgatagagttttagtgatgaaagatggtcaagtggaatcaacatcaacaccagaacaattatttgcaagaggggatgaactactccaattaggtcttgatatcccttttacaacatctgttgtacagatgcttcaagaagaaggttatcctgttgactatggatatctcacagaaaaggaattagaaaatcagttatgtcaattaatctccaaaatg

SEQ ID NO: 3168 - protein, 296 aa, Streptococcus pyogenes
MIILKEQAFFLRIRLNNMSAIIELKKVTFNYHKDQEKPTLDGVSFHVKQGEWLSIIGHNGSGKSTTIRLIDGLLEPESGSIIVDGDLLTITNVWEIRHKIGMVFQNPDNQFVGATVEDDVAFGLENKGIAHEDIKERVNHALELVGMQNFKEKEPARLSGGQKQRVAIAGAVAMKPKIIILDEATSMLDPKGRLELIKTIKNIRDDYQLTVISITHDLDEVALSDRVLVMKDGQVESTSTPEQLFARGDELLQLGLDIPFTTSVVQMLQEEGYPVDYGYLTEKELENQLCQLISKM

SEQ ID NO: 3169 - DNA, 840 bp, Streptococcus agalactiae
atgggaattgaatttaaaaatgtaagttatacctatcaagccggcactccttttgaagggcgtgccctttttgacgtcaatctgaaaattgaagatgcttcctataccgcgttcattgggcacacaggttctggaaaatcaactattatgcaacttttgaatggtttacatattcctacaaaaggtgaggtaattgtcgatgatttttctattaaagcaggggacaagaacaaagaaatcaaatttataaggcaaaaagttggtttagtttttcaatttccagaaagtcagctttttgaagagacagttttaaaggatgttgcttttggaccacaaaattttggtatttctcagattgaagctgaaaggctggctgaagaaaaattaaggttagttggtatcagtgaggatttattcgataaaaatccatttgaactttctggagggcagatgaggcgggttgctatagctggtattttagcgatggaacccaaagtactagtactggatgagccaacagctggacttgatcctaagggaagaaaagaattaatgactctttttaaaaatcttcataaaaaaggaatgactatcgtcttagtgactcacttaatggacgatgtagcggattatgctgactatgtgtatgttttagaagcagggaaagtaaccttatcaggacaaccaaaacagatttttcaagaagtagaacttttagaaagtaaacaattaggagttcccaaaatcaccaagtttgctcaaagactatctcataagggattaaatttacctagtttaccaattactattaacgaatttgtggaggctattaagcatgga

SEQ ID NO: 3170 - protein, 280 aa, Streptococcus agalactiae
MGIEFKNVSYTYQAGTPFEGRALFDVNLKIEDASYTAFIGHTGSGKSTIMQLLNGLHIPTKGEVIVDDFSIKAGDKNKEIKFIRQKVGLVFQFPESQLFEETVLKDVAFGPQNFGISQIEAERLAEEKLRLVGISEDLFDKNPFELSGGQMRRVAIAGILAMEPKVLVLDEPTAGLDPKGRKELMTLFKNLHKKGMTIVLVTHLMDDVADYADYVYVLEAGKVTLSGQPKQIFQEVELLESKQLGVPKITKFAQRLSHKGLNLPSLPITINEFVEAIKHG

SEQ ID NO: 3171 - DNA, 840 bp, Streptococcus pyogenes
atgtcaattaatctccaaaatgtaagttatacttatcaagcagggactccttttgaagggcgtgccctttttaacattaatttagatattttagatggttcttatacggcttttatcggacatactggatccgggaaatcgaccattatgcaattgctaaatggtttacacgttccgacaacgggaattgtcagcgtagataaacaagatataacgaatcactctaaaaataaagagattaaatctattcgaaaacatgtaggattagtttttcaatttccagaaagtcaactatttgaagagacagttttgaaagatgttgcttttggccctcaaaattttggggtctctccggaggaagcagaagctttagcgcgtgaaaaactagctcttgttgggatttcagaaaatctttttgaaaagaatccatttgaactctcagggggtcaaatgcgtcgtgttgctattgcgggtatccttgctatgcagccaaaggttttagttttagatgaaccgactgctggtcttgatcctaaagggcgtaaagaattaatgactatttttaaaaagttacaccaatctggcatgactattgttttagtaacccatctgatggatgatgtggccaattacgcagattttgtatatgttcttgacaaaggtaaaattattttatcaggaaaacccaaaacaatttttcaacaagtcagtttgcttgagaaaaaacagttaggagttcctaaggtgactaaacttgctcaaaggcttgttgatagaggaatacctatctcttctttgcctattaccttagaggagctaagagaggtactaaaacatgga

SEQ ID NO: 3172 - protein, 280 aa, Streptococcus pyogenes
MSINLQNVSYTYQAGTPFEGRALFNINLDILDGSYTAFIGHTGSGKSTIMQLLNGLHVPTTGIVSVDKQDITNHSKNKEIKSIRKHVGLVFQFPESQLFEETVLKDVAFGPQNFGVSPEEAEALAREKLALVGISENLFEKNPFELSGGQMRRVAIAGILAMQPKVLVLDEPTAGLDPKGRKELMTIFKKLHQSGMTIVLVTHLMDDVANYADFVYVLDKGKIILSGKPKTIFQQVSLLEKKQLGVPKVTKLAQRLVDRGIPISSLPITLEELREVLKHG

SEQ ID NO: 3173 - DNA, 810 bp, Streptococcus agalactiae
ttgtggaggctattaagcatggataaattgattttgggacgttacataccaggtaattctctcattcataaattagatcctcgaagtaagttactagccatgttgctttttatcattattgttttttgggcaaataatgtagtgacaaatgtgatcgtattcatttttacgttggttattgtgggtttatctcagataaaattttcctattttttcaatggtattaaaccgatggttggtattattttatttacaaccctcttccagatgctgtttgcacaaggcgggcaggttatcttctcgttttggatttttagcatcactagccttgggttacaacaagcagcacttatttttatgagatttgttttaattatcttcttttcgacattacttaccttaactactactccgttaagtttagcagatgctgttgaatctttgttaaaaccattggaagtactgagagtaccagcacacgagattggtttgatgttatcccttagcttacgtttcgttcctactttaatggatgatacaacacgtatcatgaatgctcaaagagctcgtggagttgattttggagagggaaacctaattcataaggttaagtctattatccctattttgattccattatttgcttctagttttaaaagagcagatgcgttggcaattgctatggaagcaagaggttatcaaggcggagccaatcgtagtaagtaccgtttattgaagtggactgttcgggatacttttagtatattacttatgttattattgggtttgagtttgtttctattaaaaaat

SEQ ID NO: 3174 - protein, 270 aa, Streptococcus agalactiae
MWRLLSMDKLILGRYIPGNSLIHKLDPRSKLLAMLLFIIIVFWANNVVTNVIVFIFTLVIVGLSQIKFSYFFNGIKPMVGIILFTTLFQMLFAQGGQVIFSFWIFSITSLGLQQAALIFMRFVLIIFFSTLLTLTTTPLSLADAVESLLKPLEVLRVPAHEIGLMLSLSLRFVPTLMDDTTRIMNAQRARGVDFGEGNLIHKVKSIIPILIPLFASSFKRADALAIAMEARGYQGGANRSKYRLLKWTVRDTFSILLMLLLGLSLFLLKN

SEQ ID NO: 3175 - DNA, 798 bp, Streptococcus pyogenes
atggataagctgattcttggtcgttatattcccggagattctctcattcatcgtcttgacccaagaagtaaattattagcgatgattatttatattgtcattatcttttgggctaacaatgttgtgacaaatttgttgatgttgacttttactttagcagttgtttttttgtcaaaaatcaagttgtctttctttttaaatggggttaaaccaatgattggtattatcctcttcacgactttatttcagatgtttttctcacaaggaggaaaagtaatttttagttggtggttcattagcataactgatttaggattgagccaagctattttaatttttatgcgtttcgttctaattattttcttttcaacgctgttaacgttgacgacaacacctttaagcctatctgatgcagttgaatcattattaaaacctttaacaagatttaaagttccagctcacgagatcggactaatgctttctttaagtttacgttttgtgcctactttaatggatgataccacgcgtattatgaatgcacaaagggcccgtggagttgattttggagagggaaatttaattcaaaaagttaaatccattattcctattttaatccctcttttcgcttcaagctttaaaagagccgacgcattagctattgctatggaagctagaggttatcagggaggagaagggcgaactaaatatcgtcaattagactggcagctaaaagatagtttagctattggaatagtttctttattgggtttgctactttttttcttgaaaacctctttg

SEQ ID NO: 3176 - protein, 266 aa, Streptococcus pyogenes
MDKLILGRYIPGDSLIHRLDPRSKLLAMIIYIVIIFWANNVVTNLLMLTFTLAVVFLSKIKLSFFLNGVKPMIGIILFTTLFQMFFSQGGKVIFSWWFISITDLGLSQAILIFMRFVLIIFFSTLLTLTTTPLSLSDAVESLLKPLTRFKVPAHEIGLMLSLSLRFVPTLMDDTTRIMNAQRARGVDFGEGNLIQKVKSIIPILIPLFASSFKRADALAIAMEARGYQGGEGRTKYRQLDWQLKDSLAIGIVSLLGLLLFFLKTSL

SEQ ID NO: 3177 - DNA, 822 bp, Streptococcus
gtggcaaccaattcaattattgccgacatgacaaaagctattgctggtgataaaatcgatctgcacagcattgtgccaatcggtcaagaccctcatgagtacgaaccattaccagaagatgttgaaaaaacaagtaatgctgatgtgattttctataatggtatcaatctagaagatggcgggcaagcttggttcaccaaactagtgaaaaatgctcaaaaaacgaaaaacaaagattactttgccgtgtctgatggcattgatgtgatttacttggaaggtgcaagcgaaaaaggaaaagaagatccacatgcttggttaaatctcgaaaacggaatcatttattcaaaaaacattgccaaacaattgattgcaaaggatcctaaaaacaaagaaacttatgaaaagaacctaaaagcttatgtggctaaattggaaaaactagacaaagaagccaaatcaaaatttgatgctattgcagaaaataaaaaattgattgtgactagtgaaggctgcttcaagtacttttcaaaagcttacggtgtcccatctgcttatatctgggaaattaacaccgaagaagaaggaacaccagatcaaatttcatcattgattgaaaaactaaaagtcatcaagccatctgcgctttttgtagagtcaagtgtcgatagacgccctatggaaactgtttctaaagatagtggtattcctatttattctgagatctttacagattcaattgctaaaaaaggtaaacctggcgatagttattatgctatgatgaaatggaaccttgacaaaatttctgaaggtctagcaaaa

SEQ ID NO: 3178 - protein, 274 aa, Streptococcus pyogenes
VATNSIIADMTKAIAGDKIDLHSIVPIGQDPHEYEPLPEDVEKTSNADVIFYNGINLEDGGQAWFTKLVKNAQKTKNKDYFAVSDGIDVIYLEGASEKGKEDPHAWLNLENGIIYSKNIAKQLIAKDPKNKETYEKNLKAYVAKLEKLDKEAKSKFDAIAENKKLIVTSEGCFKYFSKAYGVPSAYIWEINTEEEGTPDQISSLIEKLKVIKPSALFVESSVDRRPMETVSKDSGIPIYSEIFTDSIAKKGKPGDSYYAMMKWNLDKISEGLAK

SEQ ID NO: 3179 - DNA, 702 bp, Streptococcus agalactiae
atgaataaaagaagaaaattatcaaaattgaatgtaaaaaaacatcatttagcttatggagctatcactttagtagcccttttttcatgtattttggctgtaatggtcatctttaaaagttcacaagttactactgaatctttgtcaaaagcagataaagttcgcgtagccaaaaaatcaaaaatgactaaggcgacatctaaatcaaaagtagaagatgtaaaacaggctccaaaaccttctcaggcatctaatgaagccccaaaatcaagttctcaatctacagaagctaattctcagcaacaagttactgcgagtgaagaggcagctgtagaacaagcagttgtaacagaaaacacccctgctaccagtcaggcacaacaagcttatgctgttactgagacaacttatagacctgctcaacaccagacgagtggccaagtattgagtaatggaaatactgcaggggctattggctcagcagctgcagcacaaatggctgctgcaacaggagtccctcagtctacttgggaacatattattgcccgtgaatcaaatggtaatcctaatgttgctaatgcctcaggagcttcaggacttttccaaacgatgccaggttggggttcaacagctacagttcaggatcaagttaattcagctattaaagcttatcgtgctcaaggtttatcagcttggggttac

SEQ ID NO: 3180 - protein, 234 aa, Streptococcus agalactiae
MNKRRKLSKLNVKKHHLAYGAITLVALFSCILAVMVIFKSSQVTTESLSKADKVRVAKKSKMTKATSKSKVEDVKQAPKPSQASNEAPKSSSQSTEANSQQQVTASEEAAVEQAVVTENTPATSQAQQAYAVTETTYRPAQHQTSGQVLSNGNTAGAIGSAAAAQMAAATGVPQSTWEHIIARESNGNPNVANASGASGLFQTMPGWGSTATVQDQVNSAIKAYRAQGLSAWGY

SEQ ID NO: 3181 - DNA, 612 bp, Streptococcus pyogenes
atgtttaagaaagaaaatttaaaacaacgttattttaattttggattagtagcgttagctctaacaatattagccatcatttttgccttctcaagtaaaaatgctgatactaagtcttatgctaagaagtcagaaagtaaaatggtaacaatcgacaaggctccaaaaaataatcatgctattactaaagaagaaagcaaagaaaaagcaaagagcattgcttcggagcctattcccacagtagaaaactctgtagctccgacagtaacagaggaagtaccggttgttcagcaagaagtgactcaaactgttcagcaggtatcttcagtagcctataatccaaacaatgtggtactttccaatggaaatactgctggtattgtaggaagtcaagcggcggcacagatggcagcagcaacaggtgttccacaatcaacttgggaacatataattgcgcgtgaatctaatggaaatcctaacgcagctaatgcttctggggcatcagggttgttccagacaatgccaggttggggttctacagcaacggttgaagatcaagtcaatgcagccttgaaagcctatagtgcacaaggtttatcagcttggggttac

SEQ ID NO: 3182 - protein, 204 aa, Streptococcus pyogenes
MFKKENLKQRYFNFGLVALALTILAIIFAFSSKNADTKSYAKKSESKMVTIDKAPKNNHAITKEESKEKAKSIASEPIPTVENSVAPTVTEEVPVVQQEVTQTVQQVSSVAYNPNNVVLSNGNTAGIVGSQAAAQMAAATGVPQSTWEHIIARESNGNPNAANASGASGLFQTMPGWGSTATVEDQVNAALKAYSAQGLSAWGY

SEQ ID NO: 3183 - DNA, 870 bp, Streptococcus agalactiae
atgttttatacaattgaagagctggtagagcaagctaatagccaacataagggtaacatagcagagctcatgatccaaacggaaattgaaatgactggtagaagtcgtgaagaaattcgttatattatgtcccgaaatcttgaagtcatgaaagcttctgttattgatggattaacccctagtaaatcaatcagtggtttaacaggcggtgatgctgtcaagatggatcaatatttacaatcaggaaaaactatttcagataccacaatcctagctgccgttaggaatgctatggctgttaatgagttaaatgctaagatgggactggtctgtgcaacaccaactgcaggtagtgcaggatgtttaccagctgtgatttctacagccattgaaaagcttaatttaacagaagaagagcaacttgattttctatttacagccggcgcatttggtctcgtcattggtaataatgcctctatctcaggtgcagaaggaggttgccaagctgaagttgggtcagctagtgctatggctgcggctgctttagttatggctgctggaggtactcctttccaagctagccaagctatagcatttgttattaaaaatatgcttggacttatctgtgaccctgttgcaggtttagttgaagtcccttgtgtgaagcggaatgctcttggatcaagttttgcacttgttgctgctgatatggccttggctggtattgaatcgcaaattccagtagatgaagttattgatgcaatgtatcaagttggatcaagtttaccgactgcttttcgtgagactgcagaaggaggacttgctgccacgccgacaggaagacgttatagtaaagaaatttttggggaa

SEQ ID NO: 3184 - protein, 290 aa, Streptococcus agalactiae
MFYTIEELVEQANSQHKGNIAELMIQTEIEMTGRSREEIRYIMSRNLEVMKASVIDGLTPSKSISGLTGGDAVKMDQYLQSGKTISDTTILAAVRNAMAVNELNAKMGLVCATPTAGSAGCLPAVISTAIEKLNLTEEEQLDFLFTAGAFGLVIGNNASISGAEGGCQAEVGSASAMAAAALVMAAGGTPFQASQAIAFVIKNMLGLICDPVAGLVEVPCVKRNALGSSFALVAADMALAGIESQIPVDEVIDAMYQVGSSLPTAFRETAEGGLAATPTGRRYSKEIFGE

SEQ ID NO: 3185 - DNA, 870 bp, Streptococcus pyogenes
atgttttatactattgaagaacttgtcaaacaagctgaccaacaatttaatggaaatattgctgaactcatgattgccacggaagtggagatgtctggaagaaatcgagaagatattatcaaaatcatgtcacgcaatttacaagttatgaaagcagctgtaacagaaggactaacctcaaccaaatctatcagtggtttgacagggggcgatgcggtcaaaatggataactacattaaaaaagggaacagcctttctgatactactattcttaatgctgttagaaatgctatagctgtaaacgaattaaatgctaaaatgggacttgtctgtgcaacacccactgcaggaagtgcaggatgcttaccagcagtgctcgcaacagctattgaaaaacttgacttatcagaaaaagaacaattagagtttttatttactgcaggagcttttggtcttgttattggaaataacgcctctatttctggtgcagaaggtggatgccaagcagaagttggttctgcagctgctatgagtgcagctgctcttgttaaagcagccggtggaacatctcatcaagctagtcaagctattgcgtttgttatcaaaaatttattaggacttgtctgtgatcctgttgccggcctagtagaagtgccttgtgtcaaacgcaatgccctaggagcaagtttcgcccttgtcgcagctgatatggctttagctgatattgattctcaaattcctgttgacgaagttattgatgctatgtatcaagtcggctctgccatgccaactgctttccgtgaaacagcagaaggtggtttagccgctactccaactggacgacgttacagcgtagaaatatttggcgaa

SEQ ID NO: 3186 - protein, 290 aa, Streptococcus pyogenes
MFYTIEELVKQADQQFNGNIAELMIATEVEMSGRNREDIIKIMSRNLQVMKAAVTEGLTSTKSISGLTGGDAVKMDNYIKKGNSLSDTTILNAVRNAIAVNELNAKMGLVCATPTAGSAGCLPAVLATAIEKLDLSEKEQLEFLFTAGAFGLVIGNNASISGAEGGCQAEVGSAAAMSAAALVKAAGGTSHQASQAIAFVIKNLLGLVCDPVAGLVEVPCVKRNALGASFALVAADMALADIDSQIPVDEVIDAMYQVGSAMPTAFRETAEGGLAATPTGRRYSVEIFGE

SEQ ID NO: 3187 - DNA, 666 bp, Streptococcus agalactiae
atgaaacatttaaaatttcaatcggtcttcgacattattggtcctgttatgattggaccatcaagtagtcatactgcaggagctgtccgcattggtaaagttgtccattctatttttggtgaacctagtgaagtaacctttcatttatacaattcttttgctaaaacttaccaaggacacggtactgataaagcattggttgcagggattctaggaatggatacagataatccagatattaaaaactctcttgaaattgctcatcaaaaaggaattaagatttactgggatatcctaaaagatagtaattcaccacatccaaatactgcgaaaataactgttaaaaatggggataggagcatgagtattacaggagtgtcaattggtggcggaaacatccaagttactgagttgaatggattctcagtttcattaacaatgaatactcctactttaattatcgttcatcaagatatacctggcatgattgctaaagtaactgatattttatctgactttaacattaatattgctcaaatgaatgtaacacgcgaaagtgcaggagaaaaagctatcatgattatagaagtagattcacgagattgtcaacaagctgtcaaaaagatagaagctattcctcatttacacaatgtcaacttctttgat

SEQ ID NO: 3188 - protein, 222 aa, Streptococcus agalactiae
MKHLKFQSVFDIIGPVMIGPSSSHTAGAVRIGKVVHSIFGEPSEVTFHLYNSFAKTYQGHGTDKALVAGILGMDTDNPDIKNSLEIAHQKGIKIYWDILKDSNSPHPNTAKITVKNGDRSMSITGVSIGGGNIQVTELNGFSVSLTMNTPTLIIVHQDIPGMIAKVTDILSDFNINIAQMNVTRESAGEKAIMIIEVDSRDCQQAVKKIEAIPHLHNVNFFD

SEQ ID NO: 3189 - DNA, 675 bp, Streptococcus pyogenes
ttgcctatgaatacacaaaaatttcaatcagtttttgacatcattgggccagtaatgattggtccatcaagtagtcacacagctggtgccgtcagaattggtaaggtagtccattccatctttggagatattcctgatgaagtgacgtttcacctttataattcatttgctaaaacctacagaggacatggtactgataaggctcttgttgcaggaattatgggtatgggtactgataatcctgatattaaaaattctctagaaattgctcatcaaaaagggataaaaatctattgggatatcttaaaagatagtaatgctccccatcccaatactgttaaaatcagtgtcaaaaaagctgacaaaacacttagtgttactggtgtttcaattggaggaggaaacattcaagtaacagaactaaatggtttttctgtctcgttatccatgaatactcctactatagttactgtacacaaagatattcccggaatgatcgcaaaggtaactgatatcctatcttccaataatattaatatcgccacaatgaatgttacacgtgaatccgctggtgaaaaagctactatgattatagaagtcgattctagagagtgccaagaagcagccaaccaaattgcaaaaattcctcatatttataatgtcaacttctttgac

SEQ ID NO: 3190 - protein, 225 aa, Streptococcus pyogenes
LPMNTQKFQSVFDIIGPVMIGPSSSHTAGAVRIGKVVHSIFGDIPDEVTFHLYNSFAKTYRGHGTDKALVAGIMGMGTDNPDIKNSLEIAHQKGIKIYWDILKDSNAPHPNTVKISVKKADKTLSVTGVSIGGGNIQVTELNGFSVSLSMNTPTIVTVHKDIPGMIAKVTDILSSNNINIATMNVTRESAGEKATMIIEVDSRECQEAANQIAKIPHIYNVNFFD

SEQ ID NO: 3191 - DNA, 1191 bp, Streptococcus agalactiae
atgattgatctaagaacaacttggcccttcaagcctaagttaaaaataaaactttttgatgggagaattcttatgactgataattcaaacattcgtgtcgttgtaggcatgagtggaggtgttgattcatcagtaactgccctgcttttaaaagagcaaggttatgatgttattggtgtttttatgaaaaattgggatgacacagatgaatttggtgtttgtacggctactgaagattataaagatgttgctgctgttgctgatcagatcggcataccatactactctgtcaactttgaaaaagagtattgggacagggttttcgaatattttttagcagaatatcgagcaggtcgtacgccaaatccagatgttatgtgtaataaggaaattaaatttaaagcatttctagattatgcgatgacattaggtgctgactatgtagcaacaggtcattatgcacaagtaacacgtgatgagaacggaatagttcatatgcttagaggagcagataataataaggatcaaacttattttctaagtcaattatctcaggagcaattgcaaaaaacgttatttccacttggtcatttacaaaaaccagaagttcgccgtatagctgaagaagcaggacttgcgaccgctaagaaaaaagactctactggtatttgttttattggagaaaaaaatttcaaggatttcctgggtcaatatttaccggctcaaccaggtcgtatgatgactgttgatggtcgtgacatgggtgaacatgctggtttaatgtattatactattggtcaaagagggggccttggtattggtgggcaacatggtggagataataaaccttggtttgtagttggaaaggatttaagtaaaaacattctttatgtaggtcaaggtttctatcatgactcattgatgtcaactagcttgacagcttctgaaatccactttacacgtgatatgcctaatgaatttaagctagaatgtacagctaagttcagatatcgtcaacctgacagtaaagttacagtttacgtaaaaggtaatcaagcaagggttgtgtttgatgatttacaacgagcaatcacaccaggtcaagctgttgttttttataatgaacaagaatgtttaggcggtgggatgattgatcaggcttatcgtgatgataaaatctgtcaatacatt

SEQ ID NO: 3192 - protein, 397 aa, Streptococcus agalactiae
MIDLRTTWPFKPKLKIKLFDGRILMTDNSNIRVVVGMSGGVDSSVTALLLKEQGYDVIGVFMKNWDDTDEFGVCTATEDYKDVAAVADQIGIPYYSVNFEKEYWDRVFEYFLAEYRAGRTPNPDVMCNKEIKFKAFLDYAMTLGADYVATGHYAQVTRDENGIVHMLRGADNNKDQTYFLSQLSQEQLQKTLFPLGHLQKPEVRRIAEEAGLATAKKKDSTGICFIGEKNFKDFLGQYLPAQPGRMMTVDGRDMGEHAGLMYYTIGQRGGLGIGGQHGGDNKPWFVVGKDLSKNILYVGQGFYHDSLMSTSLTASEIHFTRDMPNEFKLECTAKFRYRQPDSKVTVYVKGNQARVVFDDLQRAITPGQAVVFYNEQECLGGGMIDQAYRDDKICQYI

SEQ ID NO: 3193 - DNA, 1137 bp, Streptococcus pyogenes
ttgatgggagaattttttatgacagataactcaaagatacgtgttgtcgttggtatgagtggtggcgttgattcatctgtaacagctctacttttaaaggagcaaggttatgatgttattggtgtcttcatgaaaaactgggacgatacagatgaatttggtgtttgcacagctactgaagattacaaagatgtagcagccgttgctgataaaatcggtattccttactattcagtcaattttgaaaaagaatattgggacagagtatttgaatatttcttggccgaataccgagcaggtcgtactccaaatcctgatgtcatgtgtaataaggaaataaaatttaaagctttccttgactatgccatgactttaggtgcagattatgtagcaacgggacactatgctcaagtcaagcgtgatgaaaatggtacggttcacatgttacgtggagctgataatggcaaagaccaaacctactttttaagtcaactatcacaggaacaactacaaaagactttattcccccttggtcatttgcaaaagtcagaagttagagaaatcgctgagcgagcagggcttgcaacggctaaaaagaaagattcaacaggtatttgttttattggtgaaaagaatttcaaacagtttttgagccagtacttaccggcacaaaaaggtcgcatgatgactattgatggtcgcgatatgggagaacatgccggccttatgtattatactattggtcagcgtgggggtctgggcattggtggtcagcatggtggggataatcaaccttggtttgttgtcggtaaagatttgtcgcaaaatattttatacgttggtcaaggtttctaccatgaagccctaatgtcaaatagtcttgacgcctcagtcatccattttacacgtgagatgccagaagagttcacatttgaatgtactgctaaatttcgctatcgtcaacccgattcacacgtggcggtgcatgttcgaggagataaggcagaagttgtttttgcagagccacagcgcgcgattactcctggtcaagctgttgttttctatgacggaaaagaatgccttggtggtggtatgattgacatggcttataaaaatgggcagccttgtcagtacatt

SEQ ID NO: 3194 - protein, 379 aa, Streptococcus pyogenes
LMGEFFMTDNSKIRVVVGMSGGVDSSVTALLLKEQGYDVIGVFMKNWDDTDEFGVCTATEDYKDVAAVADKIGIPYYSVNFEKEYWDRVFEYFLAEYRAGRTPNPDVMCNKEIKFKAFLDYAMTLGADYVATGHYAQVKRDENGTVHMLRGADNGKDQTYFLSQLSQEQLQKTLFPLGHLQKSEVREIAERAGLATAKKKDSTGICFIGEKNFKQFLSQYLPAQKGRMMTIDGRDMGEHAGLMYYTIGQRGGLGIGGQHGGDNQPWFVVGKDLSQNILYVGQGFYHEALMSNSLDASVIHFTREMPEEFTFECTAKFRYRQPDSHVAVHVRGDKAEVVFAEPQRAITPGQAVVFYDGKECLGGGMIDMAYKNGQPCQYI

SEQ ID NO: 3195 - DNA, 609 bp, Streptococcus agalactiae
atgatttcaaaatttattttagctttcatggcttttttcgccattatgaatcccatttctaatttgccagcttttatggctttagtagctgatgatgatcagaagatttcacgtcggattgcagcaaaaggagtattacttgcttttgtcattattgtaatctttgtattaagtggccacttactttttaacttatttgggattaccctagccgccctaaaaatatctggtggaatattggtaggcattataggttataaaatgattaatggtatacattcaccaaccaataaaaacctagaggagcataaggatgatccaatgaatgtggcagtttcaccattagcaatgccccttttggcaggtccgggtactattgcaactgctatggggttatcaagtggtggtttatctggcaaactcattactatacttgcttttgccatattatgtgtgataatgtatgttattttaataagtgcaaacgaaattactaaatttcttggaaaaaatgcaatgactataatcaccaaaatgatgggacttattttgatgactatcgggatagagatgctaataacaggcataaaaattggttttcatttaaca

SEQ ID NO: 3196 - protein, 203 aa, Streptococcus agalactiae
MISKFILAFMAFFAIMNPISNLPAFMALVADDDQKISRRIAAKGVLLAFVIIVIFVLSGHLLFNLFGITLAALKISGGILVGIIGYKMINGIHSPTNKNLEEHKDDPMNVAVSPLAMPLLAGPGTIATAMGLSSGGLSGKLITILAFAILCVIMYVILISANEITKFLGKNAMTIITKMMGLILMTIGIEMLITGIKIGFHLT

SEQ ID NO: 3197 - DNA, 1839 bp, Streptococcus agalactiae
gtggaagctagtctagctgctagtcgtatgggatgtaagacacttctagccactatcaacttagaaatgttagcatttatgccttgtaatccttctataggtggctctgctaaaggtatcgttgtcagagagattgacgctttaggtggtgaaatgggtaaaaacattgataaaacctatatacaaatgaaaatgcttaatacaggtaaggggcctgctgtccgtgccttaagagcacaagctgataaagccctctatgcacaaacaatgaagcaaactgtagaaaagcaagaaaatcttaccttaagacaagctatgattgacgaaatacttgttgaagatggaaaggttgtgggggttcgtacagcaactaatcagaaattttcagcaaaatctgttgttataacaacaggtactgctcttcgaggagagattatattaggtgatcttaagtactcctcgggccctaataatagtttagcttctgtgacattggcagataatttaagagacctaggattagaaattggtcgtttcaaaactggaacacctcctcgtgtaaaagcctcctctattaattatgaaaagacagagatacaacctggggatgagcaaccaaatcatttttcatttatgtctagggatgaagattatattactgaccaggtaccgtgctggttgacctatacgaatactttgagtcatgacatcatcaatcaaaatctacaccgtgctcctatgttttctggaatcgttaagggagttggtcctagatattgtccgtcaattgaagataaaattgtgcgttttgctgataaagagcgccaccaactcttcttagaaccagaaggtagatacactgaagaagtttatgttcaagggctatcaacgagtcttcctgaggatgttcaagttgatttattacgttctataaaagggcttgaaaatgctgaaatgatgcgtacaggctatgctattgagtatgatattgtattgcctcatcaattaagagcaacactcgaaacaaaagtaattgctggtttgtttactgcaggacagactaatggtacttcaggttatgaagaagctgctggtcaagggttggttgctgggatcaacgctgctcttaaagttcaagggaagccagaacttattttaaaacgaagtgatgcttacattggtgtcatgattgatgatttagttaccaaagggactctagaaccatatcgtctgttgacaagtcgcgcagaatatcgtctgattcttcgtcatgataatgcagatatgcgtttaacagaaatcggttatgagattggcctagtagatgaagagcgttatgcgatatttaaaaagcgtcaaatgcaatttgaaaatgaattagaacgtttagactctataaagttaaagccagtttctgagacaaataaacggattcaagaattgggctttaaacctttgacagatgctttaactgccaaagaatttatgcgccgcccacaaatcacatatgcagtagcaacggattttgttggttgtgctgatgagccattagacagtaaggttattgaacttttggaaactgaaattaaatacgaaggctatattaaaaaggctttagatcaagttgcaaaaatgaaacgaatggaagaaaaacgtattccccctcatattgactgggacgacattgattctatcgcaacagaagctagacaaaaattcaaaaaaattaacccagaaacgctaggtcaggctagtcgtatttcaggagttaatccagccgatattagtattttaatggtttaccttgaaggaagacaaaaaggtcgtaaaaatatcaat

SEQ ID NO: 3198 - protein, 613 aa, Streptococcus agalactiae
MEASLAASRMGCKTLLATINLEMLAFMPCNPSIGGSAKGIVVREIDALGGEMGKNIDKTYIQMKMLNTGKGPAVRALRAQADKALYAQTMKQTVEKQENLTLRQAMIDEILVEDGKVVGVRTATNQKFSAKSVVITTGTALRGEIILGDLKYSSGPNNSLASVTLADNLRDLGLEIGRFKTGTPPRVKASSINYEKTEIQPGDEQPNHFSFMSRDEDYITDQVPCWLTYTNTLSHDIINQNLHRAPMFSGIVKGVGPRYCPSIEDKIVRFADKERHQLFLEPEGRYTEEVYVQGLSTSLPEDVQVDLLRSIKGLENAEMMRTGYAIEYDIVLPHQLRATLETKVIAGLFTAGQTNGTSGYEEAAGQGLVAGINAALKVQGKPELILKRSDAYIGVMIDDLVTKGTLEPYRLLTSRAEYRLILRHDNADMRLTEIGYEIGLVDEERYAIFKKRQMQFENELERLDSIKLKPVSETNKRIQELGFKPLTDALTAKEFMRRPQITYAVATDFVGCADEPLDSKVIELLETEIKYEGYIKKALDQVAKMKRMEEKRIPPHIDWDDIDSIATEARQKFKKINPETLGQASRISGVNPADISILMVYLEGRQKGRKNIN

SEQ ID NO: 3199 - DNA, 1896 bp, Streptococcus pyogenes
atgacacatgaatttacagaaagctatgacgtcattgtcataggtgcaggtcatgctggtgttgaagccagtttggccactagtcgtatgggttgtaaaactttattggcaacaatcaaccttgatatgttggcttttatgccgtgtaatccttctattggaggatctgccaaagggatagtggttagagagattgatgctcttggcggcgaaatgggtaaaaatattgataaaacttatatccagatgaaaatgcttaatacaggtaagggaccagctgtacgcgctctccgagctcaagcagataaatccctgtatgcgcgtgaaatgaaacatacggttgaaaaacaggctaatttgactcttcgccaaacgatgattgatgatattctagttgaagatggacgagttgtaggtgttttaacagccacaggacaaaaatttgcagctaaggcagttgtagtgacaacaggaacagctctgcgtggcgaaattattttaggagaactcaaatattcttctgggcctaataatagtttggcatcagtaaccttagcagataatttaaaaaaactcggcttagaaattggcagattcaaaacaggaacgcctcctcgtgtcaaagcatcttctattaattacgatcaaacggaaattcagccaggtgatgacaaacctaatcatttttcatttatgtcaaaagatgctgattatctcaaagatcaaattccctgctggttgacttatacgaatcaaactagtcatgatatcattaatcagaacctttacagagcaccgatgttttctggcattgttaaaggtgtaggccctcgttactgcccatctattgaagataagattgttcgctttgctgataaagaacgtcatcaacttttcttagagccagaggggcgtgatacagaagaagtgtatgttcaagggttgtcaacgagtcttccagaagatgtccaaaaagatttgattcattcgatcaaaggacttgaaaaggctgaaatgatgcgcactggttatgctattgaatatgatattgttttacctcaccagctacgtgccacacttgaaaccaagctaatttcaggactctttacggctgggcaaactaatggaacttctgggtatgaagaggctgctggccaaggacttattgctggaatcaatgctgctttgaaagttcaaggtaagccagaacttattttgaaacggagcgatgcctatattggcgttatgattgacgatttggttaccaaaggaaccttggaaccttatcgattgttgacatcgcgagctgagtatcgtttgattttacgtcatgacaacgctgatatgcgtttgacagagattggtcgcgacattgggttggttgatgatgagcgttggaaggccttcgaaattaagaaaaaccaatttgataacgaattaaaacgtctgaacagtatcaaattaaaaccgattaaagaaaccaatgaccgcgttcaagatctaggcttcaaaccgttaaccgatgcgatgactgctaaagaattcatgcgtcgtccagaaattgattatgcgactgcagtctcttttgttggtcctgcggctgaagatttagatgctaaaatcattgaacttttagaaacagaaatcaagtacgaaggctatattcgcaaagctttagatcaggttgctaagatgaaacgcatggaagaaaaacgtattcctacaaatattgattgggatgctattgattctattgcaactgaggcgcgtcagaaatttaagaaaattaatcctgaaacaattggacaagctagtcgtatttcaggagtcaatcctgcggacatcagtatcttgatgatttatttagaaggaaacggaaaagctcatcgaaaatat

SEQ ID NO: 3200 - protein, 632 aa, Streptococcus pyogenes
MTHEFTESYDVIVIGAGHAGVEASLATSRMGCKTLLATINLDMLAFMPCNPSIGGSAKGIVVREIDALGGEMGKNIDKTYIQMKMLNTGKGPAVRALRAQADKSLYAREMKHTVEKQANLTLRQTMIDDILVEDGRVVGVLTATGQKFAAKAVVVTTGTALRGEIILGELKYSSGPNNSLASVTLADNLKKLGLEIGRFKTGTPPRVKASSINYDQTEIQPGDDKPNHFSFMSKDADYLKDQIPCWLTYTNQTSHDIINQNLYRAPMFSGIVKGVGPRYCPSIEDKIVRFADKERHQLFLEPEGRDTEEVYVQGLSTSLPEDVQKDLIHSIKGLEKAEMMRTGYAIEYDIVLPHQLRATLETKLISGLFTAGQTNGTSGYEEAAGQGLIAGINAALKVQGKPELILKRSDAYIGVMIDDLVTKGTLEPYRLLTSRAEYRLILRHDNADMRLTEIGRDIGLVDDERWKAFEIKKNQFDNELKRLNSIKLKPIKETNDRVQDLGFKPLTDAMTAKEFMRRPEIDYATAVSFVGPAAEDLDAKIIELLETEIKYEGYIRKALDQVAKMKRMEEKRIPTNIDWDAIDSIATEARQKFKKINPETIGQASRISGVNPADISILMIYLEGNGKAHRKY

SEQ ID NO: 3201 - DNA, 1980 bp, Streptococcus agalactiae
atgaaaagatttcgttttgcaaccgtccatttagttttaataggcctgattttatttggactattagctatttgtgttaggttatttcaatcctatacggctctattattggctatttttgttgctttatcttttgttgttgccttattatattaccaaaagataacttatgaactatctgaagttgaacaaattgaattacttaatgatcaaacagaagtttctcttaagagtcttcttgaacaaatgccagttggtgttatacaatttgatcttgaaacaaatgatattgagtggtttaacccttatgcagaattgatttttactggggataatggtcattttcagtctgctactgttaaagatatcattactagtagacgtaatggaacggctgggcaatcatttgaatacggtgataacaaatattcagcttatttggatacagagacgggtgttttctatttcttcgataatttcatggggaatagaagaaactatgatagttcaatgctacgtccagttattggtattatttccattgataactacgatgatattatggatactatgttagaggctgatatgtcaaagattaacgccttcgtgactagttttatttctgattttacacagtctaaaaatattttttatcgtcgtgtcaatatggatcgatactatatttttaccgactatagcgttttaaatacattgataaaagataaatttgatattttaaatgagtttcgaaaacgcgctcaggaaaaccatttatcattaacattaagtatgggaatttcttatggtgatggtaaccataatcaaattgggcaaattgctttagaaaatcttaatacagcactcgttcgcggaggagatcaaatagtagtacgtgaaaatgatagtagtaaaaaagcactttactttggtggtggtgctgtttcaactattaaacgttcacgaacacgtaccagagctatgatgactgctatttctgaccgtttgaaagtagttgatagtgtctttattgtgggacacaggaaattggacatggatgcactaggtgcatctgtagggatgcaattttttgctagtaatattgttaatgccagttatgtagtttatgacccaaatgacatgaattctgatattgaaagagcaattgattacttgcaagaagacggcgaaacacgtctcgtaagtgttgagagagcttttgaattaattactcaaaattctttattagtcatggtagaccattctaaaacagctttaaccttatctaaggaattctttaacaagtttgcagatgttattgtggtagatcatcatagaagagatgaagattttccaaaaaatgctgttctttcatttatagaaagtggcgcaagtagtgccagcgaattagttacagaattgattcaatttcaacaagctaaagataaattaagccgcagtcaagcaagtattttaatggctggtatcatgcttgatacaagaaattttgcatctaatgtaacgagtagaacttttgatgtggcaagctatttacgcggtttaggtagtaatagtatggctattcaaaaaatatcagctacagattttgatgaatatcgtttaattaatgaattgattttaaaaggtgagcgtatttatgataacatcattgttgctaccggagaagaacataaagtttactcgcatgttatagctagtaaagcagctgacaccatgttgacaatggcaggtattgaggctacttttgttattactaaaaacagttcaaatattggtatttcagcgcgcagtagaaataatatcaatgtccagcgtattatggaaaaacttggtggtggcggacattttagttttgctgcttgtcaaatacaagacaagtctgtaaagcaagttagacgtatgttactggaaataattgacgaagatttaagagaaaatagtacagtcgaaaatagaagggat

SEQ ID NO: 3202 - protein, 660 aa, Streptococcus agalactiae
MKRFRFATVHLVLIGLILFGLLAICVRLFQSYTALLLAIFVALSFVVALLYYQKITYELSEVEQIELLNDQTEVSLKSLLEQMPVGVIQFDLETNDIEWFNPYAELIFTGDNGHFQSATVKDIITSRRNGTAGQSFEYGDNKYSAYLDTETGVFYFFDNFMGNRRNYDSSMLRPVIGIISIDNYDDIMDTMLEADMSKINAFVTSFISDFTQSKNIFYRRVNMDRYYIFTDYSVLNTLIKDKFDILNEFRKRAQENHLSLTLSMGISYGDGNHNQIGQIALENLNTALVRGGDQIVVRENDSSKKALYFGGGAVSTIKRSRTRTRAMMTAISDRLKVVDSVFIVGHRKLDMDALGASVGMQFFASNIVNASYVVYDPNDMNSDIERAIDYLQEDGETRLVSVERAFELITQNSLLVMVDHSKTALTLSKEFFNKFADVIVVDHHRRDEDFPKNAVLSFIESGASSASELVTELIQFQQAKDKLSRSQASILMAGIMLDTRNFASNVTSRTFDVASYLRGLGSNSMAIQKISATDFDEYRLINELILKGERIYDNIIVATGEEHKVYSHVIASKAADTMLTMAGIEATFVITKNSSNIGISARSRNNINVQRIMEKLGGGGHFSFAACQIQDKSVKQVRRMLLEIIDEDLRENSTVENRRD

SEQ ID NO: 3203 - DNA, 1974 bp, Streptococcus pyogenes
atgaaaaaatttcgttttgaaaccattcatttgattatgatgggattgattttatttggactgctggcactttgtgtcagtattatgcaatcaaaaatattaatattattagctatttttctcgttttgctatttgttgttgctcttttatggtatcaaaaagaagcttatcaattatcagacttagctcatattgagctcttaaatgaacaaacagaagataacctaaaaacgctacttgataatatgcctgttggagtagttcaatttgatcaagagaccaacgctgtagaatggtataatccttatgcagaattaatttttacaactgaagagggttttatacaaaacggtttgattcagcaaattattacggaaaaacgtcgtgaagatatttctcaaacatttgaagtttctggtaataaatacacttcttatattgatgtatcatcaggaattttttatttttttgatagctttgtgggaaacaggcaattagctgatgctagtatgttaagaccggttgttggcattatttcggttgataattatgatgatatcactgatgatttatcagatgcagatacctcaaaaattaattcatttgtagctaacttcattgatgagtttatggagtcaaaacggattttttaccgtcgtgttaatatggatcgctactatttctttacagactttaaaacattaaatgatttgatggataataaattttctgtcttagaagagtttcgtaaagaagctcaagatgctcagcgccctttaacactcagcataggaatttcttttggtgaagaaaatcatagccagattggacaggtagctcttgagaatcttaatattgcgcttgttcgtggtggtgatcagattgtcattcgtgaaaatgcggatcatacgaatccaatttatttcgggggagggtctgtttctacagttaaacgttcaagaacacgtacccgtgctatgatgacagctatttcagatcgaatcaagatggtggacaatgtttttattgttggacataggaaacttgatatggatgcactaggttcagctgttggtatgcaatttttcgcaggtaacattattgaaaatagttttgccgtttacaatccagatgagatgagtccagatattgaaagggctattgagcgattgcaggctgacggaaagactcgtctaatcagtgtttctcaagcaatgggtttagtgactccaagatcacttttagtaatggttgaccattctaagatatctttaacactttctaaagaattttatgaacagtttcaaaatgttattgtagttgatcatcacagaagagatgatgattttcctgataatgctatcttaacttttattgaaagtggagcaagtagtgctgcggagctcgtcactgagttaattcaatttcaaaatgctaaaaaatgtttaaataagatccaagccagtgttttaatggcaggtattatgcttgatactaaaaatttttctacgcgagtgacaagtcgtacctttgatgtcgctagttacttaagaagcaaaggaagtgatagtgttgaaattcaaaatatatccgcaacagattttgaagaatataagcaaataaatgaaattattttacaaggagaacgtcttggtgacagtatcattgtagctgcaggagaaaaaaatcatctttatagcaatgttattgctagtaaagctgcagatacgatactgtcaatggctcacgttgaggctagctttgtattagttgaaacagcttctcataagattgctatttcagctagaagtcgtagtaaaatcaatgttcaacgtgtgatggaaaaattaggtggaggaggccactttaatcttgctgcctgtcagttaacggatatcagtcttccccaagcgaagtacttattattgaaaactattaatatgacaatgaaagaaacaggagaagtagaatca

SEQ ID NO: 3204 - protein, 658 aa, Streptococcus pyogenes
MKKFRFETIHLIMMGLILFGLLALCVSIMQSKILILLAIFLVLLFVVALLWYQKEAYQLSDLAHIELLNEQTEDNLKTLLDNMPVGVVQFDQETNAVEWYNPYAELIFTTEEGFIQNGLIQQIITEKRREDISQTFEVSGNKYTSYIDVSSGIFYFFDSFVGNRQLADASMLRPVVGIISVDNYDDITDDLSDADTSKINSFVANFIDEFMESKRIFYRRVNMDRYYFFTDFKTLNDLMDNKFSVLEEFRKEAQDAQRPLTLSIGISFGEENHSQIGQVALENLNIALVRGGDQIVIRENADHTNPIYFGGGSVSTVKRSRTRTRAMMTAISDRIKMVDNVFIVGHRKLDMDALGSAVGMQFFAGNIIENSFAVYNPDEMSPDIERAIERLQADGKTRLISVSQAMGLVTPRSLLVMVDHSKISLTLSKEFYEQFQNVIVVDHHRRDDDFPDNAILTFIESGASSAAELVTELIQFQNAKKCLNKIQASVLMAGIMLDTKNFSTRVTSRTFDVASYLRSKGSDSVEIQNISATDFEEYKQINEIILQGERLGDSIIVAAGEKNHLYSNVIASKAADTILSMAHVEASFVLVETASHKIAISARSRSKINVQRVMEKLGGGGHFNLAACQLTDISLPQAKYLLLKTINMTMKETGEVES

SEQ ID NO: 3205 - DNA, 450 bp, Streptococcus agalactiae
atgaaagttatttttttacaagatgttaaggggaaaggaaaaaaaggtgaggttaaggaagtacctactggttatgctcaaaacttcttattaaaaaagaatctagctaaagaagcaacgacacaagctatcggtgaattaaaaggaaaacaaaagtccgaagaaaaagcacaagcagaaattttagcacaggcaaaggagctgaaaacacaattagaatccgaaactacccgagtgcaatttattgaaaaggtaggtccagatggtcgtacgtttggttctatcacagccaaaaagattgctgaagagttacaaaaacaatacggcattaaaattgacaaacgtcatattgatttagatcatactattagagcgattggtaaggttgaagtaccagtaaaattacataaacaggtttcttcacagattaagcttgatatcaaagaagcg

SEQ ID NO: 3206 - protein, 150 aa, Streptococcus agalactiae
MKVIFLQDVKGKGKKGEVKEVPTGYAQNFLLKKNLAKEATTQAIGELKGKQKSEEKAQAEILAQAKELKTQLESETTRVQFIEKVGPDGRTFGSITAKKIAEELQKQYGIKIDKRHIDLDHTIRAIGKVEVPVKLHKQVSSQIKLDIKEA

SEQ ID NO: 3207 - DNA, 450 bp, Streptococcus pyogenes
atgaaagttatttttttagcagatgtaaaaggaaaaggtaaaaaaggagaaatcaaagaggtcccaacaggctatgctcaaaatttccttattaagaaaaatttagctaaagaagcaactagtcaaagcatcggtgaattaaaaggaaaacaaaaagctgaagaaaaagctcaagctgaaatattagcagaagctcaagctgtcaaggctgttttggatgaggacaaaacacgtgttcaatttcaagaaaaagttggtccagatggacgtacatttggttccatcacagctaaaaagatttcagaagaattgcaaaagcaatttggtgtaaaagttgataaacgtcatattgttttagatcatcctatccgcgccattggtctaattgaagttcctgtgaaattacataaggaagtaacagctgagattaaattggctatcacagaagca

SEQ ID NO: 3208 - protein, 150 aa, Streptococcus pyogenes
MKVIFLADVKGKGKKGEIKEVPTGYAQNFLIKKNLAKEATSQSIGELKGKQKAEEKAQAEILAEAQAVKAVLDEDKTRVQFQEKVGPDGRTFGSITAKKISEELQKQFGVKVDKRHIVLDHPIRAIGLIEVPVKLHKEVTAEIKLAITEA

SEQ ID NO: 3209 - DNA, 1353 bp, Streptococcus agalactiae
ttggtagaagtatctgagctaagagtacaacctcaagacctgttggcagaacaggccgttctaggatctatctttatctcaccagagaaactgattatggtgagagaatttataagtccagatgatttttataaatattcacacaaagttatcttcagagcgatgattaccttagctgatagaaatgatgcaattgatgctgctactgttagaaatattttagatgaccaaggtgatcttcaaaacattggtgggttgggctatattgttgaattagttaatagtgttccaacaagtgctaatgcggagttttatgccaaaatagtttctgagaaagccatgttgcgagatatcatttctaagttgacagatactgtcaacatggcctatgaaggaaatgattctgatgaaattattgccaccgctgagaaggctttagttgatattaacgaacacagtaatcgtagcgggtttagaaagatatctgatgttttaaaagttaattacgaaaacttagaattacgttcacagcaaacctcagatgtcacaggtttaccaactggatttagagatttagacaggattactacaggtttacatccagatcaattaatcatcttagcggcccgtcctgcagtaggtaaaacagcctttgttttaaatattgctcaaaatgttggaactaaacaaaatagacctgtagctattttttcacttgaaatgggggctgagagtttagttgaccgtatgttggcagcagagggaatggttgattctcatagtttacgaactggtcagttgacggatcaagattggaataatgtaacgattgctcaaggagctttggcggatgcgccaatttatattgatgatacgcccgggattaaaattacagaaattagagcacgctctaggaagttatctcaagaagttgatgatggtttaggtttaatcgtcattgactacctccaattaatttcaggaactagaccagaaaatcgtcagcaagaagtttctgaaatttcaaggcagttgaagattttagctaaagaattaaaggttcctgttatcgcattaagccagctctctcgtggggttgagcaaaggcaggataaacgaccggtcttatctgatattcgtgaatctggatcgattgaacaagatgctgacattgttgctttcttatatcgagatgattattatcgtagagagggcgaagaagcagaggaaattgtagaagataatactgttgaggttattttagaaaagaaccgtgctggtgcgcgtgggacagtaaaattaatgtttcaaaaggaatataataaattttctagtatagctcaatttgaagaa

SEQ ID NO: 3210 - protein, 451 aa, Streptococcus agalactiae
MVEVSELRVQPQDLLAEQAVLGSIFISPEKLIMVREFISPDDFYKYSHKVIFRAMITLADRNDAIDAATVRNILDDQGDLQNIGGLGYIVELVNSVPTSANAEFYAKIVSEKAMLRDIISKLTDTVNMAYEGNDSDEIIATAEKALVDINEHSNRSGFRKISDVLKVNYENLELRSQQTSDVTGLPTGFRDLDRITTGLHPDQLIILAARPAVGKTAFVLNIAQNVGTKQNRPVAIFSLEMGAESLVDRMLAAEGMVDSHSLRTGQLTDQDWNNVTIAQGALADAPIYIDDTPGIKITEIRARSRKLSQEVDDGLGLIVIDYLQLISGTRPENRQQEVSEISRQLKILAKELKVPVIALSQLSRGVEQRQDKRPVLSDIRESGSIEQDADIVAFLYRDDYYRREGEEAEEIVEDNTVEVILEKNRAGARGTVKLMFQKEYNKFSSIAQFEE

SEQ ID NO: 3211 - DNA, 285 bp, Streptococcus agalactiae
atgagtgatgcatttgcagatgttgcaaaaatgaaaaaaataaaagaagatatcaagtcacatgagggacagatggtcgaacttactctcgaaaatggtcgtaagagggaaaaaaataaaattgggcgcctaattgaagtttacccatctttgtttatcgtagagtataaggatactgcagctgtaccaggagcaattgataatacttatgtagagtcttacacttattcagatattttaactgagaaaactttaattcgttattttgatgacgagtcagcagaa

SEQ ID NO: 3212 - protein, 95 aa, Streptococcus agalactiae
MSDAFADVAKMKKIKEDIKSHEGQMVELTLENGRKREKNKIGRLIEVYPSLFIVEYKDTAAVPGAIDNTYVESYTYSDILTEKTLIRYFDDESAE

SEQ ID NO: 3213 - DNA, 300 bp, Streptococcus pyogenes
ttgaagaaagataagaaagagagacaaaaaatgagcgatgcatttacagatgttgcaaaaatgaaaaaaattaaagaggacataagagcccatgaaggacagttagtagaattaacccttgagaatggacggaaacgggaaaaaaataaaattggtaggcttattgaagtttacagttcactctttatcattgagtatagtgatagctctgatactccaggagcaattgataattcttatgtcgaatcatacacctattcagatattttgacagaaaaaacattaattcgttatttagat

SEQ ID NO: 3214 - protein, 100 aa, Streptococcus pyogenes
LKKDKKERQKMSDAFTDVAKMKKIKEDIRAHEGQLVELTLENGRKREKNKIGRLIEVYSSLFIIEYSDSSDTPGAIDNSYVESYTYSDILTEKTLIRYLD

SEQ ID NO: 3215 - DNA, 609 bp, Streptococcus agalactiae
atgtcacgttatactggtccatcatggaaacaatcacgtcgccttggtttatcacttacaggcacaggtaaagaattggcacgtcgtaactacgtacctggtcagcacggtcctaataaccgtagcaagctttcagaatatggcttgcagttagctgagaaacaaaaacttcgtttttcatacggacttggtgaaaaacaattccgtaacttgttcgtacaagctactaaagcaaaagaaggaactcttggtttcaactttatggttcttttagagcgtcgtcttgataacgttgtttatcgtttaggacttgcaacaactcgtcgccaagctcgtcaatttgttaaccatggtcatatccttgttgatggtaaacgtgttgatatcccatcataccgcgttactccaggacaagttatttcagttcgtgaaaaatcaatgaaagtacctgcaatccttgaagctgttgaagctactttaggacgtccagctttcgtatcatttgatgctgaaaaacttgaaggttcattgactcgccttccagaacgcgatgaaattaacccagaaatcaatgaagcacttgtcgttgaattctacaacaaaatgctt

SEQ ID NO: 3216 - protein, 203 aa, Streptococcus agalactiae
MSRYTGPSWKQSRRLGLSLTGTGKELARRNYVPGQHGPNNRSKLSEYGLQLAEKQKLRFSYGLGEKQFRNLFVQATKAKEGTLGFNFMVLLERRLDNVVYRLGLATTRRQARQFVNHGHILVDGKRVDIPSYRVTPGQVISVREKSMKVPAILEAVEATLGRPAFVSFDAEKLEGSLTRLPERDEINPEINEALVVEFYNKML

SEQ ID NO: 3217 - DNA, 609 bp, Streptococcus pyogenes
atgtcacgttatactggtccatcatggaaacaatcacgtcgccttggtttatcacttacaggcacaggtaaagaattggcacgtcgtaactacgttcctggtcaacacggtccaaacaaccgtagcaaactctcagaatatggtttgcagttagctgagaaacaaaaacttcgtttctcatacggtttaggtgaaaaacaattccgtaacttgttcgttcaagctacaaaaatcaaagaaggaactcttggtttcaactttatggttcttttagaacgtcgtcttgacaacgttgtttaccgtctaggtttagcaactactcgtcgtcaagcacgtcaattcgttaaccacggtcacatccttgttgacggtaaacgcgttgatatcccttcataccgcgttgatccaggtcaagtgatttcagttcgcgaaaaatcaatgaaagtacctgcaatccttgaagctgttgaagctactcttggacgtccagctttcgtatcatttgatgctgaaaaacttgaaggttcattgactcgccttccagaacgcgatgaaattaacccagaaatcaatgaagcacttgtcgttgaattctataacaaaatgctt

SEQ ID NO: 3218 - protein, 203 aa, Streptococcus pyogenes
MSRYTGPSWKQSRRLGLSLTGTGKELARRNYVPGQHGPNNRSKLSEYGLQLAEKQKLRFSYGLGEKQFRNLFVQATKIKEGTLGFNFMVLLERRLDNVVYRLGLATTRRQARQFVNHGHILVDGKRVDIPSYRVDPGQVISVREKSMKVPAILEAVEATLGRPAFVSFDAEKLEGSLTRLPERDEINPEINEALVVEFYNKML

SEQ ID NO: 3219 - DNA, 294 bp, Streptococcus agalactiae
atgaatctaaatgatagattaaaaatagaagaaatggaagagaagtatgatagcttcaaacctagaatcaatgcattagtagaagctatagatgattttcaaaagcactatgaagattacgtgaaattaagagaattttatggtagcgaagactggtttagactatcagaacaaacagaaaataatctcaaatgcggtgtactgagtgaggatcagctctttgattttataggagaacataacgagcttgtaggccaatttttagatatgtcttctcaaatgtatcgtcattta

SEQ ID NO: 3220 - protein, 98 aa, Streptococcus agalactiae
MNLNDRLKIEEMEEKYDSFKPRINALVEAIDDFQKHYEDYVKLREFYGSEDWFRLSEQTENNLKCGVLSEDQLFDFIGEHNELVGQFLDMSSQMYRHL

SEQ ID NO: 3221 - DNA, 294 bp, Streptococcus pyogenes
atgacaaagcaagatcagttaatcgttgaaaaaatggaacaaacctatgaggcctttagcccaaagctagcaaatctcatagaagccctagatgcctttaaagagcattatgaggaatatgccacacttagaaatttttacagtagtgacgaatggtttcggcttgcaaaccaaccttgggatgatatcccgtgcggtgtcctatctgaagacctcctctttgatatgatcggtgaccataaccaactactagctgatatcttagacttggcccctatcatgtacaagcatatg

SEQ ID NO: 3222 - protein, 98 aa, Streptococcus pyogenes
MTKQDQLIVEKMEQTYEAFSPKLANLIEALDAFKEHYEEYATLRNFYSSDEWFRLANQPWDDIPCGVLSEDLLFDMIGDHNQLLADILDLAPIMYKHM

SEQ ID NO: 3223 - DNA, 537 bp, Streptococcus agalactiae
atggtaaacgatacgaggagagaaaaaacaaaaagagctattgaagcagctatgattacgttattaaaagatcagagcttcgatgaaatttcaacgattaatctaactaaaacagctggaatcagtcgttctagtttttatactcattataaagataaatatgaaatgattgatcaataccaacagtcactcttcaataaagtcgaatatatttttgatcgcaatcaatttaaaaaagaagatgccttgctcgaaatttttcaattcttagatagagaatcattatttgctgctctcttaacccaaaatggaacaaaagaaattcagacctacatccttaataaattacaattaatgctttctaaagaattacctgtggtcaatccagatgcaacaaagtctgatatcaaccgtttgtattatagtgtctatctcagtcatgctatttttggagtctatcaaatgtggataacacgaggaaaaaaagaaagccctcaacaaattacacaagtgctactcagtttattacctcaaact

SEQ ID NO: 3224 - protein, 179 aa, Streptococcus agalactiae
MVNDTRREKTKRAIEAAMITLLKDQSFDEISTINLTKTAGISRSSFYTHYKDKYEMIDQYQQSLFNKVEYIFDRNQFKKEDALLEIFQFLDRESLFAALLTQNGTKEIQTYILNKLQLMLSKELPVVNPDATKSDINRLYYSVYLSHAIFGVYQMWITRGKKESPQQITQVLLSLLPQT

SEQ ID NO: 3225 - DNA, 531 bp, Streptococcus pyogenes
atggtcaaccgtaaagaaaatacgaagcaagcaattttaaaagcaatggttatgttactaaaaaccgaaagttttgacgatattaccacagttaaattatctaaaagagctggaattagtcgctctagtttttacacacactataaagataaatatgaaatgattgactattatcagcaaaccttttttcacaaattagaatatatttttgagaaaaaatatcaaaataaagaacaagccttccttgaagtatttgaatttctccaaagagaacagcttctctcttcccttttgtctgctaacggtactaaagaaatacaggcctttatcatcaataaagttcgcctactcatcactactgatttacaggacaagttcagtaccgaagagttatctcaaacggaaaaagaataccaaagtatctacttagcccatgctttttttggtgtctgtcaaagttggattgctaaaggtaaaaaagaatcacctcaagaaatgacacaattcgttctcaaaatgcttacgagtacc

SEQ ID NO: 3226 - protein, 177 aa, Streptococcus pyogenes
MVNRKENTKQAILKAMVMLLKTESFDDITTVKLSKRAGISRSSFYTHYKDKYEMIDYYQQTFFHKLEYIFEKKYQNKEQAFLEVFEFLQREQLLSSLLSANGTKEIQAFIINKVRLLITTDLQDKFSTEELSQTEKEYQSIYLAHAFFGVCQSWIAKGKKESPQEMTQFVLKMLTST

SEQ ID NO: 3227 - DNA, 2433 bp, Streptococcus agalactiae
ttgtacatttttaaacacagtgtccaaaaacgagatttttatcttgaaattatctatcatcactgtataatatattttatcaaaaaaatgaacaatatgtccaaaataggagaaaaaatgttagacgaattaaaagcaatcataaaaagcccaaaattatggattacgatggctggggttgcactgattccaacgctatataatgttatctttctaagctcaatgtgggatccttatgggaatactaaaaatttacctgtggcagtcgttaaccaagataaatcggctaaattaaatggaaaaactatttcaattggcaaagatatggaggacaatttgtctaaaaatgatagcttagatttccattttacaacagctaaaagagcagaaaaagaattagaaaagggtcactattatatggttattacctttcctaaagatctttctagaaaagcgacaactctcatgacagaaaaaccagaaaggttaaatattacttataaaactactaaggggcgtagttttgtagcttcaaaaatgagtgagacagcagctaataaactaaaagatgaggtagcagaatctattacagggacttatactgaatcagtttttaaaaatatgggttctatgaaaacaggtatcaataaagctgctgatgggagtcaagaattattaaatggttctaataagctacaggatgggagccaaaccttgacaagtaatttagatgttttagcaagctctagtcaaactttttctggaggagctaataaactaaatagtggaataaacctttatacagatggtgtggggaccctatctaacgggttagaaacattatcagatggtgttactgcttacacaacaggtgtgcataagttgagtgaaggtagtcaaaaattagatgataagtctcaagcattggtggaaggatcagaaaagttgacggatggtttacaacaattgtcacaagcaactcaactaaaaccagagcaagaacgtactttgcagaacctttcagatggattaaagaatctaaatcagattattacaaatttacaatcgacagcaactactgatagcgatactaatagtaagttatttaattttttatcaactattgaatcaagtacaaaggctttgatgaatacggctgctgctgataaacaaaagcaaatgactgcggtacaatcaacgtcagcttttaaaagtttaacccctgaacaacaatctcaaatcacctcagcggttactggaacacctacttcagctgagacaattgcagcaaatatttcttcaaatatagaaaatatgaaaactgtgcttagtgaagcatctagttcagccccttctaataatggatcacaaaatcttcaaactttgtcaggaacagctaacaatttagtattaaaagctatctcagatttagataaaattcaaaaattgccaacggctactaagcagttatatcaaggtagtcaaaccttgacaaaaggaatcacggattatacgaatgctgtagggcaattacgcaaaggtgcagtaactttagatagtaaatccaatcaattgatttcaggaacacaaaaagcaagtcagggagctcaaactttagatagtaaatcggatcaattgagagacggagcggggcaattagctagtggttctgatagaattgcagatggttctaataagcttgctgggggaggacatcagttgacagatgggttgacagagttgtcaggtggtgtttctcaattatcaagttctttggggaaagctggggaccagttgtccatggtttctgtaaataaagataatgccaatgcagtatctagcccagtcactatcaagcatgaagattatgatagcgttgatacgaatggtgttggaatggcaccatacatgatttcagttgcgttgatggtggtagctttatcagccaatgttatttttgcgaaagctttatctggcaaagagccagctaatcgttttagttgggctaaaaataaattattaatcaatggattcattgcaactctagcagcaactatcttattttttgcagttcaattcataggtcttaaaccagattaccctggaaaaacctactttattatcctattgacagcatggactttgatggcattagtaactgctttagtgggatgggataataggtatggttccttcttgtcgttattaatattattattccagcttggttcaagcgcaggaacttacccaatagaattgagtcctaagttctttcaaacaattcaaccatttttaccgatgacttactctgtttcaggattaagagagaccatctcgttgacgggagacgttaaccatcaatggagaatgctagtaatctttttagtatcatcgatgatacttgctcttcttatttatcgtaaacaagaagat

SEQ ID NO: 3228 - protein, 811 aa, Streptococcus agalactiae
MYIFKHSVQKRDFYLEIIYHHCIIYFIKKMNNMSKIGEKMLDELKAIIKSPKLWITMAGVALIPTLYNVIFLSSMWDPYGNTKNLPVAVVNQDKSAKLNGKTISIGKDMEDNLSKNDSLDFHFTTAKRAEKELEKGHYYMVITFPKDLSRKATTLMTEKPERLNITYKTTKGRSFVASKMSETAANKLKDEVAESITGTYTESVFKNMGSMKTGINKAADGSQELLNGSNKLQDGSQTLTSNLDVLASSSQTFSGGANKLNSGINLYTDGVGTLSNGLETLSDGVTAYTTGVHKLSEGSQKLDDKSQALVEGSEKLTDGLQQLSQATQLKPEQERTLQNLSDGLKNLNQIITNLQSTATTDSDTNSKLFNFLSTIESSTKALMNTAAADKQKQMTAVQSTSAFKSLTPEQQSQITSAVTGTPTSAETIAANISSNIENMKTVLSEASSSAPSNNGSQNLQTLSGTANNLVLKAISDLDKIQKLPTATKQLYQGSQTLTKGITDYTNAVGQLRKGAVTLDSKSNQLISGTQKASQGAQTLDSKSDQLRDGAGQLASGSDRIADGSNKLAGGGHQLTDGLTELSGGVSQLSSSLGKAGDQLSMVSVNKDNANAVSSPVTIKHEDYDSVDTNGVGMAPYMISVALMVVALSANVIFAKALSGKEPANRFSWAKNKLLINGFIATLAATILFFAVQFIGLKPDYPGKTYFIILLTAWTLMALVTALVGWDNRYGSFLSLLILLFQLGSSAGTYPIELSPKFFQTIQPFLPMTYSVSGLRETISLTGDVNHQWRMLVIFLVSSMILALLIYRKQED

SEQ ID NO: 3229 - DNA, 144 bp, Streptococcus agalactiae
atgatatggtatgtcaaagtatttaggaggagaagatatgtctactttaacaataattattgcaacattaactgctttggaacatttttatattatgtatttggagacgttagccacccagtcaaatatgactgggaagatttt

SEQ ID NO: 3230 - protein, 48 aa, Streptococcus agalactiae
MIWYVKVFRRRRYVYFNNNYCNINCFGTFLYYVFGDVSHPVKYDWEDF

SEQ ID NO: 3231 - DNA, 264 bp, Streptococcus agalactiae
atgactgggaagatttttagtatgtctaaagaagagttgtcatatttacccgttattaaactttttaagaatcaaggtgtatacaacggcttgattggcctattcctcctttatgggttatatatttcacagaatcaagaaattgtagctgtttttttaatcaatgtattgctagttgctatttatggtgctttgacagttgataaaaaaatcttattaaaacagggtggtttacctatattagctcttttaacattcttattt

SEQ ID NO: 3232 - protein, 88 aa, Streptococcus agalactiae
MTGKIFSMSKEELSYLPVIKLFKNQGVYNGLIGLFLLYGLYISQNQEIVAVFLINVLLVAIYGALTVDKKILLKQGGLPILALLTFLF

SEQ ID NO: 3233 - DNA, 753 bp, Streptococcus agalactiae
gtgactttgattatgactgagaactggttacatactaaagatggttcagatatttattatcgtgtcgttggtcaaggtcaaccgattgtttttttacatggcaatagcttaagtagtcgctattttgataagcaaatagcatatttttctaagtattaccaagttattgttatggatagtagagggcatggcaaaagtcatgcaaagctaaataccattagtttcaggcaaatagcagttgacttaaaggatatcttagttcatttagagattgataaagttatattggtaggccatagcgatggtgccaatttagctttagtttttcaaacgatgtttccaggtatggttagagggcttttgcttaattcagggaacctgactattcatggtcagcgatggtgggatattcttttagtaaggattgcctataaattccttcactatttagggaaactctttccgtatatgaggcaaaaagctcaagttatttcgcttatgttggaggatttgaagattagtccagctgatttacagcatgtgtcaactcctgtaatggttttggttggaaataaggacataattaagttaaatcattctaagaaacttgcttcttattttccaaggggggagttttattctttagttggctttgggcatcacattattaagcaagattcccatgtttttaatattattgcaaaaaagtttatcaacgatacgttgaaaggagaaattgttgaaaaagctaat

SEQ ID NO: 3234 - protein, 251 aa, Streptococcus agalactiae
MTLIMTENWLHTKDGSDIYYRVVGQGQPIVFLHGNSLSSRYFDKQIAYFSKYYQVIVMDSRGHGKSHAKLNTISFRQIAVDLKDILVHLEIDKVILVGHSDGANLALVFQTMFPGMVRGLLLNSGNLTIHGQRWWDILLVRIAYKFLHYLGKLFPYMRQKAQVISLMLEDLKISPADLQHVSTPVMVLVGNKDIIKLNHSKKLASYFPRGEFYSLVGFGHHIIKQDSHVFNIIAKKFINDTLKGEIVEKAN

SEQ ID NO: 3235 - DNA, 2541 bp, Streptococcus agalactiae
ttgttgaaaaagctaattgaaaaagtcaaatcactgacttctgtgattaaaattgtattttttatatctgttttagtgcttattattgttgaaatgattcatttgaaacgaactatttctgttgagcaactaaagagtgtttttgggcaattatctccaatgaatcttttcttaattatccttgtgggggttatcgctgtcttaccgacaaccggatatgactttgtactgaatggacttttacgtacagataaaagcaaaaggtatattttacagactagttggtgtatcaacacttttaataacttgtcaggattcggtggcttaatcgatattgggttgcgcatggctttttatggtaaaaaaggtcaagagaagagtgacctaagagaagtgactcgttttttaccctatcttatttctggtctgtcatttattagtgtgattgccttaatcatgagccatatttttcatgccaaagctagtgttgattactattatttggtattaattggtgctagtatgtattttcctgttatttattggatttctggtcataaaggaagccattatttcggagatatgccatctagtactcgtataaaattaggtgttgtttctttttttgaatggggatgtgcggccgcagcatttataattatcggttatttaatgggcattcatctaccagtttataaaattttaccactattttgtattggttgtgccgtcgggattgtatcccttattcccggtggattaggaagttttgaattagttctatttacagggtttgctgccgagggactacctaaagaaactgtggttgcatggttattactttatcgtttagcctactatattattccattctttgcaggtatctatttctttatccattatttaggtagtcaaataaatcaacgttatgaaaatgtcccgaaagagttagtatcaactgttctacaaaccatggtgagccatttgatgcgtattttaggtgcattcttaatattttcaacagcattttttgaaaatattacttatattatgtggttgcagaagctaggcttggacccattacaagaacaaatgttatggcagtttccaggtttattgctgggggtttgttttattctcttagctagaactattgatcaaaaagtgaaaaatgcttttccaattgctattatctggattactttgacattgttttatcttaatttaggtcatattagttggcgactatctttctggtttattttactattgttaggcttattagtcattaagccaactctctataaaaaacaatttatttatagctgggaagagcgtattaaggatggaatcattatcgttagtttaatgggagttctattttatattgcaggactactattccctatcagggctcatattacaggtggtagtattgaacgcctgcattatatcatagcatgggagccgatagcattggctacgttgattcttactctcgtttatttatgtttggttaagattttacaaggaaaatcttgtcagattggtgatgtgttcaatgtggatcgttataaaaaactacttcaagcttacggtggttcttcggatagcggtttagcctttttaaatgataaaaggctctactggtaccaaaaaaatggagaagattgcgttgcgttccaatttgtaattgtcaataataaatgtcttattatgggggaaccagccggtgatgacacttatattcgtgaagctattgaatcgtttattgatgatgctgataagctagactatgaccttgttttttacagtattggacagaagttgacactacttttacatgagtatggttttgactttatgaaagttggtgaggatgctttagttaatttagaaacgtttactcttaaagggaataagtacaaacctttcagaaatgccctaaatagagttgaaaaggatggtttctatttcgaagttgtacaatcgccacatagtcaagagctactaaatagtttggaagagatttctaatacttggttagaaggacgtcctgaaaaaggtttctcactaggatattttaataaagattatttccaacaagccccaatagctttggtaaaaaatgctgaacacgaagttgttgcttttgctaatattatgccaaactatgaaaagagtattatctctattgatttaatgcgtcacgataaacagaaaattccgaatggcgttatggatttcctctttttatcattattctcttattatcaagagaagggataccactattttgatttggggatggcacctttatcaggagttggtcgcgttgaaacaagttttgctaaagagagaatggcgtatcttgtctatcatttcggtagtcatttctactcatttaatggtttacacaagtataagaagaagtttacaccattgtggtcggaacgttatatttcttgttctcgttcgtcctggttaatttgtgctatttgtgccctattaatggaagatagtaaaattaagattgttaaa

SEQ ID NO: 3236 - protein, 847 aa, Streptococcus agalactiae
MLKKLIEKVKSLTSVIKIVFFISVLVLIIVEMIHLKRTISVEQLKSVFGQLSPMNLFLIILVGVIAVLPTTGYDFVLNGLLRTDKSKRYILQTSWCINTFNNLSGFGGLIDIGLRMAFYGKKGQEKSDLREVTRFLPYLISGLSFISVIALIMSHIFHAKASVDYYYLVLIGASMYFPVIYWISGHKGSHYFGDMPSSTRIKLGVVSFFEWGCAAAAFIIIGYLMGIHLPVYKILPLFCIGCAVGIVSLIPGGLGSFELVLFTGFAAEGLPKETVVAWLLLYRLAYYIIPFFAGIYFFIHYLGSQINQRYENVPKELVSTVLQTMVSHLMRILGAFLIFSTAFFENITYIMWLQKLGLDPLQEQMLWQFPGLLLGVCFILLARTIDQKVKNAFPIAIIWITLTLFYLNLGHISWRLSFWFILLLLGLLVIKPTLYKKQFIYSWEERIKDGIIIVSLMGVLFYIAGLLFPIRAHITGGSIERLHYIIAWEPIALATLILTLVYLCLVKILQGKSCQIGDVFNVDRYKKLLQAYGGSSDSGLAFLNDKRLYWYQKNGEDCVAFQFVIVNNKCLIMGEPAGDDTYIREAIESFIDDADKLDYDLVFYSIGQKLTLLLHEYGFDFMKVGEDALVNLETFTLKGNKYKPFRNALNRVEKDGFYFEVVQSPHSQELLNSLEEISNTWLEGRPEKGFSLGYFNKDYFQQAPIALVKNAEHEVVAFANIMPNYEKSIISIDLMRHDKQKIPNGVMDFLFLSLFSYYQEKGYHYFDLGMAPLSGVGRVETSFAKERMAYLVYHFGSHFYSFNGLHKYKKKFTPLWSERYISCSRSSWLICAICALLMEDSKIKIVK

SEQ ID NO: 3237 - DNA, 1512 bp, Streptococcus agalactiae
atgacaacactaatcactacctttcaagagcgttttggagattggactcaaagtcttattgaacacctccagctatcactactaacacttattttagcaactttaattgctattccactcggtatcatcattagtcattataaaaaaatcagtcatgttgtccttcagataactgggatatttcaaacaattccttctttagccttgcttggtttatttataccttttatgggaattggaactgtaccagctgtcgttgcactaattatttacgctctatttccaattttacaaaatactgtaacagtactgatgcaaattgatgctaatctcattgaggcagcaaccgcttttggaatgacacgttgggaaaggcttaaaaagtttgagttagctttaagtatgcctgttatcatctcaggcattagaactgcctctgttatgattattggtacagctacattagctagtcttatcggagctggtggccttggatcatttattttgttagggattgatcgcaacaatccttctctaattctcataggggcaatctcttctgctgtcttagctattatatttagtggtttaattggattactagaaaaggctagattacgaaccatagccgtttctggtatacttttactagcaggcttaggactatcctatgctccaaaatggatgcctggaacaaatactgcaacgataactgttgcagggaagttaggaactgaaccagatattttaattaatatgtacaaagaacttattgaggatcagacagatatcaaagttaagcttaaacctaatttcggaaaaacaactttcttatatcaagccctaaaatctggtgatattgatctttacccagagtttacaggtactattacatcaagtttacttaaaaatcctcctaaagtaagtaataaccctaaacaggtttacaacttagccaaaaacggtattttaaaacaagataagttgtcacttttgtcacctatggcttatcaaaacacctacgctgtagctgttaaaaaagattacgctgaagctaatcaactcaaaaatatcagcgacctaaaaaaattagataaactaaaagctggtttcactttagaatttaaggatagagaggatgggagtattggtttacagaaacattatggtttaaaccttgatatctcaaccttagaacctgctttacgataccaagctatcaatagtaaagatgtcaatattattgacgcttactctaccgatagtgaattaatccagtatcaacttcaaattctcaaagacgataagcatctatttccgccatatcaaggagcaccgctactaaggcaagatacgattaaaaaataccctcaagtaaaaaaagctctcaataaacttgctggtcatatcactgaaaaagaaatgcaagaaatgaactaccaagtagctgtaaagcataaatcagcagctacagtagctaaacaatatttaaaagcacatcatattataaag

SEQ ID NO: 3238 - protein, 504 aa, Streptococcus agalactiae
MTTLITTFQERFGDWTQSLIEHLQLSLLTLILATLIAIPLGIIISHYKKISHVVLQITGIFQTIPSLALLGLFIPFMGIGTVPAVVALIIYALFPILQNTVTVLMQIDANLIEAATAFGMTRWERLKKFELALSMPVIISGIRTASVMIIGTATLASLIGAGGLGSFILLGIDRNNPSLILIGAISSAVLAIIFSGLIGLLEKARLRTIAVSGILLLAGLGLSYAPKWMPGTNTATITVAGKLGTEPDILINMYKELIEDQTDIKVKLKPNFGKTTFLYQALKSGDIDLYPEFTGTITSSLLKNPPKVSNNPKQVYNLAKNGILKQDKLSLLSPMAYQNTYAVAVKKDYAEANQLKNISDLKKLDKLKAGFTLEFKDREDGSIGLQKHYGLNLDISTLEPALRYQAINSKDVNIIDAYSTDSELIQYQLQILKDDKHLFPPYQGAPLLRQDTIKKYPQVKKALNKLAGHITEKEMQEMNYQVAVKHKSAATVAKQYLKAHHIIK

SEQ ID NO: 3239 - DNA, 720 bp, Streptococcus agalactiae
atgatttcatttgaaaatgttagtaaatcatatggtgatcataccatcattgataatattagttgccatattcaaagaggagaattctttgtccttgtgggggccagtggcagtggtaaaactaccatcctcaagatgattaatcgtctcatcgaaccaagccaaggcgctattactttagatggggaaaacattacatcacttgatttgcgacaattacgcttagaaactggttatgtcttgcaacaaattgcacttttccctaatttaacagttggagaaaatatagaacttatccctgaaatgaagggctggtcaaaaggtgaccaaaaaaaagccgctagcgaccttcttgataaggtgggtttacctgctaaggactactttaatcgctatcctcatgagctctctggtggggaacaacaacgcataggtatcctacgagcaatcgttgctaaacctaaggtactacttatggatgagccattttctgctttagaccctatctcaagacgtcaattacaagatatcaccaaacaattacagtctgaattgggtattacattagtgtttgtcacccatgacatgaaggaagctatgcgtcttgcagatagaatttgtgttattaaggaaggtaagatagtgcaattggatagaccagaaataattcaaaataatccctctgaccaatttgttagaaccctatttgaagaggagaac

SEQ ID NO: 3240 - protein, 240 aa, Streptococcus agalactiae
MISFENVSKSYGDHTIIDNISCHIQRGEFFVLVGASGSGKTTILKMINRLIEPSQGAITLDGENITSLDLRQLRLETGYVLQQIALFPNLTVGENIELIPEMKGWSKGDQKKAASDLLDKVGLPAKDYFNRYPHELSGGEQQRIGILRAIVAKPKVLLMDEPFSALDPISRRQLQDITKQLQSELGITLVFVTHDMKEAMRLADRICVIKEGKIVQLDRPEIIQNNPSDQFVRTLFEEEN

SEQ ID NO: 3241 - DNA, 831 bp, Streptococcus agalactiae
gtgaaattctatattattgatgatgaccccactatcactatgattttacaagatattattgaagaagatttcaataatacagtagtcagagtgaataatgtctccagtaaagcatacaacgaattgctgattgcagatgttgatatcgtattgattgatttattaatgccaatattagacggtgtaacattagtccaaaaaatctataaacagcgttccgatttaaaatttattatgatttcccaagtcaaagataatgatttacgacaagaagcatataaagcaggaatcgaattttttattaataaacccattaatattattgaagtaaaaagcgtcgtgaaacgtgtcactgatactatcgaaatgcaaaaaaaattaaatacaatccaaaatctcctagaaaatacgccatcatatcaaaagcctataacgactagtaacctcactaaaatccgttcaatactcagttatttaggtattacttcagagacagcctacacagatattcttaacatctgtgaacttttattaaaacaagaattaaattttgcccaatttgattttcaaaaagaactttctatcgatgaacaccaacaaaaaatcattttacaacgtattcgtcgtgccgttaaaaaagctatgataaatatggctcatctgtacattgatgattttgaaaatgaattaacactgcaatatgctaatgcattgtttggatttcagaatatccataatgaggcacaacttattcaaggaaaaagcatgtatggtggtaaaatttcacttaaacattttttcgatgaacttattttacagagtaaaacgttt

SEQ ID NO: 3242 - protein, 277 aa, Streptococcus agalactiae
MKFYIIDDDPTITMILQDIIEEDFNNTVVRVNNVSSKAYNELLIADVDIVLIDLLMPILDGVTLVQKIYKQRSDLKFIMISQVKDNDLRQEAYKAGIEFFINKPINIIEVKSVVKRVTDTIEMQKKLNTIQNLLENTPSYQKPITTSNLTKIRSILSYLGITSETAYTDILNICELLLKQELNFAQFDFQKELSIDEHQQKIILQRIRRAVKKAMINMAHLYIDDFENELTLQYANALFGFQNIHNEAQLIQGKSMYGGKISLKHFFDELILQSKTF

SEQ ID NO: 3243 - DNA, 1293 bp, Streptococcus agalactiae
atgctagatatattatcagaaaaacatctagaaagaaggcagcgtattattatctctgcaatagctatcgccttagctgctcaaatcaatatctcaatacttgctgatgggtttattatgaccttatctttgttcattttgcctgtctttttatattttaatgacgacattaatccaattcttctctgtctaggaattacttttgcttctcctatcttcagaggaatcatattaagtatcgctggcgaggctgagattcatcaaataattgaattcgttttaactgatatggcgttttatatttgttatggcatcaccttttatactatttattggcatcgttcctaccgtaataaaggtacttttttcttttctatcattatttgtgattattttgccaaccttgtagaaattagttttctcataaagtttaacaattatactataactatattcgctactttatttgccatagcacttttgcgagcttttattagttgcgctgtggcttatacttatagttatctatcacttctcttacaaaaagacgatcacgaacgtcgatactattattttatgtggtcaacttcagccgttaaaagcgaggtttattttatgcaaaaaaatatcattgaaattgaaaacatcatgaaaaatgcttatttattagataaagagttatccaaatatcatctacctaaagaataccaacacctctctctagatatttcgcgggacgttcacgaagttaagaaagattaccaaaatattattaaaggcttaggaacctattttagtgtaaaaaatgaatcaactatggcattgaaagatatctttcaaattgttttatcttatactaggagtattattcaatttcggcatcaagatatcattattctcgaaaataataaatgtaatttgataatatcaaactattactatttactaaccattatttccaatatcgttttaaatgcagtagaagctattgataaacaaaaaaagggtacaatcagtgttcacacagaagaattagaagattttattaaaattgagattagtgataacggaccaggaatacctgataaaatgaaacacatgattttcaaacctggattttcgactaaatttgatgctaatggtgatatctatcgaggaatcgggctatcccacgtgcgtattttaatggaagagcaatatcaaggaacgataactgtttgtcctaatcagccaaatggaacaacatttacactgttattccgtaaaaatcgatttaagttaggagataatacg

SEQ ID NO: 3244 - protein, 431 aa, Streptococcus agalactiae
MLDILSEKHLERRQRIIISAIAIALAAQINISILADGFIMTLSLFILPVFLYFNDDINPILLCLGITFASPIFRGIILSIAGEAEIHQIIEFVLTDMAFYICYGITFYTIYWHRSYRNKGTFFFSIIICDYFANLVEISFLIKFNNYTITIFATLFAIALLRAFISCAVAYTYSYLSLLLQKDDHERRYYYFMWSTSAVKSEVYFMQKNIIEIENIMKNAYLLDKELSKYHLPKEYQHLSLDISRDVHEVKKDYQNIIKGLGTYFSVKNESTMALKDIFQIVLSYTRSIIQFRHQDIIILENNKCNLIISNYYYLLTIISNIVLNAVEAIDKQKKGTISVHTEELEDFIKIEISDNGPGIPDKMKHMIFKPGFSTKFDANGDIYRGIGLSHVRILMEEQYQGTITVCPNQPNGTTFTLLFRKNRFKLGDNT

SEQ ID NO: 3245 - DNA, 996 bp, Streptococcus agalactiae
atgaaaaatttacgtaaccgtagttttcttactttattggattttagtacagcagaagttgaatttcttttaaaactttcagaagatttaaaacgtgctaaatacgcaggaattgaacaacaaaaacttgttggtaaaaatatcgctttgatttttgaaaaagattctacacggacacgttgcgcttttgaagttgctgctcacgatcaaggagctcatgttacttatttaggtccaacaggcagtcagatgggtaaaaaagagacctcaaaagacactgcgcgtgtgctaggtggtatgtatgatggtattgagtatcgtggattttctcaagaaacagttgagactttagccgaattttcaggagttcctgtgtggaatggtttaaccgatgctgatcatccaacgcaagtactagccgattttctgaccgctaaggaatgcttacataagccctataaagatattcgctttacgtatgtgggtgatggacgtaacaatgtcgctaatgccttgatgatcggtgcttctattgtaggcatgacttatcatttggtttgtcctaaagaattagagccagatcctgaactactctctaaatgtcaagaaattgcgaaaactactggtgcttctattgaaatcactgctgatattgcagaaggcgtcagagattcagacgtcctatatacagatgtttgggtttcaatgggagaaccggatgaagtttggaaagaaagaatagctcttttagaaccctatcgtattacccaagaaatgcttaatatgacagaaaatccaaacgttattttcgagcattgcttgccctcatttcataatatagatactaaagttggatacgacatttatgaaaaatatggtttgaaggaaatggaagtatcagatgaagtttttgaaggccctcactcagttgttttccaagaagctgaaaatcgtatgcatactattaaagcagttatggtagcaactttaggtgat

SEQ ID NO: 3246 - protein, 332 aa, Streptococcus agalactiae
MKNLRNRSFLTLLDFSTAEVEFLLKLSEDLKRAKYAGIEQQKLVGKNIALIFEKDSTRTRCAFEVAAHDQGAHVTYLGPTGSQMGKKETSKDTARVLGGMYDGIEYRGFSQETVETLAEFSGVPVWNGLTDADHPTQVLADFLTAKECLHKPYKDIRFTYVGDGRNNVANALMIGASIVGMTYHLVCPKELEPDPELLSKCQEIAKTTGASIEITADIAEGVRDSDVLYTDVWVSMGEPDEVWKERIALLEPYRITQEMLNMTENPNVIFEHCLPSFHNIDTKVGYDIYEKYGLKEMEVSDEVFEGPHSVVFQEAENRMHTIKAVMVATLGD

SEQ ID NO: 3247 - DNA, 924 bp, Streptococcus agalactiae
atggcaaaaattgttgttgcactaggaggaaatgccttaggaaattctccagaagaacaattaagattagtaaaacatactgcaaaatcattggtggccttgataaaaaagggacacgaaattgttgtaagtcatggtaatggaccacaagttggtgccattaatttaggaatgaattttgcggctgagagtggtcaaggaactaattttccttttccagaatgtggagcaatgagccaaggatacataggctatcatctccaacagagccttttaaatgaattacgtcaagagggaataaataaggaagttgctacaattattacccaaattgaggtggatgaatcagaccaagcatttagcgcacctaccaagcctataggcaccttttatgataaggagacatcagaaaagattgctatagagaaagggtatactttcgtagaagacgctggacgagggtatcgtcgtgttgttgcttcacctgaacctaaaaaaatcatcgaaattaatagcattaaaacacttattgaaaatgataccctagttatcgcaggtggaggtggaggcatccctgtcattaataagggaggttatgaaggtattgcagctgttattgataaagacaaatctagtgcactgttagcaggagaactagctgcggatcaattgattattctcactgcagttgattatgtttatactcaatttggtaaagaaaatcaaaaagctttaacagaggttaatgagaatcaaatgattgattacgttaaccaaggtgagtttgcaaaaggaagtatgttacctaaagtaatagcctgtatgagtttcttagatcacaatccgaaaggaacagccttaatcacctcattaaatggtttagaagatgcattagatgggaaattaggaacacgtataactaag

SEQ ID NO: 3248 - protein, 308 aa, Streptococcus agalactiae
MAKIVVALGGNALGNSPEEQLRLVKHTAKSLVALIKKGHEIVVSHGNGPQVGAINLGMNFAAESGQGTNFPFPECGAMSQGYIGYHLQQSLLNELRQEGINKEVATIITQIEVDESDQAFSAPTKPIGTFYDKETSEKIAIEKGYTFVEDAGRGYRRVVASPEPKKIIEINSIKTLIENDTLVIAGGGGGIPVINKGGYEGIAAVIDKDKSSALLAGELAADQLIILTAVDYVYTQFGKENQKALTEVNENQMIDYVNQGEFAKGSMLPKVIACMSFLDHNPKGTALITSLNGLEDALDGKLGTRITK

SEQ ID NO: 3249 - DNA, 117 bp, Streptococcus agalactiae
gtgaaactaataccagctgcatttgaagcaataacagaagaaaacggattaattgttgaaaatgatgtcccaacagaacttgctaagaaaatagcacctacacaaatgatagaatca

SEQ ID NO: 3250 - protein, 39 aa, Streptococcus agalactiae
MKLIPAAFEAITEENGLIVENDVPTELAKKIAPTQMIES

SEQ ID NO: 3251 - DNA, 1551 bp, Streptococcus agalactiae
atgccagaaaaaatgacaaacagtgaaaacaaaaggagtaaaggttttcgaatgccaggtgcctttacaatattattcattttaacaatcttttcggttttggctacatggtggatacctgctgggtcctattcaaaattacaatttgatacagcatcatccaaactagtagtaacagatccaaatggtaagacagttcatgttccagcaacgcaaacacagttggataagatgaatgtcaaaattaaaattaaagaatttacttctggtgctattagtaagccagtttcagttccaaatacttacaaacgtttgaagcaaaatccagcaggcattggctccgtgacgactagtatggtaaatggaaccattgaagctgttgatattatggtatttatcatggtacttggaggcatgataggagtagttagaaagagtggcgcttttgagtctggtcttctagctttaacaaagaaaaccaaaggtagagagtttttattgatatttttagtttccttattgatggttttaggcggtactctatgtggtattgaagaagaagcagttgctttttatcctattttagttccaatctttttagccatgggttatgattctatcatttgtgtaggtgctattttcttagcaagttctgttgggacatcattttcaacaattaatccgttttcttctgttattgcttcaaatgcagctggtattagtttcacagaaggcttatcatggcgtacagcagggtgtattgcaggtgctatttttgttgtggtgtatctacattggtatgctaaaaaaataaaagcgaatccagagttttcatattcctatgaagatagagtagaatttaatgctaaatggggcatgacaactaaccatacaccctcactctttactattagacaaaaaattattttaagtttatttgttatttcatttcctttgatggtttggggagtaatgtcacagggatggtggtttccaaccatggcttcttcctttttagctattacaattattattatgtttttaacagcaactggggcaaatggtattggagaaagggatgttgttgatgagtttgttaatggtgcatcaagccttgttggggtttcattaatcattggtttagcgcgtggtatcaatattattttgagccaaggttatatatcagatacgatgctttacacagcttcaaaattagcttcacatgttagtggctctgtctttatcattgttatgatgtttatctactttgtgttaggatttgttgttccatcctcgtcgggtttagcagtactttcaatgccaattctagcacctcttgcagatactgttgggattcctcgttcagtagtagtaatggcttatcaatttgggcagtatgcaatgttgtttttagcacctactggactagttatggcaaccttgcagatgttagatatgaagtactcccattggctaaaatttgtgtggccggttgttttattcctcctaatatttggtggcggtttgttagttctacaagttttaatactt

SEQ ID NO: 3252 - protein, 517 aa, Streptococcus agalactiae
MPEKMTNSENKRSKGFRMPGAFTILFILTIFSVLATWWIPAGSYSKLQFDTASSKLVVTDPNGKTVHVPATQTQLDKMNVKIKIKEFTSGAISKPVSVPNTYKRLKQNPAGIGSVTTSMVNGTIEAVDIMVFIMVLGGMIGVVRKSGAFESGLLALTKKTKGREFLLIFLVSLLMVLGGTLCGIEEEAVAFYPILVPIFLAMGYDSIICVGAIFLASSVGTSFSTINPFSSVIASNAAGISFTEGLSWRTAGCIAGAIFVVVYLHWYAKKIKANPEFSYSYEDRVEFNAKWGMTTNHTPSLFTIRQKIILSLFVISFPLMVWGVMSQGWWFPTMASSFLAITIIIMFLTATGANGIGERDVVDEFVNGASSLVGVSLIIGLARGINIILSQGYISDTMLYTASKLASHVSGSVFIIVMMFIYFVLGFVVPSSSGLAVLSMPILAPLADTVGIPRSVVVMAYQFGQYAMLFLAPTGLVMATLQMLDMKYSHWLKFVWPVVLFLLIFGGGLLVLQVLIL

SEQ ID NO: 3253 - DNA, 1491 bp, Streptococcus pyogenes
atgacagaagaaaaaaaacggggttttagaattccttcttcttacaccgttctttttatcattatagccatcatggcagtgttaacttggtttattccagctggcgcctacgaaaccgctaagggcggtggtgttatttcaggaacctacaaaacagtagcatccaatcctcaaggattttttgacatcttgatggctcccgttcgaggcatgttaggtgttgaaggcactgatggtgctattcaagtgtctttctttatcttaatggttgggggctttttaggagttgtcaacaaaacaggtgctcttgacacagggattgcgtcagtggttcgtaaaaacaaaggtagagaaaaaatgctgattgctattttaatccctttgtttgctctaggtggaacgacctatggtatgggggaagaaaccatggccttttacccacttttaattcctgttatgattgcggttggttttgacagtattgttgctgtagccattattttgattggttctcaaattgggtgtctagcctccactattaacccatttgcaactggtgtagcagctgatgctgctggtgtcagcattgcagatggaatgatttggcgtgttatccaatgggttattcttgtcggcatgtctatttggtttgtttacaattacgctagtaagattgaagaagacccaagtaaatcattggttgcagacaaggaagaagagcataaggaactcttccagttgcaaaattctggagaagacttaaacaagcgccaacgaaacgttttgaccatttttactttgacctttgtcattatgattcttagtttgattccgtgggaagattttggcatcaaattctttactaatatcaatacttggttaaccacaatgcctatcttagggggagttattgggaaaaccatgggagcatttggtacttggtatttcccagaaatcaccatgctctttatcatgatgggtgtcttagttgctattgtttatcgtatgagtgaagaagacttttttagctcttttttgactggtgcaggtgaatttttaggtgttgccatgatctgtgctattgcacgcggtattcaagttatcatgaatggtggtatgattacagccactatcttacacttaggtgaaacaagtctttctggtttatcttctcaagtttttgtgatattagcttatattttctacctcccaatgtccttcttgattccatcaacatcaggacttgctggggctacaatgggaattatggcaccgcttggacaattctcaaatgtccctgctcaccttgttattacagccttccagtcagcttctggaatcttaaacatgatttctccaacttcagcaatcgttatgggagcacttgcgcttggtcgcgttgaccttggtacttggtggaaattcattggtaaatttattgtaatggtgatgcttgtaagcgtgctattacttgtagttgcaacattcttt

SEQ ID NO: 3254 - protein, 497 aa, Streptococcus pyogenes
MTEEKKRGFRIPSSYTVLFIIIAIMAVLTWFIPAGAYETAKGGGVISGTYKTVASNPQGFFDILMAPVRGMLGVEGTDGAIQVSFFILMVGGFLGVVNKTGALDTGIASVVRKNKGREKMLIAILIPLFALGGTTYGMGEETMAFYPLLIPVMIAVGFDSIVAVAIILIGSQIGCLASTINPFATGVAADAAGVSIADGMIWRVIQWVILVGMSIWFVYNYASKIEEDPSKSLVADKEEEHKELFQLQNSGEDLNKRQRNVLTIFTLTFVIMILSLIPWEDFGIKFFTNINTWLTTMPILGGVIGKTMGAFGTWYFPEITMLFIMMGVLVAIVYRMSEEDFFSSFLTGAGEFLGVAMICAIARGIQVIMNGGMITATILHLGETSLSGLSSQVFVILAYIFYLPMSFLIPSTSGLAGATMGIMAPLGQFSNVPAHLVITAFQSASGILNMISPTSAIVMGALALGRVDLGTWWKFIGKFIVMVMLVSVLLLVVATFF

SEQ ID NO: 3255 - DNA, 1362 bp, Streptococcus agalactiae
atgttattccaaagtaaaataaattaccctaaaaagtctagcatcatcactcaaattaccctctggtacagctcttttatttttatccttgttatcggtgtattaattggttcattttttatttcaaaaagcattgctgaaaacaaatctaaaaaaaatttagaagctaaagctgtgcaaatgagtcaagcgttagctaaaggtcatcggtatgaggcttttgaagatggaatattttattcagtctatgaccaaaatggaaaagttatctattctggttttccaaaaggatttaaaagggatttagaccatcaacataaacataaaaagaaattatctctattttccatggagaatcgtacctttcagtatgttgatattccaatttctgggaaaaatcagtggttacgtgctatccgtactgttgacagactggataagcaattaactgaattgttatttagtttgggtatcgttcttcctcttatgttgattataataactgttggtggctatttaattttaaagcgcacttttagaccgattcaagaaattactgaaaccgctcaatttattacccaaaatgaagactatactaagcgaattatcactaaaaataacgaaaatgaattaactgagctagcagctgttatcaatactatgttggcttctattgaatcatcatttgttcgggaaaaacaatttaacaatgatgtttctcatgaactacggactcctgtaacagttatactttctgaaagtgaatacggaaaaaactacgcagaaaatttaagtgaagcaaaagaatcctttgaggttatacaccgtcagtcactatcaatgaaaaaattagttgagcaacttctagaattgactaaggcagaaaatccattatcaattcagttagaacctcttaatttctcaattatgatgaagcaactagtatccgattcgagtagattattagataatacccctatacaccttgactctcaaatcgaagatgacctttggattataggtcaacaaacactactcaaacggctttttgataatctattttcaaatgctattaaatttacaaacaatcatatttctattagtctaagacagtccgataatcaaattgtcttctctattaaagataatggtctaggtatctcagttgatgaccaaagtaaaatttggaaccgtttctatcaagtggactctgctcgaaccaaggatagtcagtctggaattggtttagggctatctttagtaaaacaaatcgctacaatacaccgtgctaaaatatgggttgattctaaacctgatgatggcagtcagtttacgctcacctttccaaaattgaagaaagac

SEQ ID NO: 3256 - protein, 454 aa, Streptococcus agalactiae
MLFQSKINYPKKSSIITQITLWYSSFIFILVIGVLIGSFFISKSIAENKSKKNLEAKAVQMSQALAKGHRYEAFEDGIFYSVYDQNGKVIYSGFPKGFKRDLDHQHKHKKKLSLFSMENRTFQYVDIPISGKNQWLRAIRTVDRLDKQLTELLFSLGIVLPLMLIIITVGGYLILKRTFRPIQEITETAQFITQNEDYTKRIITKNNENELTELAAVINTMLASIESSFVREKQFNNDVSHELRTPVTVILSESEYGKNYAENLSEAKESFEVIHRQSLSMKKLVEQLLELTKAENPLSIQLEPLNFSIMMKQLVSDSSRLLDNTPIHLDSQIEDDLWIIGQQTLLKRLFDNLFSNAIKFTNNHISISLRQSDNQIVFSIKDNGLGISVDDQSKIWNRFYQVDSARTKDSQSGIGLGLSLVKQIATIHRAKIWVDSKPDDGSQFTLTFPKLKKD

SEQ ID NO: 3257 - DNA, 669 bp, Streptococcus agalactiae
atgaaaatccttgttgttgaagatgagtttgacttgaaccgtagtattgtaaaacttttaaaaaagcaacactacagtgttgacagtgcttcaaatggtgaagaagccttacaatttgtttcagtggcagaatatgatgtgattatcttagatgtaatgatgccaaaaatggacggcttcacctttttaaaactgcttcgcaacaaaggaagtcaagtatctattcttatgttgactgctcgagatgccgttgaagatcgtatcgcaggtctagattttggtgcggatgattaccttgtaaaaccatttgaatttggagaactcatggcccgaattcgagctatgttacgacgtgcaaatagacaagtatcttctgatgatattcaaattcaagatataacaatcaatttatctacaaagcaagtttggagaaacgacaatttgattgatttaacagctaaggaatacgaagtccttgagtatttggcacgtcacagagaccaagtcctctctcgtcatcaaattcgtgaacacgtttgggattatgattattatggagagtccaatattattgatgtccttatcaaaaaccttcgtcgaaaactagataacaatcgagatggatcactaataaaaactaaacgaggtttaggatatgttattccaaag

SEQ ID NO: 3258 - protein, 223 aa, Streptococcus agalactiae
MKILVVEDEFDLNRSIVKLLKKQHYSVDSASNGEEALQFVSVAEYDVIILDVMMPKMDGFTFLKLLRNKGSQVSILMLTARDAVEDRIAGLDFGADDYLVKPFEFGELMARIRAMLRRANRQVSSDDIQIQDITINLSTKQVWRNDNLIDLTAKEYEVLEYLARHRDQVLSRHQIREHVWDYDYYGESNIIDVLIKNLRRKLDNNRDGSLIKTKRGLGYVIPK

SEQ ID NO: 3259 - DNA, 684 bp, Streptococcus pyogenes
atgacaaagaaaattttaattattgaagatgaaaagaatctggctagattcgtttctcttgagctgcaacatgagggttatgaagtcattgttgaggtcaatggtcgtgaagggttagaaactgctttggaaaaagagtttgatttaatcctgcttgacttaatgttaccagagatggatggttttgaagtgacccgtcgtttgcaaaccgaaaaaacaacgtatatcatgatgatgactgcgcgtgattctattatggatgtggttgcaggtttagaccgcggtgcagacgactatattgttaaaccgtttgccattgaagaactacttgcccgtattcgtgctattttccgccgtcaagatattgaatctgagaagaaagtgcctagtcaaggcatttatcgagatctagttttaaatccacaaaaccgttcagttaatcgtggcgacgatgagatttctctcactaaacgtgaatatgatttgcttaatattttgatgactaatatgaatcgtgtcatgacacgtgaagaattattgtcaaatgtttggaaatatgatgaagccgttgagactaatgttgtagatgtctatattcgttatctccgcggcaaaattgacattccaggcaaggaatcttatatccaaacagtgcgtggcatgggatacgttattcgtgagaaa

SEQ ID NO: 3260 - protein, 228 aa, Streptococcus pyogenes
MTKKILIIEDEKNLARFVSLELQHEGYEVIVEVNGREGLETALEKEFDLILLDLMLPEMDGFEVTRRLQTEKTTYIMMMTARDSIMDVVAGLDRGADDYIVKPFAIEELLARIRAIFRRQDIESEKKVPSQGIYRDLVLNPQNRSVNRGDDEISLTKREYDLLNILMTNMNRVMTREELLSNVWKYDEAVETNVVDVYIRYLRGKIDIPGKESYIQTVRGMGYVIREK

SEQ ID NO: 3261 - DNA, 669 bp, Streptococcus agalactiae
atgacaaactataaaaacaactttaaaaaattcatgagcaataaattatacgtagggttagcttccattacgctacttggtattgggggagctataggagtaagtggagctgcattagcgcataaccatcactcagaacacatgtcttttgaacataagcatgaaggacacgataaacatcacgatcatagagaaaaatactcactaaaaacattaaagaatatctcgacaaaaatcgattataagactgccttagaaactgccaaaaaagaagctcgctcaggctttatttcacaaattgaattaaataccaaaggtgatacacctttttatgaaatcaaagttattgataataaaatagctaaaaaatataaaattgatgctaattctgggaagatcctttcaacaacatcagataatcaactcaattcaaaagatgcccaattaaaacaaccaagtaaagatattcagactgcattacaagctattcaagcaaaatataaaaatgcaaaaataaaagaaatttctcttgcgaataacaaatcaaataagctagtttataaagtaaaactacttgatggaaatactcctaagattgcccaatttgatagtgataaagcatcatttataaaggcaaataagcttaatacaactcataaaaatcacgac

SEQ ID NO: 3262 - protein, 223 aa, Streptococcus agalactiae
MTNYKNNFKKFMSNKLYVGLASITLLGIGGAIGVSGAALAHNHHSEHMSFEHKHEGHDKHHDHREKYSLKTLKNISTKIDYKTALETAKKEARSGFISQIELNTKGDTPFYEIKVIDNKIAKKYKIDANSGKILSTTSDNQLNSKDAQLKQPSKDIQTALQAIQAKYKNAKIKEISLANNKSNKLVYKVKLLDGNTPKIAQFDSDKASFIKANKLNTTHKNHD

SEQ ID NO: 3263 - DNA, 807 bp, Streptococcus agalactiae
atgcccaagaataggataaacaatttcatcaatataggaggcttaatcttagtaatctcttttctactattagtccttgatatagttaatcttccaacgaaatttggttttaatataaagactttaaatattgaaatttggaatatttacgctacgcttttaggaagcgggttaactctgtatggtgtaattataacaattaacagtcagtatgagtcacagatagaggatactaaacggattgtaaagcctatgattaatgtgtcacctgttgacgagtatagctacaaggataagtatattcaatttgactttatattccccaaagcatatccaaaccttttaagaaaggataatattgacactccaaatgtcaccatctctctggaaaatcttggaactagagaattgtataatttatatataggaaattttgaagctacttattttgatgatggtggctattattatcaacttaatccaattttatattcaaaccataaggtacaacttaatcttatgttctatgaaaaaaatggttatcttaaagaatttaatcaggaagataaatttcatttgctcatttctcctatcaaattttcaatctattttcaggattgcttgaataattggtacgaacaatcgtttaaattacgtattttccaccaagttcaagcagacaggtcagatgaagaaaattcactaacagttagtattgaaagagtagagatatattctgcccctaaagaaatttctcccgattcacttccgtggataactaatccaagtaagttatgccagtttggg

SEQ ID NO: 3264 - protein, 269 aa, Streptococcus agalactiae
MPKNRINNFINIGGLILVISFLLLVLDIVNLPTKFGFNIKTLNIEIWNIYATLLGSGLTLYGVIITINSQYESQIEDTKRIVKPMINVSPVDEYSYKDKYIQFDFIFPKAYPNLLRKDNIDTPNVTISLENLGTRELYNLYIGNFEATYFDDGGYYYQLNPILYSNHKVQLNLMFYEKNGYLKEFNQEDKFHLLISPIKFSIYFQDCLNNWYEQSFKLRIFHQVQADRSDEENSLTVSIERVEIYSAPKEISPDSLPWITNPSKLCQFG

SEQ ID NO: 3265 - DNA, 1143 bp, Streptococcus agalactiae
atgattttagaaaggaagatgcaaatggataacaaattcaaaaatatcccaaaacggcatttaccacaaaaactcccatttgactacacgtcaatatatactgacccacaaatcattaaattaactactagggcaaatattgcaatcggtacttacgaaggatttctagagtctatcattaaccctatgctactaatctcccctttgcttagccaagaagccgttctctcttcaaaacttgaagggacccatgccaccttgaaagacttacttaattatgaagctggtaataaagtagatattgagcgtgatgaattgcatgaaatcattaactaccgaaaggctctcttttatgctctagaaaacatttccaccatcaacaacatcgattctaaaggattaccgttatccaatagaattattaaagaaatgcacaaaattcttctagataatgttagaggtagtagtaaaaatcctggtaattttaagagaagtcaaaactatatcggtagtgtatcctcgatttcatacactcctgtccccgcggaaaaaacaccagaatacatgtctaatttggagcaatatatccattatgatgacttagacttattggttcagtcagcaattatccatgctcaatttgaaatgattcacccttttgaagacggtaatggacgaattggacgattgcttataccactattcctgtactatcaggaactactttcttatccaacattttatatgagttcgtattttgaaagagataggtctctttacatatcacacctatcaaacatttcaaaagacaacaactggaaagactggtttgagtattacctagaaggagtgatattgtccgcagaagagagtacaaaaaaagctcaggacatactaagcctatataacattatgaaggaacaagtcatccctaaacttaattctgtttcaggtatccagcttcttgactttatattctcggctccaatctttaaggcagaacaagttagtgaacacctaaaaatttctaagagaactacctatactttactaaataagttaattgatgaaggttatctttcaacagataatgctcaaaggaatagaacctactattgtcctcaacttctttcaatcgttcaa

SEQ ID NO: 3266 - protein, 381 aa, Streptococcus agalactiae
MILERKMQMDNKFKNIPKRHLPQKLPFDYTSIYTDPQIIKLTTRANIAIGTYEGFLESIINPMLLISPLLSQEAVLSSKLEGTHATLKDLLNYEAGNKVDIERDELHEIINYRKALFYALENISTINNIDSKGLPLSNRIIKEMHKILLDNVRGSSKNPGNFKRSQNYIGSVSSISYTPVPAEKTPEYMSNLEQYIHYDDLDLLVQSAIIHAQFEMIHPFEDGNGRIGRLLIPLFLYYQELLSYPTFYMSSYFERDRSLYISHLSNISKDNNWKDWFEYYLEGVILSAEESTKKAQDILSLYNIMKEQVIPKLNSVSGIQLLDFIFSAPIFKAEQVSEHLKISKRTTYTLLNKLIDEGYLSTDNAQRNRTYYCPQLLSIVQ

SEQ ID NO: 3267 - DNA, 918 bp, Streptococcus agalactiae
atgtttgaaatacttaaacctgataaaaaggctgttgggaaaagattgaggcaagtcaaggatgagttaaatttgtcttttacagattttggaaatcgtcttggactaaaaaaatcaaccatcaacgcatatgtaagaggagataacttagcgcctcttgaagttttagaaaaagtatcaaaaatctatggaaaacctgtaggttggttttactatggagaattggaagaatatattgaactttaccttagaaaacttggttatggtacattcctagatgaatatcctgagacaccgttaaagataaaggatgagctttttaggattaaagcaaatccaaaacaattaatcacaactaacgggggagtaaccattggaacatttgagaatcctaattgggaaaatgactttggttacccaaatgaaggctacctagatgatatcttttttgaaatgctttgtgaaactctaaagaactcaattagacaggaagctcaaacctacctaagtcagcaagaaggacttgacgatactaaaatcaaagaactctctaattactttgccaaccaaatctacatctcatatgattttgtcggaaatttagaaaatctttctaaagataaaatcaagcaagaagttaaagaaagctatgaacgtctgcttaaagattcacctcaagcaggtgtagaagttagctatgattccaattacctacttggttttctaataaatacacttgcggatagtcaaacaacaaggcaattactttcagatatgtcacaagcaacagtcggtatgcctttttcacaatttcatgagggacacgaattagttgaggttatccaatctgtcagaccacggctgatagaactttacaataacacgacctttgatgattggactgactgggcggagaaa

SEQ ID NO: 3268 - protein, 306 aa, Streptococcus agalactiae
MFEILKPDKKAVGKRLRQVKDELNLSFTDFGNRLGLKKSTINAYVRGDNLAPLEVLEKVSKIYGKPVGWFYYGELEEYIELYLRKLGYGTFLDEYPETPLKIKDELFRIKANPKQLITTNGGVTIGTFENPNWENDFGYPNEGYLDDIFFEMLCETLKNSIRQEAQTYLSQQEGLDDTKIKELSNYFANQIYISYDFVGNLENLSKDKIKQEVKESYERLLKDSPQAGVEVSYDSNYLLGFLINTLADSQTTRQLLSDMSQATVGMPFSQFHEGHELVEVIQSVRPRLIELYNNTTFDDWTDWAEK

SEQ ID NO: 3269 - DNA, 453 bp, Streptococcus agalactiae
atgaatgaatatgattatcaagaagttgtggatagggttgacggtcttaactcagtttcaacactgaaaaagtggcgattaaaaattgaaagcttgactggtactcaatttaaagaaagtagagtgagaacgggtcggaaatcttattctaaaatctatctctttacagatgatgaccttgcctactttcaagcggtcgcggataagaagtcctcattagggcttgagagggcaattctaagcgtttatgggagttccaagggaaaagaccatcagaaacccattagagagcttgtagacgagctagaagtttcttttatggaaattcaagaggattaccaaagaaacctaactgagttgaaacagaagttagaagtgcttcttgtcagaattcagaacttagagaaagagacaggggataaaacatctaagagaattggtttcttcaaacga

SEQ ID NO: 3270 - protein, 151 aa, Streptococcus agalactiae
MNEYDYQEVVDRVDGLNSVSTLKKWRLKIESLTGTQFKESRVRTGRKSYSKIYLFTDDDLAYFQAVADKKSSLGLERAILSVYGSSKGKDHQKPIRELVDELEVSFMEIQEDYQRNLTELKQKLEVLLVRIQNLEKETGDKTSKRIGFFKR

SEQ ID NO: 3271 - DNA, 207 bp, Streptococcus agalactiae
atgaagacggttcgccaccccaccgctgggcgagtggtcaatacggtagcccagagcaggtggggaaggtggcaaacggctgaaatcgaaattgaaattgcaccccgttccctattagggggtgcacacatacacgaaatgtggtcaaaacccttgataagcaaggggttcagcgatttgaagcaaatttcacgaaaaaaatcttta

SEQ ID NO: 3272 - protein, 69 aa, Streptococcus agalactiae
MKTVRHPTAGRVVNTVAQSRWGRWQTAEIEIEIAPRSLLGGAHIHEMWSKPLISKGFSDLKQISRKKSL

SEQ ID NO: 3273 - DNA, 429 bp, Streptococcus agalactiae
atgacaaaatttaacttaacagacgaaaccataaaagttggtgatttgaaattagataaatcacaatttgacattccaaagaaagtgactatcctttcttcacgggttgcaccagtctataaaaatgtcaatggcgaaagcattgcgacagatgaagtggctaaaatcacttgctctgtacaagatacagacaaaattcaagccttgaaagacttgggctattcttctgatgaccttaagggcattcgcttggagattgtagacaatcttgacaagttggctaaatccgttgaaaaggatgggttaaactcccttgtggtagaacttgtcaatccagaagtccatcttggttggcgagccaacaataatggtggagggaattggggtggcttaaagctagtggcaaccgatattaaatttattggagcc

SEQ ID NO: 3274 - protein, 143 aa, Streptococcus agalactiae
MTKFNLTDETIKVGDLKLDKSQFDIPKKVTILSSRVAPVYKNVNGESIATDEVAKITCSVQDTDKIQALKDLGYSSDDLKGIRLEIVDNLDKLAKSVEKDGLNSLVVELVNPEVHLGWRANNNGGGNWGGLKLVATDIKFIGA

SEQ ID NO: 3275 - DNA, 1026 bp, Streptococcus agalactiae
atggataactcagtgatgttagactatttagccgtaacgattaaaggcttggctccagatgatgtcattgagaaaatcctcattcttcctaaagacaagtttgtcctcaatgaatgggggataaacaagtatcaacggcattattccttctcagagataaaggtttacttcaataaggactggcaatcaaagatgggagtctttatcgaactgagagggcaggggtgccgtcagtatgaagaatatatggaaaacaatgtcaataactgggtaaccttgatgaaacgcatttctgaatgtcatagtaacgttacgagactagatattgccaacgatatctttgatgacagtctatccgtcccactcatttacagttattgtaaaaagcaactctgcatatcaaccgctaaaacctttgattaccatgaaaagagccttcttgaaaatggtgaaaaggtcggtgaaatggttacgattggtgttagaggtactcagcaatggtgtgtctataacaaattgttagaacaaaagctagaccaagaattgccaaatacgcccttatcatggacaagagcagagctgaggtgctggcaggaaaaagcaaatttactagccaaacagattaaagaggggcgaccgctcaaagagatttactttgaagttattaacggacactaccgttttgtcagcccgagggacaaggattctaaccgttggcgaagaaagacggtaaaatggtggaatgactatctagagacacaagaaaagacggtcttaagcgtaaaacggacaaaacctaccctaaaacgttctgagaagtggacagagaaacaagtctcacgaacactcggaaaactctatgtcgctaaggcggaatctcacgggcaagaaaaggcagatagctatatccagcacttacttgaattggggatttctaagctaaccgaaacagacgagactgacattcagcagtacaaacaagagcaactaagctcagcctattggggcataagaaaagacgacctg

SEQ ID NO: 3276 - protein, 342 aa, Streptococcus agalactiae
MDNSVMLDYLAVTIKGLAPDDVIEKILILPKDKFVLNEWGINKYQRHYSFSEIKVYFNKDWQSKMGVFIELRGQGCRQYEEYMENNVNNWVTLMKRISECHSNVTRLDIANDIFDDSLSVPLIYSYCKKQLCISTAKTFDYHEKSLLENGEKVGEMVTIGVRGTQQWCVYNKLLEQKLDQELPNTPLSWTRAELRCWQEKANLLAKQIKEGRPLKEIYFEVINGHYRFVSPRDKDSNRWRRKTVKWWNDYLETQEKTVLSVKRTKPTLKRSEKWTEKQVSRTLGKLYVAKAESHGQEKADSYIQHLLELGISKLTETDETDIQQYKQEQLSSAYWGIRKDDL

SEQ ID NO: 3277 - DNA, 1482 bp, Streptococcus agalactiae
atgagagataatggttcaagagtacttatcatcagttcttggcgaccagacccttataaggcgggtaatgtcttggtgaaattcgctatgcgattcacccaccctattactaaaaaatctcataagaaatacctttctacaggtgctagtaaagggtggtttaccaccaaggcaacaccgagcaaaaagttaccttctgggaaagaacgtctcttggtcagcgatattaaaaacacacaattaattactcaggtcacgcaagaactgaataaattagttgatgactatatcgccgagctaatgggcattaagcctaagaaagccaagaaacttttaaccctagaagaaatcgccaagccatttgataaagatggaaatttttacggtaaagcctttaaagcatggcatgaaagggtcaagccagccaataatacccttaaaacaagggttactatctataatcgctatattgagccgaactttgataccagaatgtccatcacgaaatttgcctttatgacagatgaaattcaaaatcttatcaatgcttcttctatgcacatggcgagaaatctgcatatctaccttaagatgatttttgactggtcagttgaaaatggacagataactcttacacaagacccgattgccagcaataaggttaaaaggcgagttctgacaaagagtgaggagcaggacaagaagcgtgaagatatagcagagaagtatctagaagcaagtgaggttaaccatgttctccgcctgatagagagctggactaatcgacctgataaccaacttatcgcagatgtattgagaatgatttttctaacaggcatgcgaccaagtgaggttttaggcttaaatgaagacatgcttgattttgagaaaaagtggataaaagttcattggcagagggcaagtaagaataaatcggatgatatgatggaagcactcaatcttgacgaaaaggaacgctaccgagcagaccttaagaccaaggaaagtgtccgcacgattccaatgagccctgaggttgagaagattctacgtcactatattgacagaaataaatttcaagctcaattcagtccgacttaccaagacttagggtatctctttactagaacctatattagggcaggtaatcgacaaggctctccgctttatcacaacgaactctcacaattcctgagaggtggctctagtcagtcagcaaagtataacaagaaagcaggcaagccctataaggatatcgatagctttctagactttggcagaccgattcatgtcatccctcatatgttccgccatagctttatctctattatggctagcgaaggtattgacctccctactattcgagaatttgtcggacactcggaggattccaaggagattgagcgtgtctatctccatgtgattaagaagcaaaaagataccatgagaggggcagttgaaaagctagaaaagttgattgaa

SEQ ID NO: 3278 - protein, 494 aa, Streptococcus agalactiae
MRDNGSRVLIISSWRPDPYKAGNVLVKFAMRFTHPITKKSHKKYLSTGASKGWFTTKATPSKKLPSGKERLLVSDIKNTQLITQVTQELNKLVDDYIAELMGIKPKKAKKLLTLEEIAKPFDKDGNFYGKAFKAWHERVKPANNTLKTRVTIYNRYIEPNFDTRMSITKFAFMTDEIQNLINASSMHMARNLHIYLKMIFDWSVENGQITLTQDPIASNKVKRRVLTKSEEQDKKREDIAEKYLEASEVNHVLRLIESWTNRPDNQLIADVLRMIFLTGMRPSEVLGLNEDMLDFEKKWIKVHWQRASKNKSDDMMEALNLDEKERYRADLKTKESVRTIPMSPEVEKILRHYIDRNKFQAQFSPTYQDLGYLFTRTYIRAGNRQGSPLYHNELSQFLRGGSSQSAKYNKKAGKPYKDIDSFLDFGRPIHVIPHMFRHSFISIMASEGIDLPTIREFVGHSEDSKEIERVYLHVIKKQKDTMRGAVEKLEKLIE

SEQ ID NO: 3279 - DNA, 1137 bp, Streptococcus pyogenes
atgtggtcagaaaaacacaaaagcggaaaagtaaattttgtagaacggtacaaacacccatacactggcaagtggtgcagagcttctgtccttatggaaaaagacacgccacgaatacgaaaagaagcccaaaaatatcttgacgaaaaaatatctgaaatcttaacaagtcttaccacaaccgatgcctacctactagatgtcatgaacgaatggtgggaacatcatcagaaatcactcaaatcaacttctgtccgctctcttgattttagaataagagaattgcgaaacttaattgatccagaagtgatgattgccaagataaccacgaaatacctgcaaagtattatcgacaaaataccaggtagttatgacaaacgtaaacgagcacggcagctgctcaaacaaaccttcgactacgctatcgctttagagtatgtctcaatcaatccagttattagtacccaactcgcaaaacctgttaagaccatcaaagactttgaagacgttgcccagaagtttttagaaaaagatgaactcaaaaggctattagatgaaatgtatagacgtaaaggatcgattaaaatggcttatctggcagaatttatgagcttaaatggctgccgcattggagaagctctagctatacagccagacaatatcaaaaatgatatcattgaaatccacggaactcttgactacacctcaaatggctatagaaacgctatcaaaaccacccctaaaacaaattccagttggcgtgaaacattgataaccaaacgtgaaaaagaaattattcaggatatactgaaaattaatgctcttgaaaaaaatactaatcctaattacaaggacatgggctacatcttcatttccagaaatggtgttcctattcaagacaacgccctcaacacctctatcagagcggcaaataagagactagaaaaaccgattcaaaaagaactcaccagccacatcttccgtcacaccctggtgagtcgccttgcagaaaacaaagtgcccttaaaaactatcatggatagagttggacatgctgactcgaaaactactcaacaaatctatacccacgtcacgaaaagcatgaaaaatgaagtcgtcgacatcttaaaccggcta

SEQ ID NO: 3280 - protein, 379 aa, Streptococcus pyogenes
MWSEKHKSGKVNFVERYKHPYTGKWCRASVLMEKDTPRIRKEAQKYLDEKISEILTSLTTTDAYLLDVMNEWWEHHQKSLKSTSVRSLDFRIRELRNLIDPEVMIAKITTKYLQSIIDKIPGSYDKRKRARQLLKQTFDYAIALEYVSINPVISTQLAKPVKTIKDFEDVAQKFLEKDELKRLLDEMYRRKGSIKMAYLAEFMSLNGCRIGEALAIQPDNIKNDIIEIHGTLDYTSNGYRNAIKTTPKTNSSWRETLITKREKEIIQDILKINALEKNTNPNYKDMGYIFISRNGVPIQDNALNTSIRAANKRLEKPIQKELTSHIFRHTLVSRLAENKVPLKTIMDRVGHADSKTTQQIYTHVTKSMKNEVVDILNRL

SEQ ID NO: 3281 - DNA, 624 bp, Streptococcus agalactiae
ttgaataaaattcatttgatatatagaattataaaagctgtacttcctaagaaaaagagaaaagaatatgatacaatgaacttgactaaattaaagaggaaagaaatgagaacatattcagataaaaacgaacttaaggaagaagtactaaaatcatataaaaaatatattgctgaattcaatgacattcctgagaagttgaaagatttaagaattgatgaggttgataggacaccagcggagaatctagcctatcaggttggctggactaccctgatactaaaatgggagtcagatgaacagagtggcttagaagttaaaacaccaactgagacgtttaaatggaatcaacttggagagctatatcagcattttactgagacctacgctagtctaaccatcaaagaacttacggctcaactcaatgataatgtagatgctataggtaacatgattgattcaatgagcgacgaagtcctatttaaacctcatatgagaaattgggctgatagtgcgactaagaatgcagtctgggaagtttataagtttattcatattaatacggtagctcctttcggaacatttagaactaagattcgcaagtggaaaaaagttgctttaaag

SEQ ID NO: 3282 - protein, 208 aa, Streptococcus agalactiae
MNKIHLIYRIIKAVLPKKKRKEYDTMNLTKLKRKEMRTYSDKNELKEEVLKSYKKYIAEFNDIPEKLKDLRIDEVDRTPAENLAYQVGWTTLILKWESDEQSGLEVKTPTETFKWNQLGELYQHFTETYASLTIKELTAQLNDNVDAIGNMIDSMSDEVLFKPHMRNWADSATKNAVWEVYKFIHINTVAPFGTFRTKIRKWKKVALK

SEQ ID NO: 3283 - DNA, 147 bp, Streptococcus agalactiae
atgcgcgtaaatattacacttgaacataaagaatctggtgaacgcttgtaccttacttcaaaaaacaaacgtaacactccagaccgtcttcaattgaaaaaatactcaccaaaacttcgtaaacacgttgttttcactgaagttaaa

SEQ ID NO: 3284 - protein, 49 aa, Streptococcus agalactiae
MRVNITLEHKESGERLYLTSKNKRNTPDRLQLKKYSPKLRKHVVFTEVK

SEQ ID NO: 3285 - DNA, 147 bp, Streptococcus pyogenes
atgcgcgtaaatattacacttgaacataaagaatctggtgaacgcttgtaccttacttcaaaaaacaaacgtaacactccagaccgtcttcaattgaaaaaatactcaccaaaattacgtaaacacgttacatttacagaggttaag

SEQ ID NO: 3286 - protein, 49 aa, Streptococcus agalactiae
MRVNITLEHKESGERLYLTSKNKRNTPDRLQLKKYSPKLRKHVTFTEVK

SEQ ID NO: 3287 - DNA, 180 bp, Streptococcus agalactiae
atggcaaaacctgcacgtcacacttcaaaagcgaagagaaacaaacgtcgtacacactacaaattgacagctccatctgtacaattcgacgaaactactggagattactcacgttcacaccgtgtatcactcaaaggatactacaaaggacgtaaaatcgctaaagctaacgaagctaaa

SEQ ID NO: 3288 - protein, 60 aa, Streptococcus agalactiae
MAKPARHTSKAKRNKRRTHYKLTAPSVQFDETTGDYSRSHRVSLKGYYKGRKIAKANEAK

SEQ ID NO: 3289 - DNA, 117 bp, Streptococcus pyogenes
atgacagctccatctgtacaattcgacgaaactactggagattactcacgttctcaccgtgtatcccttaaaggatactacaaaggacgtaaaatcgctaaagctaacgaagctaaa

SEQ ID NO: 3290 - protein, 39 aa, Streptococcus pyogenes
MTAPSVQFDETTGDYSRSHRVSLKGYYKGRKIAKANEAK

SEQ ID NO: 3291 - DNA, 1314 bp, Streptococcus agalactiae
atgtttaaagagaaaactaatcgaagaggtaaacttatgaaacttcaaaaaccaaaagggactcaggatatcttacctggagaatcagcaaagtggcaatacgttgaaaatgttatacgcaatctctttaaacaatatcattatgatgaaattcgtacaccaatgtttgaacattacgaggttattagtcgctcagttggggatacaacggatatcgttacaaaagagatgtatgattttcatgataaaggagatcgtcacattacgcttcgtccagaaggaacagcacctgttgtacgttcttatgttgaaaataaactatttgcaccagaagttcaaaaaccaaccaaaatgtattatattggatcaatgttccgatatgagcgcccacaggctggtcgtttacgagaatttcatcaagtaggcgttgagtgctttggatcaaataatccagcaactgatgttgaaacaatcgcaatgggacatcatctatttgaagatttaggtatcaaaaacgttaaacttcatcttaatagtttagggaatccagaaagtcgtcaggcctatcgccaagctcttattgattacttaacacccatacgtgaacaattgtctaaggatagtcaacgtcgtttgaatgaaaatccattgcgcgtactagactctaaggagccagaagacaaactagcagttgaaaatgctccttctattttagattatttagatgagtcaagccaagcccactttgatgctgtgtgtcatatgcttgatgctctaaatattccatacatcattgatactaatatggttcgtggtcttgattattataatcatactatttttgagtttatcactgagattgaagataatgaattaacgatctgtgctggaggccgttatgacggcttagtatcctattttggtggaccagaaacaccagcatttggttttggattaggattagaacgcttgctcttaatattagataagcaagggatttctttaccaatagaaaatactatagatctgtatatagctgtattaggatcagaggctaatctagctgccttagatttggcacaatcaatacgtcatcagggttttaaagtagagcgtgattatttgggtcgtaaaatcaaagcacaatttaagtctgcagatacttttaatgctaaagtgattatgacattaggtagcagtgaagtagattcgaaagaggtcggtttaaaaaataatcaaacacgtcaagaagttaaagttagttttgaaaacattaaaacagatttttcatctgtgcttaaacaattaggattg

SEQ ID NO: 3292 - protein, 438 aa, Streptococcus agalactiae
MFKEKTNRRGKLMKLQKPKGTQDILPGESAKWQYVENVIRNLFKQYHYDEIRTPMFEHYEVISRSVGDTTDIVTKEMYDFHDKGDRHITLRPEGTAPVVRSYVENKLFAPEVQKPTKMYYIGSMFRYERPQAGRLREFHQVGVECFGSNNPATDVETIAMGHHLFEDLGIKNVKLHLNSLGNPESRQAYRQALIDYLTPIREQLSKDSQRRLNENPLRVLDSKEPEDKLAVENAPSILDYLDESSQAHFDAVCHMLDALNIPYIIDTNMVRGLDYYNHTIFEFITEIEDNELTICAGGRYDGLVSYFGGPETPAFGFGLGLERLLLILDKQGISLPIENTIDLYIAVLGSEANLAALDLAQSIRHQGFKVERDYLGRKIKAQFKSADTFNAKVIMTLGSSEVDSKEVGLKNNQTRQEVKVSFENIKTDFSSVLKQLGL

SEQ ID NO: 3293 - DNA, 1278 bp, Streptococcus pyogenes
atgaaacttcaaaaaccaaaaggaacccaggatattctgcctggggatgctgcgaaatggcagtatgtggaatctgttgcgcgtgatacgtttagccaatataattatggagaaattcgtactcctatgtttgaacactacgaggtaatctcgcggtctgtaggtgatacgactgatattgtgacgaaggaaatgtatgatttctatgataaaggagatcgtcacattaccttgcgaccagagggtacagctccagtggtgcgttcttatgttgaaaataaattgtttgcgccagaggtccaaaaacccgtcaaactttattatatcggttccatgttccgctacgaacgtcctcaagctggtcgtttacgtgaatttcaccagattggggtagaatgtttcggcgctgctaatccagcaacagatgttgaaaccattgcgatggcctatcacctctttgaaaaattgggcattaaggatgtcacccttcatttaaatagtttggggagtcctgagagtcgtgcagcttatcgtcaagccttgattgactacttaacaccaatgcgtgatcaattatctaaagatagtcaacgtcgcttggatgaaaacccactgcgcgtgcttgattctaaagaaaaagaagataaactagccgttgaaaaagcgccttctattttggattacttagatgaggaaagtcaggcgcactttgaggcggtcaaagatatgcttgaagcacttgacattccttatgtgattgacaccaatatggtgcgtggccttgattactatagccacactatttttgaattcatcacgtctgtggaaggttctgacttaactatctgtgcgggtggacgttatgatagtttggtaggttattttggtgggcctgagactccaggatttggctttggtcttggtttagaacgtctcttgatgattattgaaaagcagggcattaccttgccaattgagacagagatggatatttaccttgctgtgttaggtgatggtgctaatagcaaagctttagaattggttcaagccattcgccgtcaagggtttacagctgaacgagattaccttggccgtaagattaaggctcagtttaaatcagccgatacctttaaagcaaaattggtaatgactttaggagaaagtgaagttgaagcaggcaaagctgtgattaagaataatcgtagtcgtcaagaagtggaagtcagttttgaagatatgatgacaaactttgcgaacatctcagagcaattattatct

SEQ ID NO: 3294 - protein, 426 aa, Streptococcus pyogenes
MKLQKPKGTQDILPGDAAKWQYVESVARDTFSQYNYGEIRTPMFEHYEVISRSVGDTTDIVTKEMYDFYDKGDRHITLRPEGTAPVVRSYVENKLFAPEVQKPVKLYYIGSMFRYERPQAGRLREFHQIGVECFGAANPATDVETIAMAYHLFEKLGIKDVTLHLNSLGSPESRAAYRQALIDYLTPMRDQLSKDSQRRLDENPLRVLDSKEKEDKLAVEKAPSILDYLDEESQAHFEAVKDMLEALDIPYVIDTNMVRGLDYYSHTIFEFITSVEGSDLTICAGGRYDSLVGYFGGPETPGFGFGLGLERLLMIIEKQGITLPIETEMDIYLAVLGDGANSKALELVQAIRRQGFTAERDYLGRKIKAQFKSADTFKAKLVMTLGESEVEAGKAVIKNNRSRQEVEVSFEDMMTNFANISEQLLS

SEQ ID NO: 3295 - DNA, 1800 bp, Streptococcus agalactiae
gtgctttttgttataataggttggaatgaatattttaaatggagaaaacagatgaaacgtagtatgtatgctgggcgtgttcgtagtgagcacataggaacatcgattactttaaaaggatgggttggtcgtcgtcgtgaccttggaggccttatttttattgatcttcgcgatcgcgagggaatcatgcaattagttattaatcctgaagaagtatcagcctcagttatggcaaccgcagaaagtctccgtagtgaatttgttatagaggttagcggtgtagtgacagcacgagaacaagctaatgataatttaccaacaggagaagttgaattaaaagtgcaagaattatcgattcttaatacctcgaaaacaacaccatttgaaattaaagatggtattgaggcaaatgatgatacacgcatgcgttaccgttacttggatcttcgtcgtccggaaatgcttgaaaatttcaaattacgtgcgaaagtaacacactcaatccgtaattaccttgacaacttagagtttattgatgtcgaaactccgatgctaacaaaatcaactccagagggggcacgagactatttggttccatcacgtgtcaaccaaggacatttttatgcccttccacaaagccctcaaattacaaaacagctattgatgaatgcgggatttgatcgttattatcaaattgtcaaatgtttccgtgatgaggatttacgtggagaccgtcaacctgagtttacacaagttgacttagagacatcattccttagtgatcaagaaattcaagacattgttgagggtatgattgctaaagtaatgaaagacactaaaggtttagaggtttctttaccattcccaaggatggcatatgatgatgcaatgaataactacgggtctgataagcctgatacaaggtttgatatgcttttacaagacttgacagaaattgtcaaagaagttgacttcaaggtgttctcagaagcttcagtagttaaagcgattgttgtcaaagataaggcggacaagtactctcgaaaaaatattgataaattaacagaaattgcaaaacaatacggtgccaaaggtttagcatggctaaaatatgcagataatactatttcaggtccggttgctaagttcttgacagctattgaaggtaggttgacagaagctttacagctagagaataatgacttaattctatttgtagcagatagtcttgaagtagctaacgagactttaggagcgcttcgtacacgcattgcaaaagaacttgaactcattgattattctaaatttaatttcctatgggttgttgattggccaatgtttgagtggtcagaagaagagggacgatatatgtcggctcatcatccattcaccttgccaacagcggagacagcgcatgagttggaaggggatttggctaaagtacgtgcagttgcctatgatattgttttgaatggatatgagttaggcggtggtagcctacgtattaaccaaaaagatacacaagagcgtatgttcaaggctttaggatttagcgctgaatcagctcaggaacagtttggtttcttacttgaagctatggattacggcttcccaccacatggtggattggcaataggccttgaccgctttgttatgttgttagcaggcaaggacaatattcgagaagttattgcattccctaaaaacaataaggctagtgatccaatgactcaagctcctagtctcgtttcagaacaacaattagaagaattatcacttactgtagaaagttatgaaaac

SEQ ID NO: 3296 - protein, 600 aa, Streptococcus agalactiae
MLFVIIGWNEYFKWRKQMKRSMYAGRVRSEHIGTSITLKGWVGRRRDLGGLIFIDLRDREGIMQLVINPEEVSASVMATAESLRSEFVIEVSGVVTAREQANDNLPTGEVELKVQELSILNTSKTTPFEIKDGIEANDDTRMRYRYLDLRRPEMLENFKLRAKVTHSIRNYLDNLEFIDVETPMLTKSTPEGARDYLVPSRVNQGHFYALPQSPQITKQLLMNAGFDRYYQIVKCFRDEDLRGDRQPEFTQVDLETSFLSDQEIQDIVEGMIAKVMKDTKGLEVSLPFPRMAYDDAMNNYGSDKPDTRFDMLLQDLTEIVKEVDFKVFSEASVVKAIVVKDKADKYSRKNIDKLTEIAKQYGAKGLAWLKYADNTISGPVAKFLTAIEGRLTEALQLENNDLILFVADSLEVANETLGALRTRIAKELELIDYSKFNFLWVVDWPMFEWSEEEGRYMSAHHPFTLPTAETAHELEGDLAKVRAVAYDIVLNGYELGGGSLRINQKDTQERMFKALGFSAESAQEQFGFLLEAMDYGFPPHGGLAIGLDRFVMLLAGKDNIREVIAFPKNNKASDPMTQAPSLVSEQQLEELSLTVESYEN

SEQ ID NO: 3297 - DNA, 1797 bp, Streptococcus pyogenes
ttggaaacgagcaggtttcacaggattctgtttgttttagggaatttatttatgaaacgtagcatgtatgcagggcgtgttcgcgaagaacacattggaacgacaatcacattgaaaggatgggtcagtcgtcgtcgtgacttgggtggtctcatctttattgatttgcgtgaccgtgagggtgtgatgcaattagtcattaaccctgaggaagtttccagtgatgtgatggcaactgctgaacgcttacgtagtgaatatgtgattgaagtggaaggttttgttgaagctcgacaacaagccaatgataagttggcgacaggaatggttgagttaaaagtatctgctttgaccattttaaacacagctaaaacgacgccttttgaaattaaagatgacgttgaagtaagtgatgacacgcgtttacgttaccgttacttagatttacgacgtccagaaatgttagaaaacttcaagctacgtgcaaaagtgactcattctatccgtaattaccttgatgaccttgagtttatcgatgtcgagacacctatgttgacaaaatcaactccagaaggtgcgcgtgactatctggtaccaagtcgtgttagccaagggcatttctatgctttgccacaaagtccgcaaataaccaaacagttattgatgaatgctggctttgatcgctattatcaaattgtgaaatgtttccgcgatgaagatctacgtggtgaccgtcaacctgagtttacacaagttgacttggaaacgtcattcctttctgaacaagaaattcaagacatcgttgaaggcatgattgctaaagtgatgaaagagacaaaagaaatagatgtaaccctaccattcccacgtatgagctacgatgtagcaatgaatagctacggctctgataaaccagacacacgttttgaaatgcttttacaagacttgacagtaactgtcaaaggaaatgacttcaaggttttctcagaagcaccagctgtcaaggcgattgtggtgaagggaaatgcagatcgatactctcgtaaagatattgacaaattaactgagtttgccaaacaatttggtgctaaaggccttgcctgggttaaggtgacagatggtcaattggcaggcccagtagccaagttcttgacagctattgagacagagttgtcaagccaattaaaacttgctgagaatgatttggttttatttgtagcggatactcttgaggttgctaataatacattaggtgcccttcgtaatcgtattgccaaggaccttgacatgattgatcagtcgcagtttaatttcctttgggtggttgattggccaatgtttgagtggtcagaagaagaaggacgttatatgtcagctcatcaccccttcactcttccaacgccagaatctgctcatgagttagagggtgatttggctaaggtacgggctattgcttacgacatcgttttaaatggttacgagcttggtggtggtagcctgcgtatcaatcaaaaagagatgcaagagcgcatgttcaaggctcttggctttaccgctgatgaagctaacgaccaatttggtttcttactagaagcgatggactacggctttcctcctcatggtggcttggcaattggtcttgaccgttttgtcatgttgcttgctggaaaagacaatattcgagaagttattgccttccctaaaaataacaaagcctctgatccaatgacgcaagcacctagtcttgtttctgaaaaccaattagaagaactcagtcttcaaatagaaagtcatgat

SEQ ID NO: 3298 - protein, 599 aa, Streptococcus pyogenes
LETSRFHRILFVLGNLFMKRSMYAGRVREEHIGTTITLKGWVSRRRDLGGLIFIDLRDREGVMQLVINPEEVSSDVMATAERLRSEYVIEVEGFVEARQQANDKLATGMVELKVSALTILNTAKTTPFEIKDDVEVSDDTRLRYRYLDLRRPEMLENFKLRAKVTHSIRNYLDDLEFIDVETPMLTKSTPEGARDYLVPSRVSQGHFYALPQSPQITKQLLMNAGFDRYYQIVKCFRDEDLRGDRQPEFTQVDLETSFLSEQEIQDIVEGMIAKVMKETKEIDVTLPFPRMSYDVAMNSYGSDKPDTRFEMLLQDLTVTVKGNDFKVFSEAPAVKAIVVKGNADRYSRKDIDKLTEFAKQFGAKGLAWVKVTDGQLAGPVAKFLTAIETELSSQLKLAENDLVLFVADTLEVANNTLGALRNRIAKDLDMIDQSQFNFLWVVDWPMFEWSEEEGRYMSAHHPFTLPTPESAHELEGDLAKVRAIAYDIVLNGYELGGGSLRINQKEMQERMFKALGFTADEANDQFGFLLEAMDYGFPPHGGLAIGLDRFVMLLAGKDNIREVIAFPKNNKASDPMTQAPSLVSENQLEELSLQIESHD

SEQ ID NO: 3299 - DNA, 942 bp, Streptococcus agalactiae
atgaaaactagacgaacccctttagaaaaaaaggtaaaatatattatcagtgtatgggctaaaaaatttggtctcttacacactttaaaaagtatctcacgagaaaaatatgcagagaaaatttcggcttcattgctgtatggtattctatccagtgttgctgtcaatttcttttttcaacctggacatgtttattcaagtggagcaactggtttagctcaggttatttcagctgtcagtaaacactggttttcttttgaaataccagttgctttagctttttatgccattaatatccctttgctgatattatcttggcgtaagattggacataaatttactatttttacgtttatcacagtaactgtaagctctatcttcattcaactaatgcctcaaatcacccttacaactgatcccttaatcaatgctatctttggtggtttaattatgggagctggtgttggttttagctttaagtctagaatttctagtgggggaacagatattatcagtttgacaattagaaagaaaacaggcagagatgtaggtagtatttcttttattattaatggtattattttattatttgcaggtcttttatttggttggaagtacgctttgtactcgatggtgaccatttttgtatcaagtagagttacagatgccatttttacaaagcaaaaaaagatgcaagcgatgattgttaccagtaagccttattgcgtcattaaacgtatccatcgtgatttacatcgtggtgtaacctgtatcaatgatgctgaaggtacttataatcatgagaaaaaagcagttttaataactatattaacacgtgaagaatttagtgattttaaatatttaatgctaaaagcggatccaaaagcctttgtttccgttgcagaaaatgttcatattattggacgattcgttgatgatgat

SEQ ID NO: 3300 - protein, 314 aa, Streptococcus agalactiae
MKTRRTPLEKKVKYIISVWAKKFGLLHTLKSISREKYAEKISASLLYGILSSVAVNFFFQPGHVYSSGATGLAQVISAVSKHWFSFEIPVALAFYAINIPLLILSWRKIGHKFTIFTFITVTVSSIFIQLMPQITLTTDPLINAIFGGLIMGAGVGFSFKSRISSGGTDIISLTIRKKTGRDVGSISFIINGIILLFAGLLFGWKYALYSMVTIFVSSRVTDAIFTKQKKMQAMIVTSKPYCVIKRIHRDLHRGVTCINDAEGTYNHEKKAVLITILTREEFSDFKYLMLKADPKAFVSVAENVHIIGRFVDDD

SEQ ID NO: 3301 - DNA, 939 bp, Streptococcus pyogenes
atgattaagaaaacaacctataagaaaaaagttaaatatgtcattagtagaggggccaagaaagttggcctactccacgctctaagaagtatttcaagagaaaaatatgcagagaagatttcggcttctctgctttatggcattctctctagtattgctgtgaattttttcttccagcctgggcatgtttattcaagtggagcaactggtctagcacaggttttttcagctcttagtcatcgtcttttaggctatgattttcccatcgcctttgcgttttatttgattaatattcctttgcttattttagcttggtataaaattgggcatcaatttaccatttttacctttatcacagtcagcatgagttctttctttattcaaatcatgcctcaagtgacgctgacgactgatcctcttatcaatgctatttttggtggtttggttatgggaatgggaattggtacaggtctcaaatcacgtatctctagtggggggactgatattgtcagtttgacccttaggaaacgaacaggcaaggatgtgggcagtctctcattgatggttaatggtgcaattttagcctttgcagggattttatttggctggcagtacgccctttattctatggtctctatctttgtatcaagtcgtgttacggatgccattttcaccaagcaaaagaaaatgcaggcaactattgttaccagccatccagagcgtgtgattcatatgatccataaacgtctgcatcgcggagtgaccagtatcaacgacgcagaagggacttacaagcatgaacaaaaagcagttttgattaccattttgacatgtgaagaatacccagaattcaaatggctgatgttaaaaacagacccacaagcctttgtttcagtggctgagaatgttagaattatcggtcgttttgtggaagatgat

SEQ ID NO: 3302 - protein, 313 aa, Streptococcus pyogenes
MIKKTTYKKKVKYVISRGAKKVGLLHALRSISREKYAEKISASLLYGILSSIAVNFFFQPGHVYSSGATGLAQVFSALSHRLLGYDFPIAFAFYLINIPLLILAWYKIGHQFTIFTFITVSMSSFFIQIMPQVTLTTDPLINAIFGGLVMGMGIGTGLKSRISSGGTDIVSLTLRKRTGKDVGSLSLMVNGAILAFAGILFGWQYALYSMVSIFVSSRVTDAIFTKQKKMQATIVTSHPERVIHMIHKRLHRGVTSINDAEGTYKHEQKAVLITILTCEEYPEFKWLMLKTDPQAFVSVAENVRIIGRFVEDD

SEQ ID NO: 3303 - DNA, 870 bp, Streptococcus agalactiae
atgttgaaactggatttaaaaacaaagataaaagaaactattttaattgcctttggtgtggctctctatactttcggctttgtcaaatttaatatggctaatcatttggctgaaggaggtatttccggtgtcactttgattatccatgcacttttcggagttaatccagcactttcatcacttctccttaatatcccgttatttatattaggggctaggattttagggaaaaaatccttattgttaactatatatggtacagtgttaatgtcttttttcatgtggttttggcaacaaatccctgtaacagtccctttgaaaaacgatatgatgttagttgcagtagctgctggaattttagcaggaactggtagtggtttagtatttagatatggtgcaactacaggtggtgcagatattattggtcgtattgtagaggaaaaatctggaataaaattagggcaaaccttattgtttattgatgctatagttctaacgtcttcacttgtttatattaatttacaacagatgctatatacgttagtagctagctttgtatttagtcaagtgttaacaaatgttgaaaatgggggctacactgttcgtggaatgatcattattaccaaagaatcagaatctgcagcagcaaccattttgcatgaaattaataggggtgtaacttttttacggggccaaggtgcctactcaggtagagagcatgatgtcttgtacgtagctcttaacccaagtgaagtgcgtgatgtgaaagaaatcatggctgatttagacccagatgcttttatttctgttataaatgtagatgaagttattagctcagattttaaaattcgacgaagaaattacgataaa

SEQ ID NO: 3304 - protein, 290 aa, Streptococcus agalactiae
MLKLDLKTKIKETILIAFGVALYTFGFVKFNMANHLAEGGISGVTLIIHALFGVNPALSSLLLNIPLFILGARILGKKSLLLTIYGTVLMSFFMWFWQQIPVTVPLKNDMMLVAVAAGILAGTGSGLVFRYGATTGGADIIGRIVEEKSGIKLGQTLLFIDAIVLTSSLVYINLQQMLYTLVASFVFSQVLTNVENGGYTVRGMIIITKESESAAATILHEINRGVTFLRGQGAYSGREHDVLYVALNPSEVRDVKEIMADLDPDAFISVINVDEVISSDFKIRRRNYDK

SEQ ID NO: 3305 - DNA, 870 bp, Streptococcus pyogenes
atggcacatcacgataaattgactaaactactaaaactgtttttgattgccctaggtgtagccatttataccttcggttttgttaattttaacatggctaatgctttggctgaaggtggtgtggcaggaataaccttgattttacacgcgcattttgggattaatcctgcttactcttctctcttatttaatcttccactttttattttaggggcaaagatttttgggaagcgttctttggctctaaccatctatggaacagttctgatgtccgcttttatctggatgtggcaaaaagttcctatcgaacttggcttggaaaatgacatgatgttggtggctgtagtggcaggtctcttttcagggattgggagtggcattgtttttcgctatggtgcaaccacaggtggaacggatattattggtcgcattgcagaagaaaaatttggagctaagctaggtcaaactttgcttttggtggatgctcttgtattgacagcttcgttgacttatgtggatttaaaacacatgctttacactttggtggcaagctttgtttttagccaaatgattagtgtggttcaaaatggtggttacactatccgtggaatgattattattaccaagcattcagaggctgccgctcaagctatcctaaccgaaatcaatcgtggagtgacttacttgaaaggtcaaggagcttactctggtaatgattacaatatcatgtatgtgaccttgaacccaactgaagttcgggaagtcaaacgtattttagctggtttggatccagatgcctttatctccattattgatgtggacgaagttattagctctgattttaaaattcgccgaagaaattatgataaa

SEQ ID NO: 3306 - protein, 290 aa, Streptococcus pyogenes
MAHHDKLTKLLKLFLIALGVAIYTFGFVNFNMANALAEGGVAGITLILHAHFGINPAYSSLLFNLPLFILGAKIFGKRSLALTIYGTVLMSAFIWMWQKVPIELGLENDMMLVAVVAGLFSGIGSGIVFRYGATTGGTDIIGRIAEEKFGAKLGQTLLLVDALVLTASLTYVDLKHMLYTLVASFVFSQMISVVQNGGYTIRGMIIITKHSEAAAQAILTEINRGVTYLKGQGAYSGNDYNIMYVTLNPTEVREVKRILAGLDPDAFISIIDVDEVISSDFKIRRRNYDK

SEQ ID NO: 3307 - DNA, 306 bp, Streptococcus agalactiae
atgccatcagaaaaagaaatattagatgctcttagtaaagtttatagcgaagaagtaatacaagcagatgattattttcgtcaagctattttcgagctcgctagtcaacttgaaaaagaggggatgaactcactcctagctacaaaaattgactcacttatcaatcaatacgtcttaacacatcaatttgatgctcctaaaagcatatttgatcttagtcgcttggtaaaaacaaaagctagccattacaagggaactgctatctcagctattatgcttggtagtttcttaagtggaggaccaaaa

SEQ ID NO: 3308 - protein, 102 aa, Streptococcus agalactiae
MPSEKEILDALSKVYSEEVIQADDYFRQAIFELASQLEKEGMNSLLATKIDSLINQYVLTHQFDAPKSIFDLSRLVKTKASHYKGTAISAIMLGSFLSGGPK

SEQ ID NO: 3309 - DNA, 324 bp, Streptococcus pyogenes
atgttacaggagaatgccatgccatcagaaaaagaaatattagatgctcttagtaaagtttatagcgaacaagtaatacaagcagatgattattttcgtcaagcgatcttcgagctcgccagtcaacttgaaaaagaggggatgagctcactcctagctacaaaaattgactcacttatcaatcaatacatcttaacacatcaatttgatgctcctaaaagcatatttgatcttagtcgcttggtaaaaacaaaagctagccattacaagggaactgctatatcagctattatgcttggtagtttcttaagtgggggaccaaaa

SEQ ID NO: 3310 - protein, 108 aa, Streptococcus pyogenes
MLQENAMPSEKEILDALSKVYSEQVIQADDYFRQAIFELASQLEKEGMSSLLATKIDSLINQYILTHQFDAPKSIFDLSRLVKTKASHYKGTAISAIMLGSFLSGGPK

SEQ ID NO: 3311 - DNA, 1722 bp, Streptococcus agalactiae
gtgactatattactaattaaaataggagataccatggatacaaaacatctaattgcgagtgaaattcaaaaagttgttccagatatggaacaatcgaccattctttctttattagaaaccccaaaaaattcgagcatgggagatttagctttcccagcattctctttggctaaaactctacgcaaagcacctcaaataattgctagtgacattgctgaacaaattaaaagcgaccaatttgaaaaggtggaagctgttggaccttacgttaactttttccttgataaagccgcaatctcaagtcaagttttaaaacaagtcttatctgatggttctgcctatgctactcaaaatattggtgaaggacgaaatgttgccattgacatgtctagtccaaatattgctaagccattctcaattggacaccttcgttcaacagttattggtgatagtttagctaatatttttgataaaattggctatcatcctgttaaaattaatcaccttggcgactggggtaaacaatttggaatgttaatcgttgcctataaaaaatggggcaatgaagaggctgtccgtgctcatcccatcgatgaacttttaaaactttatgtccgtattaatgctgaagccgagacagaccctagcgttgatgaagaggcacgtgagtggtttcgtaaacttgaagctaacgatcctgaagcaactgaattatggcaatggttccgtgacgagtcattattagaattcaaccgtctttacgatcaaatgaatgttacatttgatagctataacggcgaggcattctacaacgacaaaatggatgaagtgcttgaactgctagaatctaaaaacctcctagtcgaatctaaaggtgcacaagttgttaacctagaaaaatacggtattgaacatcctgccctcattaaaaaatccgatggagcaactctctacattacacgtgacttagctgctgcactttaccgtaaacgtacctacgattttgcaaaatcaatctacgttgtaggaaacgaacagtctgcacactttaagcaactaaaagctgtgcttaaagaaatggactacgattggtccgatgatatgactcatgttccttttggccttgtaacaaaaggaggagcaaaattatcaactcgtaaaggaaatgtaattctacttgaacctactgttgcagaagctattaatcgtgcggcatctcagattgaagctaaaaaccctaacctagcagataaagataaagttgctcaagcagttggtgtaggtgctattaaattttacgatttgaaaactgatcgtacaaatggttatgactttgacttagaagcaatggtatcatttgaaggtgaaactgggccatatgtacaatatgcacatgctcgtattcaatcaatcttacgtaaagctaactttagcccatctaatagcgataattacagtctcaacgatgttgaaagctgggaaatcatcaaactcatccaagattttcctcgtattattgtacgtgcggcagataattttgagccctctattattgcaaaattcgctattaatttagctcagtgcttcaataaatattacgcccacacacgtattttagatgaagacgctgaaatcagtagtcgtctagcactttgctatgcaactgctacagtattaaaagaatctcttcgcctcctaggagttgatgctccgaatgaaatg

SEQ ID NO: 3312 - protein, 574 aa, Streptococcus agalactiae
MTILLIKIGDTMDTKHLIASEIQKVVPDMEQSTILSLLETPKNSSMGDLAFPAFSLAKTLRKAPQIIASDIAEQIKSDQFEKVEAVGPYVNFFLDKAAISSQVLKQVLSDGSAYATQNIGEGRNVAIDMSSPNIAKPFSIGHLRSTVIGDSLANIFDKIGYHPVKINHLGDWGKQFGMLIVAYKKWGNEEAVRAHPIDELLKLYVRINAEAETDPSVDEEAREWFRKLEANDPEATELWQWFRDESLLEFNRLYDQMNVTFDSYNGEAFYNDKMDEVLELLESKNLLVESKGAQVVNLEKYGIEHPALIKKSDGATLYITRDLAAALYRKRTYDFAKSIYVVGNEQSAHFKQLKAVLKEMDYDWSDDMTHVPFGLVTKGGAKLSTRKGNVILLEPTVAEAINRAASQIEAKNPNLADKDKVAQAVGVGAIKFYDLKTDRTNGYDFDLEAMVSFEGETGPYVQYAHARIQSILRKANFSPSNSDNYSLNDVESWEIIKLIQDFPRIIVRAADNFEPSIIAKFAINLAQCFNKYYAHTRILDEDAEISSRLALCYATATVLKESLRLLGVDAPNEM

SEQ ID NO: 3313 - DNA, 1689 bp, Streptococcus pyogenes
atggatactaaaactctaatcgcaagtgaaatagctaaagttgttccagaattagaacaagatgctatttttaacttgcttgaaaccccaaaaaattctgacatgggagaccttgcctttccagcttttagcttagcaaaagtccttcgcaaagcccctcaaatgattgctagcgagttagctgaacagattgatgagagccaatttgaaaaagtcgtagctgtcggcccttacatcaactttttccttgataaagctaagatttcctcacaggtccttgaacaagtgattacagcaggttcagactatgctcagcaagacgaaggtcaagggcgaaatgttgctattgacatgtcaagcccaaacatcgctaagccattttcaatcggtcacctccgctcaacagttattggtgatagtctcgctcacatttttgccaaaatgggctataaacctgtaaaaatcaatcaccttggtgactggggtaaacaatttggtatgctcattgttgcctacaaaaaatggggagatgaagctgctgttcaggcacatcctattgatgaactcttaaaactttacgttcgtatcaatgctgaagctgaaactgatcccaccgttgatgaagaagctcgtgaatggttccgtaaattggaagatggcgacaaagaagctactgaattatggcaatggttccgtgatgaaagtttacttgagttcaaccgactttatgaccaattacatgtcaccttcgatagttacaacggtgaggccttctataatgacaaaatggatgaggttcttgacttattagaagctaaaaaccttcttgtagaatctaaaggtgcccaagttgttaatcttgaaaaatatggtattgaacaccctgccttgatcaaaaaatcagatggcgctactctttacattacccgtgacctagctgccgcactttaccgtaaacgcacttatgactttgctaaatccgtttatgttgttggtaatgagcaagctgctcacttcaaacaattaaaagcagtgctaaaagaaatgggttacgattggtcagatgatatgacacacgttgcttttggacttgtcacaaaaggcggtgctaaattatcaacacgtaaaggtaatgttattcttcttgaacctacggttgctgaagccattaaccgtgcagcttctcaaattgaagcgaaaaatccaaaccttgctgacaaagaagctgttgcacacgctgttggtgtcggcgccatcaagttttacgatctcaaaacagatcgtatgaatgggtatgactttgaccttgaggccatggtttcctttgaaggagaaactggaccttatgttcaatacgctcacgctcgtatccaatctattctacgtaaagctgactttacgccatctgcaaccaccacttacagtttagctgatgctgaaagctgggaaattatcaaacttatccaagatttcccacgcattatcaagcgaacatcagataactttgagccttctattatggctaaatttgctattaacttagcccaaagctttaacaaatattatgctcacactcgcattctcgacgacaactcagaacgtgataaccgcttagctctctgctatgcaactgctactgttcttaaagaagcgcttcgcttactcggtgttgacgcaccaaatgaaatg

SEQ ID NO: 3314 - protein, 563 aa, Streptococcus pyogenes
MDTKTLIASEIAKVVPELEQDAIFNLLETPKNSDMGDLAFPAFSLAKVLRKAPQMIASELAEQIDESQFEKVVAVGPYINFFLDKAKISSQVLEQVITAGSDYAQQDEGQGRNVAIDMSSPNIAKPFSIGHLRSTVIGDSLAHIFAKMGYKPVKINHLGDWGKQFGMLIVAYKKWGDEAAVQAHPIDELLKLYVRINAEAETDPTVDEEAREWFRKLEDGDKEATELWQWFRDESLLEFNRLYDQLHVTFDSYNGEAFYNDKMDEVLDLLEAKNLLVESKGAQVVNLEKYGIEHPALIKKSDGATLYITRDLAAALYRKRTYDFAKSVYVVGNEQAAHFKQLKAVLKEMGYDWSDDMTHVAFGLVTKGGAKLSTRKGNVILLEPTVAEAINRAASQIEAKNPNLADKEAVAHAVGVGAIKFYDLKTDRMNGYDFDLEAMVSFEGETGPYVQYAHARIQSILRKADFTPSATTTYSLADAESWEIIKLIQDFPRIIKRTSDNFEPSIMAKFAINLAQSFNKYYAHTRILDDNSERDNRLALCYATATVLKEALRLLGVDAPNEM

SEQ ID NO: 3315 - DNA, 444 bp, Streptococcus agalactiae
ttgaataacatgaataaaatagaacgccaaaaacgtattaaacgtttgatccaatcagggcagattggcacacaagaagaaattaaattacatttaaaaaatgaaggaatcgatgtcacgcaagcgactctatcaagagacttgcgtgagattggtcttttaaaattacgtagcccagaaggtaagctatattatagtttatcaacagctacttcaaatcgatttagcccagccttacgctcatatattttgaaagtatcgcgagcaagttttatgttagttttaaatactaatttaggggaggctagcgttttagcaaactttattgatgagaaagggctgccagagattttaggaacaatggcaggagcagacaccttgttggtgatttgtcaaaatgaagatattgccaaagtttttgaaaaagaactatcagtaggttta

SEQ ID NO: 3316 - protein, 148 aa, Streptococcus agalactiae
MNNMNKIERQKRIKRLIQSGQIGTQEEIKLHLKNEGIDVTQATLSRDLREIGLLKLRSPEGKLYYSLSTATSNRFSPALRSYILKVSRASFMLVLNTNLGEASVLANFIDEKGLPEILGTMAGADTLLVICQNEDIAKVFEKELSVGL

SEQ ID NO: 3317 - DNA, 435 bp, Streptococcus pyogenes
atgaataaaatggagcgtcaacagcagattaagcgaatcattcaagcagagcatattggcacacaagaagatattaaaaatcaccttcaaaaagaaggcattgtggtcacccaagcaactctatctcgggacttaagagaaattggccttttgaaattgagagatgaacaaggcaaactctattatagtttgtctgaacccgttgcaacaccatttagtcctgaggtgcgtttttatgttttgaaagttgatcgagcaggttttatgctggttctccataccaatttaggagaggctgatgttctagctaatttgattgacaatgatgccattgaagatattctaggaaccattgctggtgcggataccttgcttgtgatttgcagagacgaagagattgctaaacgctttgaaaaagatttggctgcaggccta

SEQ ID NO: 3318 - protein, 145 aa, Streptococcus pyogenes
MNKMERQQQIKRIIQAEHIGTQEDIKNHLQKEGIVVTQATLSRDLREIGLLKLRDEQGKLYYSLSEPVATPFSPEVRFYVLKVDRAGFMLVLHTNLGEADVLANLIDNDAIEDILGTIAGADTLLVICRDEEIAKRFEKDLAAGL

SEQ ID NO: 3319 - DNA, 2574 bp, Streptococcus agalactiae
atggccaagccaacgatatcaccgggaatgcaacagtatctggatataaaagagaattatccagatgcttttttgctttttagaatgggtgatttttatgaattattttatgatgatgcggtaaaagcagcacaaatcctggaaattagcttgactagtcgaaataagaacgcagaaaagccaatcccaatggcaggagttccctatcactcagctcaacagtatattgacgttttagttgaattaggttacaaagtagccattgctgagcagatggaagatcctaaaaaagctgtgggagtggtcaagcgtgaggtagtgcaagttgttaccccaggaacggttgtggagtcaacgaagccggatagtgctaataatttcttagtagcgattgattcgcaagatcaacaaacatttggtctagcatatatggatgtctcaactggagagtttcaggcaacccttttaacagattttgagtccgtccgtagtgaaatactaaatttaaaagctcgtgagattgtagtaggatatcaattgacggacgaaaaaaatcacctactgacgaagcagatgaacttgcttttatcatacgaagacgaacgacttaatgatattcatttgattgatgagcagttaactgatttggaaatatctgctgcggaaaaacttttacaatatgtgcatagaacacaaaagcgtgaacttagtcatttacagaaagtagttcattatgaaataaaggactatttacaaatgtcatatgcaacgaaaaatagtctagatttactggagaatgctagaacaagcaagaagcatggaagtctttactggttgttagatgagactaaaacagcgatgggaactcgaatgctgagaacttggattgacaggcctttggtaagtatgaatcgaatcaaggaacgtcaagatattattcaagtgtttcttgattatttttttgagagaaacgatctcacagaaagtttaaagggtgtatatgatattgaacgcctagcaagtcgagtatctttcggaaaagccaaccctaaagatctattgcaactcggacagaccttatcacaaattcctcggattaaaatgattttacagtccttcaatcaacctgagcttgacatcattgtcaacaaaattgacactatgcctgaattagaaagtttaattaatacggcgatagccccagaagcacaggctactatcactgagggaaacattatcaagtctggatttgataagcaattggataattatcgaacagtgatgcgtgaaggtacaggttggattgctgatattgaagctaaggaaagagcagcaagtggtatcggtactcttaaaattgattataataaaaaagacggttattacttccatgttaccaattccaatttatcactagtaccggagcattttttccgtaaagcgacattaaaaaattctgaacgctatggaacagctgaactagccaaaattgaaggtgaaatgctcgaagctcgcgagcaatcttcaaatttagaatatgatatttttatgcgtgttcgtgcccaagtagaatcttatattaaacgtcttcaagagttagcaaagacgattgcaaccgttgatgttctacagagtttggcagtagttgcagaaaattatcactatgttcgtcccaaatttaatgatcaacatcagattaagattaagaatgggcgtcatgcaactgttgaaaaagtgatgggagtgcaagaatatattcccaatagcatctattttgatagtcagacagatatccagttgattacaggaccaaatatgagtggtaagtcgacctatatgcgccagttagctttgacagttattatggcacaaatgggaggttttgtatcggcagacgaagttgatttgcctgtatttgatgcaatatttactaggattggtgctgctgacgacttaatttctgggcaatcaacctttatggtagaaatgatggaagcgaatcaagctgtaaaacgagccagtgataaatctttgattctttttgatgaattaggtcgagggacagccacttatgatggtatggcattagctcaatcgattatagaatatattcatgaccgtgttagggcaaaaacaatgtttgcgactcattaccatgagttgacagatttatctgaacagttgacaaggcttgtcaatgtacacgtggctactttagagagagatggagaagttaccttcttacataaaattgaatctggacctgcggataagtcttatgggatacacgtcgcaaaaatagctggtttaccaattgacttattggatagggcaactgatattttatcacagttggaagctgatgcagtacagttgatcgtatcgccctcccaagaagctgttactgctgacttaaatgaggaactagattctgagaagcaacaaggacaattatcgctttttgaagaaccttcaaatgcaggtagggttattgaggagttagaagcgatagatataatgaatctaactccaatgcaagctatgaatgctatatttgacttaaagaaattatta

SEQ ID NO: 3320 - protein, 858 aa, Streptococcus agalactiae
MAKPTISPGMQQYLDIKENYPDAFLLFRMGDFYELFYDDAVKAAQILEISLTSRNKNAEKPIPMAGVPYHSAQQYIDVLVELGYKVAIAEQMEDPKKAVGVVKREVVQVVTPGTVVESTKPDSANNFLVAIDSQDQQTFGLAYMDVSTGEFQATLLTDFESVRSEILNLKAREIVVGYQLTDEKNHLLTKQMNLLLSYEDERLNDIHLIDEQLTDLEISAAEKLLQYVHRTQKRELSHLQKVVHYEIKDYLQMSYATKNSLDLLENARTSKKHGSLYWLLDETKTAMGTRMLRTWIDRPLVSMNRIKERQDIIQVFLDYFFERNDLTESLKGVYDIERLASRVSFGKANPKDLLQLGQTLSQIPRIKMILQSFNQPELDIIVNKIDTMPELESLINTAIAPEAQATITEGNIIKSGFDKQLDNYRTVMREGTGWIADIEAKERAASGIGTLKIDYNKKDGYYFHVTNSNLSLVPEHFFRKATLKNSERYGTAELAKIEGEMLEAREQSSNLEYDIFMRVRAQVESYIKRLQELAKTIATVDVLQSLAVVAENYHYVRPKFNDQHQIKIKNGRHATVEKVMGVQEYIPNSIYFDSQTDIQLITGPNMSGKSTYMRQLALTVIMAQMGGFVSADEVDLPVFDAIFTRIGAADDLISGQSTFMVEMMEANQAVKRASDKSLILFDELGRGTATYDGMALAQSIIEYIHDRVRAKTMFATHYHELTDLSEQLTRLVNVHVATLERDGEVTFLHKIESGPADKSYGIHVAKIAGLPIDLLDRATDILSQLEADAVQLIVSPSQEAVTADLNEELDSEKQQGQLSLFEEPSNAGRVIEELEAIDIMNLTPMQAMNAIFDLKKLL

SEQ ID NO: 3321 - DNA, 2553 bp, Streptococcus pyogenes
atggcaaaaactaacatttctcctggaatgcaacagtatctggacatcaaaaaagattatccagatgcttttttgctttttaggatgggtgacttttatgaattattttacgaggacgctgtcaaagcagcacaactcttagaaattggtttgaccagtcgcaacaagaatgcggaaaatccaattcctatggcaggcgtgccacatcattctgcccaacaatacattgatgtgttaattgagttgggttacaaggttgctgtcgcagaacaaatggaagacccaaagcaagctgttggggtggtgaagcgtgaggtcgttcaagtcataactcctggaacggttgtggattcagctaagccagatagcgccaataactttttggtagctgttgactttgatggttgccgttatggattggcttatatggatgtatccacaggtgaattttgcgtgacagatttggcggactttacgagtgttcgtagcgaaatccaaaacctcaaggcgaaagaagtcttactaggttttgatttatctgaagaagaacagacgattttggtcaagcagatgaatttgctgctttcttatgaagaaacggtctatgaagataaatctttaattgacggccaattgacaacggtagaactgacagcggcaggaaaactcttgcaatacgttcacaaaacacaaatgcgagaactcagccacttgcaagcattggttcactatgagatcaaggattatttgcagatgtcgtatgccactaagtcaagtttagatttggtagaaaatgctaggactaataaaaaacatggaagtctctattggctgttagatgaaaccaagacagctatggggatgaggcttttgcgctcatggattgatcgacctttggtttctaaagaagctattttagagcgtcaagaaattattcaagtttttctgaatgcttttattgagcgaaccgatttaagcaatagtttaaaaggtgtttacgacatcgaacgcttatctagtcgcgtgtcttttggcaaggcaaatccgaaagatttacttcaattggggcataccttagctcaagtgccttatatcaaagctatcttagagtcttttgacagtccttgtgttgacaaacttgtcaatgatattgacagtttgcctgagttggaatacttgattagaacagccattgatccagatgcaccagcaactattagtgaaggaagtattatccgcaatggttttgatgagcgcttggaccattatcgtaaagtaatgcgagaggggacaggctggattgcggatattgaggccaaagagcgtcaagcaagtggcattaataacctaaaaattgattacaataaaaaagatggttattattttcacgttacgaattcaaatcttagcttagttcccgagcattttttcagaaaggcaactttaaaaaattctgaacgttatggaacagcagaattggctaagattgaaggtcagatgttagaggctagggaagagtcatctagtttagaatacgatatttttatgtgtattcgagctcaagttgaaacctatattaatcgtttacagaaactggctaaaattttggcaacggtagatgttttgcaaagtttagcagtcgttgctgaaaccaatcattatatccggccgcagttcaatgataatcatgtgattacaattcaagaaggtcgtcacgcggttgttgaaaaggttatgggagtgcaggaatacattcccaatagtatctcttttgaccaacagaccagtattcagctgattacaggtccaaatatgagtggtaagtcgacttatatgagacagctggccttaacggttatcatggcccagatgggttcatttgtggctgctgatcatgttgatttacctttatttgatgcgatttttacgcgtattggggctgctgatgatttgatttctgggcaatcaacctttatggtggagatgatggaagcaaaccaagcaatcaaacgcgcaagtgacaactctcttattctatttgatgaactgggacgaggcacggcaacttatgatggtatggctttagcccaggcaattattgaatatatccatgatagagttggtgctaagaccatatttgcaacgcattatcatgaattgacagacttgtcaactaacttgacaagtctagtcaatgttcatgtagcaacgcttgaaaaagatggcgatgttaccttccttcataagattgctgagggaccggcggataaatcttacggtattcatgtggcaaaaatagcaggactgccaaaatccctattaaagagagcagacgaagttctgacccgtttagaaacacagtcacgatctactgagataatatcagtcccttcacaagttgagtcaagcagcgctgttagacaggggcaattatccctttttggtgatgaagagaaagctcatgagattaggcaagcactggaagttattgatgtcatgaacatgaccccgcttcaagcaatgacaactctttacgaattgaaaaagttgtta

SEQ ID NO: 3322 - protein, 851 aa, Streptococcus pyogenes
MAKTNISPGMQQYLDIKKDYPDAFLLFRMGDFYELFYEDAVKAAQLLEIGLTSRNKNAENPIPMAGVPHHSAQQYIDVLIELGYKVAVAEQMEDPKQAVGVVKREVVQVITPGTVVDSAKPDSANNFLVAVDFDGCRYGLAYMDVSTGEFCVTDLADFTSVRSEIQNLKAKEVLLGFDLSEEEQTILVKQMNLLLSYEETVYEDKSLIDGQLTTVELTAAGKLLQYVHKTQMRELSHLQALVHYEIKDYLQMSYATKSSLDLVENARTNKKHGSLYWLLDETKTAMGMRLLRSWIDRPLVSKEAILERQEIIQVFLNAFIERTDLSNSLKGVYDIERLSSRVSFGKANPKDLLQLGHTLAQVPYIKAILESFDSPCVDKLVNDIDSLPELEYLIRTAIDPDAPATISEGSIIRNGFDERLDHYRKVMREGTGWIADIEAKERQASGINNLKIDYNKKDGYYFHVTNSNLSLVPEHFFRKATLKNSERYGTAELAKIEGQMLEAREESSSLEYDIFMCIRAQVETYINRLQKLAKILATVDVLQSLAVVAETNHYIRPQFNDNHVITIQEGRHAVVEKVMGVQEYIPNSISFDQQTSIQLITGPNMSGKSTYMRQLALTVIMAQMGSFVAADHVDLPLFDAIFTRIGAADDLISGQSTFMVEMMEANQAIKRASDNSLILFDELGRGTATYDGMALAQAIIEYIHDRVGAKTIFATHYHELTDLSTNLTSLVNVHVATLEKDGDVTFLHKIAEGPADKSYGIHVAKIAGLPKSLLKRADEVLTRLETQSRSTEIISVPSQVESSSAVRQGQLSLFGDEEKAHEIRQALEVIDVMNMTPLQAMTTLYELKKLL

SEQ ID NO: 3323 - DNA, 201 bp, Streptococcus agalactiae
atgacacaaggtacagtgaaatggtttaactcagaaaaaggttttggctttatttctagcgaaactggaacagacgtcttcgctcatttttcagagattaaagttgatggcttcaaaactcttgaagaaggacaaaaagtaacatttgatattcaagatggtcaacgtggaccacaagcaacaaatatcaatcttgttaaa

SEQ ID NO: 3324 - protein, 67 aa, Streptococcus agalactiae
MTQGTVKWFNSEKGFGFISSETGTDVFAHFSEIKVDGFKTLEEGQKVTFDIQDGQRGPQATNINLVK

SEQ ID NO: 3325 - DNA, 207 bp, Streptococcus pyogenes
atgtatatggcacaaggtacagtaaaatggtttaatgctgaaaaaggttttggttttatttcaactgaaaacggtcaagatgtctttgcacatttttcagccatccaaactaatggttttaaaacgttagaagaaggacaaaaagtggcatttgacgtcgaagaaggtcaacgtggacctcaagcagtcaatatcactaaattggcc

SEQ ID NO: 3326 - protein, 69 aa, Streptococcus pyogenes
MYMAQGTVKWFNAEKGFGFISTENGQDVFAHFSAIQTNGFKTLEEGQKVAFDVEEGQRGPQAVNITKLA

SEQ ID NO: 3327 - DNA, 99 bp, Streptococcus agalactiae
gtgtcatttgtttattacctttctaaaaatgttactgtaaaaaataaaaaaggtaaaaatgttaaacaaaaatacaacttcaaaacttattacgctccc

SEQ ID NO: 3328 - protein, 33 aa, Streptococcus agalactiae
MSFVYYLSKNVTVKNKKGKNVKQKYNFKTYYAP

SEQ ID NO: 3329 - DNA, 2028 bp, Streptococcus agalactiae
atggctaagatatcacaaaaaaagttacaaaaaatcataaaaaaaggagggatgaacttgtctaaaattattgaattaccggatatattagctaaccagattgctgctggtgaggttgttgaaaggcctagtagcgtcgttaaagaattagttgaaaatgccatagatgcaggaagtagccaaattaccatagaggttgaagaatctggtcttaaaaagattcaaataacggataacggtgaagggatgactagtgaggatgccgttctcagtttacgacgtcacgctacatccaaaatcaaaagccagagtgacctttttcgtattcggaccttaggttttcgtggtgaagctctaccatcaatcgcttcgattagtttaatgacgataaaaacagctacagagcaagggaaacaagggacgttacttgttgctaaagggggaaacattgaaaaacaggaagttgtttcaagtcctcgtggaacaaaaattttagttgaaaatttattctttaacacgcctgccagattgaaatacatgaagagtttacagtctgaactagctcatattattgatattgttaatagactcagtctagcgcatccggaagttgcttttacactgataaatgatggtaaagaaatgactaaaactagtgggactggcgatttgagacaggcgattgcaggtatttatggtttaaatactgcaaaaaaaatgattgagatttcaaatgcagatttagattttgaaatttcgggttatgtaagtttgcctgaattgacacgagctaaccgaaactatattaccctattaattaacggtcgttacattaaaaattttcttttgaaccgctcaattctagatggttatggttcaaagttgatggttggaagatttccaattgctgtcattgatattcagatagatccttatctagcagatgtcaacgttcatccgactaagcaagaggtgagaatttctaaggaacgagaattaatgagtttaataagcacagcaatttctgagagtcttaaacaatatgacttgattccggatgctttagagaatttagctaaaactagtacccgaagtgtagataagcctatacaaacaagcttctcactaaaacagcctggtttgtattacgatagggctaaaaatgacttttttataggtgcagatactgtatctgaacctattgctaactttacaaaccttgacaaaagtgacggttcagttgacaatgatgtaaaaaactctgttaatcaaggagcaacgcagtctcctaatataaagtatgctagtagagatcaagctgatagtgagaacttcattcattctcaggattaccttagtagtaaacagtcacttaacaaacttgttgaaaaattagattcggaagaaagttcgacttttccagagctcgaattttttggtcaaatgcatgggacctacttatttgctcaagggaatggtgggttgtatattattgatcaacatgcagctcaagagcgtgtaaaatacgagtattaccgtgaaaagataggtgaggttgataatagtcttcaacaattgttagtaccatttctatttgaattttcaagttcagattttcttcaattacaagaaaaaatgtcattattacaagatgttggtattttcttggaaccgtatggtaataatactttcattttaagggaacatccaatttggatgaaagaagaagaggtagagtctggcatttatgaaatgtgtgatatgttgttgctcactaatgaagtatcagtgaaaaaatatcgcgcagagttggctattatgatgtcttgcaagcgatctattaaagcaaaccatacgctagacgattactcagcacgtcatttattagatcagttagcgcaatgtaaaaatccttataattgccctcatggaagacctgttttagttaattttacaaaagctgatatggagaaaatgtttaaacgaatccaagaaaatcatacaagcctcagggatttaggaaaatat

SEQ ID NO: 3330 - protein, 676 aa, Streptococcus agalactiae
MAKISQKKLQKIIKKGGMNLSKIIELPDILANQIAAGEVVERPSSVVKELVENAIDAGSSQITIEVEESGLKKIQITDNGEGMTSEDAVLSLRRHATSKIKSQSDLFRIRTLGFRGEALPSIASISLMTIKTATEQGKQGTLLVAKGGNIEKQEVVSSPRGTKILVENLFFNTPARLKYMKSLQSELAHIIDIVNRLSLAHPEVAFTLINDGKEMTKTSGTGDLRQAIAGIYGLNTAKKMIEISNADLDFEISGYVSLPELTRANRNYITLLINGRYIKNFLLNRSILDGYGSKLMVGRFPIAVIDIQIDPYLADVNVHPTKQEVRISKERELMSLISTAISESLKQYDLIPDALENLAKTSTRSVDKPIQTSFSLKQPGLYYDRAKNDFFIGADTVSEPIANFTNLDKSDGSVDNDVKNSVNQGATQSPNIKYASRDQADSENFIHSQDYLSSKQSLNKLVEKLDSEESSTFPELEFFGQMHGTYLFAQGNGGLYIIDQHAAQERVKYEYYREKIGEVDNSLQQLLVPFLFEFSSSDFLQLQEKMSLLQDVGIFLEPYGNNTFILREHPIWMKEEEVESGIYEMCDMLLLTNEVSVKKYRAELAIMMSCKRSIKANHTLDDYSARHLLDQLAQCKNPYNCPHGRPVLVNFTKADMEKMFKRIQENHTSLRDLGKY

SEQ ID NO: 3331 - DNA, 2019 bp, Streptococcus
ttgttatatcaacgtttagaaagtgttaaaaacaaaattatgacaaacattattgaattaccggaagttctcgccaaccaaattgcagctggtgaagttgtagaaaggccagcgagtgttgtcaaggaattggttgagaatgctattgatgctaaaagtagccagattaccgttgaaattgaagagtctggccttaagatgatacaggttacagacaacggtgagggaatgtctcatgaagatttacctttaagtctgcgtcgccacgctactagtaaaattaagagtcagagtgatttgtttagaattagaacacttggcttccgtggagaggctttaccgtctgttgcctctatcagtaaaatcacgataaaaacagcaacaaaagaagtcactcacggttctcttcttatagctactggtggggaaattgagacacttgaagcgatctcaactcctactggaaccaaaattaaggttgaaaaccttttttacaacacgcctgctcgtctcaaatatatgaaaagtttacaggcagaattagctcacattgtagatgtggtcaaccggttgagtttggcacatccagaagttgctttcacactgattagtgatggtcgccaattaactcagacatcaggaactggcgatttacgccaagcaattgcagggatttatggtttgaatactaccaaaaaaatgctggctatctctaatgctgatttggattttgaagtttccggctatgttagcttgccagagttgacacgcgccaaccgtaattacatgacgattttggttaatgggcgttacatcaagaatttcttgcttaatcgagcaattcttgatggttacggttctaagctcatggttggacgtttcccaattgttgtgattgatattcagattgatccctatttggccgatgtcaatgttcaccccacaaaacaagaggttcgtatttcaaaagagcgtgaattaatggctttaattagcacggctatttcagagagtcttaaggaacaagatttgattccagatgctctggaaaatttagccaaatcaagcacacgacatttctctaaaccagagcaaacacaacttcctttacagtctaggggactttattatgatcctcaaaagaatgacttttttgtcaaagagtcggctgtctcggaaaaaatacctgaaactgatttttattccggcgctgttgacaacagtgtaaaggttgaaaaagtagagctgttaccccactcagaagaagttataggaccttcttcggttaaacacgcaagtcgtccccagaatacctttaccgagactgatcatcctaatcttgacttaaaaaacagacaaaagttatctcaaatgctaacccgtttggaaaatgaagggcaatcagtgtttcccgaattggattattttggtcagatgcacggaacttatctctttgctcagggaaaagatggtttatttataattgaccaacacgctgcccaggagcgggttaaatacgaatattatcgtgataagataggtgaggttgacagtagtttacagcaattgttggtgccctatttgtttgagttttctggttctgatttcattaacttacaggagaaaatggcactcttaaatgaagttggtatcttcttagaagtttatgggcacaatactttcattttgagggagcatcctatctggatgaaagaagaagagattgcatctggtgtctatgaaatgtgtgacatgttacttctaaccaatgaggtatctattaaaacttaccgagcagagttagctattatgatgagttgtaaacgatctatcaaggcaaatcatagcttggatgattattcagcaagaaatctgctactgcaattggcccaatgtcaaaatccttataactgccctcatggtagacccgtattgattaattttagtaaggcagatatggaaaaaatgttccgtcgaattcaagaaaatcacactagcctgcgagagctaggaaaatat

SEQ ID NO: 3332 - protein, 673 aa, Streptococcus pyogenes
LLYQRLESVKNKIMTNIIELPEVLANQIAAGEVVERPASVVKELVENAIDAKSSQITVEIEESGLKMIQVTDNGEGMSHEDLPLSLRRHATSKIKSQSDLFRIRTLGFRGEALPSVASISKITIKTATKEVTHGSLLIATGGEIETLEAISTPTGTKIKVENLFYNTPARLKYMKSLQAELAHIVDVVNRLSLAHPEVAFTLISDGRQLTQTSGTGDLRQAIAGIYGLNTTKKMLAISNADLDFEVSGYVSLPELTRANRNYMTILVNGRYIKNFLLNRAILDGYGSKLMVGRFPIVVIDIQIDPYLADVNVHPTKQEVRISKERELMALISTAISESLKEQDLIPDALENLAKSSTRHFSKPEQTQLPLQSRGLYYDPQKNDFFVKESAVSEKIPETDFYSGAVDNSVKVEKVELLPHSEEVIGPSSVKHASRPQNTFTETDHPNLDLKNRQKLSQMLTRLENEGQSVFPELDYFGQMHGTYLFAQGKDGLFIIDQHAAQERVKYEYYRDKIGEVDSSLQQLLVPYLFEFSGSDFINLQEKMALLNEVGIFLEVYGHNTFILREHPIWMKEEEIASGVYEMCDMLLLTNEVSIKTYRAELAIMMSCKRSIKANHSLDDYSARNLLLQLAQCQNPYNCPHGRPVLINFSKADMEKMFRRIQENHTSLRELGKY

SEQ ID NO: 3333 - DNA, 96 bp, Streptococcus agalactiae
gtgaaaaacgtcatggcaatcaaaatagctccaaaagtgtttagagaaatattaaaaagcattccaaaaccacaaatcaagctccctaatattagt

SEQ ID NO: 3334 - protein, 32 aa, Streptococcus agalactiae
MKNVMAIKIAPKVFREILKSIPKPQIKLPNIS

SEQ ID NO: 3335 - DNA, 1254 bp, Streptococcus agalactiae
ttgttagggaagaagggagaaaaagtgaaagagttttttgctttgccaaaacagctacagttaagagaattattgcgttttatttccattacggttggttcagctatttttccttttatggcaatgtattatgttcaatattttggaaatctagttacaggaatcttgatcatcataactcaactatcagggtttgtagcgaccttatatggaggccatttgtcagatgctatggggaggaaaaaagttgtgattataggttcactgctggcaaccattggttgggctataactatagctgcaaatgttccaaatcatattacgccacacttgacctttgtaggtatccttatcattgaaatagctcaccaattttatttccctgcctatgaagctatgaccattgatttgacgaacgaacagaatcgtcgctttgtttacactataggttattggttggttaacatcgctgtaatgctaggttctggaattgctgggattttctatgatcaccatttttttgaattattaatagttcttcttattatttcagcgatttgttgtttcgtggtctacttcaagtttgatgagacaaaaccacaggagggaaccttcaagcatgataaaggagttttaggaacttttaaaaattatagtcaggttttagtggataaagcgtttgttgtttatactttaggagcaattggttccagtgttgtctggctccaggttgataattatttctcggtcaatcttaagcaaaattttgaagtagtgtccattttaggacatacaatcacaggtgctaaaatgcttagtttagcagtctttacaaacactctattaattgtcttactaatgacaactataaataaattcatagagaattggcctttgaaacgtcaactaatattagggagcttgatttgtggttttggaatgctttttaatatttctctaaacacttttggagctattttgattgccatgacgtttttcacctttggcgaaatgatttatgttccagctagtcaggttctaagggcggagatgatggtggagggaaaaattggatcatattctggatttttagctatcgcacaacctgttgcaagtgtattagcaggtgccatggtttcgctcagctattttacaggaaaaataggtgttcaaataacattgaccatttttatgttagcaggtctggttttaatcttatatgctaccaaaatgaaaaatattgagataggaaaa

SEQ ID NO: 3336 - protein, 418 aa, Streptococcus agalactiae
MLGKKGEKVKEFFALPKQLQLRELLRFISITVGSAIFPFMAMYYVQYFGNLVTGILIIITQLSGFVATLYGGHLSDAMGRKKVVIIGSLLATIGWAITIAANVPNHITPHLTFVGILIIEIAHQFYFPAYEAMTIDLTNEQNRRFVYTIGYWLVNIAVMLGSGIAGIFYDHHFFELLIVLLIISAICCFVVYFKFDETKPQEGTFKHDKGVLGTFKNYSQVLVDKAFVVYTLGAIGSSVVWLQVDNYFSVNLKQNFEVVSILGHTITGAKMLSLAVFTNTLLIVLLMTTINKFIENWPLKRQLILGSLICGFGMLFNISLNTFGAILIAMTFFTFGEMIYVPASQVLRAEMMVEGKIGSYSGFLAIAQPVASVLAGAMVSLSYFTGKIGVQITLTIFMLAGLVLILYATKMKNIEIGK

SEQ ID NO: 3337 - DNA, 1218 bp, Streptococcus pyogenes
atgcaagagtttttaaaccttcctaagcagattcagctgaggcaactggtacgctttgtgaccattaccttaggcagtagtatctttccctttatggccatgtattatacgacttactttggtacgttttggacaggcctcttaatgatgattaccagtttgatgggatttgttggaactttatacggtgggcatctgtcagatgctcttggtcgcaaaaaagtcattatgattgggtcagtaggaacaacactaggctggtttctgactattttagctaatttgcctaatgcggctattccttggttaacctttgcgggtattttattggtagagattgcttctagtttttatggtcctgcctatgaagctatgttgattgatttgactgatgagagtaatcgtcgatttgtttacaccatcaattattggtttatcaatattgccgtcatgtttggtgcagggctatctgggcttttttatgaccatcattttttagccttgttagtagccttattactcgtcaatgtactttgttttggcgttgcttactactgttttgatgaaactagaccagaaacacacgcttttgaccatggtaaaggattactggcgagttttcagaactaccgtcaggtgtttcatgatcgtgcctttgtcttgtttaccttaggtgccatcttttctggtagtatctggatgcagatggataactatgtgccagtccatttgaaactgtattttcagccaacggctgtattaggtttccaagtaactagttctaaaatgttatcattaatggttttaactaatacattgctgattgtccttttcatgacagtagtaaataaattaacggaaaaatggaaactattacctcagcttgtggttggttctttactatttactctagggatgctcttgtcatttacctttacgcagttctatgctatctggttatcagttgttttgttaacttttggggaaatgataaatgtttctgctagtcaagtcctacgtgctgatatgatggatcattcccaaataggatcttatacaggttttgtgtcaatggcacaacccctaggtgctattttggctagtctactagtatctgtcagccattttacaggtcctttaggcgtgcaatgcttatttgcagtcattgctttgctagggatttattttacggttgtttctgcaaaaatgaaaaaggtg

SEQ ID NO: 3338 - protein, 406 aa, Streptococcus pyogenes
MQEFLNLPKQIQLRQLVRFVTITLGSSIFPFMAMYYTTYFGTFWTGLLMMITSLMGFVGTLYGGHLSDALGRKKVIMIGSVGTTLGWFLTILANLPNAAIPWLTFAGILLVEIASSFYGPAYEAMLIDLTDESNRRFVYTINYWFINIAVMFGAGLSGLFYDHHFLALLVALLLVNVLCFGVAYYCFDETRPETHAFDHGKGLLASFQNYRQVFHDRAFVLFTLGAIFSGSIWMQMDNYVPVHLKLYFQPTAVLGFQVTSSKMLSLMVLTNTLLIVLFMTVVNKLTEKWKLLPQLVVGSLLFTLGMLLSFTFTQFYAIWLSVVLLTFGEMINVSASQVLRADMMDHSQIGSYTGFVSMAQPLGAILASLLVSVSHFTGPLGVQCLFAVIALLGIYFTVVSAKMKKV

SEQ ID NO: 3339 - DNA, 588 bp, Streptococcus agalactiae
atgtacgattatattaaaggaaaattgagtaaaataacggctaaatttattgttgtggaaacagctggattgggatacatgatatatgtggcaaatccctactctttttcaggttacgttaatcaagaagttaccatctacttacatcaagtcattcgcgatgatgcacatcttttatttggctttcatacggaaaatgaaaaagaaatttttcttaatttaatttcagtatcaggaattggtccaacgaccgctttagcaattattgcagtcgatgacaatgaaggtctcgtaagtgccattgataatagtgatattaagtatttgactaaatttccaaagataggaaaaaaaacagcacaacagatgatccttgatttgtcagggaagtttgtagaagcttctggtgagagtgcgactagtcgtaaggttagctctgagcagaatagcaatcttgaagaagctatggaagctttgttagcgttggggtataaggcgactgaattgaaaaaagtaaaagccttttttgaaggtacgaacgagactgtggagcaatacatcaaatctagtttgaagatgttgatgaaa

SEQ ID NO: 3340 - protein, 196 aa, Streptococcus agalactiae
MYDYIKGKLSKITAKFIVVETAGLGYMIYVANPYSFSGYVNQEVTIYLHQVIRDDAHLLFGFHTENEKEIFLNLISVSGIGPTTALAIIAVDDNEGLVSAIDNSDIKYLTKFPKIGKKTAQQMILDLSGKFVEASGESATSRKVSSEQNSNLEEAMEALLALGYKATELKKVKAFFEGTNETVEQYIKSSLKMLMK

SEQ ID NO: 3341 - DNA, 594 bp, Streptococcus pyogenes
atgtacgattatattaaaggtcaattgaccaaaattacggcaaaatacattgtcgttgaagctaatggattgggctacatgattaatgttgccaatccttatagctttacagatagtgtcaaccaattggtaaccatttatctgcatcaagtgattcgtgaggatgctcacctgttgtttgggtttcacacggaagatgaaaaagatgtttttctgaaattaatttctgtatcaggtattggtccgacaacagctcttgctattgtggcagttgatgataatgagggacttgtgaatgccattgataacagtgacattaagtacctaatgaaatttcctaaaattggtaaaaaaacagcgcagcaaatggttcttgacttagctggcaaatttgtggaggctccacaagagactggtcataccaaagcgcgcagcaataaagcaggcaatactcaactggacgaagcgattgaagccctccttgctctcggttataaagcaaaagagctgaaaaaaattcgtgccttctttgaggggacctctgagacggcagagcaatacatcaaatcagcattgaaactgttaatgaaaggg

SEQ ID NO: 3342 - protein, 198 aa, Streptococcus pyogenes
MYDYIKGQLTKITAKYIVVEANGLGYMINVANPYSFTDSVNQLVTIYLHQVIREDAHLLFGFHTEDEKDVFLKLISVSGIGPTTALAIVAVDDNEGLVNAIDNSDIKYLMKFPKIGKKTAQQMVLDLAGKFVEAPQETGHTKARSNKAGNTQLDEAIEALLALGYKAKELKKIRAFFEGTSETAEQYIKSALKLLMKG

SEQ ID NO: 3343 - DNA, 561 bp, Streptococcus agalactiae
atgaggtttcacatgaaacgatgttcttgggtgaatttagataatccattatatgtagcttaccatgataaagagtgggggagagctgttcatgacgatcatgtactctttgagttactatgtttagaaacttatcaatcgggtttatcttgggaaacagtattaaataaacgtcaggagttcagacaagtttttcatcactataatattgaaaaggtagctgcaatgtcagatgcggatttagagataatcttacaaaatcctagggttattcgtcatcgtctaaaacttttctcaacacgacaaaatgctaggtcaattatattaattcagaaagaattcggaagttttgatcgctacatttggtcttttgtagataataaagtacaggttaactcagttaacaactacaacgatgtgcctgcaagtactaccttatccgaacgcttatctaaggatttaaaaaaacgcggttttaaatttgttggtccaacttgcctctattcttttattcaggccgcgggtatggttaatgaccatgaaaatatatgtgatttcaag

SEQ ID NO: 3344 - protein, 187 aa, Streptococcus agalactiae
MRFHMKRCSWVNLDNPLYVAYHDKEWGRAVHDDHVLFELLCLETYQSGLSWETVLNKRQEFRQVFHHYNIEKVAAMSDADLEIILQNPRVIRHRLKLFSTRQNARSIILIQKEFGSFDRYIWSFVDNKVQVNSVNNYNDVPASTTLSERLSKDLKKRGFKFVGPTCLYSFIQAAGMVNDHENICDFK

SEQ ID NO: 3345 - DNA, 567 bp, Streptococcus pyogenes
gtgtttcacatgaaacgttgctcatgggttcctaaggataaccagctttactgtgattaccacgatttagaatggggtcaacccctggatgatgatagagatttttttgaattgctgtgccttgaaagttaccagtcaggcttatcctggctgactgttttgaaaaaacgccaagctttcagaactgtttttcatcattacgacattgcatcggttgcaacctttacctcggaggaaatggctgatgctttagagaatccatccattatccgccacaagctaaagctagcagcaactgtcaacaacgctatcgcagtacagaaaattcaaaaagagtttggtagtttttcaacttatctctggaattttgttgggggaaagccaattaacaaccttgtcaatcaagagaatcttgttcctgctcaaacagaattatctattcgcttagctaaggatttaaagaaaagaggatttaaatttttagggcctacaacggtttattcttttatgcaagcatcgggtctggtaaatgaccatgaagaggcttgtgttttcaatagaatcttc

SEQ ID NO: 3346 - protein, 189 aa, Streptococcus pyogenes
VFHMKRCSWVPKDNQLYCDYHDLEWGQPLDDDRDFFELLCLESYQSGLSWLTVLKKRQAFRTVFHHYDIASVATFTSEEMADALENPSIIRHKLKLAATVNNAIAVQKIQKEFGSFSTYLWNFVGGKPINNLVNQENLVPAQTELSIRLAKDLKKRGFKFLGPTTVYSFMQASGLVNDHEEACVFNRIF

SEQ ID NO: 3347 - DNA, 897 bp, Streptococcus agalactiae
ttggttgaaggctcaatacctctacaaaaccttactggtctagctgttggtggtatcgttacatctaagggagtccaatatatggttttaccaggtccgcctagtgaattaaagccaatggttatggagcaggtagtacctattttgtcaaataatggcacaaaattatattcacgtgtattgagattctttggtatcggtgagagtcagttagtcacaatcttagaagacataattaagaatcagacagacccaactatagcaccatatgcaaaggttggtgaggtaactttaaggttatcaacgaaagctgaaaatcaggatgaggccgactttaaattagatagcttagaaaaagaaatacttgctcttaagacattagataaccgtaaattaaaagatttattatatggttatggtgataataatagtatggcacgtactgttttagaattattgaaagtacaaaataaaacgattactgccgcagagagcttaacagcagggttatttcaatctcagttagcagaattttctggtgcttcgcaagtttttaatggtggttttacgacctatagtatggaagcaaaatcacaacttctcggcatccctaagaaaaaattgcaagaatatggagttgtcagtcattttacagctgaggcaatggctcagcaagctcgccaacttttaaaagcagattttggtatcggtttaacgggagttgctggtcctgatgagttggaaggataccctgcaggtacagtttttattgggattgcaacccctgaaggcgtttcttctattaaagtatcgattggagggaagagtcgctcagatgtccgtcatatcagtactttacatgcttttgacttggtgcgtagggctttattaaagata

SEQ ID NO: 3348 - protein, 299 aa, Streptococcus agalactiae
MVEGSIPLQNLTGLAVGGIVTSKGVQYMVLPGPPSELKPMVMEQVVPILSNNGTKLYSRVLRFFGIGESQLVTILEDIIKNQTDPTIAPYAKVGEVTLRLSTKAENQDEADFKLDSLEKEILALKTLDNRKLKDLLYGYGDNNSMARTVLELLKVQNKTITAAESLTAGLFQSQLAEFSGASQVFNGGFTTYSMEAKSQLLGIPKKKLQEYGVVSHFTAEAMAQQARQLLKADFGIGLTGVAGPDELEGYPAGTVFIGIATPEGVSSIKVSIGGKSRSDVRHISTLHAFDLVRRALLKI

SEQ ID NO: 3349 - DNA, 1269 bp, Streptococcus pyogenes
atgaaagctgaactgattgcagtaggtaccgaaattttgactggtcaaattgtgaataccaatgctcaatttctgtcggaaaaaatggcagagctaggtattgatgtctattttcaaacggctgttggggacaacgaggagcgtttactttcagtgattacaactgctagtcagcgtagtaacttggtaattttatgtggtggccttggtccaacgaaagatgatttaaccaaacaaactttagcaaagtaccttaggaaagacttggtttatgatgagcaagcttgtcagaaactagatgacttttttgctaagcgcaagccttcatcacggacaccaaataatgagcgacaggcacaagtgattgaagggtcaatccctttgccaaataaaactggtcttgcggttggtgggttcatcacagtcgatggtattagttatgttgtcttaccgggtcctccaagtgaattgaagccgatggtaaatgaagaattggtaccacttctgtcaaaacaatacagtacattgtattcaaaggtactacgcttttttggtattggggaaagtcagttggtaacagtcttgtcagattttattgagaatcaaactgatccaaccattgctccgtatgctaagactggcgaagtgactcttcgcttatcaacaaaaactgaaaaccaagctctggcagataaaaagttaggtcagctagaagcgcagctactatcccgaaaaactcttgaaggtcaacccttagctgatgtcttttatggctatggggaggataattccttagcgcgtgagacatttgagctcttagtaaaatatgataagacaattacagcagcagaaagtctaaccgcgggattatttcagtcaactttggcgagttttccaggagcttctcaagtattcaatggaggctttgtgacttatagcatggaagaaaaagcgaaaatgctaggccttcctttagaggagttgaaatcgcatggcgttgttagtgcttatacggccgaggggatggcggagcaagcaaggttattgactggtgctgatattggggtaagtttaacaggtgttgccggaccagatatgttggaggaacagcctgcaggtacagttttcattggtcttgccactcaaaataaggtagaatcaataaaggttttgattagcgggcgaagtcgtttggatgtgcgctatatcgctactttacatgcttttaatatggtccgtaaaactttattaaaacttgagaatttgcta

SEQ ID NO: 3350 - protein, 423 aa, Streptococcus pyogenes
MKAELIAVGTEILTGQIVNTNAQFLSEKMAELGIDVYFQTAVGDNEERLLSVITTASQRSNLVILCGGLGPTKDDLTKQTLAKYLRKDLVYDEQACQKLDDFFAKRKPSSRTPNNERQAQVIEGSIPLPNKTGLAVGGFITVDGISYVVLPGPPSELKPMVNEELVPLLSKQYSTLYSKVLRFFGIGESQLVTVLSDFIENQTDPTIAPYAKTGEVTLRLSTKTENQALADKKLGQLEAQLLSRKTLEGQPLADVFYGYGEDNSLARETFELLVKYDKTITAAESLTAGLFQSTLASFPGASQVFNGGFVTYSMEEKAKMLGLPLEELKSHGVVSAYTAEGMAEQARLLTGADIGVSLTGVAGPDMLEEQPAGTVFIGLATQNKVESIKVLISGRSRLDVRYIATLHAFNMVRKTLLKLENLL

SEQ ID NO: 3351 - DNA, 1137 bp, Streptococcus agalactiae
ttggctaaaaaaacgaaaaaagcagaagaaattactaagaaattcggtgatgaacgtcgaaaagccttagatgatgctttgaaaaatattgaaaaagattttggtaagggcgcagtgatgcgcttaggtgagcgagctgaacaaaaggttcaagtaatgagttcaggttctcttgctttagatatcgctttaggagcaggtggatatcctaaaggacgtatcgtcgaaatttatggaccagagtcatctggtaaaacaacggttgcccttcatgccgtagctcaagcccaaaaggaaggtgggattgctgcctttattgatgctgagcacgctcttgacccagcctatgctgcggctcttggagttaatattgatgagttacttttgtctcaacctgactcaggtgagcaaggtcttgaaattgcaggtaaattgattgattcaggcgcagttgatttagttgttgtcgattcagttgcagcccttgttcctcgtgctgagattgatggtgatattggtgacagccacgttggtttgcaagctcgtatgatgagtcaagcaatgcgtaaattgtcagcatccattaacaagacaaagacaatcgcaatttttatcaaccagttaagggaaaaagtaggcgttatgtttggtaaccctgaaacaacacctggtggtcgtgctttgaaattttattcatcggttcgtctagatgttcgtggtaatactcaaatcaagggaactggtgagcataaagatcataatgttggtaaagagacaaaaatcaaagttgttaaaaataaagttgctccaccattccgtgaagcttttgtcgaaattatgtatggtgaaggtatttctcgcacgggtgagttaattaaaattgctagtgatttggatattatccaaaaagcaggtgcatggtactcatataatggtgagaaaattggacaaggttctgaaaatgccaaaaaatatttagcagataatccagcaatttttgatgaaattgaccataaagtgcgcgtgcactttggaatgactgaagatgattcgccagttcagtctgagctcgttgaagaaaaaaatgaagctgatgatcttgttttagatttggacaatgctattgaaattgaggaa

SEQ ID NO: 3352 - protein, 379 aa, Streptococcus agalactiae
MAKKTKKAEEITKKFGDERRKALDDALKNIEKDFGKGAVMRLGERAEQKVQVMSSGSLALDIALGAGGYPKGRIVEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLSASINKTKTIAIFINQLREKVGVMFGNPETTPGGRALKFYSSVRLDVRGNTQIKGTGEHKDHNVGKETKIKVVKNKVAPPFREAFVEIMYGEGISRTGELIKIASDLDIIQKAGAWYSYNGEKIGQGSENAKKYLADNPAIFDEIDHKVRVHFGMTEDDSPVQSELVEEKNEADDLVLDLDNAIEIEE

SEQ ID NO: 3353 - DNA, 1134 bp, Streptococcus pyogenes
ttggcaaaaaaattaaaaaagaatgaagaaatcactaagaagtttggtgacgaacgtcgcaaagcccttgatgatgctttgaaaaatattgaaaaagattttggtaagggtgcagtgatgcgattaggagaacgtgcagagcaaaaagttcaggttatgagttcaggaagtctagctcttgatattgcgcttggagctggtggttatcctaaaggacgtatcatcgaaatctatggtccagagtcttccggtaaaacgactgtggctttacatgctgtagcacaagctcaaaaagaaggtggaatcgcagcctttatcgatgccgagcatgcgcttgatccagcttatgctgctgcgcttggggttaatattgatgaactcctcttgtctcaaccagattctggagaacaaggacttgaaattgcaggtaaattgattgattctggtgcggttgatctggttgttgtcgattcagtagcagctttagtgccacgtgctgaaattgatggtgatattggcgatagccatgtcggattgcaagcacgtatgatgagtcaggccatgcgtaaattatcagcttctattaataaaacaaaaactatcgctatctttattaaccaattgcgtgaaaaagttggtgtgatgtttggaaatcctgaaacaacaccaggtggtcgagctttgaaattctatgcttctgttcggctggatgtgcgtggaacaactcaaattaaaggaactggtgaccaaaaagatagcagtattggtaaggagaccaaaatcaaggttgttaaaaacaaggtcgctccgccatttaaggtagcagaagttgaaatcatgtatggggaaggtatttctcgtacaggggagcttgtgaaaattgcttctgatttggacattatccaaaaagcaggtgcttggttctcttataatggtgagaagattggccaaggttctgaaaatgctaagcgttatttggccgatcacccagaattgtttgatgaaatcgaccttaaagtacgtgttaaatttggtttgcttgaagaaagcgaagaagaatctgctatggcagtagcatcagaagaaaccgatgatcttgctttagatttagataatggtattgaaattgaagat

SEQ ID NO: 3354 - protein, 378 aa, Streptococcus pyogenes
LAKKLKKNEEITKKFGDERRKALDDALKNIEKDFGKGAVMRLGERAEQKVQVMSSGSLALDIALGAGGYPKGRIIEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLSASINKTKTIAIFINQLREKVGVMFGNPETTPGGRALKFYASVRLDVRGTTQIKGTGDQKDSSIGKETKIKVVKNKVAPPFKVAEVEIMYGEGISRTGELVKIASDLDIIQKAGAWFSYNGEKIGQGSENAKRYLADHPELFDEIDLKVRVKFGLLEESEEESAMAVASEETDDLALDLDNGIEIED

SEQ ID NO: 3355 - DNA, 408 bp, Streptococcus agalactiae
gtgagaaggcacatgattaagatttatactatttcaagttgcacaagttgtaaaaaagcaaaaacttggctaaatgctcatcaacttccatataaagaacaaaacctaggtaaagaatcactaacacgtgatgaaattttagaaatattaacaaaaactgaaagtggtattgaaagtatcgtttcttctaaaaatcgttatgctaaggcgctcaattgtaatattgaggagttgagtgtaaatgaagttattgatcttattcaagaaaatccacgtattttaaagagtccaattctaattgatgacaaacgtcttcaagtaggttataaggaagatgatattcgtgcttttctacctcgctctattcgtaacgttgaaaatgcagaagctcgtcttcgtgcagcactt

SEQ ID NO: 3356 - protein, 136 aa, Streptococcus agalactiae
MRRHMIKIYTISSCTSCKKAKTWLNAHQLPYKEQNLGKESLTRDEILEILTKTESGIESIVSSKNRYAKALNCNIEELSVNEVIDLIQENPRILKSPILIDDKRLQVGYKEDDIRAFLPRSIRNVENAEARLRAAL

SEQ ID NO: 3357 - DNA, 396 bp, Streptococcus pyogenes
atgattaaaatttacacgatttcaagttgtacgagctgcaagaaagccaaaacttggctaaatgcccataagcttgcttataaagaacagaacttaggaaaagaaccgctaactaaagaagaaattttagcaattttatcaaaaaccgaaaatggagtggagagcattgtttcatctaaaaatcgttatgccaaagctctcgattgcgatattgaagaattaagtgttagtgaggttattgatttgattcaagataacccgcgcatccttaaaagtcccattttgattgatgataaacgtctgcaagtaggctacaaagaagacgatattcgtgcttttttacctcgctctattcgtaatattgaaaatactgaagcacgattacgtgctgcactc

SEQ ID NO: 3358 - protein, 132 aa, Streptococcus pyogenes
MIKIYTISSCTSCKKAKTWLNAHKLAYKEQNLGKEPLTKEEILAILSKTENGVESIVSSKNRYAKALDCDIEELSVSEVIDLIQDNPRILKSPILIDDKRLQVGYKEDDIRAFLPRSIRNIENTEARLRAAL

SEQ ID NO: 3359 - DNA, 264 bp, Streptococcus agalactiae
atgggatttacagatgaaactgttcgttttagattagatgatagtaacaaagtagaaattagtgaaacattaacagctgtttatcgttcattagaagaaaaaggttacaatcccatcaatcaaattgttggttacgtattgagtggggaccctgcttatgtacctcgttacaatgatgctcgcaatcaaattcgtaaatatgaacgtgatgagattgtagaagagctcgttcgttattatttacaaggaaatggaatagatttg

SEQ ID NO: 3360 - protein, 88 aa, Streptococcus agalactiae
MGFTDETVRFRLDDSNKVEISETLTAVYRSLEEKGYNPINQIVGYVLSGDPAYVPRYNDARNQIRKYERDEIVEELVRYYLQGNGIDL

SEQ ID NO: 3361 - DNA, 267 bp, Streptococcus pyogenes
atgggatttacagatgaaacagtccgctttaagttggatgatggcgacaaacgacaaattagtgaaacattaacagcagtctatcattcacttgatgaaaagggttataatccaattaatcaaattgttggttatgtcttgagtggggacccagcttatgttcctcgttataatgatgctcgaaatcagattcgtaaatatgaacgtgatgaaattgtagaagaacttgttcgctactatttacaaggaaatggaattgatgttaaa

SEQ ID NO: 3362 - protein, 89 aa, Streptococcus pyogenes
MGFTDETVRFKLDDGDKRQISETLTAVYHSLDEKGYNPINQIVGYVLSGDPAYVPRYNDARNQIRKYERDEIVEELVRYYLQGNGIDVK

SEQ ID NO: 3363 - DNA, 417 bp, Streptococcus agalactiae
atgagaataatgggacttgacgtcggctcgaaaactgtcggcgttgcaattagtgatccactcggtttcactgcacaaggtcttgaaatcattaagatcgatgaagaatctggaaattttggttttgaccgcttagcagagttagtaaaagagtacaaagttgataaatttgtagttggtctacctaaaaatatgaataatacaagtggtcctcgtgtagaggctagtcaggcatatggcgataaaatcactgaattattcaatcttccagttgaatatcaagatgaacgtttaacgactgttcaagcagagcgtatgctagttgagcaagctgatattagtcgtggtaagcgtaagaaagttatcgataaattagcagctcaactaatcttacaaaattatttagaccgcatgttt

SEQ ID NO: 3364 - protein, 139 aa, Streptococcus agalactiae
MRIMGLDVGSKTVGVAISDPLGFTAQGLEIIKIDEESGNFGFDRLAELVKEYKVDKFVVGLPKNMNNTSGPRVEASQAYGDKITELFNLPVEYQDERLTTVQAERMLVEQADISRGKRKKVIDKLAAQLILQNYLDRMF

SEQ ID NO: 3365 - DNA, 417 bp, Streptococcus pyogenes
atgagaataatgggacttgatgttggctcgaaaacggttggtgtagctattagtgatcctcttggctttacagcccaaggacttgaaattatcaagattgatgaggaaaaagcagaatttggctttacacgtttagaagagcttgttaagcagtaccaagttgaacagtttgttattggattgccaaaaaatatgaataacaccaatggtccacgtgttgatgcaagtataacttatggaaaccacatagagcacctctttggacttccagtccattatcaagatgaacgattgacgactgttgaggcaaagcgtatgcttattgagcaagctgacattagtcgtggtaagcgaaaaaaagtcattgataaattagctgcacaactcattttacagaactatttaaatcggaatttt

SEQ ID NO: 3366 - protein, 139 aa, Streptococcus pyogenes
MRIMGLDVGSKTVGVAISDPLGFTAQGLEIIKIDEEKAEFGFTRLEELVKQYQVEQFVIGLPKNMNNTNGPRVDASITYGNHIEHLFGLPVHYQDERLTTVEAKRMLIEQADISRGKRKKVIDKLAAQLILQNYLNRNF

SEQ ID NO: 3367 - DNA, 315 bp, Streptococcus agalactiae
atggcacataatcataaccacgatcataaccatgaacatcaacatgaagtaatcactcttgtagatgagaatgggaacgaaacactttttgaaattctattaactattgatgggcgtgaagagtttggcaaaaactatgttctcctcgttcctgcaggtgcggaagaagacgaacaaggtgaaattgagattcaagcttactcatttacagaaaatgccgatggaactgaaggagaccttcagcctataccagaagattcagatgcagaatgggacatgattgaggaagttttcaacagctttctagatgaagaa

SEQ ID NO: 3368 - protein, 105 aa, Streptococcus agalactiae
MAHNHNHDHNHEHQHEVITLVDENGNETLFEILLTIDGREEFGKNYVLLVPAGAEEDEQGEIEIQAYSFTENADGTEGDLQPIPEDSDAEWDMIEEVFNSFLDEE

SEQ ID NO: 3369 - DNA, 303 bp, Streptococcus pyogenes
atgacacataatcatgaaaatgaccaccaacacgaagttatcacacttgtggatgaacaaggaaatgaaaccttgtttgaaattttattaacaattgatggtcgtgaagagtttggtaaaaattatgttctcttggttccagcgggatctgaagaagatgagtctggtgaaattgaaatccaagcctattcatttactgaaaatgaagatggtactgaaggggatttacaaccgattcctgaggattcagatgctgaatgggatatgattgaagaggtatttaatagttttctagatgagaac

SEQ ID NO: 3370 - protein, 101 aa, Streptococcus pyogenes
MTHNHENDHQHEVITLVDEQGNETLFEILLTIDGREEFGKNYVLLVPAGSEEDESGEIEIQAYSFTENEDGTEGDLQPIPEDSDAEWDMIEEVFNSFLDEN

SEQ ID NO: 3371 - DNA, 126 bp, Streptococcus agalactiae
ttgagcaattgttcagtcgtttttttttcgaataataatagtgatgatgtagtaaaaggaggtgatgttaatgtcagatactcagctaacactagaagaacaagaatttctcaaacaatatatgtc

SEQ ID NO: 3372 - protein, 42 aa, Streptococcus agalactiae
MSNCSVVFFSNNNSDDVVKGGDVNVRYSANTRRTRISQTIYV

SEQ ID NO: 3373 - DNA, 1554 bp, Streptococcus agalactiae
atgaggagaaaaatagtggtagaaaacctagaaaaaccaattggagtgagctataaaaatagcccatcaatgagtaaacgaacggctatcagaatgaagaaatctagtcgattttcaattttactatatagtgttttgtcaactctcttagcaattgcaaatcctttattgacttattttgcaaatggtttgcagactcagaatctctatacaggtttgatgatgaccaaaggacagatcccttatagtgatgtttttgctacaggaggatttttatactatgtaacgattgctctaagttaccttttagggtctagtatctggttacttattgtacagtttattgcttactatgtatctggaatttatttttataaattagtttattatgtggcacaaagtgaaattgtctcgataggcatgacgttgattttctatataatgaatattgtcttaggattcggtggtatgtacccaatacagtgggcattaccttttatgctcatttcgctatggtttttaattaaattttgtgtcgataatatcgttgatgaagcatttatattttatggcattttagcagcattctcactatttatagatccccaaacactgattttttggctttgctcttttgttctcttaacagcaaccaatattaagcaaaagcagtcactacgaggattttatcagtttttatgcgttgtttttggtatgattttaattgcttatactgttggttactttatgtttaatctacagattatctcttcttatattgacaaagctattttttacccctttacgtatttcgctaggacaaaccactcattccttcttagtttagcaattcaaattgttgtccttctagggtcaggttgtctctttggactatgggattttattcaaaatcgtaaaaaagcatcttatcaaatcggcttgaactttattgcctgtatttttattatttacgctataatggccattttttcaagagattttaacctttaccactttttacctgctttaccatttggtcttttgctaacgagtaataaaattactattctttaccaaaaagtgattgacagacgttcacatagacgtcagtatttctctggtaaatctcttatcgtagacctttttgtaaagaaaacatattatttgcccctcttactagtttccttatcgatagggttactagtttataatacttatcaaaatgttactcttagtaaagaaaggcgtgacatttcacattatttgactacaaaaattgatagagatggtaagatttatgtttgggacaaagttgctagcatttatagccagactcggttaaaatctgcttctcaatttgttttgccacatattaatacagcgcaaaaaaataatgagaaaattttgaaggacgagctgcttcagcatggggctaaatactttatcttaaataaaaatgagaagttaccaaatgaactgaaatctgatattaagaagcactaccaagaagttcctctatcaaatatcactcattttgttctatatcgtttcaaa

SEQ ID NO: 3374 - protein, 518 aa, Streptococcus agalactiae
MRRKIVVENLEKPIGVSYKNSPSMSKRTAIRMKKSSRFSILLYSVLSTLLAIANPLLTYFANGLQTQNLYTGLMMTKGQIPYSDVFATGGFLYYVTIALSYLLGSSIWLLIVQFIAYYVSGIYFYKLVYYVAQSEIVSIGMTLIFYIMNIVLGFGGMYPIQWALPFMLISLWFLIKFCVDNIVDEAFIFYGILAAFSLFIDPQTLIFWLCSFVLLTATNIKQKQSLRGFYQFLCVVFGMILIAYTVGYFMFNLQIISSYIDKAIFYPFTYFARTNHSFLLSLAIQIVVLLGSGCLFGLWDFIQNRKKASYQIGLNFIACIFIIYAIMAIFSRDFNLYHFLPALPFGLLLTSNKITILYQKVIDRRSHRRQYFSGKSLIVDLFVKKTYYLPLLLVSLSIGLLVYNTYQNVTLSKERRDISHYLTTKIDRDGKIYVWDKVASIYSQTRLKSASQFVLPHINTAQKNNEKILKDELLQHGAKYFILNKNEKLPNELKSDIKKHYQEVPLSNITHFVLYRFK

SEQ ID NO: 3375 - DNA, 1557 bp, Streptococcus pyogenes
gtgatcgagttaaacgatgaattcatccgaaaagagacgatagaactggccaacgatggcccacgagtacacaccactcaatatgaaactaaagtacctcggcttcataaatgctatctgcttttctttagcattattatcagttctttaacaattgcagtaccttttttaacagatgcagccaatggtcttcagtcccaaaacttatatataggaatgatgttaacgaaggggcaacttccctatagtgctgcttttacaacaggagggctcttttactttgttatcattgcattaagttattatttgggatcgacactttggctagtctttgttcaggtgttttgtttttacttatctggtttatatctttataaactcattaattatatgacaggctttcaaaaagtggctttaactttttcaattagctactatttattatctgttagtcttggttttgggggattgtatcctactcaactggctatgccatttatattaatatcggcttggtttttaactaagtattttgcctgtttagtgaaagatgaggcatttattctttttggctttgtaggtgctcttgcaatgctaattgacccgagtacccttatcttttggtcttttgcttgtgtgacagttttttcttataatataagccaaaagcatcttgcaagaggtttttatcaactgctagcttcgatttttggaatgattttagttttttacacagcaggatatttcattttgaacttacaagtgctaaatccttatttatcacaaacgatgatttatccttttactttttttaaatcaggaaacttatcgttgctttttggactggctattcagttgttcttcgctttggggcttggtcttttgacgggaatggagaatgtcattaggcgatttaaaaacaattctgatagggtcgtcaagtggctatttgtcatggtcattctagaatctatacttgtggctatattttcacaagactatcgcccctatcatcttttacctcttttaccttttggattaattttgactgctattcctgttggctatcagtatggtataggattaggtcagagtagtcatcgcagacgtcatggtaaaaatggtgttggtcgagtaatgatgatttatcttaagagacacttttatttgccaattttaattgtagggacaatactaatctgttctacttattgtttcattagtagtattcctcttaatcaggagcgtgatcatattgctagttatttagaacagaaactaaataaaactcaatctatttatgtttgggatgatacttctaaaatttatttggacagtaaagctaaatctgtttctcaatttagttctcctgacatcaatacgcaaaaagagagtcatcgaaaaatattagaagatgaactattagaaaataaggctgcttatatcgttgttaatcgctataaaaacctgcctaaaatcattcaaaaagtattatctactaattacaaagtagataaacagataacgacaaaaagttttattgtttatcagaaaaag

SEQ ID NO: 3376 - protein, 519 aa, Streptococcus pyogenes
VIELNDEFIRKETIELANDGPRVHTTQYETKVPRLHKCYLLFFSIIISSLTIAVPFLTDAANGLQSQNLYIGMMLTKGQLPYSAAFTTGGLFYFVIIALSYYLGSTLWLVFVQVFCFYLSGLYLYKLINYMTGFQKVALTFSISYYLLSVSLGFGGLYPTQLAMPFILISAWFLTKYFACLVKDEAFILFGFVGALAMLIDPSTLIFWSFACVTVFSYNISQKHLARGFYQLLASIFGMILVFYTAGYFILNLQVLNPYLSQTMIYPFTFFKSGNLSLLFGLAIQLFFALGLGLLTGMENVIRRFKNNSDRVVKWLFVMVILESILVAIFSQDYRPYHLLPLLPFGLILTAIPVGYQYGIGLGQSSHRRRHGKNGVGRVMMIYLKRHFYLPILIVGTILICSTYCFISSIPLNQERDHIASYLEQKLNKTQSIYVWDDTSKIYLDSKAKSVSQFSSPDINTQKESHRKILEDELLENKAAYIVVNRYKNLPKIIQKVLSTNYKVDKQITTKSFIVYQKK

SEQ ID NO: 3377 - DNA, 2196 bp, Streptococcus agalactiae
atgatggtattggaaagagaacgatttatgacagaatctgatatcaaagtgattaaacgtgacgggcgtttggtcagctttgataagtataaaatctacacggctctattaaaagctagtaataaagttatcaaaatgtctcctttagttgaggctaaacttgagatgattgcagatcatgtcatcgctgagatctacaatcgttttaaagataacatcaagatatatgaaatacaaaatatcgttgaacataaattattggaagctaatgagtacgctattgcacaagaatatatcaattatcgtacccaacgcgattttgagcgttcacaggctacagatatcaatttttctattggaaaattaattaataaggatcaaactgttgttaatgagaatgctaataaagactctgatgtgtttaatacccaacgtgatttaacagcaggtattgtagggaaatcaattggtctgaaaatgttaccttctcatgtagcaaatgcacatcaaaagggtgatatccattatcatgatttagattacagcccatacactcccatgacaaattgctgtttaatcgattttaagggaatgcttgcaaatggttttaagattggtaatgcagaagttgagagtccaaaatctattcagacagcgactgctcagatttcacagattattgcgaacgttgcttcaagtcaatatggtggctgtacagcagatcgcattgatgagtttttagctccttatgcacagttaaattatcaaaaacatttaaaagatgcaaaagaatgggttattgaagataaacaagaagactatgcgcgcgctaaaacacaaaaagatatatatgatgccatgcaatctttggagtatgaaattaatactttatttacttcaaatgggcaaacgccatttacttcgcttggttttggattaggaactaattggtttgaacgagaaattcaaaaagcgattttgaaaattcggattcaaggtttaggaagcgagcatcgtactgctatttttccaaaattaatttttacgcttaaaaaaggtcttaatttagaagaagatagccccaattatgatattaaacaattagcattagagtgtgcgacaaaacggatgtatccagatgtcctttcttatgataaaattattgacttaacgggctcttttaaagcccctatgggctgtcgttctttcctacaagggtggcgagatgcaaatggtcaggatgtaacatctggtcgtatgaatcttggagttgtaacagttaatctaccgcgtgttgccatggagtctaacggtgatatggataaattctgggagatatttaatgaacgtatgagtattgctagagatgccttggtttatcgtgtggaacgtgtcaaagaggctatcccagcaaatgcgcccattctttaccagtatggagcatttggagaacgtttaggaaaatatgacaatgttgatcgactctttaatcaccgccgtgcaacggtgtctcttggttatattggtttatatgaggtggcgagtgttttttatggtggtgactgggaagataaccatcaagctaaagcatttactgtagacatcgttcgtaagatgaagcagttatgtgcagattggtctgatgagtatgattatcatttttcagtttattcgacaccatcggagagcttgactgaccggttttgtcgtttagatactgaaaaatttggtatagtaactgatattactgataaggaatactacactaattcattccattatgatgtgcgtaagaatccaacaccttttgaaaaactagattttgagaaaatctatcctgaaacgggtgcatcaggaggatttattcactactgtgaataccctgttttgcaacagaatccaaaagctttagaagcagtttgggactatgcttatgatcgggtaggttatctaggtactaatacaccgattgataagtgttaccaatgtcaatttgaaggggattttacaccgacagatcgaggttttacttgtccaaattgtggtaacagcgaccctaagacagtagatgttgtcaaacgtacatgtggttatttaggtaatccacaggctcgtccgatggttaatggtcgtcataaggaaatctctgctcgtgtaaaacatatgaacggatcaagtattaaaaatcaaggtaat

SEQ ID NO: 3378 - protein, 732 aa, Streptococcus agalactiae
MMVLERERFMTESDIKVIKRDGRLVSFDKYKIYTALLKASNKVIKMSPLVEAKLEMIADHVIAEIYNRFKDNIKIYEIQNIVEHKLLEANEYAIAQEYINYRTQRDFERSQATDINFSIGKLINKDQTVVNENANKDSDVFNTQRDLTAGIVGKSIGLKMLPSHVANAHQKGDIHYHDLDYSPYTPMTNCCLIDFKGMLANGFKIGNAEVESPKSIQTATAQISQIIANVASSQYGGCTADRIDEFLAPYAQLNYQKHLKDAKEWVIEDKQEDYARAKTQKDIYDAMQSLEYEINTLFTSNGQTPFTSLGFGLGTNWFEREIQKAILKIRIQGLGSEHRTAIFPKLIFTLKKGLNLEEDSPNYDIKQLALECATKRMYPDVLSYDKIIDLTGSFKAPMGCRSFLQGWRDANGQDVTSGRMNLGVVTVNLPRVAMESNGDMDKFWEIFNERMSIARDALVYRVERVKEAIPANAPILYQYGAFGERLGKYDNVDRLFNHRRATVSLGYIGLYEVASVFYGGDWEDNHQAKAFTVDIVRKMKQLCADWSDEYDYHFSVYSTPSESLTDRFCRLDTEKFGIVTDITDKEYYTNSFHYDVRKNPTPFEKLDFEKIYPETGASGGFIHYCEYPVLQQNPKALEAVWDYAYDRVGYLGTNTPIDKCYQCQFEGDFTPTDRGFTCPNCGNSDPKTVDVVKRTCGYLGNPQARPMVNGRHKEISARVKHMNGSSIKNQGN

SEQ ID NO: 3379 - DNA, 2196 bp, Streptococcus pyogenes
atggtaagtttagaagaagacaaggtgactgttcaacctgatattaaagtgattaaacgagatggtcgccttgttaattttgatagtacaaaaatctatagtgctttattaaaagcaagcatgaaagtaactcggatgtcgccacttgttgaggctaaattagaggctatttctgatcgcattatagcagaaattattgagcgttttccaactaatatcaaaatttatgaaatccaaaatattgtagagcataagcttcttgcagctaatgaatatgctattgcaaaagaatacattaattatcgtactcagcgtgactttgcacgttcacaagcaacagatatcaatttttctattgataaattaattaataaagatcaaacagttgttaatgaaaatgctaacaaagatagcgatgtttttaatactcaacgagatttaactgctggaatcgtagggaaatcgattggtttaaaaatgttaccttcgcatgttgctaatgctcatcaaaaaggagatatccattaccatgatttggattacagtccttatacaccgatgacgaactgctgtttaattgactttaagggcatgttagccaatggctttaaaattggtaatgctgaagtggaaagtcccaagtctattcaaactgcaacagctcagatctcacagattattgcgaatgtagcatcaagtcagtacggcggatgcacagctgatcgcattgacgagtttttagccccatatgcggagcttaactttaaaaaacatatggctgatgctaagaaatggatcgttgagactaagagagaaagctatgcttttgaaaagactcaaaaagatatttatgatgcgatgcagtctttggagtatgaaattaatacgctctttacgtctaatggtcaaacaccatttacttctttaggatttggtttggggacgtcttggtttgaacgtgagattcaaaaagctattttgaccattcggattaatggtcttggtagtgaacatcgcacggctattttccctaaattaattttcacggttaaacgtggcttgaatttagaaccagattcaccaaactatgatattaagactttggctttagaatgtgcgactaagcggatgtacccggatatgttatcttatgataaaattattgatttgacaggatctttcaaatctccaatgggatgccgctctttccttcaaggctggaaagatgaaaatgggcaagatgtgacctcaggccgtatgaatcttggggttgtcaccctcaatttacctcgcattgccatggaatcaaatggcgatatggataagttttgggagctgtttaatgagaggatgctaattagtaaggatgctttaatttatcgtgtcgaacgtgtcacagaagcaaaaccagcaaatgctcctattctttatcaatatggtgcttttggaaagcgtttggagaagacagggaatgtaaatgatctctttaagaatcgtcgtgcaacagtctctcttggctatattggtctttatgaagtggcgtctgttttttatggtggtcaatgggaaggtaatccagatgctaaagcttttaccttgtcaattgtcaaggcaatgaaacaggcctgtgaggattggtcagatgaatatggttatcatttctctgtttattcgactccatcagaaagtttgacagatcgcttttgtcgtttagatacggaaaaatttggcattgtgacagatattacggataaagaatactatacaaattcttttcactatgatgtgcgtaagagtccgacaccttttgaaaaattagattttgaaaaagattatccagaagcaggtgcttcaggtggttttatccactactgtgagtatcctgttttgcaacaaaatccaaaggccttggaagcggtttgggactatgcttatgatcgtgtggggtatttgggaaccaatacgcctattgataaatgctataattgccaatttgaaggcgattttaccccaacagaacgtggttttacttgcccaaactgtggcaataatgaccctaaaacagttgatgtggtcaaacgtacatgtggttacttggggaatcctcaggcccgcccaatggttaacggtcgccataaggaaatctctgcgcgtgtaaaacatatgaatggttctactataaaatacccaggcctg

SEQ ID NO: 3380 - protein, 732 aa, Streptococcus pyogenes
MVSLEEDKVTVQPDIKVIKRDGRLVNFDSTKIYSALLKASMKVTRMSPLVEAKLEAISDRIIAEIIERFPTNIKIYEIQNIVEHKLLAANEYAIAKEYINYRTQRDFARSQATDINFSIDKLINKDQTVVNENANKDSDVFNTQRDLTAGIVGKSIGLKMLPSHVANAHQKGDIHYHDLDYSPYTPMTNCCLIDFKGMLANGFKIGNAEVESPKSIQTATAQISQIIANVASSQYGGCTADRIDEFLAPYAELNFKKHMADAKKWIVETKRESYAFEKTQKDIYDAMQSLEYEINTLFTSNGQTPFTSLGFGLGTSWFEREIQKAILTIRINGLGSEHRTAIFPKLIFTVKRGLNLEPDSPNYDIKTLALECATKRMYPDMLSYDKIIDLTGSFKSPMGCRSFLQGWKDENGQDVTSGRMNLGVVTLNLPRIAMESNGDMDKFWELFNERMLISKDALIYRVERVTEAKPANAPILYQYGAFGKRLEKTGNVNDLFKNRRATVSLGYIGLYEVASVFYGGQWEGNPDAKAFTLSIVKAMKQACEDWSDEYGYHFSVYSTPSESLTDRFCRLDTEKFGIVTDITDKEYYTNSFHYDVRKSPTPFEKLDFEKDYPEAGASGGFIHYCEYPVLQQNPKALEAVWDYAYDRVGYLGTNTPIDKCYNCQFEGDFTPTERGFTCPNCGNNDPKTVDVVKRTCGYLGNPQARPMVNGRHKEISARVKHMNGSTIKYPGL

SEQ ID NO: 3381 - DNA, 141 bp, Streptococcus agalactiae
atggggaaataccaattagattacaaagggcaagcacaagtacagaagttccatgagaagcactctactggagagaatgctaatcaaaaatcacgtctaaaagatttaaggaaacaatttttggaaaaggcaaagaaaaaa

SEQ ID NO: 3382 - protein, 47 aa, Streptococcus agalactiae
MGKYQLDYKGQAQVQKFHEKHSTGENANQKSRLKDLRKQFLEKAKKK

SEQ ID NO: 3383 - DNA, 144 bp, Streptococcus pyogenes
atgggaaaatatcaattagactataaaggaatgcagcaggtagaacgctttcatgagaagcattctaaaaaaaagacggataaaaaatcccgcgttcaagaacttaaggctcggtttttagagaagtcaaaaaaacaggataac

SEQ ID NO: 3384 - protein, 48 aa, Streptococcus pyogenes
MGKYQLDYKGMQQVERFHEKHSKKKTDKKSRVQELKARFLEKSKKQDN

SEQ ID NO: 3385 - DNA, 930 bp, Streptococcus agalactiae
atgttgcaacttggaattgtcggtttaggaggtatttcacagaaagcttatctaccttatatgcgtcaagtgacaggtgtgcactggcatctttttacacgccaaaaacagattttagaagaagttaatatgctttttggttcttctacagcttatgacagtttagatagtctagccgagcatcctttggatggagtcttcattcatgtcgcgactagtgctcactttgatatagcaaagctttttttaaaaaagggtattccagtttttatggataagcctttgacagaagattatacttcaactaaagcattgtatgatttggcgaaggatcataaaacatttttaatggcaggttttaatcgtcgctttgcaccacgtattatggaaatgaaaaaagtagaagataaaaaccatattcgcacctttaaaaatgctgtcaatgcaccagcggattttcaatataagctttttgatatgtttatccatcctttagatacggcgctatttttgacaaataatgttgttaaaagaggatactttgtgactaaacgtgatgggaataagatattacaagtatcagtaacgctagaaacagacagtgagataatagaagcaagcatgaacctgcagtcggggtctcgtcgagaaataattgaaatagagtcgccagaagtaacctattcattagatgatttgtcaaatctttctgttattgatggctttgaccgtcgtgctatcggttttggttcttgggcaagcactctagagaaacgtggttttgaaccaatgattgatgcttttattcaagctatcactacaggtgtcaatcctatatcaccaaagtctagtttattgagtcattttatttgtgaccagattaataaagcgaatgctccttttggaatgcttaacttgaagataatggaa

SEQ ID NO: 3386 - protein, 310 aa, Streptococcus agalactiae
MLQLGIVGLGGISQKAYLPYMRQVTGVHWHLFTRQKQILEEVNMLFGSSTAYDSLDSLAEHPLDGVFIHVATSAHFDIAKLFLKKGIPVFMDKPLTEDYTSTKALYDLAKDHKTFLMAGFNRRFAPRIMEMKKVEDKNHIRTFKNAVNAPADFQYKLFDMFIHPLDTALFLTNNVVKRGYFVTKRDGNKILQVSVTLETDSEIIEASMNLQSGSRREIIEIESPEVTYSLDDLSNLSVIDGFDRRAIGFGSWASTLEKRGFEPMIDAFIQAITTGVNPISPKSSLLSHFICDQINKANAPFGMLNLKIME

SEQ ID NO: 3387 - DNA, 939 bp, Streptococcus pyogenes
ttgagtatgcttaatattgggattgtgggactaggtgctatttcacaaaaagcctatttaccatatatgagacagctgagtgacattacttggcatctatcaacgcggaatgcagcagtacgtcagcaggtcggtcagttatttggtcacgctattctttacagtgatgtcaaggagttgtcaaaaacaaacttagatggggtctttattcatgcggccacatcggcccacgcagagttggctagtttatttttaaatcaggggatcccagtctttatggataaacctatagctgacaattacctgatgacaaagaacctctatgacttagccaaagaaaatcagacttttctgatggcaggatttaacaggcgttttacacctcgtgtcaagaagttgtcaagtttgtcaactaagcgtaaagtggctgttgaaaaaaatgacttgaaccggccaggagatatgacttttaagctctttgatttctttatccatcctttagatacagccttattcttgacagaagggaccttactaaaagggcattttcaatatcatctggaagcaggcttactgagtcaagttatggtaaccttgatgaccgaaagcatgacgactacagcttctatgaatttacaatcagggagtcgccgtgaggtaatggaagttcaacgggctgaagaaacttatcatttagagaacttagacgagttatctatttataaaggtactgaaaaaagggtgcttggctttgcttcttgggacactaccttgcacaaaagaggttttgaaacaatgatcgatgcctttttagaagctattagcacaggcgtcaatcctgtcagccctgagtctagtcttttaagccactggatttgtcaacagattgctgactctcagctttcttatggagagttaacggtagagttgcctaaggat

SEQ ID NO: 3388 - protein, 313 aa, Streptococcus pyogenes
LSMLNIGIVGLGAISQKAYLPYMRQLSDITWHLSTRNAAVRQQVGQLFGHAILYSDVKELSKTNLDGVFIHAATSAHAELASLFLNQGIPVFMDKPIADNYLMTKNLYDLAKENQTFLMAGFNRRFTPRVKKLSSLSTKRKVAVEKNDLNRPGDMTFKLFDFFIHPLDTALFLTEGTLLKGHFQYHLEAGLLSQVMVTLMTESMTTTASMNLQSGSRREVMEVQRAEETYHLENLDELSIYKGTEKRVLGFASWDTTLHKRGFETMIDAFLEAISTGVNPVSPESSLLSHWICQQIADSQLSYGELTVELPKD

SEQ ID NO: 3389 - DNA, 489 bp, Streptococcus agalactiae
atgaaattacggcgcccagtgttagaagataaagaagaaattttagccatgtataaagagtttcaaaaagaaagtagttcagtggacggtggtttttatgaaccaactatgcattttgaagactggctagatcataacctaaatatggagttaggggtaggcgttcctgataattttgttccatatattcagtttgtgtcttttgacaatgacaataatgctataggtttcttaaatttacgtttaagactaaatgatactcttttagaaaaaggtggacatattggttattccatacgacctcgccagcgtggcaaaggttatgctaaagaacagttgaagctaggaattgagcaagcacatctaaaaaatattaatgaaatacttgtgacatgccatgtagacaatgatgccagcaagtcagtaatattagctaacggtggtgttttagaagattgtcttcatcagacagagcgttattggataacc

SEQ ID NO: 3390 - protein, 163 aa, Streptococcus agalactiae
MKLRRPVLEDKEEILAMYKEFQKESSSVDGGFYEPTMHFEDWLDHNLNMELGVGVPDNFVPYIQFVSFDNDNNAIGFLNLRLRLNDTLLEKGGHIGYSIRPRQRGKGYAKEQLKLGIEQAHLKNINEILVTCHVDNDASKSVILANGGVLEDCLHQTERYWIT

SEQ ID NO: 3391 - DNA, 507 bp, Streptococcus pyogenes
atggaaataagacgaccgactttaaaagataaagacgctgtattgtcaatgattaacgaatttttagagcagaaaagtgctacagatgggttatggcattttaacgtcaatgactttaactatgaaacatggttggaagattccttgcgacaggaaatgggtttgtccagtcaaggagtgcctgctattcaatacgtcgcatttgatgagagaagtcaggctatcgggttcttaaatcttcgtttacggttaaatgagagattacttgaaaaaggtgggcatattggttactctgtccgtcccagccagcgtgggaaaggttatgccaaggagatgcttaaacaagctgtcagctatgcgatttccaagaatatcacgacaattttggtaacttgtgatgagactaatgttgcaagccgagcagttattgtggctaacgtcggtatcttggaagatagtcgaggtggaacggaacgttattggattgaagaacaaagaggcgataag

SEQ ID NO: 3392 - protein, 169 aa, Streptococcus pyogenes
MEIRRPTLKDKDAVLSMINEFLEQKSATDGLWHFNVNDFNYETWLEDSLRQEMGLSSQGVPAIQYVAFDERSQAIGFLNLRLRLNERLLEKGGHIGYSVRPSQRGKGYAKEMLKQAVSYAISKNITTILVTCDETNVASRAVIVANVGILEDSRGGTERYWIEEQRGDK

SEQ ID NO: 3393 - DNA, 615 bp, Streptococcus agalactiae
atgtcagaagaagcaagttggaatactccaaagcctggggagtggaaaagcgaagaattaagtcatggccatatcattgattataaagcttttaattttgtagatggtgaaggtgttagaaactcactctacgtagctggatgtatgttccactgtaaagggtgttataatactgctacatggtcctttcgagccggaatcccttatacaaaagagcttgaagatcaaattatgacagatttagaacaaccttacgtccaaggtttaacgttattaggtggagagccgttcttaaatacaggtattttgttgccacttcttcagcgtatccgacgtgaattgccagaaaaagatatttggtcatggacggggtatacttgggaagaaatgatgctggagactcaagataaattggagatgttatctttgattgatattttagtggatggtaggtttgatcaaagtaagcgaaatttaatgctacaatttagaggatcttcaaatcaaagaatcattgatgtacaaaaatctttaaaagaaggtgaagtcgtgatttgggaaggattaaacgatggtgacaatagttatgaacaagtcaaacgagatgatttactc

SEQ ID NO: 3394 - protein, 205 aa, Streptococcus agalactiae
MSEEASWNTPKPGEWKSEELSHGHIIDYKAFNFVDGEGVRNSLYVAGCMFHCKGCYNTATWSFRAGIPYTKELEDQIMTDLEQPYVQGLTLLGGEPFLNTGILLPLLQRIRRELPEKDIWSWTGYTWEEMMLETQDKLEMLSLIDILVDGRFDQSKRNLMLQFRGSSNQRIIDVQKSLKEGEVVIWEGLNDGDNSYEQVKRDDLL

SEQ ID NO: 3395 - DNA, 615 bp, Streptococcus pyogenes
gtgatggcagaaaagtgttggaataatcctaagccaaaggaatggcaggcagaggagttaagtcaaggccggattattgactataaggcttttaactttgttgatggtgaaggggttcgtaattccctttatgtgtctggttgtttattccattgcaaggggtgttataatgctgcgacttggtcttttaaggcgggaatgccttatacgcaagaacttgaagagcagataatgacggatttggcacagccttatgttcagggactgacacttttaggtggagaaccctttttgaatacgggtatcttaattcctctgattaagcgtattcggcgtgaattgccagaaaaagatatttggtcttggacgggttatacttgggaagaaatgatgcttgaaacaccagacaaactggaaatgctgtccttaattgatattctggtagatggtcgttttgatatcacaaaaaagaacctcatgttgcaatttagaggctcttctaaccagcgaattatcgatgttcaaaagtctttggctgctaaagaagtgattatctgggataagttaaacgatggggaccaaacctttgaacaaattagtcgggaggatttgctt

SEQ ID NO: 3396 - protein, 205 aa, Streptococcus pyogenes
VMAEKCWNNPKPKEWQAEELSQGRIIDYKAFNFVDGEGVRNSLYVSGCLFHCKGCYNAATWSFKAGMPYTQELEEQIMTDLAQPYVQGLTLLGGEPFLNTGILIPLIKRIRRELPEKDIWSWTGYTWEEMMLETPDKLEMLSLIDILVDGRFDITKKNLMLQFRGSSNQRIIDVQKSLAAKEVIIWDKLNDGDQTFEQISREDLL

SEQ ID NO: 3397 - DNA, 729 bp, Streptococcus agalactiae
atgataaaaattttgatcccaactgcaaaagaaatgaaagtgtgtcaaaacattgcatggcctaaactgagtgctcaaacgaaaattataattgattatttttctactttaactgtttcagacttagaggatatctacagaattaatacaagtgcagctcgttgtgaggctcaaagatggcaagattttaaagctaaacaacttactctgaatcctgctattaagttattcaacggtcttatgtaccgcaatatcaaaaggcacaacttatccacaagtgaagcacaatttatggaaaattctgtttttattactagtgctctttatggcatcattcctgctatgacactaatatcccctcatcgtttagattttaacactaaaatcaaaatcaacaataactctcttaaagttttttggcgtgaaaattacgatacttttatgcagtcagatgacattatggtttctttgctttctaatgaatttgaaactgtcttttctcctaaagagcgtcaaaaactaatacatcttaactttattgaagatcgagatggccaattaaaaacccactctaccatatcaaaaaaagcaagaggaaagtgtttaactgctatgatggaaaataattgccaaactctagaacacttaaagcaattacgctttgatggcttctgttatgataatgaactctcagactctaagcaattaacttttgttaaaaaacagact

SEQ ID NO: 3398 - protein, 243 aa, Streptococcus agalactiae
MIKILIPTAKEMKVCQNIAWPKLSAQTKIIIDYFSTLTVSDLEDIYRINTSAARCEAQRWQDFKAKQLTLNPAIKLFNGLMYRNIKRHNLSTSEAQFMENSVFITSALYGIIPAMTLISPHRLDFNTKIKINNNSLKVFWRENYDTFMQSDDIMVSLLSNEFETVFSPKERQKLIHLNFIEDRDGQLKTHSTISKKARGKCLTAMMENNCQTLEHLKQLRFDGFCYDNELSDSKQLTFVKKQT

SEQ ID NO: 3399 - DNA, 729 bp, Streptococcus pyogenes
atgctaacctttttaattccaaccgcaaaagaaatgacgatccctaaggaatctcacccacacctccttccacaagacagccaagccattttaaaaatcatggcagctatgaccacggaggacttggccaaatcatatcgtatcaaagaagagtcagctaaaaaagaacagcaacgctggcaagacatggcctctcaacaaagcttggcttaccctgcctaccaactgttcaatggccttatgtaccgccatatcaagcgcgataagctcactacccaagaacaggcttacctcacccagcaggtttacatcacctcatccttttacggtatcattcccgctaatcatcctatcgcagagcaccgccatgattttcacaccagaataaaaattgaaggacaaagcctcaagtcttactggcggccctgttataatcagtttgccaaagagcatccccaagtgatttcccttttatccagtgaatttgacgatgtcttttccaaagactgtaaacaattgtggataagtcccaagtttatggcagaaaaagagggccaattcaaaacccattccaccatttcaaaaaaggcacgaggtgcatttctcactgcctgtatggaaaataattgccaaactgttgacagccttaaaagccttgtctttgctggtttttactaccatccagacctatcaacagatcatgaatttgtctatatcaaaaaagaggcc

SEQ ID NO: 3400 - protein, 243 aa, Streptococcus pyogenes
MLTFLIPTAKEMTIPKESHPHLLPQDSQAILKIMAAMTTEDLAKSYRIKEESAKKEQQRWQDMASQQSLAYPAYQLFNGLMYRHIKRDKLTTQEQAYLTQQVYITSSFYGIIPANHPIAEHRHDFHTRIKIEGQSLKSYWRPCYNQFAKEHPQVISLLSSEFDDVFSKDCKQLWISPKFMAEKEGQFKTHSTISKKARGAFLTACMENNCQTVDSLKSLVFAGFYYHPDLSTDHEFVYIKKEA

SEQ ID NO: 3401 - DNA, 906 bp, Streptococcus agalactiae
atgaacggtgtaatatgttactatatagtaataataggaggattaactatgtcgtatccatacaaagccaatcattccattgaatcaatcaccttaaaagtaaatgacctcgaaaacctcgtaaacttctatagcgatatcattgggttaactgttattgacaaatcaagcactagagccttactaggggtaaatcaaaaaatccctcttattatccttgaaaaaactgaacttgaaaagcatagtacctatggcctttatcacactgctattttagtaccagatgaataccatctcagtctagctctaaatcatttattatctcagcatatccctctagagggtggagctgaccatggctatagcaatgctatctatctaagtgatcctgaaggtaatggaattgaaatttataatgataaggatatctctatgtgggatatcagagagagtggacaaattattggtattactgaaagactagatattgacaatttacttgacagccttgtcaacgttcctaataattataagctttctgaaaaaactagtattggtcatattcatttgagtgttaaagatgctaagattagctcaaaactctatcaaaatgtttttggccttgatgagaaatttgcaatcccgacagctagttggattgcatccggcaactaccatcatcatctagcctttaataattgggctggtccaaatctttctaaaaaccaagaagatagacccggaatttccttattgacaattgcttacaatgatgacaacctttttagagatagcttaaaaaaagcgcaactttaccaactgactttccttgaaaaacaagatcattattatattattgaagattttgatggcatccgaattaaagttgttctaaaaccagagaat

SEQ ID NO: 3402 - protein, 302 aa, Streptococcus agalactiae
MNGVICYYIVIIGGLTMSYPYKANHSIESITLKVNDLENLVNFYSDIIGLTVIDKSSTRALLGVNQKIPLIILEKTELEKHSTYGLYHTAILVPDEYHLSLALNHLLSQHIPLEGGADHGYSNAIYLSDPEGNGIEIYNDKDISMWDIRESGQIIGITERLDIDNLLDSLVNVPNNYKLSEKTSIGHIHLSVKDAKISSKLYQNVFGLDEKFAIPTASWIASGNYHHHLAFNNWAGPNLSKNQEDRPGISLLTIAYNDDNLFRDSLKKAQLYQLTFLEKQDHYYIIEDFDGIRIKVVLKPEN

SEQ ID NO: 3403 - DNA, 855 bp, Streptococcus pyogenes
atgatatacccttacaactcaaccatctctttaggaacggtttctctaaatgttaccgatctagcaaagatgacaaccttttacacaagtattatcggtttacaggttctctcacaagacacgacatctcgtcaattgactacagacggtaaaaccgttatcttagagttacgacaaacacctttaccaggcgataaagcttatggtctttatcacacagcctttttagttcctgatcgtcatagcttgggacttgttctcaatcatttcttaaccagaagtatctctttagaaggagcagctgatcacggccatagcgaagctatctacctcagcgatcctgagggtaatgggattgaaatttatcatgacaaagctgttgagcattgggatatccgcgacaatggtcaaattattggtgtgactgagcccacggataccaaaagcatattggagcagttgacagatatccccaagcactttttactagctcaagacacacgcattcgccatgtccatctgagtgtcaaaaatgctctggcttcttcacttctctatcaaaaggtttttgatttaggcgataaaatgaccattccaagtgctagctggattgcttcagggaactactatcatcaccttgcattcaatcactggtcagccccttacctcaaaaaacaccaagaaggtgctccaggcttagccttcttgaccattcacattgagacgcccctgcttttttcagccactctcaaaaaagcaagattacacggcctagctattttacaagaagattcttcttctttcacgacagaagacgaggaaggtatccgtgtgaacgtcatccttggacaagac

SEQ ID NO: 3404 - protein, 285 aa, Streptococcus pyogenes
MIYPYNSTISLGTVSLNVTDLAKMTTFYTSIIGLQVLSQDTTSRQLTTDGKTVILELRQTPLPGDKAYGLYHTAFLVPDRHSLGLVLNHFLTRSISLEGAADHGHSEAIYLSDPEGNGIEIYHDKAVEHWDIRDNGQIIGVTEPTDTKSILEQLTDIPKHFLLAQDTRIRHVHLSVKNALASSLLYQKVFDLGDKMTIPSASWIASGNYYHHLAFNHWSAPYLKKHQEGAPGLAFLTIHIETPLLFSATLKKARLHGLAILQEDSSSFTTEDEEGIRVNVILGQD

SEQ ID NO: 3405 - DNA, 822 bp, Streptococcus agalactiae
gtgtacaattatattttggaggataatatggtaaggctaatatttagtgatattgatggtactttaattaacagtaattttaaagtaacacctaagacacggcagggaattaaacaaatagtagctcaaggggctactttcgttcccatatcagctaggatgcctgaggcaattactccgattatggaacaaattggaatagattcttatattatttcctataatggggctttaatacaagatatgcaacaaaaaacaattgcttcccacacaatggatggtcaagttgccttacaagtttgttcttatgtaagcaagcattattcgaaaattgcatggaatgtctatcgttatcatgaatggtattcctgtgataaagaaaatgagtgggtccaaaaagaggaggagattgttggtttacaatctaaagagatgagtttgatggagttagagaagcaagataggattcataaacttctcttgatgggagaaccatctctgatgggagaattggagaacactttgaaagctcaatatccacatttatcaatcgcacaatctgctccttactttattgaaataatggctccaggtattgaaaaaggaaaatctgctaaaactttagcagactatttagatatttctcttgcagactctattgcgtttggtgataactataatgatttaaatctgcttgaaattgtgggtaaaggttttgtcatggggaatgctcctaaagatttacaagagagaattggaaatgtaactcaggataatgataacgatggtatttattatgctttagtagagtatatggaaaat

SEQ ID NO: 3406 - protein, 274 aa, Streptococcus agalactiae
MYNYILEDNMVRLIFSDIDGTLINSNFKVTPKTRQGIKQIVAQGATFVPISARMPEAITPIMEQIGIDSYIISYNGALIQDMQQKTIASHTMDGQVALQVCSYVSKHYSKIAWNVYRYHEWYSCDKENEWVQKEEEIVGLQSKEMSLMELEKQDRIHKLLLMGEPSLMGELENTLKAQYPHLSIAQSAPYFIEIMAPGIEKGKSAKTLADYLDISLADSIAFGDNYNDLNLLEIVGKGFVMGNAPKDLQERIGNVTQDNDNDGIYYALVEYMEN

SEQ ID NO: 3407 - DNA, 807 bp, Streptococcus pyogenes
atgtctatcaaactggttgctgtcgatattgatggcacattactcactgatgaccgtcgaattacagatgatgtttttcaagctgtccaagaggctaaagcccaaggggttcatgtggtgattgctactggcagacctattgccggagtgatttcattactcgaacaattagaactcaaccacaaaggaaaccacgttatcacttttaatggtggcttggtgcaagatgccgagaccggcgaagaaattgttaaagaattgatgacttacgacgattatctggaaacggaatttttgagccgaaaattaggagttcacatgcatgccattaccaaagaaggtatttacactgccaatcggaatattggaaaatacacagttcatgaatcgactttggtaaacatgcctattttctatcgcactcccgaagaaatgaccaataaagaaatcatcaaaatgatgatgattgatgaacctgaccttttggacgcggccatcaagcaaattcctcaacatttctttgataagtacaccatcgtcaagtcaacccctttttatttagagttcatgccaaaaaccgtcagcaagggtaatgccatcaaacacttagctaaaaaactcgggctagatatgtcacaaaccatggccatcggggatgctgaaaatgatcgtgctatgttagaagtcgttgccaaccctgttgtcatggaaaatggggttcctgaattgaaaaaaatagccaaatacatcaccaaatccaacaatgacagtggtgtggcacatgctattcgcaagtgggtattaaac

SEQ ID NO: 3408 - protein, 269 aa, Streptococcus pyogenes
MSIKLVAVDIDGTLLTDDRRITDDVFQAVQEAKAQGVHVVIATGRPIAGVISLLEQLELNHKGNHVITFNGGLVQDAETGEEIVKELMTYDDYLETEFLSRKLGVHMHAITKEGIYTANRNIGKYTVHESTLVNMPIFYRTPEEMTNKEIIKMMMIDEPDLLDAAIKQIPQHFFDKYTIVKSTPFYLEFMPKTVSKGNAIKHLAKKLGLDMSQTMAIGDAENDRAMLEVVANPVVMENGVPELKKIAKYITKSNNDSGVAHAIRKWVLN

SEQ ID NO: 3409 - DNA, 960 bp, Streptococcus agalactiae
atgaaaaaaataacaaagatggtaattagcagcgttttagcaactgttctgatgacagcttgttcacaatcttctcaaaatggtcaatctgatgtaaaacatattggtattttacaatatgtagaacatccctctctaactgccactaggaaaggatttataaaagaattagctaaagaaggctataaagatggcaaaaatatcaaaattgagtataagaatgctcaaggggatcagtcaaatatccaatcaatttctgaaaaactcattaaagataataaattagtattgggaattgcgactccggcggctcaatcgttgacaacggtgtcaacagaaacacctattttatttacagcagtgacagatccggtatcagccgaattagtaaaatcaatgaaaaaacctgaaggtttagcgactggtacaagtgacatgtctccaattaaaaagcaagtatcccttttgagaaaagtaatgcctaaggttaaacgtgttggtattatgtataccactagcgagcgtaactcagaagttcaggtaaaacaagcaaaaaaaatcttccaagaggcggggattaaaacaagtgttaaaggtatttcttccactaatgatgtacaagatactgctaagagtttaatgtctaaaacagaggttatttttgtaccaacagataatattatagccagctcagtaacgctgttagggaatctatcgaaagaattaaaagtgcctgttgtgggaggttcagcagatatggtaccaagtggtttgctcttttcttatggggctgattatgaggctttaggtcgtcaaacggcaagacaagctgttaaaatcctcaaaggtaaagacgtcgctaaagttccttcagaatatcctcaaaatctaaaagtagtagttaatgaagatatggcaaaagagcttggaattgatgtttcaagtattaaaaataataaa

SEQ ID NO: 3410 - protein, 320 aa, Streptococcus agalactiae
MKKITKMVISSVLATVLMTACSQSSQNGQSDVKHIGILQYVEHPSLTATRKGFIKELAKEGYKDGKNIKIEYKNAQGDQSNIQSISEKLIKDNKLVLGIATPAAQSLTTVSTETPILFTAVTDPVSAELVKSMKKPEGLATGTSDMSPIKKQVSLLRKVMPKVKRVGIMYTTSERNSEVQVKQAKKIFQEAGIKTSVKGISSTNDVQDTAKSLMSKTEVIFVPTDNIIASSVTLLGNLSKELKVPVVGGSADMVPSGLLFSYGADYEALGRQTARQAVKILKGKDVAKVPSEYPQNLKVVVNEDMAKELGIDVSSIKNNK

SEQ ID NO: 3411 - DNA, 894 bp, Streptococcus agalactiae
atgttagatattatcttatccggaatttcgcaaggattactttggtcaattatggcaattggcgtgtttatcacttttcgtatcttagacatagccgatctctctgcagagggtgctttccctatgggggctgcagtttgcgctttatgtatcgttaatgatattaatccaattgtggcaaccatagcgggcatgttaggtggtatgttggcaggactagtatcgggttttcttcatactaaaatgaaaataccagccctcctcacaggtattattacgttgacaggactttactctattaatttacttgttttaggaagatcaaacgtctcttttgctctcaaaaatactttggttacaatggtaacaagattaggtttaaataaactttcagcagttttattaattggaattgtttgtgtaggcttggttatcttaattttgtatctctttttaaatacccaactaggattagctttaagagcgacaggtgataatgaggctatgggacaagccaatagtattaaagtagatcggatgaaaatgctaggatatatgattgggaatggcctgattgctttatctggtgcacttttagcgcaaaataatggctatgcagatttgaatatgggagtgggtacaatcgttattggattagcttcaattatcttggcagaagtaatgataaaatacttacctcttggcaaaaggttatggtcaattgtattagggtctgttttataccgtatgattattgttttcatattaacaaccgatattgatgcacagatgataaagttggtttcagcaattttgttggctctcattttgtatgtcccagaattacgagctaaactaggagtaaaaacctctaaatcacttacaaaggaagga

SEQ ID NO: 3412 - protein, 298 aa, Streptococcus agalactiae
MLDIILSGISQGLLWSIMAIGVFITFRILDIADLSAEGAFPMGAAVCALCIVNDINPIVATIAGMLGGMLAGLVSGFLHTKMKIPALLTGIITLTGLYSINLLVLGRSNVSFALKNTLVTMVTRLGLNKLSAVLLIGIVCVGLVILILYLFLNTQLGLALRATGDNEAMGQANSIKVDRMKMLGYMIGNGLIALSGALLAQNNGYADLNMGVGTIVIGLASIILAEVMIKYLPLGKRLWSIVLGSVLYRMIIVFILTTDIDAQMIKLVSAILLALILYVPELRAKLGVKTSKSLTKEG

SEQ ID NO: 3413 - DNA, 801 bp, Streptococcus agalactiae
atgtcattacttgaattagtcaatctgcacaaaacttttgaaaaaggaactgtcaatgagaaccatgttttacgtggtttagatttaacgattgaagacggtgattttatttcagtaattggaggtaacggtgcgggaaaatcaaccctccttaactgtatcgctggtctgatccctattgatcagggggcaatcacattagacaaccaatcaattactaaagactctgtagaaaaacgatctaaggatattagtcgagtcttccaggatcctagaatgggaactgcaacaaatttgacgattgaagaaaatatggcaattgcacataaaagaggcaataagcgtcacatttttagacagtcagtgactgacgatgaccgtcaactatttaaaaagtctctatcacaattaggtctaggcttagaaaatcgaatgaagactgatgctgcatttttatctggcggtcagcgtcaagccctcacgttagctatggcaactcttgttcgtcccaaattattattactggatgaacatacagcggctctagatcccaaaactagcgatatggttatggaattaacacagaaagtgatagaagaacaacgattgacagccttaatgattacgcacaatatggagcatgccattgcttatggtaatcgtctcgtgatgctctaccacgggaaaattgttgttgatgttaaaggagaagcaaagagaaacttaacagttgcagaattaatggaacttttccataaaaactcaggtcaacagttgatagatgatgcccttgtcttaggt

SEQ ID NO: 3414 - protein, 267 aa, Streptococcus agalactiae
MSLLELVNLHKTFEKGTVNENHVLRGLDLTIEDGDFISVIGGNGAGKSTLLNCIAGLIPIDQGAITLDNQSITKDSVEKRSKDISRVFQDPRMGTATNLTIEENMAIAHKRGNKRHIFRQSVTDDDRQLFKKSLSQLGLGLENRMKTDAAFLSGGQRQALTLAMATLVRPKLLLLDEHTAALDPKTSDMVMELTQKVIEEQRLTALMITHNMEHAIAYGNRLVMLYHGKIVVDVKGEAKRNLTVAELMELFHKNSGQQLIDDALVLG

SEQ ID NO: 3415 - DNA, 1008 bp, Streptococcus agalactiae
atgggtatcggtattattattgccagccatggtaaatttgctgaaggtattcatcaatcaggttcaatgatctttggtgaacaagaaaaagttcaagttgtaactttcatgccaaatgaaggaccagatgatttgtatggacacttcaacaatgctatcgcacaatttgatgctgatgatgaggtgcttgtgttagctgacctttggagtgggtcaccatttaaccaagcaagccgtgttatgggagaaaatcctgaacgtaaaatggctatcatcactggtctcaatttgccaatgcttatccaagcctatactgagcgtatgatggacgctaatgcaggtgttgaacaagttgccgcaaatattattaaagagtctaaggaaggtatcaaagcccttccagaagaacttaatcctgttgtagaagctactcctgtagcaggtgttcctgcagatgttcctgcggaagttaaacaaagtggatctatccctgaaggaactgttattggagatggcaagcttaaaattaatcttgctcgtattgacacacgtcttttacatggtcaagttgcaactgcatggactccagcatcaaaagcaaaccgtattatcgttgcttctgatgaagtttctaaagatgaacttcgtaaacaattgattaagcaagctgctcctggaggagtcaaagcaaacgttgtcccaattagtaaattaattgaagtagctaaagacccacgtttcggaaacacacgtgccttgatcttatttgaaactgtacaagatgcactccgtgcaattgaaggtggtgtggaaatccctgaattgaacgttggttcaatggctcactcaactggtaaaacaatggtaaacaacgttctttcaatggataaagacgatgttgctgcctttgaaaaattacgtgacttaggtgtatcatttgatgtacgtaaagtaccaaatgacgctaaaaagaatttgtttgatttaatcaacaaagcaaacgtaaaa

SEQ ID NO: 3416 - protein, 336 aa, Streptococcus agalactiae
MGIGIIIASHGKFAEGIHQSGSMIFGEQEKVQVVTFMPNEGPDDLYGHFNNAIAQFDADDEVLVLADLWSGSPFNQASRVMGENPERKMAIITGLNLPMLIQAYTERMMDANAGVEQVAANIIKESKEGIKALPEELNPVVEATPVAGVPADVPAEVKQSGSIPEGTVIGDGKLKINLARIDTRLLHGQVATAWTPASKANRIIVASDEVSKDELRKQLIKQAAPGGVKANVVPISKLIEVAKDPRFGNTRALILFETVQDALRAIEGGVEIPELNVGSMAHSTGKTMVNNVLSMDKDDVAAFEKLRDLGVSFDVRKVPNDAKKNLFDLINKANVK

SEQ ID NO: 3417 - DNA, 990 bp, Streptococcus pyogenes
atgggtatcggtattattattgccagccatggtaaatttgctgaaggtattcatcaatctggttctatgatttttggtgaacaagagaaagttcaagttgttactttcatgccaaacgaaggaccagatgatttgtatggacacttcaacaatgctatccaacaatttgatgctgatgatgaaatccttgtgctagctgacctttggagtggttctccatttaaccaagctagtcgtgtggcaggtgaaaatcctgaccgcaaaatggcgatcatcactggtctcaacttgcctatgcttattcaagcttacactgaacgtcttatggatgctggtgcaggtgttgaacaagttgctgcaaacatcattaaggaatctaaggacggtatcaaagcccttcctgaagaccttaacccagttgaagaaactgctgcaactgaaaaagttgttaacgcacttcaaggagctattcctgctggaactgtcatcggagatggtaaattaaagatcaatcttgctcgtgttgacactcgtcttttacacggtcaagttgcaacagcatggactccagcttctaaggctgaccgtatcattgttgcttctgatgaggttgctcaagatgaccttcgcaaacaattgatcaaacaggctgcacctggtggtgtcaaagctaacgttgttccaattagcaaattgattgaagcttctaaagatcctcgttttggtaacacacacgcacttattcttttccaaacccctcaagatgcccttcgagcggttgaaggtggtgttgaaatcaacgaattgaacgttggttcaatggctcactcaactggtaaaacaatggttaacaacgttttatcaatggacaaagaagacgttgctacttttgaaaaattacgcgacctaggtgttacattcgacgtccgtaaagttcctaacgattctaagaaaaacttatttgagcttatccaaaaaactaacattaaa

SEQ ID NO: 3418 - protein, 330 aa, Streptococcus pyogenes
MGIGIIIASHGKFAEGIHQSGSMIFGEQEKVQVVTFMPNEGPDDLYGHFNNAIQQFDADDEILVLADLWSGSPFNQASRVAGENPDRKMAIITGLNLPMLIQAYTERLMDAGAGVEQVAANIIKESKDGIKALPEDLNPVEETAATEKVVNALQGAIPAGTVIGDGKLKINLARVDTRLLHGQVATAWTPASKADRIIVASDEVAQDDLRKQLIKQAAPGGVKANVVPISKLIEASKDPRFGNTHALILFQTPQDALRAVEGGVEINELNVGSMAHSTGKTMVNNVLSMDKEDVATFEKLRDLGVTFDVRKVPNDSKKNLFELIQKTNIK

SEQ ID NO: 3419 - DNA, 810 bp, Streptococcus agalactiae
atgacaaagaaaattatcgccgtagatttagacggtactctattacataataataacactatttctgactacaccgctgatacacttcgaaaagttcaagctcaaggacacaaagtaattattacaaccggacgcccataccgtatggcactcgctcattatttacgcctagatttaaaaacaccaatgataaattttaatggtgctttaactcatatccccgaaaaaaagtgggcgtttgagcgtagtgcaacgattgataaaaaattactccttgaaaccttaaatttatcagatgctatccaagccgattttattgctagcgaataccgtaaaaatttttacattactatggataatcgtgataaaattaacccacaattattcggtgtcaatgaaattactgataaaatggcattagatgttactaaaatcacacgcaatccaaatgctctattgatgcaaacacgtcataaagataagtatgagttagctaaagagttacgacaacattttaatcacgaactagaagtagattcttggggtggtccattgaatatactcgaattttcacctaaaggtgttaacaaagcttatgctctcaaacatttattaaaatcactcaatctttcacaagaaaatttgattgcctttggagatgaacacaatgacaccgagatgctggcctttgcacatacaggatatgctatgaaaaatgctaatccaactctacttccatatgccgaccaacaaatccaatggacaaacgaagaagatggtgttgctaaaactctagaaaaattattattg

SEQ ID NO: 3420 - protein, 270 aa, Streptococcus agalactiae
MTKKIIAVDLDGTLLHNNNTISDYTADTLRKVQAQGHKVIITTGRPYRMALAHYLRLDLKTPMINFNGALTHIPEKKWAFERSATIDKKLLLETLNLSDAIQADFIASEYRKNFYITMDNRDKINPQLFGVNEITDKMALDVTKITRNPNALLMQTRHKDKYELAKELRQHFNHELEVDSWGGPLNILEFSPKGVNKAYALKHLLKSLNLSQENLIAFGDEHNDTEMLAFAHTGYAMKNANPTLLPYADQQIQWTNEEDGVAKTLEKLLL

SEQ ID NO: 3421 - DNA, 810 bp, Streptococcus pyogenes
atgactaaaaaattgattgccattgatttggatggaaccttattacatcatgacaacaccatctctacctatactcaaaaaaccatcaaagctgtccaagacaagggccaccacgtcattatttcaacaggccgtccttaccgcatggcactgggctactatctgcagctcaatttaaagaccccaatcatcacttttaatggggccttgacccacatgcctgaacaaaaatgggcctatgaacataatgtcactttggacaaaggctacctactaaggttactaaaatatcaggatgatttccagatggattttattgccagtgagtatcgaaaaaatgtctacatcaccatgaccaatccagaaagtatcgacccgcaactctttggtgttgatgaaattactcaggacatggcattagagattaccaaaatcactcgaaatccaaacgccttattgatgcaaacgcatcacgaagacaagtatgccttagctaaaaacatgcgtgcttgcttcaaagatgaaattgaaattgattcttggggaggccctctcaacattcttgaaatttcgtctaagaatgtcaataaagcttacgctctgaactatctccttggaatttacaatatggataaaaaggatttaatcgcctttggtgatgaacacaatgacactgagatgctagcttttgctggaactggttatgctatgaaaaatgctagccctgtgctactgccttatgctgatcagcagcttaatttttccaacgaagaagacggtgttgccaaaaaattggaagaacttttcttg

SEQ ID NO: 3422 - protein, 270 aa, Streptococcus pyogenes
MTKKLIAIDLDGTLLHHDNTISTYTQKTIKAVQDKGHHVIISTGRPYRMALGYYLQLNLKTPIITFNGALTHMPEQKWAYEHNVTLDKGYLLRLLKYQDDFQMDFIASEYRKNVYITMTNPESIDPQLFGVDEITQDMALEITKITRNPNALLMQTHHEDKYALAKNMRACFKDEIEIDSWGGPLNILEISSKNVNKAYALNYLLGIYNMDKKDLIAFGDEHNDTEMLAFAGTGYAMKNASPVLLPYADQQLNFSNEEDGVAKKLEELFL

SEQ ID NO: 3423 - DNA, 582 bp, Streptococcus agalactiae
atgaaaaagttaatttggagtcatctttttgccatagtcagtattttagggatatggtattatcatgtaaaaattgatcatttgatggtaattctattggcatcagtcttgtcgttagagatgggattcattgcttattatagtcgtaatatttttattcgtcttttagcaagtttaggtcttttatttttttacccacagagtttagggatttttcttagtttggtgagcttagagtggtcaacaaaagacatttggcagtctaatcactttatgcaatatatggcataccttcttgcaattctttttattatctcttcagctttactaagcttgaagctattggtaaatgcatatgatattagtaaaaggtatcaattagcaactgttatacctgtaatgctttttagtagttttgccttttgcttagaaaaatcaggatcattaggtttagaaggaatcattttaaatccgtcagcattttttaatggaatacagactaatatggctaaccttgattttaaagccttgtcttgcctttttttagtacaattattactttggggaatattaatggaagac

SEQ ID NO: 3424 - protein, 194 aa, Streptococcus agalactiae
MKKLIWSHLFAIVSILGIWYYHVKIDHLMVILLASVLSLEMGFIAYYSRNIFIRLLASLGLLFFYPQSLGIFLSLVSLEWSTKDIWQSNHFMQYMAYLLAILFIISSALLSLKLLVNAYDISKRYQLATVIPVMLFSSFAFCLEKSGSLGLEGIILNPSAFFNGIQTNMANLDFKALSCLFLVQLLLWGILMED

SEQ ID NO: 3425 - DNA, 108 bp, Streptococcus agalactiae
atggggaattattggaattgtatcattagtttcaagttttggtattcatattggtcgttatgcccgtctaaattcatgggatatcttaacgaagccacaagtggtaat

SEQ ID NO: 3426 - protein, 36 aa, Streptococcus agalactiae
MGNYWNCIISFKFWYSYWSLCPSKFMGYLNEATSGN

SEQ ID NO: 3427 - DNA, 621 bp, Streptococcus agalactiae
ttggaggttagaatgaaagtaaaactatttgcgatacatctattttttattgttatttcttttgggattaaatattatcatttgcagggaccaaatttgatttggaatatgactctagccctaatagcgttagattttgcataccttactagtttatttaagaaaaaaattcttatcggtctttttgcacttgcttggttttttttctatcctaataccttttatatgttgacggatatcattcatatgcattttgtcggagacgttctttataataagacaaatttaatactttatatcttgtatgtatctagtatcttgtttggttttttatcaggtatcgaaagtttttctgtgattatgcgtaaatttagaattagcaatatatttttaagatggggaattattggaattgtatcattagtttcaagttttggtattcatattggtcgttatgcccgtctaaattcatgggatatcttaacgaagccacaagtggtaattaacgaacttttagcggttccgagtagggattcattccactttattttaggatttacatttttacaggtattgtgtcttatttttatggattattctgcagggaaaaagcttgaaaag

SEQ ID NO: 3428 - protein, 207 aa, Streptococcus agalactiae
MEVRMKVKLFAIHLFFIVISFGIKYYHLQGPNLIWNMTLALIALDFAYLTSLFKKKILIGLFALAWFFFYPNTFYMLTDIIHMHFVGDVLYNKTNLILYILYVSSILFGFLSGIESFSVIMRKFRISNIFLRWGIIGIVSLVSSFGIHIGRYARLNSWDILTKPQVVINELLAVPSRDSFHFILGFTFLQVLCLIFMDYSAGKKLEK

SEQ ID NO: 3429 - DNA, 678 bp, Streptococcus agalactiae
atgagcgttccaatggtatcaaaaatatcagtcagtgaaaaagcaagaatggccattaatacacttggtagacgtgaaggattagaaaataaagaaattaatcctttctctcctaatgcaactccaaatacttgcttcaaatctctaaaagaggccgagaggttagttgcttcccaattaatagcatctaacttaaccactcccattaaaatacctaagagggtcgttgttaatatcgatagaataatccctccacggataccctttacaataaagaagatggtaatgcttaaaccaatcaaagataataaaatggctggattatcaaacgacactagccctggcgttgctgaagaatttgctgtaatagtagccaatcctttcgcagcaccctttccaacaacatcatacgtcccaggatcaattgaaaatttcaaaaaaccagcatttttaatcccaacgtatgctaaaaaagttccgattcctgctgtaatggctgattttaaagttgttgggatagactcaataatcatctttctaactttcgttaaagtaataatcagagaaatcaaaccacaaataaataccatagctaaggcttcttgccatgtatatcccaatgcaaagacaactgtatatgtaaagaaagcatttaatcccatcccaggagcttgtgca

SEQ ID NO: 3430 - protein, 226 aa, Streptococcus agalactiae
MSVPMVSKISVSEKARMAINTLGRREGLENKEINPFSPNATPNTCFKSLKEAERLVASQLIASNLTTPIKIPKRVVVNIDRIIPPRIPFTIKKMVMLKPIKDNKMAGLSNDTSPGVAEEFAVIVANPFAAPFPTTSYVPGSIENFKKPAFLIPTYAKKVPIPAVMADFKVVGIDSIIIFLTFVKVIIREIKPQINTIAKASCHVYPNAKTTVYVKKAFNPIPGACA

SEQ ID NO: 3431 - DNA, 1419 bp, Streptococcus agalactiae
atggaaaagttttttaagctaaaggaacacgggacgacaattcggactgaaatcactgctggtctaacgactttctttgcaatgtcgtacattttgtttgtaaatccagctattttatctcagactgggatgccagcacaaggagttttcttagcgacgattattggtgccgttgtagctacatctgttatggctttctatgctaaccttccctatgcacaagctcctgggatgggattaaatgctttctttacatatacagttgtctttgcattgggatatacatggcaagaagccttagctatggtatttatttgtggtttgatttctctgattattactttaacgaaagttagaaagatgattattgagtctatcccaacaactttaaaatcagccattacagcaggaatcggaacttttttagcatacgttgggattaaaaatgctggttttttgaaattttcaattgatcctgggacgtatgatgttgttggaaagggtgctgcgaaaggattggctactattacagcaaattcttcagcaacgccagggctagtgtcgtttgataatccagccattttattatctttgattggtttaagcattaccatcttctttattgtaaagggtatccgtggagggattattctatcgatattaacaacgaccctcttaggtattttaatgggagtggttaagttagatgctattaattgggaagcaactaacctctcggcctcttttagagatttgaagcaagtatttggagttgcattaggagagaaaggattaatttctttattttctaatccttcacgtctaccaagtgtattaatggccattcttgctttttcactgactgatatttttgataccattggaacgctcattggtaccggagaaaaagttggtatcttagcaacgactggtgataatcatgaatctaagagtttagacaaagcactctattcagacttaattgggacaacttttggtgctatttgtggaacatctaacgttacaacctatgttgagtcagcagcaggaatcggagctggtggtcgtacaggattgacagccttagtagttgctggtttgtttgctatatctagtttttttagtccactagtatctatcgttccgagtcaagctactgcaccaatattggttattgttggtattatgatgctttcaaatttaaaagatatcaaatgggatgatatgtcagaagctatcccagctttctttacttctctttttatggggtttacttatagcattacttatggtattgcagctggtttcttgacctatacactagctaaagtcatcaaaggacaagcaaaagatattcatgtggtactgtggattttagatatattatttattctaaactttatcagcttggctattttg

SEQ ID NO: 3432 - protein, 473 aa, Streptococcus agalactiae
MEKFFKLKEHGTTIRTEITAGLTTFFAMSYILFVNPAILSQTGMPAQGVFLATIIGAVVATSVMAFYANLPYAQAPGMGLNAFFTYTVVFALGYTWQEALAMVFICGLISLIITLTKVRKMIIESIPTTLKSAITAGIGTFLAYVGIKNAGFLKFSIDPGTYDVVGKGAAKGLATITANSSATPGLVSFDNPAILLSLIGLSITIFFIVKGIRGGIILSILTTTLLGILMGVVKLDAINWEATNLSASFRDLKQVFGVALGEKGLISLFSNPSRLPSVLMAILAFSLTDIFDTIGTLIGTGEKVGILATTGDNHESKSLDKALYSDLIGTTFGAICGTSNVTTYVESAAGIGAGGRTGLTALVVAGLFAISSFFSPLVSIVPSQATAPILVIVGIMMLSNLKDIKWDDMSEAIPAFFTSLFMGFTYSITYGIAAGFLTYTLAKVIKGQAKDIHVVLWILDILFILNFISLAIL

SEQ ID NO: 3433 - DNA, 1458 bp, Streptococcus pyogenes
atggaaaagttttttaagttaagcgaaaatgggacaactgtctcaactgagattatggctggtttaacgaccttttttgccatgtcctatattttgtttgttaacccaagtattttaggtgcagcggggatgccctctaatgctgtctttttggctacgattatcgcagcagccatatcaaccttaattatgggactatttgccaatgtgccttatgcgttggcaccaggaatgggacttaacgcttttttcacttatacagttgtttttgctttaaggttttcatggcaagaagccttggcaatggttttcatttgtggattattcaatatttttattaccgtaaccaagtttcgtaaaagtatcatcaaggcgattccagttagtttacagcatgctattggtgggggaattggtgtctttgtagcttatttaggatttaaaaacgcaaatatcattactttttctatctctgctgaaaatatagtaatggtaaatggtgttgaaccggctaaagcatcggctaaaacatttgcagatggtctattatttgtagacgccaatggtggagttgtacctacgatttctagttttacggattccggtgtattacttgctatttttggtttacttttgacgacagctcttgtgattcgaaattttagaggtgctattttaattggtattgtcgcaacaactcttgtaggtattcctttaggaatagtggatgtgtccaacctcaattttgggatcagccatattggtgaagcttggactgaattaggtacaactttccttgcagctttcgatggtttgagttctctttttagcgattcaagtcgtttaccgctagttttcatgactatttttgcttttagtctatcagatacttttgacacaattggtacctttatcggaactggtcgtcgaacaggtattttctctcaagacgatgagaatgctttggaaaatagtataggctttagttcaaaaatggaccgtgcgctttttgcagatgctatcggtacttctattggggctttggttggaacttcaaatacgactacctatgttgaatcagcagcaggaattgctgaaggtggacgtactggactaacagcagtctccaccgcagtatgcttcttattatcaatattgctattaccgcttgtaggtattgtcccagctgctgctacggctccagctttaattattgtgggtgtcatgatggtgtcttcttttcttgatgttaattggagtaaatttgcagatgctcttccagctttttttgcagctttctttatggcgctgtgttactctatttcctatggtattgccgctgcctttattttctattgtctagtaaaagttgttgagggaaaaacaaaagatattcaccctattatttggggagcaaccttcttgttcattgtaaatttcatcatattaactatctta

SEQ ID NO: 3434 - protein, 486 aa, Streptococcus pyogenes
MEKFFKLSENGTTVSTEIMAGLTTFFAMSYILFVNPSILGAAGMPSNAVFLATIIAAAISTLIMGLFANVPYALAPGMGLNAFFTYTVVFALRFSWQEALAMVFICGLFNIFITVTKFRKSIIKAIPVSLQHAIGGGIGVFVAYLGFKNANIITFSISAENIVMVNGVEPAKASAKTFADGLLFVDANGGVVPTISSFTDSGVLLAIFGLLLTTALVIRNFRGAILIGIVATTLVGIPLGIVDVSNLNFGISHIGEAWTELGTTFLAAFDGLSSLFSDSSRLPLVFMTIFAFSLSDTFDTIGTFIGTGRRTGIFSQDDENALENSIGFSSKMDRALFADAIGTSIGALVGTSNTTTYVESAAGIAEGGRTGLTAVSTAVCFLLSILLLPLVGIVPAAATAPALIIVGVMMVSSFLDVNWSKFADALPAFFAAFFMALCYSISYGIAAAFIFYCLVKVVEGKTKDIHPIIWGATFLFIVNFIILTIL

SEQ ID NO: 3435 - DNA, 519 bp, Streptococcus agalactiae
gtgaagaaatatatgctatggggctgtcagaatcagcaaactgttggaagacagagatatttctggtataatatctctatgttttatactcaaaatgaagaagagcttattgccctagggcaaaaactgggtactgttttaaagtcaggagatatcgtattattgactggtaatttaggtgcaggcaaaacaactcttacaaaaggtattgcaaagggattagacataaaacaaatgattaagagcccaacttacactattgttagagaatatgaagggcgtgtaccactttaccatttggatgtttatcgtattggagatgatcctgattctattgacttagatgacttcttgtttggtcaaggagtaacagttattgaatggggagagttgcttagtgataaccttatcaataactacttagaaattgttattacgaggagcaatcaaggacgtcaggttcagttagaagcttatgggcatcgcgcaagagaaattattgaggcgattcaagatgtc

SEQ ID NO: 3436 - protein, 173 aa, Streptococcus agalactiae
MKKYMLWGCQNQQTVGRQRYFWYNISMFYTQNEEELIALGQKLGTVLKSGDIVLLTGNLGAGKTTLTKGIAKGLDIKQMIKSPTYTIVREYEGRVPLYHLDVYRIGDDPDSIDLDDFLFGQGVTVIEWGELLSDNLINNYLEIVITRSNQGRQVQLEAYGHRAREIIEAIQDV

SEQ ID NO: 3437 - DNA, 459 bp, Streptococcus pyogenes
atgttttatagtgaaaatgaatatactcttaaagcttacggagaaaccctaggtacttatttgtctattggagatgtgattgtattgtctggcgacttaggtgccggtaaaacaacattggcaaaaggtattgctaaagggatggggattagtcaaatgatcaaaagcccaacttatactattgttagagaatatgaaggacgtctacctctttatcacttagatatttaccgtgttggtgatgatccagactctattgatttagatgattttctttttggtaatggtgttaccgttattgagtggggagaattattaggagagggattattacaagactatttgcaaattaccattactaaacgagacaaaggtcgtcaactagacttgttagcgcatggtgagcgctctcgtcagcttctggagataatgtcacatggttcagcaaagtctcgttat

SEQ ID NO: 3438 - protein, 153 aa, Streptococcus pyogenes
MFYSENEYTLKAYGETLGTYLSIGDVIVLSGDLGAGKTTLAKGIAKGMGISQMIKSPTYTIVREYEGRLPLYHLDIYRVGDDPDSIDLDDFLFGNGVTVIEWGELLGEGLLQDYLQITITKRDKGRQLDLLAHGERSRQLLEIMSHGSAKSRY

SEQ ID NO: 3439 - DNA, 558 bp, Streptococcus agalactiae
atgggcatcgcgcaagagaaattattgaggcgattcaagatgtctaaacaatttgctgttgattttatagaagcttcgagagaggaagcatctgcgatccttgaatttttaaatactgttactgaggaaacagattttattttgcatacggtgagcaatcaactatctttgtcagaaatggaaacgtttattgaaaataccttaatgacgaaaaattgcatttgtttgattgctaaattaaaaaataaagtgatcggcttgataacaatcattagtcagtctgatattgaaattgaacacgttggggatctttttattgccgttcagaaggattattggggatatggtattggtcatattctcatggaagaagcaatagaatgggcgtcagataacgatattacacgccgcttagaactatcagtccaaggacgtaatgaacgtgctattcacctctaccaaaaattcggttttgaaatagatgggcttcaaacaagaggtattaaaagagaaaatggagaatttctagacatttacagaatgagtaagttgatagat

SEQ ID NO: 3440 - protein, 186 aa, Streptococcus agalactiae
MGIAQEKLLRRFKMSKQFAVDFIEASREEASAILEFLNTVTEETDFILHTVSNQLSLSEMETFIENTLMTKNCICLIAKLKNKVIGLITIISQSDIEIEHVGDLFIAVQKDYWGYGIGHILMEEAIEWASDNDITRRLELSVQGRNERAIHLYQKFGFEIDGLQTRGIKRENGEFLDIYRMSKLID

SEQ ID NO: 3441 - DNA, 1305 bp, Streptococcus agalactiae
atgaaaatttggaaaaaaataaccttaatgttttctgcaattattttaacaacagtaattgcattgggagtctatgttgcctcagcttataatttttcgactaatgaattgtctaagacttttaaagattttaagctagctaaatcaaaaagtcatgctattgaagaaacaaagccgttttcaatactattaatgggggtggacacaggttcagagcatcgaaaatctaagtggtcaggaaatagcgattctatgatcttagtcactataaatcctaaaactaataaaacaacgatgacaagcttagaacgtgacgtattgattaaattgagtggtcccaaaaataatggacagactggagtagaagcaaagctaaatgcagcctatgcttctggtggtgcggaaatggcattgatgactgttcaagacttattagatattaatgttgattactttatgcaaattaatatgcaaggattagttgatttagtcaatgctgttggtggtataacagtaactaataaatttgactttccaatatcaattgctgccaatgaaccagagtacaaggctgttgttgaaccagggacacataaaataaatggagaacaagcacttgtttattctcgtatgcgctatgatgatccagagggagattatgggcgtcaaaaaagacaacgtgaagtaattcaaaaagtccttaaaaaaatattggcgttaaatagtattagttcatacaaaaaaattctttccgcagtaagtaataacatgcaaactaatattgagatatcatcaaaaacgattcctaatttgttagcttataaagattcattggaacatattaaatcttatcagttgaagggtgaagacgctactttatcagatggtggctcttatcaaattttaactaagaaacatctacttgcagttcaaaatagaattaagaaagaactggataaaaagcgtagtaaaactctgaagacaagcgcgattctatatgaagattactatggtactactgctagtaatgattcttctacttattcatcaacacaagagaataattataatacaacaccttattcagaagcaccaccaagttacagtggtaatactacttatagttctgagactaatcaaacaactcatcaaaattactataatagtagcactcctgctagtaactatagcagtaacactaacacaggtcaggctgattcaagtggaagtgtcaataatcataacggggctgcaacgcctaatccaaacacaggaacgcaaccagtaccaggtcaaactaatcca

SEQ ID NO: 3442 - protein, 435 aa, Streptococcus agalactiae
MKIWKKITLMFSAIILTTVIALGVYVASAYNFSTNELSKTFKDFKLAKSKSHAIEETKPFSILLMGVDTGSEHRKSKWSGNSDSMILVTINPKTNKTTMTSLERDVLIKLSGPKNNGQTGVEAKLNAAYASGGAEMALMTVQDLLDINVDYFMQINMQGLVDLVNAVGGITVTNKFDFPISIAANEPEYKAVVEPGTHKINGEQALVYSRMRYDDPEGDYGRQKRQREVIQKVLKKILALNSISSYKKILSAVSNNMQTNIEISSKTIPNLLAYKDSLEHIKSYQLKGEDATLSDGGSYQILTKKHLLAVQNRIKKELDKKRSKTLKTSAILYEDYYGTTASNDSSTYSSTQENNYNTTPYSEAPPSYSGNTTYSSETNQTTHQNYYNSSTPASNYSSNTNTGQADSSGSVNNHNGAATPNPNTGTQPVPGQTNP

SEQ ID NO: 3443 - DNA, 294 bp, Streptococcus agalactiae
atgaaaataggtcgtttaattgcactaggtttagttagtttaggagcgcttgaactttacaaaaatagaaaaactatcaaggattcctatcaaaatacaaaaaatgagacagattcagctaaattaaaattagaacgtatcaaaaatgatcttgctattattagtcaggaaaaagaaaaaatcagattaatttctcaagaactcaatcataaattccaagtgtttaataaagatattcaacctcgtttagaagaaattaatcaacgcatggctaaatatcaagagaaagacgaa

SEQ ID NO: 3444 - protein, 98 aa, Streptococcus agalactiae
MKIGRLIALGLVSLGALELYKNRKTIKDSYQNTKNETDSAKLKLERIKNDLAIISQEKEKIRLISQELNHKFQVFNKDIQPRLEEINQRMAKYQEKDE

SEQ ID NO: 3445 - DNA, 354 bp, Streptococcus pyogenes
atgaaagttaaaaccgtgatagccgtcggattattatcttttaccgcttacaaagcatatcaaaaacgttgtaccataaaagagctgttatccatcagtagacaagcaaaagatgctgcccaacttgatttagataacattaaagcaaaccttgacctcattcacagtcaaggaaaagtaattcaaaatattagtcaggacttggcccataaatggcgctactttaaccaagagacacaagcacacctcactgaaatccaaaatcgtatggccaaatatcaagaagatagtgagctaatttctagtgaatcacctacttgccaaaccgtcattttaactaacaaccattccaga

SEQ ID NO: 3446 - protein, 118 aa, Streptococcus pyogenes
MKVKTVIAVGLLSFTAYKAYQKRCTIKELLSISRQAKDAAQLDLDNIKANLDLIHSQGKVIQNISQDLAHKWRYFNQETQAHLTEIQNRMAKYQEDSELISSESPTCQTVILTNNHSR

SEQ ID NO: 3447 - DNA, 417 bp, Streptococcus agalactiae
atggataattgtattttttgtaaaatcatcagtggagaaatcccttcatcaaaagtttatgaagatgatgaagtattagcttttctcgacattacacaaactacgaccgggcacacccttcttattcctaaaaaacatgttcgaaatgtgttagagatggatgaaaaaactgcacagataacctttgaacgcttgcctaaagtggcgcgtgctgtccaagctgctacaaaagccaaaggaatgaatattattaacaacaatgaggaaattgctggacaaactgtttttcatgcacacgtccaccttgttccccgctttgatgaatcagacggtatcaaaattcactacactactcatgaacccgactttgaggcacttgcaaaattagccaaagaaattagaaaagagattcaatta

SEQ ID NO: 3448 - protein, 139 aa, Streptococcus agalactiae
MDNCIFCKIISGEIPSSKVYEDDEVLAFLDITQTTTGHTLLIPKKHVRNVLEMDEKTAQITFERLPKVARAVQAATKAKGMNIINNNEEIAGQTVFHAHVHLVPRFDESDGIKIHYTTHEPDFEALAKLAKEIRKEIQL

SEQ ID NO: 3449 - DNA, 417 bp, Streptococcus pyogenes
atggaaaattgtattttttgcagcatcattcaaggggatatcccctcttcgaaagtctacgaagatgagcaggtcctcgcctttttagatatctcacaaactacaaaagggcatactctagtcattcctaagcaacatgttcgtaacttactagagatgactgctgagacagctagtcatctctttgctcgtattcctaaaattgctcgtgctatccagtcagctactggcgctactgccatgaatatcattaacaataacgaagccttagcgggacaaactgttttccatgctcatgttcatctcgttcctcgttataatgaagaagacggtatctcaattcaatacaccactcatgagcctgactttcctgtcttggaaaagctcgcccgacaaatcaatcaggaggttagttca

SEQ ID NO: 3450 - protein, 139 aa, Streptococcus pyogenes
MENCIFCSIIQGDIPSSKVYEDEQVLAFLDISQTTKGHTLVIPKQHVRNLLEMTAETASHLFARIPKIARAIQSATGATAMNIINNNEALAGQTVFHAHVHLVPRYNEEDGISIQYTTHEPDFPVLEKLARQINQEVSS

SEQ ID NO: 3451 - DNA, 537 bp, Streptococcus agalactiae
atgataattgagatttatcatagaaggaaaactattttgaaattaaataaaataatattatctactgcagctcttactgctctctttttaggatataatagcgttactgcggatacatataataactatcagccacatagatcaaataatatggatttaactgaggaatataactataataaccagatagaacttcaggagcgtataaaaaaactaaatataccttttaaagaaaaacttgccttacttagaaaggttaaatcaagacaagattcttatgtattagacacattaagaaaagaagttgaaaataaaaacagtgagtattcagaactagagcaagaatatcaaagaatttcagctcttattgatgctaagtttccgcaagggaaatctagtttagcagaaaaattacataaagaactaatttgggacttggatggtgttaaatatgatgagggtatttctaagagaactgctctaaaaaaattagaaggtaaaatcaacgaatatactaaaaaatacagttatttattc

SEQ ID NO: 3452 - protein, 179 aa, Streptococcus agalactiae
MIIEIYHRRKTILKLNKIILSTAALTALFLGYNSVTADTYNNYQPHRSNNMDLTEEYNYNNQIELQERIKKLNIPFKEKLALLRKVKSRQDSYVLDTLRKEVENKNSEYSELEQEYQRISALIDAKFPQGKSSLAEKLHKELIWDLDGVKYDEGISKRTALKKLEGKINEYTKKYSYLF

SEQ ID NO: 3453 - DNA, 729 bp, Streptococcus agalactiae
atgacaatgttaaaaattgaaaatgttacaggggggtatgttaatatcccagttttaaaaaatatttcttttgaagtaaatgatggagagttagttggattaattgggcttaatggtgcaggaaaatcaaccactattaacgagattattggtattttgagaccctatcaaggagatattacaattgatggtattagtcttgaagccgaccaagaactttatagaaagaaaataggctttattcctgagacaccaagtctctatgaggagctaactctcagggaacatttagaaacggtagctatggcgtatgatattgccaccgatgaagttatggcacgtgcgcaaaaactattagagatgtttcgtctaacagataaattagactggtttccaatgcatttttcaaagggaatgaaacaaaaggttatgattatttgtgcttttgttgtatctccaagtttatttattgttgatgaaccatttttaggtttggatccactagctatttcagatttgattaatcttctagcagaagaaaaagctaaagggaaatctattttgatgtcaacacacgtattagattctgccgaaaaaatgtgtgatcgttttgttattttacataaaggagaaatacgggcagttggaaccctagaggaattacgggctatttttggagacagtaatgctaatttaaatgacatctacatagctctgacaaaagaggtg

SEQ ID NO: 3454 - protein, 243 aa, Streptococcus agalactiae
MTMLKIENVTGGYVNIPVLKNISFEVNDGELVGLIGLNGAGKSTTINEIIGILRPYQGDITIDGISLEADQELYRKKIGFIPETPSLYEELTLREHLETVAMAYDIATDEVMARAQKLLEMFRLTDKLDWFPMHFSKGMKQKVMIICAFVVSPSLFIVDEPFLGLDPLAISDLINLLAEEKAKGKSILMSTHVLDSAEKMCDRFVILHKGEIRAVGTLEELRAIFGDSNANLNDIYIALTKEV

SEQ ID NO: 3455 - DNA, 723 bp, Streptococcus pyogenes
atgttaaacattaaaaatctaacaggaggatatcacaatatccctgttttaaacgatgtctcattttctgtagacaatggagagttagtcggtttgatcgggctaaatggtgctggaaagtcaacaactatcaacgaaattattggctttttgaagccttatcaaggaagtatttctattgatggtttaactctagcagaaaatgcagttgcctaccgtcaaaaaataggttttatcccagaaactcctagtctctatgaagaattgaccttatcagagcatatcaacaccgtagctatggcttatgatatcgacttagaagtggcacaaaaacgagcacaacctttcttggaaatgtttcgtttaactgacaaacttgaatggtttcctgtcaatttttctaaagggatgaaacaaaaagtcatgattatttgtgcctttgtcattgatccaagtctatttattcttgatgaaccattcttagggttagaccctttagctatttcagacttaatccaaacgctagaagtcgaaaaagcaaaaggaaaatctattttgatgagtacacatgttttggactctgctgaaagaatgtgtgatcgttttgtgattttgcatcatggacaagttcgtgcccaaggaactcttgctgacttgcaagaagcttttggtgaccgttcagcgagcttaaatgatatctatcttgcattaacaaaagaggat

SEQ ID NO: 3456 - protein, 241 aa, Streptococcus pyogenes
MLNIKNLTGGYHNIPVLNDVSFSVDNGELVGLIGLNGAGKSTTINEIIGFLKPYQGSISIDGLTLAENAVAYRQKIGFIPETPSLYEELTLSEHINTVAMAYDIDLEVAQKRAQPFLEMFRLTDKLEWFPVNFSKGMKQKVMIICAFVIDPSLFILDEPFLGLDPLAISDLIQTLEVEKAKGKSILMSTHVLDSAERMCDRFVILHHGQVRAQGTLADLQEAFGDRSASLNDIYLALTKED

SEQ ID NO: 3457 - DNA, 147 bp, Streptococcus agalactiae
ttggttggttattcaaaccttatttttagtattaatatcaccaattttgataaagttaggcttgtcagtttttatgattacattgttaatttttggtctaggaataatcaaatggttggtaataacttacaaggtaaaggtctttta

SEQ ID NO: 3458 - protein, 49 aa, Streptococcus agalactiae
MVGYSNLIFSINITNFDKVRLVSFYDYIVNFWSRNNQMVGNNLQGKGLL

SEQ ID NO: 3459 - DNA, 1032 bp, Streptococcus agalactiae
atgaaaaagttatttaataaacgtcgaagtctctttttaactcaaaatagtaaatatttgagatacgtctttaacgatcattttgtattagtattaatgtttttgtcaggttttttgttatatcagtatagccagttactaaaagactttccaaaaacacattggccaattatcgtgattgtgtcaatcattatcttaatgttactagcgatggggggaatagccagctatttagaaccggctgataaacaatttttacttataaaagaagaagcaataaaggaaattataaattctgctaaaaaacggacttatatcttttggttggttattcaaaccttatttttagtattaatatcaccaattttgataaagttaggcttgtcagtttttatgattacattgttaatttttggtctaggaataatcaaatggttggtaataacttacaaggtaaaggtcttttataacaatcaaaatttgaactgggatgcagctataaatcatgagcaggaaagaaaacagagtatattaaaatttttctctttgtttacaaatgttaaaggaatttcgacaagtgtaaaacgtcgttcatttttagatggtattttaaaacttatttctaaaacgccatcgcgtttatggactaacttatttgtgagggcatttctaagaagctcagattatcttggtttaacaataaggttggtaactttaaatatcttatcagtcatctttgttaacgaaacctacctcgcccttgctctggcatttgtatttaactacttattattgttccaactattagctttaggtcaccattttgattatcaatacatgaatcagctctatccagttagattaaatgctaaagcaagtcagctaaaaggttttctcagagtattatcatatgctgtgacagtaattgatagcatacttataagagaattgaaacctgttatattattgatagttttgatgttaattgtgacggaatattacatcccttacaaaataaagaagatgattgac

SEQ ID NO: 3460 - protein, 344 aa, Streptococcus agalactiae
MKKLFNKRRSLFLTQNSKYLRYVFNDHFVLVLMFLSGFLLYQYSQLLKDFPKTHWPIIVIVSIIILMLLAMGGIASYLEPADKQFLLIKEEAIKEIINSAKKRTYIFWLVIQTLFLVLISPILIKLGLSVFMITLLIFGLGIIKWLVITYKVKVFYNNQNLNWDAAINHEQERKQSILKFFSLFTNVKGISTSVKRRSFLDGILKLISKTPSRLWTNLFVRAFLRSSDYLGLTIRLVTLNILSVIFVNETYLALALAFVFNYLLLFQLLALGHHFDYQYMNQLYPVRLNAKASQLKGFLRVLSYAVTVIDSILIRELKPVILLIVLMLIVTEYYIPYKIKKMID

SEQ ID NO: 3461 - DNA, 1032 bp, Streptococcus pyogenes
atgaaagcattatttctgaaacgccgtcaagactttcaaaaacaacaaaacaaataccttcgttacgtcttaaatgatcactttgttttggtgttgatgtttttattaggctttgctatggtgcagtatggtcagctactaaaccattttccaacgaatcatctacctattcaggtttgccttgggatattgatcccattattgctcagtatgggatctatagcaacgtatctagaagaggcagatcagcatttcttacttccaaaagaagaagaagtgatttcttatatcaaacaagctgagcgactctcttttttgctttggggaactttgcagactgctgtattgctctttttatatcctatttttagacgtttaggtctgtctttatttatttttattatcttagttttgatattattggcactaaaaagagtagtgcttagtcgaaagacaagatattttttgagaggaaatcgtttagattgggcaaaagctgtcgcatttgaaagcaatcgcaagcaaagtattttaaagttttattctctttttacaacagtcaaaggaatttctacaaaagtgaaagaaagaacttatctaaatcctcttttaaaattagttaagcaaactccttcaaacctttggctgtccctttatgctagagcctttttacgtagttcagattatttgggcttatttttacgactaatgctattaagctcattatctgtattttttatccataatctttatttgtcagtaagtttagcactcatttttaactatttagttgtattccaattactttccctttattatcactacgattaccattatatgactagtctttatcctgaaaatagtcggagcaagaagaaaaatatgttaagttttttacgaggtttaagctttttaatgttaatcgtcaatatgctgtgttgctcatcagcgccaaaagcactcattttgattgtaggtatggttttcatagcttgtatatatctaccttataagttaaagaagatcattgac

SEQ ID NO: 3462 - protein, 344 aa, Streptococcus pyogenes
MKALFLKRRQDFQKQQNKYLRYVLNDHFVLVLMFLLGFAMVQYGQLLNHFPTNHLPIQVCLGILIPLLLSMGSIATYLEEADQHFLLPKEEEVISYIKQAERLSFLLWGTLQTAVLLFLYPIFRRLGLSLFIFIILVLILLALKRVVLSRKTRYFLRGNRLDWAKAVAFESNRKQSILKFYSLFTTVKGISTKVKERTYLNPLLKLVKQTPSNLWLSLYARAFLRSSDYLGLFLRLMLLSSLSVFFIHNLYLSVSLALIFNYLVVFQLLSLYYHYDYHYMTSLYPENSRSKKKNMLSFLRGLSFLMLIVNMLCCSSAPKALILIVGMVFIACIYLPYKLKKIID

SEQ ID NO: 3463 - DNA, 798 bp, Streptococcus agalactiae
gtgacaatatcaaatcaagaattgacgcttactcccttaagaggaaaaagtggcaaagcctatattggtacttatccaaatggtgaacgtgtctttgtcaaatataatacgacacctattttgccagccttagctaaggaacagattgcgccacaactactgtgggcacgccgtacaagtaatggcgatatgatgagtgctcaagaatggttagatggtcgaacattgactaaagaagatatgggtagtaaacagattattcatattttattgcgcctgcacaagtctcgtcccttagtaaatcagctgttacaattagggtataaaattgaaaacccttatgatttgttgatggattgggaaaaacaaactcctattcaaatccgggaaaacacttatttgcaatctattgtgactgagttaaagcgtagtttacctgagtttcgaacagaggttgcaacaatcgttcacggagatatcaaacatagcaactgggttattacaacaagtggtttaatttatttggttgattgggattctgttcgtttaacagatcgcatgtatgacgttgcatatattttaagtcattatattccacaaaaacactggaaagattggctgtcttactacggttataaagataatgagaaagtctggagcaaaattatctggtatgggcaattttcatatttatcacagataatcaaatgttttgataaacgagatatggagcatgtcaatcaagaaatttatgaattacgaaagtttagagagttaattaaaaagcataatgcgagt

SEQ ID NO: 3464 - protein, 266 aa, Streptococcus agalactiae
MTISNQELTLTPLRGKSGKAYIGTYPNGERVFVKYNTTPILPALAKEQIAPQLLWARRTSNGDMMSAQEWLDGRTLTKEDMGSKQIIHILLRLHKSRPLVNQLLQLGYKIENPYDLLMDWEKQTPIQIRENTYLQSIVTELKRSLPEFRTEVATIVHGDIKHSNWVITTSGLIYLVDWDSVRLTDRMYDVAYILSHYIPQKHWKDWLSYYGYKDNEKVWSKIIWYGQFSYLSQIIKCFDKRDMEHVNQEIYELRKFRELIKKHNAS

SEQ ID NO: 3465 - DNA, 789 bp, Streptococcus pyogenes
gtgacaacgacggaacaagaacttaccttgactcccttacgtgggaaaagtggcaaagcttataaaggcacttatccaaatggggaatgtgtctttataaaattaaatacgacccctattctacctgccttagcaaaagaacagattgcgccacagttactttgggccaaacgcatgggcaatggtgatatgatgagtgcccaagaatggcttaacggccgtacattgaccaaagaagatatgaacagtaagcaaatcattcatattctattgcgccttcacaaatctaaaaaattagtcaatcaactgcttcagctcaattataagattgaaaacccatacgatttattggttgattttgagcaaaatgcacccttgcaaattcagcaaaattcatacttacaagctatcgttaaagaattaaaacggagcttaccagagttcaaatcagaagtagcaacgattgtgcatggagatattaaacatagcaattgggtgattactactagtggtatgatttttttagtagattgggattctgttcgtctaactgatcggatgtatgatgttgcttacctgttgagccactatattccacggtctcgttggtcagaatggctgtcttattatggctataaaaataatgacaaggttatgcaaaaaattatttggtatggtcaattttctcacctgacacaaattctcaagtgttttgacaagcgtgacatggagcatgtgaatcaggagatttatgccctcagaaaatttagagaaatatttagaaagaaa

SEQ ID NO: 3466 - protein, 263 aa, Streptococcus pyogenes
VTTTEQELTLTPLRGKSGKAYKGTYPNGECVFIKLNTTPILPALAKEQIAPQLLWAKRMGNGDMMSAQEWLNGRTLTKEDMNSKQIIHILLRLHKSKKLVNQLLQLNYKIENPYDLLVDFEQNAPLQIQQNSYLQAIVKELKRSLPEFKSEVATIVHGDIKHSNWVITTSGMIFLVDWDSVRLTDRMYDVAYLLSHYIPRSRWSEWLSYYGYKNNDKVMQKIIWYGQFSHLTQILKCFDKRDMEHVNQEIYALRKFREIFRKK

SEQ ID NO: 3467 - DNA, 633 bp, Streptococcus agalactiae
atgcgagttagaaaacgtaagggtgcagaggaacacttagaaaataatcctcactatgttatttcaaatccagaagaagccaaagggcgttggcatgagatttttggaaataataaccccattcacatagaagttggttccggaaaaggggcttttatcactggtatggcagagcaaaatccagatatcaattatattggaattgatattcaattgtcagtgctttcctatgctttggataaagttctagatagcggtgctaagaatatcaaattactattagttgatggttctagtctatcaaactactttgatactggcgaagttgatttgatgtatcttaactttagtgatccatggcctaagaaaaagcatgagaaacgtcgattgacctataagactttcttggatacctataaagacatacttcctgagcagggggaaattcattttaaaacagataatagaggtttatttgaatatagccttgctagcttttctcaatacggtatgactttaaaacaagtttggttagatttacatgcaagtgattaccagcaaaatatcatgactgagtacgaacgcaaattttcaaataaaggacaggttatctatcgtgtagaagcacgattt

SEQ ID NO: 3468 - protein, 211 aa, Streptococcus agalactiae
MRVRKRKGAEEHLENNPHYVISNPEEAKGRWHEIFGNNNPIHIEVGSGKGAFITGMAEQNPDINYIGIDIQLSVLSYALDKVLDSGAKNIKLLLVDGSSLSNYFDTGEVDLMYLNFSDPWPKKKHEKRRLTYKTFLDTYKDILPEQGEIHFKTDNRGLFEYSLASFSQYGMTLKQVWLDLHASDYQQNIMTEYERKFSNKGQVIYRVEARF

SEQ ID NO: 3469 - DNA, 633 bp, Streptococcus pyogenes
atgcgagttagaaaacgaaaaggtgctgaggagcacttagctaataacccacactatgtgatattaaatccagaagatgccaagggccgttggcatgacgtttttggaaatgaccgtcctattcatatcgaagttggttcaggaaagggcggatttatcacagggatggccttgaaaaatcctgatattaactacattggcattgatattcaattatctgtcctaagctacgccttggataaggtattagcttcagaagtacccaatgtcaaacttctgcgagtggatggatcaagtttaaccaactattttgaagatggtgaggtggatatgatgtacctcaacttttcagatccttggccaaaaaccaagcatgaaaaacgtcgtttgacctacaaggatttcttagacacttacaagcgtatcttgccagaacacggtgaaattcattttaaaaccgataatcggggcttgtttgagtacagtttagctagtttttctcaatacggcatgaccttgagacagatctggcttgacttacacgctagtaactatgaaggaaatgtcatgacagaatatgaagagaagttctctaataaaggtcaagtcatttaccgagttgaggcaaatttc

SEQ ID NO: 3470 - protein, 211 aa, Streptococcus pyogenes
MRVRKRKGAEEHLANNPHYVILNPEDAKGRWHDVFGNDRPIHIEVGSGKGGFITGMALKNPDINYIGIDIQLSVLSYALDKVLASEVPNVKLLRVDGSSLTNYFEDGEVDMMYLNFSDPWPKTKHEKRRLTYKDFLDTYKRILPEHGEIHFKTDNRGLFEYSLASFSQYGMTLRQIWLDLHASNYEGNVMTEYEEKFSNKGQVIYRVEANF

SEQ ID NO: 3471 - DNA, 381 bp, Streptococcus agalactiae
atgggtggcgactatgtgctcagtattttaattgataaacccggaggcattacggttgaagatacagcacaattgacagacgttgtaagtcccttacttgacacaattcaaccagatccatttccagaacagtatatgcttgaagtctcaagtcctgggttggaaagaccacttaaaacagcagaagcattatcaaatgctgttgggtcttatatcaatgtaagtctgtataaatccattgataaagttaaaatatttgaaggtgacttattatcatttgatggtgaaaccttgacaattgattatatggacaaaacacgtcataaaactgtagatattccctatcagacggttgcaaaagcccgtcttgcggttaaactt

SEQ ID NO: 3472 - protein, 127 aa, Streptococcus agalactiae
MGGDYVLSILIDKPGGITVEDTAQLTDVVSPLLDTIQPDPFPEQYMLEVSSPGLERPLKTAEALSNAVGSYINVSLYKSIDKVKIFEGDLLSFDGETLTIDYMDKTRHKTVDIPYQTVAKARLAVKL

SEQ ID NO: 3473 - DNA, 534 bp, Streptococcus pyogenes
gtggattcccaaggaccaattatcttagagaagagcataaaaatagaggaggtaatcaaaatagcaaatacatctattatcgatatcgtaaccaagacagtaacgcctgagattaaggcaccttatgaattagtagacgttgagtatgacaaaatgggtagtgactacatccttagtattttagtcgataaggaaggtggaatcacagtggaagatacatctgacttgacgaatattattagtccgctgttagatacgattgatccagatccttttccaaaccaatatatgctagaagtctctagtccaggtttggagcgtccgctcaagacagctgacagtttaaaagcagcagttggctcttatatcaatgtgagtctttatcaagctattgataaggtgaaagtttttcaaggagacttattagcctttgatggtgaaacgttgaccattgattatcttgataaaacacgtcataagatcgtgaatataccatatcaagcagttgctaaggtgagaatggctgtcaaatta

SEQ ID NO: 3474 - protein, 178 aa, Streptococcus pyogenes
VDSQGPIILEKSIKIEEVIKIANTSIIDIVTKTVTPEIKAPYELVDVEYDKMGSDYILSILVDKEGGITVEDTSDLTNIISPLLDTIDPDPFPNQYMLEVSSPGLERPLKTADSLKAAVGSYINVSLYQAIDKVKVFQGDLLAFDGETLTIDYLDKTRHKIVNIPYQAVAKVRMAVKL

SEQ ID NO: 3475 - DNA, 1158 bp, Streptococcus agalactiae
atggacactatgagcaaagaaatgctagaagccttccgtattttggaagaagaaaaacacattaataaagaagatattattgatgcagttactgagtcactaaaatctgcctataagcgtcgttatggtcaatcagaatcatgcgttattgaatttaacgagaagaaagcagactttaccgtctatactgttcgtgaagttgttgatgaagtttttgatagccgtttggaaattagcctaaaagatgcccttgctattagctcagcgtatgaacttggtgataagattcgctttgaggaatctgttacagaatttggacgcgtggcagctcagtcagcaaaacaaactattatggaaaaaatgcgtcgtcaaatgcgtgaagtaaccttcaatgaatacaaacaacacgaaggtgaaattatgactggtactgttgaacgatttgaccaacgttttatttatgtcaatctcggttcacttgaggcgcaattatcgcatcaagatcagattcctggagagagctttaaatctcatgatatgattgatgtttatgtctataaagtggagaataatcctaaaggagtcaacgtttttgttagccgtagtcatccagagtttatcaaacgcattatggagcgagaaattccagaagtatttgatggaactgttgagattatgagcgtctctcgtgaggctggagatcgtactaaagttgctgtacgcagtcataattcaaacgttgatgcgattggaacaattgttggacgcggtggaagtaacattaaaaaagttatcagtaatttccatcctaaacgcgttgatgctaaaacaggattggagatcccggttgaagaaaacattgatgttattcaatgggttgaagatccagcggaattcatttacaatgctattgcaccagccgaagttgatatggtactttttgatgatgaagatacaaaacgtgctactgtagttgttccagatagcaagttatcgctagctattggtcgccgaggacaaaatgtgcgtttagcagctcatttgactggctatcgtattgatattaaatctgcaagtgaatacgaaaaaatggaagcgcaagaacttcaaactgaggaagtagctcaagaatctgaagttatttcagataaggcagaa

SEQ ID NO: 3476 - protein, 386 aa, Streptococcus agalactiae
MDTMSKEMLEAFRILEEEKHINKEDIIDAVTESLKSAYKRRYGQSESCVIEFNEKKADFTVYTVREVVDEVFDSRLEISLKDALAISSAYELGDKIRFEESVTEFGRVAAQSAKQTIMEKMRRQMREVTFNEYKQHEGEIMTGTVERFDQRFIYVNLGSLEAQLSHQDQIPGESFKSHDMIDVYVYKVENNPKGVNVFVSRSHPEFIKRIMEREIPEVFDGTVEIMSVSREAGDRTKVAVRSHNSNVDAIGTIVGRGGSNIKKVISNFHPKRVDAKTGLEIPVEENIDVIQWVEDPAEFIYNAIAPAEVDMVLFDDEDTKRATVVVPDSKLSLAIGRRGQNVRLAAHLTGYRIDIKSASEYEKMEAQELQTEEVAQESEVISDKAE

SEQ ID NO: 3477 - DNA, 1188 bp, Streptococcus pyogenes
ttgccaagctttacaagcaaggtagataacattatgagcaaagaaatgctagaagccttccgtattttggaagaagaaaaacacattgataaagcagatattattgacgcagtgacagaatcattaaagtctgcctataaacgtcgctatggtcaatcagaatcatgtgttattgaatttaatgaaaaaacagctgattttcaagtatttacggttcgtgaggttgttgaagaagtttttgacagccggcttgagattagtttgaaagatgctcttgctatcagttctgcctatgaattgggtgataagattcgctttgaagaatctgtcaatgaatttggacgtgtcgcagctcaatcagctaaacagactattatggaaaagatgcgccgccaaatgcgtgaagtgatgttcaatgaatacaaagagcatgaaggtgaaattatgacaggaacagttgaacggtttgatcaacgttttatttatgtcaatcttggttccttagaagcacaattgtctcaccaagaccagattccaggtgaaactttcaaatcacatgaccgtattgacgtttatgtctacaaagttgaaaataatcctaaaggagttaacgtctttgttagtcgtagccatccagaattcatcaaacgtattatggagcaagaaattcctgaagtctttgatggtactgttgaaatcatgagtgtttctcgtgaagcaggtgaccgcaccaaggttgctgtgcgcagtcataatcctaacgttgatgccatcggaacaattgttggacgtggtggaagtaatattaaaaaggtcatcagcaagttccatccaaaacgtgtagatgctaagacggggcttgaaattccagttgaagaaaatattgacgtgattcaatgggtagatgatccagctgagttcatctacaatgccattgctccggctgaagtagacatggtactttttgacgatgaagatcttaaacgtgctacggtagtagttcctgatagcaaattatcattagctatcgggcgtcgcggccaaaatgttcgtttagcggcacatttgactggctaccgtattgatatcaaatcagctagcgaatatgatcgtcttgaggcggaaaaagaagcagcaacagctgtggaagagccagttgttgacgatgttatgactgccgaggaagta

SEQ ID NO: 3478 - protein, 396 aa, Streptococcus pyogenes
LPSFTSKVDNIMSKEMLEAFRILEEEKHIDKADIIDAVTESLKSAYKRRYGQSESCVIEFNEKTADFQVFTVREVVEEVFDSRLEISLKDALAISSAYELGDKIRFEESVNEFGRVAAQSAKQTIMEKMRRQMREVMFNEYKEHEGEIMTGTVERFDQRFIYVNLGSLEAQLSHQDQIPGETFKSHDRIDVYVYKVENNPKGVNVFVSRSHPEFIKRIMEQEIPEVFDGTVEIMSVSREAGDRTKVAVRSHNPNVDAIGTIVGRGGSNIKKVISKFHPKRVDAKTGLEIPVEENIDVIQWVDDPAEFIYNAIAPAEVDMVLFDDEDLKRATVVVPDSKLSLAIGRRGQNVRLAAHLTGYRIDIKSASEYDRLEAEKEAATAVEEPVVDDVMTAEEV

SEQ ID NO: 3479 - DNA, 294 bp, Streptococcus agalactiae
atggctaaaacaaaaaaaatacctttaagaaaatcagttgtttctggtgaagtgatcgataagcgagatcttttacgaattgttaaaaataaagaaggacaggtttttatagatcctaccggaaagcaaaatggtcgaggtgcctacataaaattggacaatgatgaagctatcctagcgaaaaagaaacgagtgtttgatcgcagtttttcgatggaagtttctgatgaattctatgatgaactattggcatatgtcgaccataaggtcaaaagaagagagttaggccttgaa

SEQ ID NO: 3480 - protein, 98 aa, Streptococcus agalactiae
MAKTKKIPLRKSVVSGEVIDKRDLLRIVKNKEGQVFIDPTGKQNGRGAYIKLDNDEAILAKKKRVFDRSFSMEVSDEFYDELLAYVDHKVKRRELGLE

SEQ ID NO: 3481 - DNA, 297 bp, Streptococcus pyogenes
ttgatgtctaaagtcaaaaaaatacctttacgaaaatcacttgtttctggtgaaattattgctaaacgagatcttcttaggattgtaaaaactaaggatggtcaagttttcattgatccaactggtaaacaaaatggtcgtggtgcttatatcaaattagacaatcaagaggccttaatggccaagaaaaaacaagttttcaacaggagtttctcaatggacattccagaaagtttttacgatgacttgattgcttatgttgatcacaaaatcaaaagaagagagttaggtcttgac

SEQ ID NO: 3482 - protein, 99 aa, Streptococcus pyogenes
LMSKVKKIPLRKSLVSGEIIAKRDLLRIVKTKDGQVFIDPTGKQNGRGAYIKLDNQEALMAKKKQVFNRSFSMDIPESFYDDLIAYVDHKIKRRELGLD

SEQ ID NO: 3483 - DNA, 300 bp, Streptococcus agalactiae
ttgaataattcagaaaaagtattaaatctcattgggttagcacagcgtgcggggcgccttattacaggtgaagaattggttattaaagcaattcaaaatcaacaagtatcgctaatctttctagcaaatgatgctggcccaaatttgacgaaaaaagtaactgataaaagtaattactacaaaacagaagtctccacagtgttttcaacactggaattaagtgatgcgttaggcaaaccaagaaaagtggttgctgtcgcagacgctggattttcaaagaaaatgaggactcttatggca

SEQ ID NO: 3484 - protein, 100 aa, Streptococcus agalactiae
MNNSEKVLNLIGLAQRAGRLITGEELVIKAIQNQQVSLIFLANDAGPNLTKKVTDKSNYYKTEVSTVFSTLELSDALGKPRKVVAVADAGFSKKMRTLMA

SEQ ID NO: 3485 - DNA, 300 bp, Streptococcus pyogenes
ttgactaatttagaaagattatctagtcttattggtccagctcaacgggctggaaaagtgatttcaggtgaagaactagtagtaaaagctattcaacaccagcaggtaatattagtatttttagccaatgatgctggtcctaatgtgacaaaaaaagtgacagataaaagtaattattataatgtagaagtctccacagtgttgaatgcactggaattaagtgctgcactaggtaaaccaaggaaggttgctgccattgcagatgctggattttcaaagaaaatgaggactcttatggaa

SEQ ID NO: 3486 - protein, 100 aa, Streptococcus pyogenes
LTNLERLSSLIGPAQRAGKVISGEELVVKAIQHQQVILVFLANDAGPNVTKKVTDKSNYYNVEVSTVLNALELSAALGKPRKVAAIADAGFSKKMRTLME

SEQ ID NO: 3487 - DNA, 2781 bp, Streptococcus agalactiae
ttgtcaaagaaaagattacacgaaatcgctaaggaaattggaaaaacgagtaaggaagtggttgagcaagctcaatcgcttggcttacctgtaaaaagtcatgcttctagcgttgaagaaaatgatgctacacgtattgttgagagttttagctcttctaaaactaaagctccaacaaattctgttcaaactaatcaaggtgtgaaaacagaatctaaaactgttgaaaccaaacaaggcttgtccgatgataaaccttcaactcaacctgtagctaaaccgaaaccacaaagtcgtaactttaaggcggagcgcgaggctcgtgctaaagctgaagcggagaagcgtcaacataatggggatcaccgtaagaataatcgccataatgatacacgctctgacgacagacgccatcaaggtcaaaagcgttcaaatggtaatcgtaatgataaccgacaaggtcagcaaaataaccgtaataaaaatgatgggcgttatgctgatcataaacagaaaccccaaacgcgtcctcagcaacctgcaggcaatcgcattgactttaaagctcgagcagcagctttgaaagctgagcaaaatgctgaatactcacgtcatagtgagcagcgtttccgtgaagagcaagaagccaaacgtcaagcagctaaggagcaagaactagctaaagcagcagcgttaaaagcgcaagaagaagctcaaaaagctaaggaaaaacttgcttctaaacctgttgctaaggtaaaagaaattgtcaataaagtagccgctacgccatcacagacagcagatagtcgtcgtaaaaaacaaactcgttctgataagtctcgtcaattttcaaatgaaaatgaagatggacaaaagcaaacaagaaataagaaaaactggaataatcaaaaccaagtgagaaatcaaagaaatagtaactggaatcataataagaaaaataaaaaaggtaagactaatggagctccaaaaccagtaacagagcgtaaattccatgaattaccaaaagaatttgaatatactgagggcatgaccgttgcggaaattgcaaaacgtattaaacgcgaaccagcggaaattgttaaaaaactctttatgatgggagttatggcaacgcagaatcaatcattagatggagacactattgagctattgatggttgactacgggattgaagcacatgctaaggttgaagttgatgaagctgatattgaacgcttctttgcagatgaggattaccttaatcctgataacttaacggaacgtccgcctgttgttactatcatgggacacgttgatcatggtaaaacaactcttcttgatactctacgtaattcacgtgtcgctactggcgaagctggtggaattactcaacatattggtgcttatcagattgaagaagctggcaagaaaattactttcttggatacaccagggcatgcggcctttacttctatgcgtgcgcgtggtgcatcagtaactgatattactatccttatcgttgccgctgatgatggtgttatgccgcagacagttgaggcaattaatcactctaaagctgcgggtgtcccaattattgttgctatcaacaaaattgataaacctggtgcaaatccagaacgcgttatcagtgaattagctgagcatggtgtcatctctactgcatggggtggtgagtctgaatttgttgaaatttcagctaagtttggtaaaaatattcaagaattacttgagacagttcttttagttgctgaaatggaagaattaaaagcagatgcagatgttcgtgctattggtactgttattgaagcccgtcttgataaaggtaagggagccgttgcaacgcttcttgtccaacaaggtactttaaatgtacaagatccaatcgttgttggtaatacatttggacgtgttcgtgcgatgactaatgatcttgggcgtcgtgtcaaagttgcgggtccatctacaccagtttctattactggtttgaacgaagctccaatggctggtgatcattttgctgtttatgcagatgagaaagctgcgcgtgctgcaggtgaagaacgtgcaaaacgtgctctcttaaaacaacgccaaaacacgcaacgtgttagcctcgagaacttatttgatacccttaaagctggtgaagttaagtcagttaatgttattatcaaagctgatgtgcaaggttctgtagaagcacttgcagcttctctccttaagattgatgttgaaggagtaaaagttaacgttgttcactcagcagttggtgctattaatgagtctgatgtaacacttgctgaagcatcaaatgctgttattataggatttaacgtacgccctactccacaagctcgtcaacaagcagatgctgatgatgtcgaaattcgtcaacatagcattatctataaagttatcgaagaagttgaagaagcgatgaaaggtaaacttgatcctgaataccaagaaaaaatccttggtgaagccattattcgtgagacctttaaagtttcaaaagtgggaactattggtggatttatggttatcaatggtaaagttactcgtgattcaagtgttcgtgttatccgtgatggtgttgtcatttttgatggtaaattagcaagtcttaaacactataaagatgatgttaaagaagtcggcaatgctcaagaaggtggtctaatgattgagaattataacgatctcaaagaagatgacactattgaagcatacattatggaagaaattaaacgtaaa

SEQ ID NO: 3488 - protein, 927 aa, Streptococcus agalactiae
MSKKRLHEIAKEIGKTSKEVVEQAQSLGLPVKSHASSVEENDATRIVESFSSSKTKAPTNSVQTNQGVKTESKTVETKQGLSDDKPSTQPVAKPKPQSRNFKAEREARAKAEAEKRQHNGDHRKNNRHNDTRSDDRRHQGQKRSNGNRNDNRQGQQNNRNKNDGRYADHKQKPQTRPQQPAGNRIDFKARAAALKAEQNAEYSRHSEQRFREEQEAKRQAAKEQELAKAAALKAQEEAQKAKEKLASKPVAKVKEIVNKVAATPSQTADSRRKKQTRSDKSRQFSNENEDGQKQTRNKKNWNNQNQVRNQRNSNWNHNKKNKKGKTNGAPKPVTERKFHELPKEFEYTEGMTVAEIAKRIKREPAEIVKKLFMMGVMATQNQSLDGDTIELLMVDYGIEAHAKVEVDEADIERFFADEDYLNPDNLTERPPVVTIMGHVDHGKTTLLDTLRNSRVATGEAGGITQHIGAYQIEEAGKKITFLDTPGHAAFTSMRARGASVTDITILIVAADDGVMPQTVEAINHSKAAGVPIIVAINKIDKPGANPERVISELAEHGVISTAWGGESEFVEISAKFGKNIQELLETVLLVAEMEELKADADVRAIGTVIEARLDKGKGAVATLLVQQGTLNVQDPIVVGNTFGRVRAMTNDLGRRVKVAGPSTPVSITGLNEAPMAGDHFAVYADEKAARAAGEERAKRALLKQRQNTQRVSLENLFDTLKAGEVKSVNVIIKADVQGSVEALAASLLKIDVEGVKVNVVHSAVGAINESDVTLAEASNAVIIGFNVRPTPQARQQADADDVEIRQHSIIYKVIEEVEEAMKGKLDPEYQEKILGEAIIRETFKVSKVGTIGGFMVINGKVTRDSSVRVIRDGVVIFDGKLASLKHYKDDVKEVGNAQEGGLMIENYNDLKEDDTIEAYIMEEIKRK

SEQ ID NO: 3489 - DNA, 2859 bp, Streptococcus pyogenes
ttgtcaaagaaaagattacatgaaattgccaaggaaattggtaaaagtagtaaagaggtggttgaacacgctaaatacttaggattagatgtgaaaagccatgcatcaagtgttgaagaagcggatgcgaaaaagattatttcaagtttttcaaaggcttctaaacctgatgtgacagcttctcaaacagtcaaacccaaagaagttgctcaaccctctgtaacagtggtcaaagaaacaggttctgagcatgtagagaaaacacaggtctctaagccaaagagtcgtaattttaaagctgaaagagaggctcgtgcaaaggaacaggctgctcgaaaacaagcaaatggctcttctcatcgttctcaagaacgtcgaggaggttatcgccagcccaataatcatcaaactaacgaacaaggagataagaggattacccatcgttctcaaggtgatacaaacgataagcgtattgagcgaaaagcatcgaatgtatcacctagacatgataatcatcagctagttggtgatcgtaaccgttcctttgctaaggagaatcacaagaatggtcgattcacaaaccaaaaaaagcaaggacgacaagagcctcaatcgaaaagtcctaaaattgatttcaaagctcgtgctgctgccttaaaagctgaacaaaatgctgaatactcacgccaaagtgaaacacgttttcgtgcacagcaagaagctaagcgtttagctgagttggcaagacaagaagctaaagaagcggctctaaaagcacaagctgaggagatgagccatcgtgaagcagcattgaaatctattgaagaagcagaaactaaattaaagtcatcaaatattagtgctaaatctactgctgataatcgccgtaaaaaacaagcacgtcctgaaaagaatcgtgagttaactcatcattcacaagaaggacaaaagaaaaataagaagagttggaatagtcaaaaccaagtgagaaatcaaaaaaatagtaactggaataaaaataaaaagaccaaaaaaggcaaaaatgttaagaataccaacaccgctccaaaaccagtaaccgagcgtaaattccatgaattgccaaaagaatttgaatatactgaaggcatgacagttgccgaaatcgcaaaacgtatcaaacgcgaacccgctgaaattgttaaaaagctgtttatgatgggtgttatggcaactcaaaaccaatctttagatggtgacactatcgaattattgatggtagattatggtattgaggctaaggctaaggtagaagtagatgatgctgatatcgagcgcttctttgaggatgaaaattacctcaatcctgaaaatattgtagaacgcgcacctgttgtaactatcatgggacacgtagaccacggtaagacaactttgcttgatactttgcgtaactcacgtgtggcaacaggagaagctggaggaattactcagcatattggtgcttaccagattgaagaagctggcaagaaaattaccttcttggatactcccggacacgcggcctttacaagtatgcgcgcacgtggagcttccgttaccgatatcaccattttgattgttgcagctgatgatggtgttatgccacaaacgattgaagcgatcaatcactcaaaagctgctggtgttccaattattgttgctatcaacaaaattgataaaccaggtgctaatccagaacgtgttatcgcagaattggcagaatatggtatcatctcaactgcttggggcggagagtgcgaatttgtagagatatctgctaaatttaataaaaatattgatgaactattagaaacagtccttttggttgctgaagtggaagaattgaaagctgatccgacggttcgtgctattggtactgtaattgaagcacgcttagataaaggtaaaggtgctatcgctacgcttcttgtccaacaaggaactcttcatgttcaagatccaatcgttgttggtaatacctttggtcgtgtccgtgccatggtaaatgaccttgggcgtcgtgttaaatctgcggagccatcaacaccagtttccattactggtttgaacgaaacaccaatggctggtgatcactttgctgtttacgctgatgaaaaagctgcgcgtgcagctggtgaggagcgatcaaaacgtgccctcctcaaacaacgtcaaaatacacagcgtgttagccttgataatctctttgatacccttaaagcaggagaaatcaagactgttaatgtcatcatcaaagcagacgttcaaggttctgttgaagcccttgcagcatctcttgtaaagattgaagtggaaggtgtccgtgtcaatgtcgttcactctgctgtaggtgctatcaatgagtctgatgtgacccttgctgaagcatcaaatgctgttattatcggtttcaacgttcgccctaccccacaagctcgtcaacaagcagatacggatgatgtggaaattcgtcttcatagtattatctataaagtcattgaagaagtagaagaagccatgaaagggaaacttgaccctgtttaccaagaaaaaattcttggtgaagccattatccgtgaaaccttcaaagtttctaaagtgggaacaattggtggctttatggtaatcaacggtaaggtgacacgtgattcgagtgttcgtgttatccgtgatagtgtcgttatttttgatggtaaactggccagcttgaaacattacaaagatgacgttaaagaagtcggtaatgctcaagaaggtgggttgatgattgaaaactttaacgatcttaaagttgacgatactattgaagcctatattatggaagaaattgtgagaaaa

SEQ ID NO: 3490 - protein, 953 aa, Streptococcus pyogenes
LSKKRLHEIAKEIGKSSKEVVEHAKYLGLDVKSHASSVEEADAKKIISSFSKASKPDVTASQTVKPKEVAQPSVTVVKETGSEHVEKTQVSKPKSRNFKAEREARAKEQAARKQANGSSHRSQERRGGYRQPNNHQTNEQGDKRITHRSQGDTNDKRIERKASNVSPRHDNHQLVGDRNRSFAKENHKNGRFTNQKKQGRQEPQSKSPKIDFKARAAALKAEQNAEYSRQSETRFRAQQEAKRLAELARQEAKEAALKAQAEEMSHREAALKSIEEAETKLKSSNISAKSTADNRRKKQARPEKNRELTHHSQEGQKKNKKSWNSQNQVRNQKNSNWNKNKKTKKGKNVKNTNTAPKPVTERKFHELPKEFEYTEGMTVAEIAKRIKREPAEIVKKLFMMGVMATQNQSLDGDTIELLMVDYGIEAKAKVEVDDADIERFFEDENYLNPENIVERAPVVTIMGHVDHGKTTLLDTLRNSRVATGEAGGITQHIGAYQIEEAGKKITFLDTPGHAAFTSMRARGASVTDITILIVAADDGVMPQTIEAINHSKAAGVPIIVAINKIDKPGANPERVIAELAEYGIISTAWGGECEFVEISAKFNKNIDELLETVLLVAEVEELKADPTVRAIGTVIEARLDKGKGAIATLLVQQGTLHVQDPIVVGNTFGRVRAMVNDLGRRVKSAEPSTPVSITGLNETPMAGDHFAVYADEKAARAAGEERSKRALLKQRQNTQRVSLDNLFDTLKAGEIKTVNVIIKADVQGSVEALAASLVKIEVEGVRVNVVHSAVGAINESDVTLAEASNAVIIGFNVRPTPQARQQADTDDVEIRLHSIIYKVIEEVEEAMKGKLDPVYQEKILGEAIIRETFKVSKVGTIGGFMVINGKVTRDSSVRVIRDSVVIFDGKLASLKHYKDDVKEVGNAQEGGLMIENFNDLKVDDTIEAYIMEEIVRK

SEQ ID NO: 3491 - DNA, 375 bp, Streptococcus agalactiae
atgagcacaatgaagaaaggattaattatggctaatcatcgtattgatcgcgttggaatggaaattaaacgtgaagtcaatgagattttgcgtctccgagttaatgatccacgtgtacaagatgtcacaattactgatgttcagatgttgggtgacctttcaatggctaaagtattttatactattcattcgacacttgcttctgataatcaaaaagcacaaattggtttagaaaaagcaactggtactattaagcgtgaacttggcaaaaaccttactatgtataaaataccagatttacaatttgttaaagatgaatctattgaatacggaaataagattgatgaaatgttgcgcaatctagataaaaaagat

SEQ ID NO: 3492 - protein, 125 aa, Streptococcus agalactiae
MSTMKKGLIMANHRIDRVGMEIKREVNEILRLRVNDPRVQDVTITDVQMLGDLSMAKVFYTIHSTLASDNQKAQIGLEKATGTIKRELGKNLTMYKIPDLQFVKDESIEYGNKIDEMLRNLDKKD

SEQ ID NO: 3493 - DNA, 354 bp, Streptococcus pyogenes
atggctatggctaatcatcgtattgaccgcgttgggatggaaatcaagcgcgaagtaaatgatattcttcagaaaaaagtgcgtgatccacgcgttcagggagtaacgattacagaagtgcaaatgcagggtgacttgtcacttgctaaagtttattacactattatgagtgacttggcatctgataatcaaaaagcacaaacagggcttgaaaaagcgactggaacgattaaacgtgaacttggcaaacaattgaccatgtacaaaattccagatttggtgtttgaaaaagacaattccatcgcctatggtaataaaattgatcaactcttacgagatcttgacaacaaatcc

SEQ ID NO: 3494 - protein, 118 aa, Streptococcus pyogenes
MAMANHRIDRVGMEIKREVNDILQKKVRDPRVQGVTITEVQMQGDLSLAKVYYTIMSDLASDNQKAQTGLEKATGTIKRELGKQLTMYKIPDLVFEKDNSIAYGNKIDQLLRDLDNKS

SEQ ID NO: 3495 - DNA, 1002 bp, Streptococcus agalactiae
ttgaaaccgtccttcaaaaaactattgctactatttagtattatcaccattttatccatcgcctgtacaccacatgcaaaagcaagtgggcgttcatggaaaagttggtttatcgaacaatacttttggctaaagcgcgataaaagttattataaagttcaagatgaaagctcatttcaaaagtacttaaatgctagccgtgaacaatctgataagggttattacttagacccaaactctgttaatggagggcttgttcaagagagactttttgatatgcaagtctattcttggaatgacaacggtaaagctaatcaaaagaccattttctatttagctggtggctcttacttaaataatccaacgccttaccatatcagcatgcttaagacgctctcaactagtcttgatgcaaaaattattttaccaatttatccaaaaactcctcgttatacctatgattatgctatccctagattggttaacctttatagacactttcatgaaaaaaacgctaatctcactttgatgggtgattcagctggcggaggattagcactaggattagcgcatgcattgtctcaccaatcagggcaagaggctattcctcaacctaaaaatattatcctcttatctccatggctagatgtgacaatgaaacatccagaaattcccaaatacgaagatactgatcctatcctatctgcttggggtctcgcacgtgtaggtgaaatttgggcaaatggttctaataatactaaccatacatatgttagtcctaaaaatgcccctgctactaaactcgctcctattacgttatttactggaacacgagaaatattcttcccagatattcgcgattatgctgcacaactccaagcagctaatcaccccgttaactatattgcacaagagggaatgaatcatgtttatccaatttaccctattgaagaagctaaaacagcacagtatcaaatgattgatatcatcaataaaactcct

SEQ ID NO: 3496 - protein, 334 aa, Streptococcus agalactiae
MKPSFKKLLLLFSIITILSIACTPHAKASGRSWKSWFIEQYFWLKRDKSYYKVQDESSFQKYLNASREQSDKGYYLDPNSVNGGLVQERLFDMQVYSWNDNGKANQKTIFYLAGGSYLNNPTPYHISMLKTLSTSLDAKIILPIYPKTPRYTYDYAIPRLVNLYRHFHEKNANLTLMGDSAGGGLALGLAHALSHQSGQEAIPQPKNIILLSPWLDVTMKHPEIPKYEDTDPILSAWGLARVGEIWANGSNNTNHTYVSPKNAPATKLAPITLFTGTREIFFPDIRDYAAQLQAANHPVNYIAQEGMNHVYPIYPIEEAKTAQYQMIDIINKTP

SEQ ID NO: 3497 - DNA, 984 bp, Streptococcus pyogenes
ttgaaacatcctattcgaaaaacacttgtcaccttaggtctattactgaccttatgcctgccgactccagttgcagctagttctcgttcttggaagagctggtttatcgagcaatatttctggttaaaacgtgacaagagttactattctaaacaagatgacccaagcttccaaagataccttgatgcctgtcgtgaacaatctgataaaccttatcaactagatactaatttagtcaatggtccccttgttcaagaaaatctttatggcatgcaggtttactcttggaatgataatggaaaacctgatcaaaaaacaattatttatcttgccggtggttcttatcttaacaatccaacgacataccatattaatatgttaaagacattatccacaagtcttgacgctaaaattgttttacccatttatcctaaagccccacgttatacctataactatactatgccaaaattggtcaatctttaccaacactattaccataaaaatcagaatgttttccttatgggagattcagcaggtggaggtttagccttaggtctagctcatgccctacacaatgaatcagtccctcaaccaaagcagctcgttcttttatcaccttggttagatgttactatgtcacacccagagattccagaatacgaagatgctgatcctattctatcttcttggggattaaaacgagtgggagaattgtgggcctactctgctgataataccaaccatatttatgtcagtcctaaaaatggtccgatcacttatctaccaccaattactttatttactgggacacgagagatcttttatcctgatattcgcgattatgccgcaaaactgaaagccgctaaccacaatattacctttattacccaagaaggcatgaaccacgtttacccaatttatcctatcgaagaggcaaaaacagctcaataccaaatcattgatgccatcaacaaaactcct

SEQ ID NO: 3498 - protein, 328 aa, Streptococcus pyogenes
LKHPIRKTLVTLGLLLTLCLPTPVAASSRSWKSWFIEQYFWLKRDKSYYSKQDDPSFQRYLDACREQSDKPYQLDTNLVNGPLVQENLYGMQVYSWNDNGKPDQKTIIYLAGGSYLNNPTTYHINMLKTLSTSLDAKIVLPIYPKAPRYTYNYTMPKLVNLYQHYYHKNQNVFLMGDSAGGGLALGLAHALHNESVPQPKQLVLLSPWLDVTMSHPEIPEYEDADPILSSWGLKRVGELWAYSADNTNHIYVSPKNGPITYLPPITLFTGTREIFYPDIRDYAAKLKAANHNITFITQEGMNHVYPIYPIEEAKTAQYQIIDAINKTP

SEQ ID NO: 3499 - DNA, 414 bp, Streptococcus agalactiae
atgactatttcaagcgcagaatgggaaattatgagagtggtttgggcacagcagaatacaaccagtaatgagatactagcagttttactagagaagtatgattggactccttcaactgtcaaaaccttattaagaaggctcttagataaaggctacgtgagcagagaaaaaatgggaaaaggatttagctattctcctttaattgatgaagatttagctatgatgtcagaggtagatagtgtatttcaaaaagtttgccagaccaaacatgttgctattgttagacacttattggaaagtataccaatgacagagaaggatcgattaaatttgcaatcatcactagaagctaagaaaggcaaaacacttgaacgtgtagcttgtaattgcattcctggtcagtgtcaatgccat

SEQ ID NO: 3500 - protein, 138 aa, Streptococcus agalactiae
MTISSAEWEIMRVVWAQQNTTSNEILAVLLEKYDWTPSTVKTLLRRLLDKGYVSREKMGKGFSYSPLIDEDLAMMSEVDSVFQKVCQTKHVAIVRHLLESIPMTEKDRLNLQSSLEAKKGKTLERVACNCIPGQCQCH

SEQ ID NO: 3501 - DNA, 450 bp, Streptococcus pyogenes
gtgaatgaaggtgacgttatgcaacagatatcagctgctgaatgggaagtcatgcgtgtggtgtgggccagtggtgatattaaaagtagcgatattattactattttaaggaaaaaatatcaatggtcagattccactattaagaccctcattggtaggctagttaaaaaaaattttttaacgtcttatcggcaaggaagagcttatatttatcaagctcttttggatgagactttgctacaaaaagaagcactagcgactgttttagacggtatttgtcagcggcaacacacgcgtctacttcttgaacggctttatcacttaccgatgaccttagaggaaatcggggcattccaagagctactagaagtcaaaaaagaaaatgcagttcttgaggtgccgtgtaattgtctgcctgggcagtgccactgtcagagaaaggagacgtat

SEQ ID NO: 3502 - protein, 150 aa, Streptococcus pyogenes
VNEGDVMQQISAAEWEVMRVVWASGDIKSSDIITILRKKYQWSDSTIKTLIGRLVKKNFLTSYRQGRAYIYQALLDETLLQKEALATVLDGICQRQHTRLLLERLYHLPMTLEEIGAFQELLEVKKENAVLEVPCNCLPGQCHCQRKETY

SEQ ID NO: 3503 - DNA, 2232 bp, Streptococcus agalactiae
atggctaatagaaaagaaacatttttgattgatgggatgacttgtgcatcttgtgctttaacgatagaaaaagctgtcaacaagttagaccatgtggatagtgcagtagtaaatttagcaacagagaaaatgacagttacgtttgatgatacaaccttatcgccaaatgtgattgaagagtgtgtttctgagagtggatacgaagcatcgcttttcaaagaggaaacttctaaaagccaatctgaacggcaccaattagccattgaaaagatgtggcatcgcttttggatgtcagcagttgcaactatacctcttctctatatttccatgggaccaatgattaacttatggttaccatcatttttgatgccagataagggacctctaaactatggtatgatacaattattgttaacactaccggtgatgtattttgggcgtatcttttaccaaaatggttttaaagcactttttaaaaggcatcccaatatggattcattagttgctatagccacaacagcggctttcatttatagcttatatggattgtacgaaatattacagggtgacatacactacgctcaccagctttatttcgaatctgttgcagttattttaacacttattactctaggaaaatattttgaaatattatccaaagggcgtacttcggcctcgattgaaaaattattaactttatcagcaaaagaagcaagagttatcaaagatggtgaagactatatggttcctttggataaagttaaaataggtgaaacaattcttgtcaaacctggagaaaaaattcctcttgatggccatgttgtagcaggagaatcaagtattgatgaatccatgttaacaggtgaaagtattccagttgaaaaaaaggttggtagtaaggtttacggtgccagcattaatgggcaaggtagcttaacgattttcgttgaaaaagaagctggcggttcccttctatcacaaattattaacttagtagaagctgcacagacaagtaaggctccaattgctaacttagcagacaaagtatcaggagtctttgtcccttttgttattgtcattgcaattttatcaggcttgagttggtacttaattctggggcaaagttttgccttctctctgaagattatgattgcagtcttagtgattgcttgtccatgtgctttagggttggcaactcctacagctattatggtggctagtggtaaagcagctgagaatggtattttatttaaaggtggtgaagtgttggaaaaggctcaccacattgatacaatagtttttgataaaacaggaaccttgaccaaagggaaaccagaagtagttgctatcaaaacatatgggggagataaagaggagtttttaggtcaggtagcatcagtagaaaaactttcaaatcatccacttagccaaacaattgttaataaagcaaaagagaaagaacttcccttaagggaagtcatggcttttaaaaatattttgggttacggtttgagtgcaactattaatggtaaaactatgcttgtaggtaatgctaacttaatgactaagaacgatgttaatttagatttagcaaaggctgatatagaaatagctcaagaagaagcacaaactgtggtttacgtttccgaaaatggagtgttgagcggtttaataactttaacggaccagctaaagacagatagccaagaaacagttaagcagttacaaagattaggatttaatttagttttacttactggtgataataaggctagtgcagatgccatagcacaaaaattgggtatcacgacagttgtttcagaagttttacctgatcagaaagcaaacgttattttagaacttaaagaaaaaggcggacagattgcgatggttggtgatggcatcaatgatgctcctgcgctagctagcagtgatgtaggtatctctatgagttctggaacagatattgctattgaatcagcagatatcgtgttgatgaaacctgagttaacagatctcttaaaagcaatgactatcagtaaacaaacgattcaaattattaaggaaaatttattttgggctttcttttataacgttttagcgattccagtggcaatgggtgttttacatctttttggtggtcccttactcaatcctatgttggcaggcttagctatggcgtttagttcagtttcagtagttttaaacgcacttcgcttaaaagtcttaaaa

SEQ ID NO: 3504 - protein, 744 aa, Streptococcus agalactiae
MANRKETFLIDGMTCASCALTIEKAVNKLDHVDSAVVNLATEKMTVTFDDTTLSPNVIEECVSESGYEASLFKEETSKSQSERHQLAIEKMWHRFWMSAVATIPLLYISMGPMINLWLPSFLMPDKGPLNYGMIQLLLTLPVMYFGRIFYQNGFKALFKRHPNMDSLVAIATTAAFIYSLYGLYEILQGDIHYAHQLYFESVAVILTLITLGKYFEILSKGRTSASIEKLLTLSAKEARVIKDGEDYMVPLDKVKIGETILVKPGEKIPLDGHVVAGESSIDESMLTGESIPVEKKVGSKVYGASINGQGSLTIFVEKEAGGSLLSQIINLVEAAQTSKAPIANLADKVSGVFVPFVIVIAILSGLSWYLILGQSFAFSLKIMIAVLVIACPCALGLATPTAIMVASGKAAENGILFKGGEVLEKAHHIDTIVFDKTGTLTKGKPEVVAIKTYGGDKEEFLGQVASVEKLSNHPLSQTIVNKAKEKELPLREVMAFKNILGYGLSATINGKTMLVGNANLMTKNDVNLDLAKADIEIAQEEAQTVVYVSENGVLSGLITLTDQLKTDSQETVKQLQRLGFNLVLLTGDNKASADAIAQKLGITTVVSEVLPDQKANVILELKEKGGQIAMVGDGINDAPALASSDVGISMSSGTDIAIESADIVLMKPELTDLLKAMTISKQTIQIIKENLFWAFFYNVLAIPVAMGVLHLFGGPLLNPMLAGLAMAFSSVSVVLNALRLKVLK

SEQ ID NO: 3505 - DNA, 2151 bp, Streptococcus pyogenes
ttgcctgaagtagaacaggctgttgtgaatttagcgactgagaagctcacggttacttatcaagatgacgatttagaaacggccaaagttattcaagcggtgaaagctgctggttatggtgcacaagtctttgatgaacatgcaaaacacatgcaaacaggtcgtcgtgacgaagacctaaaggttatttggtctcaggtcttgtggtctgccctattcaccattcctatattatacctagctatgggtcacatggtgggcttatggcttcctccatttctgcaaccagatcgctatcctttcgtttacagctttagtcagctactcttgacgattccagtcttagtattaaatcgtcattattaccataatgggtttaaagctttgtttaagggacatcctaatatggactccttggtagctttagcaaccagctttgcttttgcttatagtctttatggagtggttgaaatcagtctgggccgggcgcactttgtgcactccctttattttgaatcggtggtagtgattttgacactcatcggtctaggaaagtattttgaaagtcgttctaagggccgtacttctcaagctattcaaaagctcctatccttgaaggctactgttgtgagggtatggagaaacagccaatggcaattgttaccattagaagaagttagctatgatgaccttgtcctggttcaaccaggtgaaaaagtttctattgacggtattatcgtggaaggacatagcagtttggatgaatcctttttaaccggggaaagtttgcctgttgaaaagggagaaaaagataatgtctttgcgggcagcttgaatgggccaggcgccctcacgattaaaccagataagcttggaaatgataccttgttagcacaaattatccaactagttgagaatgctcaagaaaataaagcacctattgcagctattgctgatagagtctcaggtgtctttgttccggtggttttggtattagctctgttaacaggggtgttttggttggtattcatgcaggaaagtcttcgttttagtttgacaacagccatcgctgttctagtcattgcttgcccttgtgcgcttggtttagcaacgccgacagcgattatggttggaacagggcgtgcagctgaaaatggtattctttttaaaggtggtgacatcttagaacaagcacatcaggtagatacggttgtttttgataaaacggggacgattacggaggggaaaccaagtcttcaaaagctcctaactttttcgggagatgatcaccttatcttgcaagaagctgcttccttggaggcctattctcaacaccccttaggggaggctattgttcgtgctgctcaggaagctggttacgatagtctaccagtggaagagtttgagtctttaaccggcctaggagttactggtcagcttgaagggcgtcgtttggcgattggaaatgctgctttaatgggaattcttggtatcgatttatcttgtgttcagtcggtttgtgctaaggcttctgagaaaggccaaacccttgtatattatgctaaagaggggcagctacgagctcttttcagtattgctgacgctgtcaaagaagatagtcaagctaccgtcgaagctttgcatcaactgggaattcacaccatcatgctaacaggtgaccacgatgctaccgctaaggctattgcctctcaagtggggattacagatgtgatcagtcaagtcttacctgatcaaaaagcaggcgtgatagcagacctccgctctcaagggagaaaagttgcaatggtaggtgatggtattaatgatgctccggcattggctgtagcagacattgggatagctatggggtcagggacagatattgccattgaatcggcggatgtgattctgatgaaacctgatatgctggatttggtgaaagctatgtcattgagtcgagtgactatgagaattgtcaaggaaaatttattttgggcattcatttacaatgtcctcatgattccagtggccatgggcttacttcatctttttggaggtccactattgaacccgatgttagcaggttttgccatgagttttagttcagtatcagttgttttgaatgccctgcgattaaaaggaaaaaccatt

SEQ ID NO: 3506 - protein, 717 aa, Streptococcus pyogenes
LPEVEQAVVNLATEKLTVTYQDDDLETAKVIQAVKAAGYGAQVFDEHAKHMQTGRRDEDLKVIWSQVLWSALFTIPILYLAMGHMVGLWLPPFLQPDRYPFVYSFSQLLLTIPVLVLNRHYYHNGFKALFKGHPNMDSLVALATSFAFAYSLYGVVEISLGRAHFVHSLYFESVVVILTLIGLGKYFESRSKGRTSQAIQKLLSLKATVVRVWRNSQWQLLPLEEVSYDDLVLVQPGEKVSIDGIIVEGHSSLDESFLTGESLPVEKGEKDNVFAGSLNGPGALTIKPDKLGNDTLLAQIIQLVENAQENKAPIAAIADRVSGVFVPVVLVLALLTGVFWLVFMQESLRFSLTTAIAVLVIACPCALGLATPTAIMVGTGRAAENGILFKGGDILEQAHQVDTVVFDKTGTITEGKPSLQKLLTFSGDDHLILQEAASLEAYSQHPLGEAIVRAAQEAGYDSLPVEEFESLTGLGVTGQLEGRRLAIGNAALMGILGIDLSCVQSVCAKASEKGQTLVYYAKEGQLRALFSIADAVKEDSQATVEALHQLGIHTIMLTGDHDATAKAIASQVGITDVISQVLPDQKAGVIADLRSQGRKVAMVGDGINDAPALAVADIGIAMGSGTDIAIESADVILMKPDMLDLVKAMSLSRVTMRIVKENLFWAFIYNVLMIPVAMGLLHLFGGPLLNPMLAGFAMSFSSVSVVLNALRLKGKTI

SEQ ID NO: 3507 - DNA, 204 bp, Streptococcus agalactiae
atgaaacatacctatcgagttagtggcatgaaatgtgatggttgtgccaaaacagtttctgataagttatcaagtgtgattggtgttgacgaggttaatgttgatttgactaaaaatcaagttgtcgtaagtggaaaaacattcaaatggcttttaaaacgttctttaaaagacacaaagtattcactagaagaggaaataaat

SEQ ID NO: 3508 - protein, 68 aa, Streptococcus agalactiae
MKHTYRVSGMKCDGCAKTVSDKLSSVIGVDEVNVDLTKNQVVVSGKTFKWLLKRSLKDTKYSLEEEIN

SEQ ID NO: 3509 - DNA, 201 bp, Streptococcus pyogenes
atggaaaaacattatcaggttacaggaatgacatgtgacggttgcgcaagaacggtcactgaaaaattatcagctgtccccggtgtgcaatcggtccaggtaaatttggaaaaaggagaggctaaggtgacaggacgtcctttaacgttcctaatcaagcgtgctttgaaggataccaaatttgaattatataaatggtct

SEQ ID NO: 3510 - protein, 67 aa, Streptococcus pyogenes
MEKHYQVTGMTCDGCARTVTEKLSAVPGVQSVQVNLEKGEAKVTGRPLTFLIKRALKDTKFELYKWS

SEQ ID NO: 3511 - DNA, 618 bp, Streptococcus agalactiae
gtgcagatgtcaattgatatttggaacattttaagtttggttggaaccgtagcttttgcaagttcgggagctattgtggcgattgaggaagaatttgatattctagggctttttatcttaggttttgtaacggcatttggtggtggagctattagaaatgtactaattggcttgcctattgaaacactttggagtcaaggaattgctttttatgcagcagcagcagctattttatttattatgattttccctaatttgttgagtggtaagggacgggatgccgaagttgtatcagatgctattgggttagcagcgtttagtgttcaaggagcactatatgcgactcaatctcatcaacctcttagtgctgtcattgtcgcagcagtactaactggtgcaggtggtggtattgtcagagatgttctggctggccgaaaacctggagtactaagaagtgaaatatatgcaggttggtcaatattagtggggatcattttatattttaaaattgctaaaacaacaactgactattatttgttagtgttagttgtaactagcctaaggatgttgggttataagaaacaatggcacttgccagttgtcagaccacgtaagaaa

SEQ ID NO: 3512 - protein, 206 aa, Streptococcus agalactiae
MQMSIDIWNILSLVGTVAFASSGAIVAIEEEFDILGLFILGFVTAFGGGAIRNVLIGLPIETLWSQGIAFYAAAAAILFIMIFPNLLSGKGRDAEVVSDAIGLAAFSVQGALYATQSHQPLSAVIVAAVLTGAGGGIVRDVLAGRKPGVLRSEIYAGWSILVGIILYFKIAKTTTDYYLLVLVVTSLRMLGYKKQWHLPVVRPRKK

SEQ ID NO: 3513 - DNA, 615 bp, Streptococcus pyogenes
atgacaattgatatgtgggaaattttaaatatcatcgggaccattgcctttgctctttctggtgctattgttgccatggaagaagaatttgatattttagggatttttattttaggtttcgtgacagcctttggaggcggagccattcgaaacaccctaattggtttacctatagaggccttatgggggcaaaagccagaattcacttgcgctttctttgctatggttttgattatgctttttcctaagctaatggctagaggttgggtacgggcagctgttttgactgatgccattggtctggcagcttttagtgtccaaggagccttgcatgctgtccgtcttaaccagcctttaagtgctgtcattgtaacagctgtgttgactggtgcaggcggtggtgttgtcagagatattctggcagggcgaaaacctagtgttttgcgtagtgaaatctatgctgggtggtctattcttgcagctattgttttgcattttaaactagcagattcaacgattgaatgttatgccttggttgttttactcacgactttacgcatgattggcaaccgtaaaaaatggaacctccctaaaatcaaatggaaagaggaaaga

SEQ ID NO: 3514 - protein, 205 aa, Streptococcus pyogenes
MTIDMWEILNIIGTIAFALSGAIVAMEEEFDILGIFILGFVTAFGGGAIRNTLIGLPIEALWGQKPEFTCAFFAMVLIMLFPKLMARGWVRAAVLTDAIGLAAFSVQGALHAVRLNQPLSAVIVTAVLTGAGGGVVRDILAGRKPSVLRSEIYAGWSILAAIVLHFKLADSTIECYALVVLLTTLRMIGNRKKWNLPKIKWKEER

SEQ ID NO: 3515 - DNA, 828 bp, Streptococcus agalactiae
atgatagaggagaaaaagatgataaaattaattgctattgatatggatggaacgcttttaaatgatgaaaagaaaattccaaaggaaaatatccaagctattaaagaagcaactcaagcaggtattaaaattgtactgtgtactgggcgaccgatgtcaggtatacttccttattttaatgaactaggtttaacaaaagaggagtatattatcatgaataatggttgtagcacttatagcacgaaagattggcaattgattgattctgcaactttaacacatgatgaactcatctttcttgaggaggttgttaaagaatttcccaacgtttgtttaacattaacagctgaaaatacattttacgctgttggagaggaagttcctgaaattgttgcttatgatgctgatttagtttttacaaaagcaaagtcaacaagtttagatgctcttcgcaatcaagaagaaattgtctttcaagcaatgtacatgggattagatgcagatgtaactgcttttcaagaagctgttgaagaagccttaatctcgaaatttagtggagttcgaagccaagactatatttatgagattatgcctcaaggagtaacaaaagcaagaggcttaaaatccttgatagcaaaattaggactggatattaatcaagttatggccatcggtgatgctcctaacgatattgaattattagatttagttcccaatagcgttgctatggggaatgcatcagatgagattaaatctagatgtaaatatataacggtggataataacaaagcaggggttgctaaagctatttatgactatgctttacgt

SEQ ID NO: 3516 - protein, 276 aa, Streptococcus agalactiae
MIEEKKMIKLIAIDMDGTLLNDEKKIPKENIQAIKEATQAGIKIVLCTGRPMSGILPYFNELGLTKEEYIIMNNGCSTYSTKDWQLIDSATLTHDELIFLEEVVKEFPNVCLTLTAENTFYAVGEEVPEIVAYDADLVFTKAKSTSLDALRNQEEIVFQAMYMGLDADVTAFQEAVEEALISKFSGVRSQDYIYEIMPQGVTKARGLKSLIAKLGLDINQVMAIGDAPNDIELLDLVPNSVAMGNASDEIKSRCKYITVDNNKAGVAKAIYDYALR

SEQ ID NO: 3517 - DNA, 879 bp, Streptococcus pyogenes
ttggcaaccgtaaaaaatggaacctccctaaaatcaaatggaaagaggaaagataggatgattcaactaattgcaattgatttggacggcaccttattaaaccaggacaaacagattccaaaagagaatatcacagccatccaagaagcagctcagtcaggcttaaaaattgtcttatgcacaggccggcctcagtcagggacaagaccctattttgaccaattaggtttgacacaagaggaattcctcattatcaataatggctgtagtacttatagtagtcctgactggcaattacgccattcaaaaatgttgaaggtttcagatattgaattgctggaagagctaagccaaagttttccagatatttacctgactttaactgaggaaaacgattatttggtgcttgaagaagaagtgccagaccttgtgcaggaagatggagatttggtatttaccattgtcaagcctgtctccttagcagagctgtcggacactcctcgcctgatttttcaagccatgtacttaggagaaaaagctgcgctagatgcctttgaacgtgcggtgagaaatcagcttagtcagagttttcatgttgttcgtagccaagataatattttagaaattctccctcagggagtcagcaaggcatcggctctcaaagaattagtagaagatttgggtttaactgctgaccaagtgatggctattggggatgctcccaatgacattgagatgttaacttatgctggtttaggagttgctatggaaaatgcttcagcagctatcaagccattagctgacaaagtcactttgactaatgatatggcgggtgtggcccaggctatccgtcagtttgcacttgtagctcaaaaagac

SEQ ID NO: 3518 - protein, 293 aa, Streptococcus pyogenes
LATVKNGTSLKSNGKRKDRMIQLIAIDLDGTLLNQDKQIPKENITAIQEAAQSGLKIVLCTGRPQSGTRPYFDQLGLTQEEFLIINNGCSTYSSPDWQLRHSKMLKVSDIELLEELSQSFPDIYLTLTEENDYLVLEEEVPDLVQEDGDLVFTIVKPVSLAELSDTPRLIFQAMYLGEKAALDAFERAVRNQLSQSFHVVRSQDNILEILPQGVSKASALKELVEDLGLTADQVMAIGDAPNDIEMLTYAGLGVAMENASAAIKPLADKVTLTNDMAGVAQAIRQFALVAQKD

SEQ ID NO: 3519 - DNA, 2640 bp, Streptococcus agalactiae
atgacaaacaagaataaattacttttaattgatggctcatctgtagcctttcgtgctttttttgctctttataatcaaattgaccgctttaaaaacaattctggacttcatactaatgccatatatggtttccatttgatgttgaatcatattttaggtcgtgtccagcctagtcatattttagtggcttttgatgccggaaaaactactttccgtacggaaatgtatgcagattataaaggtgggcgtgctaaaactccggatgaatttcgtgaacaatttccttacattcgtcaacaattagatgtcttaggcatcaaacattatgaattggaacattatgaagccgatgatatcattggtactcttgcaaaacaagccgaagctagtaatgaacattttgatataacggtggtttctggggataaagatttaattcaattaacagacactaacacggtagtagaaatctctaaaaagggagttgctgagtttgaagaattcacgccagcttaccttatggaaaaaatgggaattacgccgagtcaatttattgatttaaaagctttgatgggagataaatcagataatattcctggggttactaaaatcggtgaaaaaactggcttgaagttgctatcagaatatggttccttagaagggatctatgaaaatattgaggctatgaaacagtctaagatgaaagaaaaccttatcaatgataaggagcaagctttcttatcaaagaccctagctacaatcaacatagcatcacctataacaatcggcttagaagatatcctttatagtggaccgcaagatataaaagccttgtctcaattttatgatgagatggattttaaacagtttaaagcagctctgggtgaggagacaagtcaggaagattttgaggttgactttactgaagtggagcaattaaaaacagaaatgttctccgataatgatttttattactttgagatgttgggtgataactaccatgtagaagatttaattgggatagcttggggaaatagcgatacaatctacgctactagtaatgtatcgttattgcaagaagctttatttaaaaaagctttatcaaaacctatcaaaacttatgattttaaaagaagtaaggtccttttaaatcgttttaatattgatttaccagagccagcctttgatactagattggccaagtaccttttgtctactactgaggataatctagtatcaacaattgctaggttatatacaaatctgccactggatactgatgatgctgtttatgggaaaggtgctaaacgcgctataccagaaaaaacacgatttcttgagcatctagctaaaaaagtaaaagttttagtggattctgaggctaatattatgcaacagcttaaagctaatgagcaagaagaattgctgtttgaaatggagcaacctttagcgaatgttttagctaaaatggaaattcgaggtattaaggttaagaaaaataccttgaatgaaatggccattgaaaatcaaaaagtcatcgaaacattaacacaagaaatctatgaattggctgggcaagagtttaatattaattctccaaaacagttaggaaagttgttgtttgaaacgttaggtcttcctgtagaaatgactaaaaaaacaaaaacaggttattcaactgcagtagatgtattagagcgcttagctccgatttctcctcttgtaactaaaattttagagtaccgtcaaatcactaaattgcaatcaacctatattattggtttacaagattatattttagaagatggtaaaattcatacacgttatgttcaagatttgactcagacaggtcgtctttcaagttctgacccaaaccttcaaaatataccagttagactagagcaaggacggcttatccgaaaagcttttgttccatcagaagacaatgctgttttattgagttcagattattctcaaatagaattgcgcgtgttagcacatatttcaaaagacgaacatttgatcgctgcctttaaagagggagctgatattcatacttcaacagctatgcgtgtttttggtatcgaaaaacctgagaatgtcactcccaatgatcgtcgaaatgctaaggctgttaattttggaattgtttatggtatttcagattttggtctatcgcataatttaggaatacctcgtaaactagcgaagcaatatattgacacctattttgagcgttatcctggaataaaaaactatatggaaacagttgttcgtgaagcaaaagataagggttacgttgaaacacttttccatcgtcgtcgttcattaccagatattaattctcgtaattttaacattcgccaatttgcagagcgcacagcaatcaattcaccaatccaaggaagtgcagctgatattcttaaaattgcaatgataaatttagatagggtacttgataaaggtggttataaatcaaaaatgctgttgcaagttcatgatgaaattgtacttgaagtccctaacgaggagataggagcaatcagggagttggttacaaaaacaatggagtcagcaattagtttatcggtacctttgattgcagatgagaacgcaggtgagacttggtatgaagcgaag

SEQ ID NO: 3520 - protein, 880 aa, Streptococcus agalactiae
MTNKNKLLLIDGSSVAFRAFFALYNQIDRFKNNSGLHTNAIYGFHLMLNHILGRVQPSHILVAFDAGKTTFRTEMYADYKGGRAKTPDEFREQFPYIRQQLDVLGIKHYELEHYEADDIIGTLAKQAEASNEHFDITVVSGDKDLIQLTDTNTVVEISKKGVAEFEEFTPAYLMEKMGITPSQFIDLKALMGDKSDNIPGVTKIGEKTGLKLLSEYGSLEGIYENIEAMKQSKMKENLINDKEQAFLSKTLATINIASPITIGLEDILYSGPQDIKALSQFYDEMDFKQFKAALGEETSQEDFEVDFTEVEQLKTEMFSDNDFYYFEMLGDNYHVEDLIGIAWGNSDTIYATSNVSLLQEALFKKALSKPIKTYDFKRSKVLLNRFNIDLPEPAFDTRLAKYLLSTTEDNLVSTIARLYTNLPLDTDDAVYGKGAKRAIPEKTRFLEHLAKKVKVLVDSEANIMQQLKANEQEELLFEMEQPLANVLAKMEIRGIKVKKNTLNEMAIENQKVIETLTQEIYELAGQEFNINSPKQLGKLLFETLGLPVEMTKKTKTGYSTAVDVLERLAPISPLVTKILEYRQITKLQSTYIIGLQDYILEDGKIHTRYVQDLTQTGRLSSSDPNLQNIPVRLEQGRLIRKAFVPSEDNAVLLSSDYSQIELRVLAHISKDEHLIAAFKEGADIHTSTAMRVFGIEKPENVTPNDRRNAKAVNFGIVYGISDFGLSHNLGIPRKLAKQYIDTYFERYPGIKNYMETVVREAKDKGYVETLFHRRRSLPDINSRNFNIRQFAERTAINSPIQGSAADILKIAMINLDRVLDKGGYKSKMLLQVHDEIVLEVPNEEIGAIRELVTKTMESAISLSVPLIADENAGETWYEAK

SEQ ID NO: 3521 - DNA, 2640 bp, Streptococcus pyogenes
atggaaaacaagaataaattactattaattgatgggtcatctgttgcctttcgtgccttttttgccctctacaatcaaattgaccgctttaaaaaccatagcggtcttcataccaatgccatttatggctttcatttgatgctagaccacatgatgaagcgagtccagcccacacacgtgctggtggcttttgatgcgggcaaaaccaccttccggacagaaatgtatgccgattataaggcgggtcgcgctaaaaccccagaggaatttcgtgagcagtttccttatattcgtgagatgttgacagcccttgggattgcttattatgagttggaacactacgaagcagacgatattatcgggacgcttgataaaatggcggagcgcacagaagtgccttttgatgtgaccattgtcagtggtgataaagatttgatccagttaactgacgaaaataccgtggttgaaatttctaaaaaaggggtagccgaatttgaagaattcacaccggcttacctcatggaaaaaatgggattgacgccaaaccagtttattgacctcaaagccttgatgggagataaatcggataatattccaggagtgaccaaaatcggtgaaaaaactgggctcaagctccttcatgaatttggtagtttagaaggtatctacgagcatattgatggattcaagacctcaaaaatgaaagaaaacttgattaatgatcgtgaccaagctttcctatctaaaacgctcgccactatcaatacagcatctcctatcacaattggcttagatgatattgtctacaatggtccagatgttgctagtctctctcaattttacgatgagatggattttgtgcaactcaagaaaggtcttgctagccagatgcctcaagagccagtagctgtcatttcctatcaagaagtgaccaatgtgtctgctgatttgtttagcgcagaagacatcttctactttgaaacgcttcgggacaattaccatcgtgaggccatcattggttttgcttggggacatggtgagcagatttacgcatccacagaccttggcctattagcgacggatagttttaagcaggtcttccaaaaacccattgccacttatgattttaaacgtagcaaggtcttgttgagccacttaggaattgagttggtagcacctagctatgatgctagattagctaattaccttctgtcaactgtagaagacaatgagcttagcaccattgcccgcatttttactgacatctctttggaagaagacgatacagtctatggtaaaggtgctaaacgggctgttcctgataaagacgtcttactagaacacttagctcgtaaggtcaaagtattattagatagcaagtctcaaatgctagacaagctcactgcccatgagcaactagacctctatcagaatattgaattgcctttggctaatgtccttgctaaaatggaaattgaagggatcaaggttaatagggcgactttgcaagatatggcagagcaaaacaaggtcattattgaagcgctcacccaagagatttatgatatggctggccaagaatttaatatcaattcgcctaaacagttaggcagtatcttgtttgagaagatgcaactacctcttgagatgactaagaagaccaaaacaggttattctacagctgttaatgttttggaacgtttggcaccgattgctccaattgtggctaaaattttggattaccgccagattaccaaattacagtctacttatgtgattggtttacaggattatattctggctgatggcaagattcatacccgctatgtgcaggatctcacgcagacagggcgtttgtctagtgtggaccctaatcttcaaaacattcccattcgtttggaacaggggcgtttgattcgtaaggcctttaccccatctcatgaagatgccgtcttgttgagttcagattactcacagattgaattgcgggtactggcacatatttcaggggatgagcatttgattgctgcctttaatgaaggggcagacattcatacctcaacggctatgcgtgtgtttgggattgacagggcagcagatgttactgccaatgaccgccgtaatgccaaggctgttaactttggaattgtgtatgggatttctgattttggtttgtcaaataaccttggtatcacccgtaaacaggccaagtcttacattgatacctattttgaacgctatcctgggattaaagcctatatggaaaatgtggtgcgtgaggctaaagacaagggctatgtagagaccctctttaagcgtcgtcgtgaattaccggatatcaactctcgtaatttcaacgttcgctcttttgcggagcgtacagccatcaactcgcccattcaaggaagcgcagctgatattctcaaaatcgctatgattaatctggataaggccttgcaagcaggtggttttagagctaaaatgctgcttcaagtgcatgatgaaatcgttttggaagtgccaaatgatgagttgactgctataaaaaaacttgtcaaagacaccatggaagctgctgttgatttagctgttcctttatgtgtcgatgaaagtactgggcatagctggtacgaagccaaa

SEQ ID NO: 3522 - protein, 880 aa, Streptococcus pyogenes
MENKNKLLLIDGSSVAFRAFFALYNQIDRFKNHSGLHTNAIYGFHLMLDHMMKRVQPTHVLVAFDAGKTTFRTEMYADYKAGRAKTPEEFREQFPYIREMLTALGIAYYELEHYEADDIIGTLDKMAERTEVPFDVTIVSGDKDLIQLTDENTVVEISKKGVAEFEEFTPAYLMEKMGLTPNQFIDLKALMGDKSDNIPGVTKIGEKTGLKLLHEFGSLEGIYEHIDGFKTSKMKENLINDRDQAFLSKTLATINTASPITIGLDDIVYNGPDVASLSQFYDEMDFVQLKKGLASQMPQEPVAVISYQEVTNVSADLFSAEDIFYFETLRDNYHREAIIGFAWGHGEQIYASTDLGLLATDSFKQVFQKPIATYDFKRSKVLLSHLGIELVAPSYDARLANYLLSTVEDNELSTIARIFTDISLEEDDTVYGKGAKRAVPDKDVLLEHLARKVKVLLDSKSQMLDKLTAHEQLDLYQNIELPLANVLAKMEIEGIKVNRATLQDMAEQNKVIIEALTQEIYDMAGQEFNINSPKQLGSILFEKMQLPLEMTKKTKTGYSTAVNVLERLAPIAPIVAKILDYRQITKLQSTYVIGLQDYILADGKIHTRYVQDLTQTGRLSSVDPNLQNIPIRLEQGRLIRKAFTPSHEDAVLLSSDYSQIELRVLAHISGDEHLIAAFNEGADIHTSTAMRVFGIDRAADVTANDRRNAKAVNFGIVYGISDFGLSNNLGITRKQAKSYIDTYFERYPGIKAYMENVVREAKDKGYVETLFKRRRELPDINSRNFNVRSFAERTAINSPIQGSAADILKIAMINLDKALQAGGFRAKMLLQVHDEIVLEVPNDELTAIKKLVKDTMEAAVDLAVPLCVDESTGHSWYEAK

SEQ ID NO: 3523 - DNA, 468 bp, Streptococcus agalactiae
gtggacaacatacgtaaaggagtcattaatatggtttatcattttcaaaatccaagtgattttatgttaaaaaattatttaacaaaagcaaagaccatcgcagttgtaggactgtcagaccgtcaagaaactgcagcttatcaagtatcaaaaataatgcaagaagcaggttatcaaattattccagttaatcctaaaaatgcaggacagaaaatacttgggcaaatgacatatgcctcacttaaggatgtcactgaacatattgatattgttaatatttttcgacgtagcgagtatttacctgatattgcaagagaatttttagaagtagacgctgatattttctgggctcagcttggacttgaaagtcaagaagcagagacaattctaaagcaagcaggacacaaacagattgtcatgaataaatgtctgaaagttgaatgccaaaaattacactcagaaactaac

SEQ ID NO: 3524 - protein, 156 aa, Streptococcus agalactiae
MDNIRKGVINMVYHFQNPSDFMLKNYLTKAKTIAVVGLSDRQETAAYQVSKIMQEAGYQIIPVNPKNAGQKILGQMTYASLKDVTEHIDIVNIFRRSEYLPDIAREFLEVDADIFWAQLGLESQEAETILKQAGHKQIVMNKCLKVECQKLHSETN

SEQ ID NO: 3525 - DNA, 453 bp, Streptococcus pyogenes
gtgatttattcgtttcaaaatccctcagaggatgtcctaaaagcttacttggagtcagccaaaaccattgcggttgttggtctttctgaccgcaaagacacagcagcttatggtgtcgccaaatttatgcaggctatggattatcggatcattccagtcaatcccaaattagcaggtcagcttattttgggagagaaggtctatgccagtatcaaggcaattccctttgaggttgacattgtagatgtctttcgcagaagtgagtttttaccagaagttgccagagactttttagcaggtcaggccaaagtcttttgggcgcaattaggccttgaaaaccaagaagcacaaaccattttacggtcggcaggcaaagaggctattgtgatgaaccgctgcctaaaaatagactatttgcaattagtcgctaaaccagaatgcatcacaaatcat

SEQ ID NO: 3526 - protein, 151 aa, Streptococcus agalactiae
VIYSFQNPSEDVLKAYLESAKTIAVVGLSDRKDTAAYGVAKFMQAMDYRIIPVNPKLAGQLILGEKVYASIKAIPFEVDIVDVFRRSEFLPEVARDFLAGQAKVFWAQLGLENQEAQTILRSAGKEAIVMNRCLKIDYLQLVAKPECITNH

SEQ ID NO: 3527 - DNA, 495 bp, Streptococcus agalactiae
gtgctggaaaggagtcctatggacagtcattcacatggtcatagacctctcgatgcttatgaaaacgtcctagagcatctccgtgaaaaacgtattcgaattactgagactcgaaaagctattatttcctatatggttaatagtcgtgagcatccgagtgcagaaaagatttacaatgatttattaccagaatatcctaacatgagcttggcaacagtttacaataaccttaaggtccttgtggatgaggggtttgtgacagagctaaaactttgcaattatagtacaacttattatgattttatggggcatcagcacctaaacattgcctgtgaagattgtgggaaaatcgttgattttgtcgatgttgacttattggatatttctagagaagcacaccaacaaacaggttttgaagtgactagagttcagttagtagcttatggtatctgtccggagtgtcagaggaagcgtaaggataaatataaaaaagat

SEQ ID NO: 3528 - protein, 165 aa, Streptococcus agalactiae
MLERSPMDSHSHGHRPLDAYENVLEHLREKRIRITETRKAIISYMVNSREHPSAEKIYNDLLPEYPNMSLATVYNNLKVLVDEGFVTELKLCNYSTTYYDFMGHQHLNIACEDCGKIVDFVDVDLLDISREAHQQTGFEVTRVQLVAYGICPECQRKRKDKYKKD

SEQ ID NO: 3529 - DNA, 465 bp, Streptococcus pyogenes
atggacattcattcacatcagcaagccctagatgcctatgaaaatgtcctagagcatctacgggaaaaacatattcgaattacagagacacgtaaagccattatttcttacatgattcagtccacagaacaccctagtgccgataagatttaccgtgacttacagcctaactttcctaacatgagccttgccacagtctataataatttgaaagttttagttgatgaaggttttgtctcagaattgaaaatcagcaatgatttaaccacctactatgactttatgggccatcaacacgtcaatgtggtttgtgaaatatgtgggaagattgctgactttatggatgttgatgttatggatattgccaaagaagcccatgagcaaacaggttataaggtcacgcgtatcccagttattgcttacgggatttgtccggattgccaagcaaaagaccaacctgatttt

SEQ ID NO: 3530 - protein, 155 aa, Streptococcus pyogenes
MDIHSHQQALDAYENVLEHLREKHIRITETRKAIISYMIQSTEHPSADKIYRDLQPNFPNMSLATVYNNLKVLVDEGFVSELKISNDLTTYYDFMGHQHVNVVCEICGKIADFMDVDVMDIAKEAHEQTGYKVTRIPVIAYGICPDCQAKDQPDF

SEQ ID NO: 3531 - DNA, 1563 bp, Streptococcus agalactiae
atgaaaatatcacaatacaataaatggtcaattcgccgattgaaagttggagctgcatctgtaatgattgctagtggaagcattgttgctttagggcaatctcatattgtttcagcagatgagatgtcccaacctaaaacaaccattacagctccaacagctaacacttctacaaatgtagaaagtagtactgataaggcattatcaaaagttactacgatggagacaagttcagaaatgcctaaaatgcaaaatatggcaaaagttgaaaaaacgagtgacaaacctatgatggtggctacctctgttagaaaaatgatggcaacgccgacacctgtagcgatgaccaaaacgactagtgtagatgaggtaaagaaatcaactgatactgcttttaaacagacagtagacgttccggctcattatgttaatgcagcaaaagggaatggcccatttctagcaggtgtaaatcaaacgattccatatgaagcgtttggtggagatggcatgttaacgcgtttaatccttaaatcttctgaaggagcaaaatggtcagataatggtgttgataaaaatagtccattattaccattgaaaggcttaactaaaggtaaatatttctatcaagtttctttaaatggtaatacgacaggtaaagagggacaagctctcttagatcaaattaaagctaatgataaacatagctaccaagccacaattagagtttatggtgctaaagatggtaaagttgatttaaaaaacatgattagcccaaaaatggtaaccattaacattcctcacattacaactgatatggaagtaaaaaattctctaaagatggcctttaaagaaaaagtagacgtcccagcaaaatatgttagtgctgcaaaagctaaaggtccatttttagcaggtgttaacgaaacgattccatatgaagcgtttggtggggatggcatgttaacgcgtttaatccttaaagcttcagagggagcaaaatggtcagacaatggtgttgataaaaatagtccattattaccgttaaaagatttaactaagggtaaatacttctaccaagtctctcttaatggcaatacagccggtaaaaaaggccaagctctcttagatcaaattaaggcaaatggaagccatacttatcaagcaactatcactatttatggtacgaaagatggcaaagttgatatgaatactattttaggacaaaagacagtgatgattcatattaatgtcgctaaaaaagatatgaatagcacatcaatgatgatgaaaaaagataagatgacaatgcctatgaagaaagaaatgacttcatctaaaataaataccggtatgatgatgtctaacaacaagatgtcagctaatatgcaaatgtcatcacaagccaaatcaaatgataaagctggtaaaaaaatgtctatgatgtctaaaaatttacctaatacaggtgaaacaaagcaacaaaatgtaggtgtgctaggtatgcttagtctagcctttgcgacaggtctaactgcgctaggtcttaaaaaatctaaacaaaga

SEQ ID NO: 3532 - protein, 521 aa, Streptococcus agalactiae
MKISQYNKWSIRRLKVGAASVMIASGSIVALGQSHIVSADEMSQPKTTITAPTANTSTNVESSTDKALSKVTTMETSSEMPKMQNMAKVEKTSDKPMMVATSVRKMMATPTPVAMTKTTSVDEVKKSTDTAFKQTVDVPAHYVNAAKGNGPFLAGVNQTIPYEAFGGDGMLTRLILKSSEGAKWSDNGVDKNSPLLPLKGLTKGKYFYQVSLNGNTTGKEGQALLDQIKANDKHSYQATIRVYGAKDGKVDLKNMISPKMVTINIPHITTDMEVKNSLKMAFKEKVDVPAKYVSAAKAKGPFLAGVNETIPYEAFGGDGMLTRLILKASEGAKWSDNGVDKNSPLLPLKDLTKGKYFYQVSLNGNTAGKKGQALLDQIKANGSHTYQATITIYGTKDGKVDMNTILGQKTVMIHINVAKKDMNSTSMMMKKDKMTMPMKKEMTSSKINTGMMMSNNKMSANMQMSSQAKSNDKAGKKMSMMSKNLPNTGETKQQNVGVLGMLSLAFATGLTALGLKKSKQR

SEQ ID NO: 3533 - DNA, 684 bp, Streptococcus agalactiae
atgacacaaaaattattattagttgacgatgaatttgaaattattgatattaatagacgttatctagagcaagcaggatatgaagtgtcagtagctgcggatggcatagaagcactcaaagaggtagatgagaatcgttttgacctaattattagtgatattatgatgcctaaaatggatggctatgattttattagtgaagttctagttcgagaacccaaccaaccttttctctttataaccgctaaagtatctgaaccagataaaatttactctttgagtatgggtgcagatgactttatttccaagcctttcagtcctagggaattagttttacgtgttaaaaatattctaagacgtatctatgggaatcatcaacaatctgaagtgttgacgattggtgatttggttatcgaccaaaaacaacgtttggtaatggtggactgcaatacaatttccttaaccaataaatcatttgacttgctttggatattagcaaatcatttgaatcgtgttttttcaaaaacagagctttatgaacgtgtctggggcgaagaatttttagatgacactaatactttgaatgttcatatccatgccttacgcaatgaccttgctaaatttagtacagacaataccccaactatcaaaacagtttggggattagggtataaattagaggaa

SEQ ID NO: 3534 - protein, 228 aa, Streptococcus agalactiae
MTQKLLLVDDEFEIIDINRRYLEQAGYEVSVAADGIEALKEVDENRFDLIISDIMMPKMDGYDFISEVLVREPNQPFLFITAKVSEPDKIYSLSMGADDFISKPFSPRELVLRVKNILRRIYGNHQQSEVLTIGDLVIDQKQRLVMVDCNTISLTNKSFDLLWILANHLNRVFSKTELYERVWGEEFLDDTNTLNVHIHALRNDLAKFSTDNTPTIKTVWGLGYKLEE

SEQ ID NO: 3535 - DNA, 1035 bp, Streptococcus agalactiae
atgaaattaaaatattatattgttattggttaccttatttctatgttaataactgtagcaggtgttttctttgggcttaatcatatgctgattgagactcgaggtgtttactacatcctttcagttacaattattgcctgtattgtaggtggtatagttaatttgttcttattatcaagtgtatttacatctttgaaaaagttaaaacaaaaaatgaaggatatttctcaaagatgttttgatacaaaagcacaaatttgttcaccacaagaattcaaggatttagagacagcctttaaccaaatgtcttcggagttagagtcaacgtttaaatctctaaacgagagtgaacgcgaaaaaacaatgatgattgcacaactttcacatgatatcaagactccaattacttctatacaatcaacagtagaaggtattttagatggtattatatctgaagaagaagttaactattatctcaataccatttctcgtcaaacaaaccgtcttaaccatctggttgaagaattaagttttattacattagagactatgtcagacacggctgaacctcataaagaagaaacaatttatctggataaactactgattgatattttatctgaatttcaattggtgtttgaaaaagaaaatcgccaagtaatgattgatgttgcgccagatgtttcgaaattatctagtcaatatgataaattatcacgaattttattgaatttgattagcaatgcagtcaaatattctgatcctggaagtcccttgactatcaaggcctattcaaatcgtcaagatatcgttatcgatattattgaccaaggctatgggataaaagatgaagatcttgcttctatttttaatcgtctttatcgtgtagaatcttcacgaaatatgaagacaggaggacatggtctaggtctttatattgcgcgacaacttgcacatcaactgaatggggatattttggtcgaaagtcagtatcaaaaaggcagtaagttctctttagtacttaaattacaaaaa

SEQ ID NO: 3536 - protein, 345 aa, Streptococcus agalactiae
MKLKYYIVIGYLISMLITVAGVFFGLNHMLIETRGVYYILSVTIIACIVGGIVNLFLLSSVFTSLKKLKQKMKDISQRCFDTKAQICSPQEFKDLETAFNQMSSELESTFKSLNESEREKTMMIAQLSHDIKTPITSIQSTVEGILDGIISEEEVNYYLNTISRQTNRLNHLVEELSFITLETMSDTAEPHKEETIYLDKLLIDILSEFQLVFEKENRQVMIDVAPDVSKLSSQYDKLSRILLNLISNAVKYSDPGSPLTIKAYSNRQDIVIDIIDQGYGIKDEDLASIFNRLYRVESSRNMKTGGHGLGLYIARQLAHQLNGDILVESQYQKGSKFSLVLKLQK

SEQ ID NO: 3537 - DNA, 783 bp, Streptococcus agalactiae
atgtgttataatgaaatgaattgtacttttgtgtatggaggagatatgacgaattcagaaattaaaaatgaggcaaaaactatattaagcaatcttcaaggtaagaatcaactttttttactcccgattctccttagtattattacgttatatatatcattttattatcaatataataatatgacactacttgatttttttgtacctcttccagtttatttcttttacacactttttattatttcagtcagttttgtaatgttagatgtcgtcaaaaatcagaaactaaacgttagattctcggacaatacttatgtattttcaagccatattttctggaaattactctcagtacttgttctaaaaggactaattttatctttcttttatctactaagtacttttggtctactaatcatcatttcaagttttaggctacttttgagtggtaaccttatccttgcccctgttttaatagttgttagtagcctaattactactaaggcagttataaaactcgttcaacaatattactcctatagtatctcaactttagtattttacactcaattagaaagtggaaactatgagggaccgtctaaagtactggttgctagtcgagaactaatgaatggtaataaacttagactcttccttttagacttaagttttattggttggcagttccttacaatcttcagtttcggattagtctatatctatctccttccttaccaaactactgcgcgcttaatcttttatagaaacattacaaaaaatagc

SEQ ID NO: 3538 - protein, 261 aa, Streptococcus agalactiae
MCYNEMNCTFVYGGDMTNSEIKNEAKTILSNLQGKNQLFLLPILLSIITLYISFYYQYNNMTLLDFFVPLPVYFFYTLFIISVSFVMLDVVKNQKLNVRFSDNTYVFSSHIFWKLLSVLVLKGLILSFFYLLSTFGLLIIISSFRLLLSGNLILAPVLIVVSSLITTKAVIKLVQQYYSYSISTLVFYTQLESGNYEGPSKVLVASRELMNGNKLRLFLLDLSFIGWQFLTIFSFGLVYIYLLPYQTTARLIFYRNITKNS

SEQ ID NO: 3539 - DNA, 861 bp, Streptococcus pyogenes
atgtcaattaaagcaatcaaaggccaggctagagacacgttaaaaaatctctctggcaagtatttactatttttaattccaacccttctctttatgtttcatttcggtattgagattcatcaaggttacgtcctatctagtggtattgaagtctcgctagcggctagttatttcccattactactaggacttatccttagccttttcattttatcagcatcctttacgatgattgatgttgttaggcattttcgtcagaaagtttcttttgccgaatcaacaacagccttctcaaaagaattctttgggaacctgctggttttagcgatcactaagtggctattctttctcatctggtcactaatttggttttttggcctctttattttcctttccggactttcagcgtttttggtcaatgctaaatcaggtagctcaacagtcatttcactgatctttttactatttggagcagttttgtccttaattggttttggtatttatatcaaccgttattacgcttatagtctatcagaataccttctctacgatgaggttaaagaggggacttatctaggagctatagccgtcattgaaacaagtgtagctatgatgaaaggttataaatggaagctttttttcctacaacttagcttcaccggttggtttctactgaatattgttacttttgggttacttaatatctatcttttaccatattttacaacagccaatgtcattttttatgatcaactcaagaaacgtttcaaagacaaagatgacccaattgaaggagaacatttaagccttcatcagcttaataaaaatcctactcctatgatgtatgacgatcaaaaagac

SEQ ID NO: 3540 - protein, 287 aa, Streptococcus pyogenes
MSIKAIKGQARDTLKNLSGKYLLFLIPTLLFMFHFGIEIHQGYVLSSGIEVSLAASYFPLLLGLILSLFILSASFTMIDVVRHFRQKVSFAESTTAFSKEFFGNLLVLAITKWLFFLIWSLIWFFGLFIFLSGLSAFLVNAKSGSSTVISLIFLLFGAVLSLIGFGIYINRYYAYSLSEYLLYDEVKEGTYLGAIAVIETSVAMMKGYKWKLFFLQLSFTGWFLLNIVTFGLLNIYLLPYFTTANVIFYDQLKKRFKDKDDPIEGEHLSLHQLNKNPTPMMYDDQKD

SEQ ID NO: 3541 - DNA, 1173 bp, Streptococcus agalactiae
atgactgtttttcatggaagcaaggagaaaacgatgactgatcatccaataaaatatcgattaattaaacaggaaaaacacacaggagccagacttggtgaaataatcacaccacatggtacatttccgacaccaatgtttatgcctgttgggacacaagcaactgttaagacacaatctcctgaagaactaaaagaaatgggttcaggaattattctatcaaatacctaccatttatggttacgtccaggtgatgaattgattgctaaagctggaggtttacataaattcatgaactgggatcaggctattctaacagacagtggaggctttcaggtttattctttggctgatagtcgaaacatcactgaagaaggagtaacctttaaaaaccatttaaatggtgcgaaaatgtttttatcaccagaaaaagctatttcaattcaaaataaccttggttctgatattatgatgagttttgatgagtgtccacaattttaccagccttatgattatgtaaaaaaatcaattgagcgaacaagccgttgggcagaacgtggattaaatgcccaccgccgtcctcatgatcaaggactatttggtattgttcaaggggcagggtttgaggatttacgtcgtcaatcagcacgagatttagtatcgatggattttccaggttattcaattggagggcttgcggtcggagaaacacatgatgagatgaatgcagttcttgattttactgttccaatgcttccgaatgataagcctcgttatttgatgggagttggtgcaccagatagtttaatagacgccgttatccgaggagtagatatgtttgattgcgtcttacctactcgtattgctcgaaatgggacatgtatgacaagtcaaggtcgcttagttgttaagaatgctaaatttgcagaagattttacgcctcttgatccaaattgcgattgctatacttgtaaaaattatacacgcgcttatattcgtcacttattgaaagcagatgaaacttttggtattcgtttgactagttaccataatctttatttccttgtcaatcttatgaaagatgtcagacaagctattatggatgataatcttctagaattccgtcaagattttatggagcgctatggctatggcatgaataaccgtaatttt

SEQ ID NO: 3542 - protein, 391 aa, Streptococcus agalactiae
MTVFHGSKEKTMTDHPIKYRLIKQEKHTGARLGEIITPHGTFPTPMFMPVGTQATVKTQSPEELKEMGSGIILSNTYHLWLRPGDELIAKAGGLHKFMNWDQAILTDSGGFQVYSLADSRNITEEGVTFKNHLNGAKMFLSPEKAISIQNNLGSDIMMSFDECPQFYQPYDYVKKSIERTSRWAERGLNAHRRPHDQGLFGIVQGAGFEDLRRQSARDLVSMDFPGYSIGGLAVGETHDEMNAVLDFTVPMLPNDKPRYLMGVGAPDSLIDAVIRGVDMFDCVLPTRIARNGTCMTSQGRLVVKNAKFAEDFTPLDPNCDCYTCKNYTRAYIRHLLKADETFGIRLTSYHNLYFLVNLMKDVRQAIMDDNLLEFRQDFMERYGYGMNNRNF

SEQ ID NO: 3543 - DNA, 1140 bp, Streptococcus pyogenes
atgacagattatccgattaagtatcgccttatcaaagcagaaaagcacaccggtgcacgcttgggcgaaattatcacccctcacgggacctttccgacaccaatgtttatgccagtgggaactcaggctactgttaaaacacagtctccagaagagttaaaagcaattggatcagggattattttatcaaacacttatcacctctggttgcgtccaggagatgagttgattgctcgctctggtggtctgcacaagtttatgaactgggatcagccaatcttaaccgattcgggtggttttcaagtttactctttagccgattcacgaaacatcactgaagaaggagtgactttcaaaaatcacttgaatggctcaaaaatgtttctatcacccgaaaaagccatttccattcagaataaccttggctcagacatcatgatgagttttgacgagtgcccgcaattttaccaaccttatgattacgtgaaaaaatccattgaacgtactagccgttgggcagaacgtggcttgaaagcccatcgtcgtcctcatgaccaaggattatttggaattgtgcaaggagctggatttgaggaccttcgtcgtcagtctgcggcagatttggtggctatggatttcccaggttattctattggtggtttagctgttggggagagccatgaagaaatgaatgccgtccttgactttacgactcccctcttaccagaaaataaacctcgttacctgatgggagtgggagcaccagatagcttgattgatggtgtgattcgtggtgtcgatatgtttgactgtgtcttgccaacgcgtatcgcccgtaacggaacttgtatgactagtgaggggcgtcttgtgattaaaaatgccaaattcgctgaagattttaccccacttgatcatgactgtgactgctacacttgtcaaaactatagccgtgcctacattcgtcacttgctaaaagcggacgaaacttttggtattcgtttgacaagctaccacaacctttatttcttggttaacttgatgaaaaaagtacgtcaggctattatggacgataacttacttgaattccgccaagattttcttgaacggtatggttataataaatcaaaccgtaatttc

SEQ ID NO: 3544 - protein, 380 aa, Streptococcus pyogenes
MTDYPIKYRLIKAEKHTGARLGEIITPHGTFPTPMFMPVGTQATVKTQSPEELKAIGSGIILSNTYHLWLRPGDELIARSGGLHKFMNWDQPILTDSGGFQVYSLADSRNITEEGVTFKNHLNGSKMFLSPEKAISIQNNLGSDIMMSFDECPQFYQPYDYVKKSIERTSRWAERGLKAHRRPHDQGLFGIVQGAGFEDLRRQSAADLVAMDFPGYSIGGLAVGESHEEMNAVLDFTTPLLPENKPRYLMGVGAPDSLIDGVIRGVDMFDCVLPTRIARNGTCMTSEGRLVIKNAKFAEDFTPLDHDCDCYTCQNYSRAYIRHLLKADETFGIRLTSYHNLYFLVNLMKKVRQAIMDDNLLEFRQDFLERYGYNKSNRNF

SEQ ID NO: 3545 - DNA, 297 bp, Streptococcus agalactiae
  misc_feature (1)..(297): n = a, c, g, or t
atgatgcaagagtactttggtattggtcttgatagtagcagccgctgttaccactatcatactaaattggatattgtcgctttaaaatgtgctgtttgtcaaaaatattatgcttgttataaatgtcatgatgcactcgaggagcattgttttgcagcaacaaaatctgatgaaacgtttcctgtcttatgcggttcttgtcgtcagatgttgacattaaaagagtataaaactggtttttgtccttattgtcgtatgctttttaatccaaattgtcaacgccnnnnnttaattaat

SEQ ID NO: 3546 - protein, 99 aa, Streptococcus agalactiae
  misc_feature (1)..(99): Xaa = Any Amino Acid
MMQEYFGIGLDSSSRCYHYHTKLDIVALKCAVCQKYYACYKCHDALEEHCFAATKSDETFPVLCGSCRQMLTLKEYKTGFCPYCRMLFNPNCQRXXLIN

SEQ ID NO: 3547 - DNA, 309 bp, Streptococcus pyogenes
atgacggactgttttggaattgaccttgaccaagagtatcggtgcctacattatcataccccgcttgatattgttgggctcaaatgtgcttcttgtcagacttattatgcttgttaccattgccatgaccagttaacagatcatgcctttgtgccaacaggacatcaagaaacatctcctgttatttgtgggcattgtcgaaagctcttgagtcgagctgagtatggttgtggatgctgtccttattgtcaaagtccctttaatccagcctgtcataggcacaaggatatctattttttaaaggagtcg

SEQ ID NO: 3548 - protein, 103 aa, Streptococcus pyogenes
MTDCFGIDLDQEYRCLHYHTPLDIVGLKCASCQTYYACYHCHDQLTDHAFVPTGHQETSPVICGHCRKLLSRAEYGCGCCPYCQSPFNPACHRHKDIYFLKES

SEQ ID NO: 3549 - DNA, 972 bp, Streptococcus agalactiae
atggattttttatacaaaggaggaatcgccatgaagcaaatgtttctttcaacggcaattgaatttaaagaaattgaaacattcgagccaggtgcttggataaatctggttaatccctcccaggaagaatccgaacaagtagctgatcaatttggtattgatattgatgatttacgtgctcccctcgatgtggaagaaacttcccgtatctcggttgaagatgattatactttagttattgttgacgttcctacctatgaagaacgcaataacaaaagttattatatgactattcctatgggcattatcgttactgacaacgctgttattactacttgcctagaacatttgacgctgtttgatcacttttatagacgacgtgtcaaaaatttttatacctttatgaagacacgttttgttttccaattgctttatcgcaatgccgaattatacttacaggctttgcgtactatcgataggcagagcgataaaattgaagcacaactagagagtgcaactcgaaatgagcaattgatcgatatgatggaattggaaaaatctattgtctatctaaaggcctctttaaaatttaatgagcgaatcgtcaaaaaattgaccagtagtaccagtagtttaaaaaaatacattgaagatgaagatctgcttgaagatacattgatcgaaactcagcaggctattgaaatggcaaatatctatgaaaatgtcttaaatgccatgacagaaacgactgcttcaatcatcggtaataatcagaataccattatgaaaaccttagccctagtaactatgacattggatattccaacggttattttttcggcgtatgggatgaactttcaaaataattggatgcctttgaatggtctcgcacatggctttatctatgttgttcttttggcctttttgatgagttcatttgttgtattttattttattcgtaaaaaatggttt

SEQ ID NO: 3550 - protein, 324 aa, Streptococcus agalactiae
MDFLYKGGIAMKQMFLSTAIEFKEIETFEPGAWINLVNPSQEESEQVADQFGIDIDDLRAPLDVEETSRISVEDDYTLVIVDVPTYEERNNKSYYMTIPMGIIVTDNAVITTCLEHLTLFDHFYRRRVKNFYTFMKTRFVFQLLYRNAELYLQALRTIDRQSDKIEAQLESATRNEQLIDMMELEKSIVYLKASLKFNERIVKKLTSSTSSLKKYIEDEDLLEDTLIETQQAIEMANIYENVLNAMTETTASIIGNNQNTIMKTLALVTMTLDIPTVIFSAYGMNFQNNWMPLNGLAHGFIYVVLLAFLMSSFVVFYFIRKKWF

SEQ ID NO: 3551 - DNA, 669 bp, Streptococcus agalactiae
atgactttacaagacttaactaaaaagaatcaagagtttgttcatattgcaactaatcaacttttagctgatggaaaatcagatgcagaaatcaaagctattttagaagaacatctcccagagattatagataatcagaaaaaaggaattaccgcacgctcactcttaggagcaccaactacttgggcagcctcattcactgagcgacctgaggataaagctagagtatctgtacaaaaaaataccaatccttggttgatgtggttagatacttccttactatttcttggcttagtaactgctttgaatggtttaatgttgctatttggtcaatctaatgtcaatacagggcttatttcaattttaactcttggttttggtggtggtgcggccatgtacgttacttattactatatttatcgccatatgggtaaaccaaaatctgaaagaccaggctggcttaaatctttcgcagtactggcactagttatgttagtttggtttgccttatttgcagtagtacctcttctacctgcaactattaatcctaaacttcctgaggttgttttgtttattattgctttagcatcgtttggtttgcgcttttatttacaacgtaaatataatattcaaagctcaatggcaccagtggcaccacaacaaagaaga

SEQ ID NO: 3552 - protein, 223 aa, Streptococcus agalactiae
MTLQDLTKKNQEFVHIATNQLLADGKSDAEIKAILEEHLPEIIDNQKKGITARSLLGAPTTWAASFTERPEDKARVSVQKNTNPWLMWLDTSLLFLGLVTALNGLMLLFGQSNVNTGLISILTLGFGGGAAMYVTYYYIYRHMGKPKSERPGWLKSFAVLALVMLVWFALFAVVPLLPATINPKLPEVVLFIIALASFGLRFYLQRKYNIQSSMAPVAPQQRR

SEQ ID NO: 3553 - DNA, 654 bp, Streptococcus pyogenes
atggaattacaagaacttaccaaaaaaaatcaagaatttatccacaccgctacgaacaaattaatccaagacggcaagtctgatgaggacattaagctgattctcgaagaagccattccagctattctcgaaaaccagaaaaaaggagtcaccgctcgaaatctattaggcactccgactgcttgggcagcttcttttagccaagaccctagtcaaaaagcagcagaaactgacaaaaacaccaatccttggttgatgtggctagatacctctttgctattcatcggaattgttgcccttttaaatggcatcatgaccttcttcaacacaaacgctacagttacaggattgatttccttactggcacttggttttggtggaggagcatccatgtacgctacttattactttatttaccgtcatctcggaaaagataagagccttcgtccaagttggttcaaaatcatcgcagccttatcattagccatgttgatttggattgccttgtactctgcaactgcctttttaccaacctctcttaacccacagttgcctcctcttgccttgctcattattggtggtgtttcccttgctttacgctattacctacaacgcaaatacaacattcaaaacactatgtcacctgttaacaaa

SEQ ID NO: 3554 - protein, 218 aa, Streptococcus pyogenes
MELQELTKKNQEFIHTATNKLIQDGKSDEDIKLILEEAIPAILENQKKGVTARNLLGTPTAWAASFSQDPSQKAAETDKNTNPWLMWLDTSLLFIGIVALLNGIMTFFNTNATVTGLISLLALGFGGGASMYATYYFIYRHLGKDKSLRPSWFKIIAALSLAMLIWIALYSATAFLPTSLNPQLPPLALLIIGGVSLALRYYLQRKYNIQNTMSPVNK

SEQ ID NO: 3555 - DNA, 99 bp, Streptococcus agalactiae
atgaaatttaaaactaaaaaaatactgactttattaaaatttgatataataagtcaacactattcaaaaaggagtgctgaggcacaacattatgcaaga

SEQ ID NO: 3556 - protein, 33 aa, Streptococcus agalactiae
MKFKTKKILTLLKFDIISQHYSKRSAEAQHYAR

SEQ ID NO: 3557 - DNA, 2844 bp, Streptococcus agalactiae
gtgctgaggcacaacattatgcaagataaattaatgataagaggagcaagagctcacaatttaaaaaatataagtgtcgacattccacgagacaagttagttgtcgttacgggactatcaggatcaggtaagtctagtttggcctttgacactatctatgcagaaggacaacgtcgttacgttgaaagtctttctgcttacgcgcgccaatttttgggaaatatggaaaagcctgatgtagattctattgatggccttagtccagctatttctattgatcagaaaacaacaagtaagaatcctcgctctactgttgggactgtaacagaaattaacgattatttacgtttgctttatgctcgtgttggaaccccatattgtatcaatggtcacggagccatcacagcatcttctgtagagcaaattgtggataaggtactagcgcttccagagcgaacaaagatgcaaattttagccccaattatacgtcgaaaaaaaggacaacacaaatcaacatttgagaaaatacaaaaagatggttacgttcgtgttcgtattgatggtgatattcacgatgttactgaggtgcctgaattatcaaaaagtaagatgcacaatattgatattgtagtagatcgattaattaataaagagggcattcgttcccgcttatttgattccgttgaagcggctctacgtttgtcggatggttatgtcgttattgatacaatggatggcaatgagttattgttttcagaacattattcttgtcctgaatgtggttttactgttcctgaattagagccacgccttttttcttttaatgctccctttggttcttgtccgacctgtgatggcttaggaattaagttagaagtagatatagatttggttattccagatagaagtaagacccttagagaaggggccttagttccttggaatccaatttcatcaaattattatccaacgatgctagagcaagctatgactcaatttggtgttgatatggatacgccatttgaaaaattaagcaaggcggagcaggacctagccctatatggttcaggcgaacgagagttccatttccattatattaacgattttggaggcgagagaaatattgatttgccttttgaaggggttgtcaataatattaatcgtcgttaccatgaaactaatagcgattacacacgcaatgttatgcgagaatatatgaacgagctaaaatgtaacacttgtcatggctatcgtctcaatgatcaagcactttgcgtaagagttgggggagaagaaggtcttaatattgggcaagtctcagatttatcgatagcagaccatttagaacttttagaaacattgcgtttatcttcaaatgaacaattaattgctcgaccaattatcaaagaaatccatgaccgtctaagtttcttaaataatgttggacttaattatttaaatctgtcacgttctgcaggaacactttccgggggcgagagtcaacgtattcgtttggctactcaaattgggtctaatttatcaggtgtcctttatgtacttgatgagccgtccattggacttcatcagcgagacaatgaccgtttgattgatagtcttaagaaaatgcgtgatttgggtaatacgcttattgttgttgaacatgatgaagatacaatgatggcagctgattggttaatcgatgtgggacctggcgctggtgcgtttggtggtgagattgtggcctctggtacaccgaagcaagtagctaaaaatactaaatctattacaggacaatatttgtcaggtaagaaagtgattcctgtgccatctgaacgaagagtaggtaatggtcgctttttagaaatcaaaggtgcggcagaaaacaacctacaaaatttagatgtcaagttccctctcggtaaatttattgccgtaactggtgtctcaggttctggaaaatcaaccttaattaatagtattttgaaaaaagctgttgcgcagaagcttaaccgtaactcagataaaccaggtaaatatgtttctttagaaggcattgaatatgttgatcgattgattgatattgatcaaagtccaattggtcggactccacgttctaatcccgcaacctatacaggtgtttttgatgatattcgtgatctttttgctcaaactaatgaggcaaagattcgaggttataaaaaaggacgcttctcatttaacgtcaaaggtggacgttgtgagtcttgttctggcgatggtatcatcaaaattgagatgcattttttaccagatgtctacgttccttgtgaagtatgccacggcacgcgctataatagtgagactctggaagtacattacaaagaaaaaaatattgcacaaattcttgatatgacagtgaatgatgcagttacattttttgcagctattcctaaaattgctcgtaagttacagactattaaggatgttggtttgggatatgtcactttggggcaaccagctacaaccttatcaggaggagaagctcagcgaatgaagctggcaagtgaattacataagcgttcgacaggtaagagtctttacatattagacgaaccaacaacggggcttcatgcagatgatattgctcgtttacttaaggttttggatcgttttgtagatgatggtaatacagtgcttgttattgagcataaccttgatgttattaaaactgctgaccacattattgatcttggccctgaaggaggtattggtggcggacaaattgtagctatcggaacaccagaagaagttgctgaaaatcctaaatcctatacaggatattatttaaaagagaagttagcaaga

SEQ ID NO: 3558 - protein, 948 aa, Streptococcus agalactiae
MLRHNIMQDKLMIRGARAHNLKNISVDIPRDKLVVVTGLSGSGKSSLAFDTIYAEGQRRYVESLSAYARQFLGNMEKPDVDSIDGLSPAISIDQKTTSKNPRSTVGTVTEINDYLRLLYARVGTPYCINGHGAITASSVEQIVDKVLALPERTKMQILAPIIRRKKGQHKSTFEKIQKDGYVRVRIDGDIHDVTEVPELSKSKMHNIDIVVDRLINKEGIRSRLFDSVEAALRLSDGYVVIDTMDGNELLFSEHYSCPECGFTVPELEPRLFSFNAPFGSCPTCDGLGIKLEVDIDLVIPDRSKTLREGALVPWNPISSNYYPTMLEQAMTQFGVDMDTPFEKLSKAEQDLALYGSGEREFHFHYINDFGGERNIDLPFEGVVNNINRRYHETNSDYTRNVMREYMNELKCNTCHGYRLNDQALCVRVGGEEGLNIGQVSDLSIADHLELLETLRLSSNEQLIARPIIKEIHDRLSFLNNVGLNYLNLSRSAGTLSGGESQRIRLATQIGSNLSGVLYVLDEPSIGLHQRDNDRLIDSLKKMRDLGNTLIVVEHDEDTMMAADWLIDVGPGAGAFGGEIVASGTPKQVAKNTKSITGQYLSGKKVIPVPSERRVGNGRFLEIKGAAENNLQNLDVKFPLGKFIAVTGVSGSGKSTLINSILKKAVAQKLNRNSDKPGKYVSLEGIEYVDRLIDIDQSPIGRTPRSNPATYTGVFDDIRDLFAQTNEAKIRGYKKGRFSFNVKGGRCESCSGDGIIKIEMHFLPDVYVPCEVCHGTRYNSETLEVHYKEKNIAQILDMTVNDAVTFFAAIPKIARKLQTIKDVGLGYVTLGQPATTLSGGEAQRMKLASELHKRSTGKSLYILDEPTTGLHADDIARLLKVLDRFVDDGNTVLVIEHNLDVIKTADHIIDLGPEGGIGGGQIVAIGTPEEVAENPKSYTGYYLKEKLAR

SEQ ID NO: 3559 - DNA, 2856 bp, Streptococcus pyogenes
atgaggagggtgcctttaggcacattcaagatgcaaaataaaataataattcatggggcaagagcccacaatttaaaaaatattgacgtggaaattccacgagacaaattagttgtcgtgacagggttatcagggtcaggaaaatctagtctagcctttgatactatttatgcggaagggcaacgtcgttacgtagaaagtttatcagcttatgctagacagttcttgggtaatatggaaaaaccagatgtggattccattgacggtcttagccctgctatttccattgaccaaaaaaccaccagtaagaaccctcgctcaacggttggtacggttacggaaatcaatgattatttacgtctactatatgcgcgtgtgggcacaccttactgtatcaatgggcatggtgctatcacggcgtcttctgcagaacaaattgtagagcaggtcttagccctccctgaacggacacgcatgcagattttagctcctgttgttcgtcggaagaaggggcaacacaaaacagtttttgagaaaattcaaaaagacggctatgtccgtgtgcgcgttgacggggatatttttgacgtgacagaagtgccagagttgtccaaaagtaagatgcacaacattgaggtggttattgaccgtctggttaataaggatggtattcgtagccgtttatttgattcggttgaagcagctttaaggctgggagatggctaccttatgattgacactatggatggcaatgaactgctcttttctgagcattattcctgtcctgtctgtggatttacggttcctgaattagaaccaagactcttctcttttaatgcgccgttcggctcttgtccgacctgtgatgggctaggcattaagttggaagtggatttggacttggttgttcctgacccaagtaagtctttgagagagggagctttggcgccttggaatcctatttcctccaattattacccaaccatgcttgagcaagctatggcaagttttggggtggatatggatacaccttttgaggccttgactgaggaagaaagagatttagtgctttatggttcaggtgatagagaatttcattttcactatgtgaatgattttggtggtgagcgtaacattgacattccttttgaaggtgttgtaactaatgttaatcgccgttatcacgaaactaatagtgattatacgcgcaatgtgatgcgtggttatatgaacgaattgacctgtgcgacttgtcatggttaccgtttgaatgaccaagctttgtgtgtgcatgtgggtggcgaagaaggaactcatattggtcaaatttcagaattatcgattgccgaccacttgcagttattggaagaattggaactcacagaaaatgaaagtaccattgctaaaccgattgtcaaagaaatccatgaccgtctgacattcttaaataatgtgggactgaattatctgaccttgtcacgggctgctgggactttatcaggtggtgaaagtcaacgaatcaggttagcaacacaaattggttctaacctatcaggggtgctctatatcttggatgagccttctattggattgcatcaaagagacaatgaccgtttgatcgagagcctgaaaaaaatgcgtgatttgggtaatacgttaattgtggtagaacacgatgaagacaccatgatgcaggcagactggctgattgatgtgggaccgggggcaggtgagttcggtggagaaattactgcctctggaacgccgaaacaagtggctaagaataaaaaatccatcacgggtcaatatttgtctggtaaaaaattcattccagtgcctttagagcgccgttctggtaatggccgattcattgaaataaaaggagcagcgcagaataatcttcaaagcctcgacgtgagattcccactgggtaaatttattgcggtcacaggggtatcaggctcagggaaatcaaccttggttaatagtattttgaaaaaggctgtcgcccaaaaattaaaccgtaatgctgataagcctggtaaatatcactctatttctggtattgaacatattgaacgcttgattgacattgaccaaagtccgattggaaggacgccacggtcaaatccagccacctatacgggtgtctttgatgatattcgagacttgtttgcccaaaccaacgaagctaagattcgtggttacaaaaaaggccgtttctcttttaatgtcaaaggtgggcgttgtgaggcttgttcaggtgatgggattatcaaaatcgaaatgcactttttgccagatgtttatgtgccttgtgaggtttgccacggcagacggtataattctgagacgcttgaggtgcattacaaaggaaaaaatatcgcagaagtccttgatatgactgtcgatgatgccttggtatttttctctgctattcctaaaatcgctcgaaaaattcaaacgattaaggatgttggacttggttatgtgaccttaggtcaaccagctaccaccctctctgggggagaagctcaacggatgaagttggctagtgaattgcacaaacgctcgacaggtaagagcttgtatatcctagatgagccaacgactggtttacacacagatgatattgcaaggctattaaaagttttggaacgctttgtagacgatggtaatacggttcttgtgattgagcataatttggacgttatcaaatctgctgaccatattattgacttaggaccagaaggtggtgacggaggtggtcagattgttgccacggggacaccagaagaggtagctcaagttaaagaaagctatactggtcattatttgaaagtaaaactacaacaa

SEQ ID NO: 3560 - protein, 952 aa, Streptococcus pyogenes
MRRVPLGTFKMQNKIIIHGARAHNLKNIDVEIPRDKLVVVTGLSGSGKSSLAFDTIYAEGQRRYVESLSAYARQFLGNMEKPDVDSIDGLSPAISIDQKTTSKNPRSTVGTVTEINDYLRLLYARVGTPYCINGHGAITASSAEQIVEQVLALPERTRMQILAPVVRRKKGQHKTVFEKIQKDGYVRVRVDGDIFDVTEVPELSKSKMHNIEVVIDRLVNKDGIRSRLFDSVEAALRLGDGYLMIDTMDGNELLFSEHYSCPVCGFTVPELEPRLFSFNAPFGSCPTCDGLGIKLEVDLDLVVPDPSKSLREGALAPWNPISSNYYPTMLEQAMASFGVDMDTPFEALTEEERDLVLYGSGDREFHFHYVNDFGGERNIDIPFEGVVTNVNRRYHETNSDYTRNVMRGYMNELTCATCHGYRLNDQALCVHVGGEEGTHIGQISELSIADHLQLLEELELTENESTIAKPIVKEIHDRLTFLNNVGLNYLTLSRAAGTLSGGESQRIRLATQIGSNLSGVLYILDEPSIGLHQRDNDRLIESLKKMRDLGNTLIVVEHDEDTMMQADWLIDVGPGAGEFGGEITASGTPKQVAKNKKSITGQYLSGKKFIPVPLERRSGNGRFIEIKGAAQNNLQSLDVRFPLGKFIAVTGVSGSGKSTLVNSILKKAVAQKLNRNADKPGKYHSISGIEHIERLIDIDQSPIGRTPRSNPATYTGVFDDIRDLFAQTNEAKIRGYKKGRFSFNVKGGRCEACSGDGIIKIEMHFLPDVYVPCEVCHGRRYNSETLEVHYKGKNIAEVLDMTVDDALVFFSAIPKIARKIQTIKDVGLGYVTLGQPATTLSGGEAQRMKLASELHKRSTGKSLYILDEPTTGLHTDDIARLLKVLERFVDDGNTVLVIEHNLDVIKSADHIIDLGPEGGDGGGQIVATGTPEEVAQVKESYTGHYLKVKLQQ

SEQ ID NO: 3561 - DNA, 1497 bp, Streptococcus agalactiae
atgactacaaaagcaaaacatgatattcatggcaaaccatataatcgtacagccatgatcaccttattgttgattgctacatttgcaggggtattaaatcagacaagtttgggaacggctatcccaactttgatgaatagctttaacatttcgttgtcaacggctcaacaagcaacaacatggtttttattagcgaatgggattatgattcctgtttcagcttatttagcgacacgtttttcaacaaaatggttgtatgtgacatcctacgttgttttacttattggactgttaatgacgacgttagcacctacatctaactggaacctttttttagtaggacgtattattcaagcgatttctgtagggatttctatgcctttgatgcaggttgttatggtgaatgtttttcctccagagcagcgtggtgccgctatgggacttaatggtttggtggttggtcttgccccagctattgggcctacattagcagggtggattttaaaacaagaatttcattttgcagggcatgatttaacatggcgtgcaattttccttcttcctttactaattttaacggtcactacaattttatccccctttgttctaaaagatgtggttgataataagtcagttaaattggaagtgccttcccttatcctttcaataattggctttggtagctttttgtggggcttcacaaatgtggcaacttatggatggggagatattggatatgttatttctcctattatggttggtattatttttatcgccttattcattcatcgtcaattaaaactagaaacaccgttcttagatatccgtgttttcaaaaataaacaattctcagtaacaacagcagctattgcactttcaatgatggcgatgatgggtgttgaaatgatgctaccgctttacttgcaaaatgttcatggtctctctgcacttgattctggtttagctttattaccaggtgccttgatgatggggatagttagtccaatttctggagctgtatatgataaagttggtgcaagacgtatggctatgattggttttaccatactaggtgtagcgacgttaccttttgttttcttaacgactacaacaccagatcattttattaccctcttatatgcagtacgtatgtttggtattgctatggttatgatgccattgacagcaagtgcgatgagcgcacttccaccacatgaggccgcacatggaacagcagctaataatactgctcgtcaaattgcttcagcagttgtagttgcattgctttcaagtgttgctcaaaatattatcaccaacaataaaccatcaaaagatttgctaacaatgaatcctttaaaatatgcaaatcagatgttgaatgctagtcttgatggcttccatgtttcttttgccattggttttgtatttgcggttcttggtttactggtatctcttttcctgagaaaagggaaaattattgagacggaaaaggaggta

SEQ ID NO: 3562 - protein, 499 aa, Streptococcus agalactiae
MTTKAKHDIHGKPYNRTAMITLLLIATFAGVLNQTSLGTAIPTLMNSFNISLSTAQQATTWFLLANGIMIPVSAYLATRFSTKWLYVTSYVVLLIGLLMTTLAPTSNWNLFLVGRIIQAISVGISMPLMQVVMVNVFPPEQRGAAMGLNGLVVGLAPAIGPTLAGWILKQEFHFAGHDLTWRAIFLLPLLILTVTTILSPFVLKDVVDNKSVKLEVPSLILSIIGFGSFLWGFTNVATYGWGDIGYVISPIMVGIIFIALFIHRQLKLETPFLDIRVFKNKQFSVTTAAIALSMMAMMGVEMMLPLYLQNVHGLSALDSGLALLPGALMMGIVSPISGAVYDKVGARRMAMIGFTILGVATLPFVFLTTTTPDHFITLLYAVRMFGIAMVMMPLTASAMSALPPHEAAHGTAANNTARQIASAVVVALLSSVAQNIITNNKPSKDLLTMNPLKYANQMLNASLDGFHVSFAIGFVFAVLGLLVSLFLRKGKIIETEKEV

SEQ ID NO: 3563 - DNA, 738 bp, Streptococcus agalactiae
ttgagacggaaaaggaggtatagcatgattattttgattattgcactggcaactattttgacatttgtcacatggatgttgattcgtccaaaagctctacggtatattctaggtcttctctcattagctttgttgtttgcctcagtttggatgttaacggatcactttattaatcatacaggtatgactattgaaactaagacaaagacacgtgagatttatagtgcgggtgatagtaaggctccatttggtctcatgatttataaagagattggtactcattcgagtaataatgttttagtttatcgaacagatttaaatcaaaaagaagcaaaagctcactttgttccaaatacaaaagaagtgacaagtgctgtgaaaaaatctgctagctaccaattagctgatgtgaaaaaagccacagtaacaacaaagactaaacgttatgtgtggaaagatagtctttcgaaactactttatggctttgcaggtgaaaatggagaattgatttctcagaaatcagttgctaaaataccacgaaaaacttggctagttttgactaaagagcagtccgaacacttagaatcggctgcggctaaactaaaagaacaaatgacttcgcaagcaaaagtaaacccagtgaaagctatggagataaagacattagctaagacaaatccagaagcttatgctgagatgcaagttaaagcattaaaagaagctcttaatataaaagaa

SEQ ID NO: 3564 - protein, 246 aa, Streptococcus agalactiae
MRRKRRYSMIILIIALATILTFVTWMLIRPKALRYILGLLSLALLFASVWMLTDHFINHTGMTIETKTKTREIYSAGDSKAPFGLMIYKEIGTHSSNNVLVYRTDLNQKEAKAHFVPNTKEVTSAVKKSASYQLADVKKATVTTKTKRYVWKDSLSKLLYGFAGENGELISQKSVAKIPRKTWLVLTKEQSEHLESAAAKLKEQMTSQAKVNPVKAMEIKTLAKTNPEAYAEMQVKALKEALNIKE

SEQ ID NO: 3565 - DNA, 399 bp, Streptococcus agalactiae
atgggttttgaacaacgtctaactagatgtcaaacagcaatttcacaattatcatgtgacgcactcttaataacaaatttaacaaatattttttatttgactggtttttcaggaactaatgcaacggtactcattagtccaaaacaccggatttttgttacagattcacgatatgccttgatagcaaagaatactgtaagagagtttgatattatcattagcagagaaccacttgcggctattttgaaaattattcgcgatgacgcattgatagcgattggttttgaaactgatatttcttatcatatgtacaaacatatggtggaagtttttgaagattatcgcttgatagaagctccatctgttgttgaaaagttacgtatgattaaagatgtaaca

SEQ ID NO: 3566 - protein, 133 aa, Streptococcus agalactiae
MGFEQRLTRCQTAISQLSCDALLITNLTNIFYLTGFSGTNATVLISPKHRIFVTDSRYALIAKNTVREFDIIISREPLAAILKIIRDDALIAIGFETDISYHMYKHMVEVFEDYRLIEAPSVVEKLRMIKDVT

SEQ ID NO: 3567 - DNA, 1110 bp, Streptococcus pyogenes
atgctacaatattctcaaaagttaccaaaggagttcgcgatgtcaggatttttagaacaacgattaggtcactgcctaaggcagatggcagagaaggggctagaggctcttctagtcacccatttaaccaatagttattacttgacaggtttttctggaactgcagcaactgttttgataacggccaaacgtcgtgttttgatcacagattcacgttataccttgcttgctaaagctagtgttgagggatttgatattatcgaaagccgcacgccgcttaaggttgtggcagaattgttagaggctgatcaaatagattgccttggttttgaggaccaggtatcgttttctttttaccaggccatgcaagcagaactgtcaggaataaccttgcttgctcagtcaggttttgtggagcatttacgtcttattaaggacgcctctgaaatcgataccattgctaaagcgtgctcgatctcagacaaagcatttgaagatgctcttgattttattaaaccagggacaaccactgaacgtgacctggctaattttttagattttcgtatgcgtcagtatggtgccagcggcacatcatttgatatcattgtagcttcaggctatctctctgccatgcctcatggacgcgccagtgacaaggttatccagaataaagagagcttgaccatggactttgggtgttactacaatcactatgttagtgatatgacgaggaccattcatattggccaagttactgatgaagaacgtgagatttatgctcttgttcttgctgctaataaggctttaattgctaaagctagcgctggcatgacttatagtgactttgacggtattccgcgccaactcatcactgaggcgggttatggcagtcgcttcacacatggcattggtcatggcatcgggcttgacatccatgagaatccattttttgggaaatctgagcaacttctccaagctggaatggtggtaacagatgagccaggtatctatttggataacaaatatggtgtccgtattgaagatgacttggttatcacaaaaactggttgtcaagtcttgaccttggcacccaaagaattaattgtattg

SEQ ID NO: 3568 - protein, 370 aa, Streptococcus pyogenes
MLQYSQKLPKEFAMSGFLEQRLGHCLRQMAEKGLEALLVTHLTNSYYLTGFSGTAATVLITAKRRVLITDSRYTLLAKASVEGFDIIESRTPLKVVAELLEADQIDCLGFEDQVSFSFYQAMQAELSGITLLAQSGFVEHLRLIKDASEIDTIAKACSISDKAFEDALDFIKPGTTTERDLANFLDFRMRQYGASGTSFDIIVASGYLSAMPHGRASDKVIQNKESLTMDFGCYYNHYVSDMTRTIHIGQVTDEEREIYALVLAANKALIAKASAGMTYSDFDGIPRQLITEAGYGSRFTHGIGHGIGLDIHENPFFGKSEQLLQAGMVVTDEPGIYLDNKYGVRIEDDLVITKTGCQVLTLAPKELIVL

SEQ ID NO: 3569 - DNA, 612 bp, Streptococcus agalactiae
gtgttggattttataaagcctgatcgaacaactgaattgcaagttgctaattttttagactttcgcatgagagaattaggagcaactggtccttcatttgattttattgtagcatctggatatcgatcagcgatgccacatggggttgcgagtcagaagactattcaatcgggagaaactctgactttagattttggttgttactatcagcactatgttagtgatatgacacgtacgattcatatcggtcatgtcactgatcaggaacgcgagatttacgatatcgttttgaaaagtaatcaagctattattggtaatgtaaaatcaggaatgaagcgttgtgattatgattacttggcgcgacaagtcattgaaaattctggatacggtaatcattttacccacggtatagggcatggtatggggcttgatgttcatgaaattccttattttggtaagtcagagggagtgattgcatctgggatggtagtgactgacgagccaggaatatatctcgataataaatacggtgttcgtattgaagatgatttattaataacggaaacaggttgcgaagtattgacatctgcacctaaagaattaattgtactt

SEQ ID NO: 3570 - protein, 204 aa, Streptococcus agalactiae
MLDFIKPDRTTELQVANFLDFRMRELGATGPSFDFIVASGYRSAMPHGVASQKTIQSGETLTLDFGCYYQHYVSDMTRTIHIGHVTDQEREIYDIVLKSNQAIIGNVKSGMKRCDYDYLARQVIENSGYGNHFTHGIGHGMGLDVHEIPYFGKSEGVIASGMVVTDEPGIYLDNKYGVRIEDDLLITETGCEVLTSAPKELIVL

SEQ ID NO: 3571 - DNA, 450 bp, Streptococcus agalactiae
atgaatagactttcttgggaagattattttatggcaaatgcagagttgatttctaaacgttctacctgtgaccgtgcttttgttggagctgttttagtcaaaaataatcgcatcattgctacaggttataacggaggagtctctgagacagataactgtaacgaagtgggacattatatggaagatggtcactgtattaggactgttcatgctgagatgaatgcccttattcagtgtgctaaagaaggtatttctactaataatacagaaatttatgtgacgcattttccttgtatcaattgcaccaaggcgctcttgcaagccggggttaagaaaattacttataaagctaattatcgcccacacccatttgctattgaacttatggaagcaaaaggagttgcttatgttcaacatgatgttccagaggtaacactagggatggaagag

SEQ ID NO: 3572 - protein, 150 aa, Streptococcus agalactiae
MNRLSWEDYFMANAELISKRSTCDRAFVGAVLVKNNRIIATGYNGGVSETDNCNEVGHYMEDGHCIRTVHAEMNALIQCAKEGISTNNTEIYVTHFPCINCTKALLQAGVKKITYKANYRPHPFAIELMEAKGVAYVQHDVPEVTLGMEE

SEQ ID NO: 3573 - DNA, 504 bp, Streptococcus pyogenes
ttgtattgtaaaagaatggttcaggaaaggattaggggagaagcaatgacaaatcgtttatcatggcaagactattttatggccaatgcagagctgatttccaagcgctctacctgtgatcgcgcctttgtgggagctgttttggtaaaggataaccgcattattgccacaggttacaatggcggagtttctgctacggataactgcaacgaagcgggtcattatatggaagacggacattgtattcgcactgttcatgctgaaatgaatgctttgattcaatgtgcgaaagaaggaatttcaacggacggaactgaaatttacgtgactcattttccttgtattaactgcactaaggcgcttttgcaggcggggattacaaagattacctataaagcacattaccgtccgcacccctttgccattgaactgatggagaaaaaaggggttgcctatgtgcaacatgatgtgcctcaaattgttttaggaggcgataaggaacaa

SEQ ID NO: 3574 - protein, 168 aa, Streptococcus pyogenes
LYCKRMVQERIRGEAMTNRLSWQDYFMANAELISKRSTCDRAFVGAVLVKDNRIIATGYNGGVSATDNCNEAGHYMEDGHCIRTVHAEMNALIQCAKEGISTDGTEIYVTHFPCINCTKALLQAGITKITYKAHYRPHPFAIELMEKKGVAYVQHDVPQIVLGGDKEQ

SEQ ID NO: 3575 - DNA, 162 bp, Streptococcus agalactiae
ttgttgctgacctcaatagatgtaaatccagtttatgctaatatggcatttgattgggtgtatgataactataaagatgatatcatcaattatggacaagaaactatcaaaaatattggtaaatccatttcagctaataatagtttaggtactttatataat

SEQ ID NO: 3576 - protein, 54 aa, Streptococcus agalactiae
MLLTSIDVNPVYANMAFDWVYDNYKDDIINYGQETIKNIGKSISANNSLGTLYN

SEQ ID NO: 3577 - DNA, 168 bp, Streptococcus agalactiae
ttgaataagatattagcaattggtactgaaattgcacctgtgataggagcagttgcttcgattggtgtaaaagcattgtataataattctaaatcatttagaaatgttataagtagtacaggaaatgtaattaacaatattgataaacattttacaaaaataaatagt

SEQ ID NO: 3578 - protein, 56 aa, Streptococcus agalactiae
MNKILAIGTEIAPVIGAVASIGVKALYNNSKSFRNVISSTGNVINNIDKHFTKINS

SEQ ID NO: 3579 - DNA, 297 bp, Streptococcus agalactiae
atgttattaccagtagggagtgttgtctatcttattgatggcaatcaaaaattagttattgtaaatagaggtgcaattgttgagcaagaaggacaagaagtttattttgattacctaggtggaatttttcctgagggtttaaatcttgaacaagtttactattttaatcaagaagatattgatgaggttgtttttgaaggttaccatgatgaggaggaagaaagagtttctcgtctcattgaaaaatggaaaaatacagagggaaagaatcttccaaagggaaagactagtgtagaa

SEQ ID NO: 3580 - protein, 99 aa, Streptococcus agalactiae
MLLPVGSVVYLIDGNQKLVIVNRGAIVEQEGQEVYFDYLGGIFPEGLNLEQVYYFNQEDIDEVVFEGYHDEEEERVSRLIEKWKNTEGKNLPKGKTSVE

SEQ ID NO: 3581 - DNA, 144 bp, Streptococcus agalactiae
gtgaatatgctattgatagatgtcatgatacacttatcagaagaaaacgaaaagggctttactaaattacaattctttactcgacaaattgtggttggtgtaaactggtatgtacttcccaaaattgataactatttcaacccc

SEQ ID NO: 3582 - protein, 48 aa, Streptococcus agalactiae
MNMLLIDVMIHLSEENEKGFTKLQFFTRQIVVGVNWYVLPKIDNYFNP

SEQ ID NO: 3583 - DNA, 558 bp, Streptococcus agalactiae
atgattgaagcaagtaagcttaaagcaggcatgacttttgaaacggctgatgggaaattaatccgtgttcttgaagctagccaccacaaaccaggtaaaggtaacacaatcatgcgtatgaaattgcgtgatgttcgtactggttcaacttttgatacaagttaccgtcctgaagaaaaatttgagcaagctattattgaaactgtacctgctcaatacctttataagatggatgatacagcttacttcatgaataatgaaacttacgatcaatatgaaattccaactgttaacattgaaaatgaattactctacattcttgaaaactcagaagtaaaaattcaattctatggaacagaagttattggtgttcaaattccaacaactgttgaattgacagttgctgaaactcaaccatcaatcaaaggtgctactgtaactggttcaggaaaacctgcaactatggaaacaggacttgttgttaacgttccagattttattgaagctggacaaaagttagtaatcaatacagcagaaggaacttacgtttcacgcgcc

SEQ ID NO: 3584 - protein, 186 aa, Streptococcus agalactiae
MIEASKLKAGMTFETADGKLIRVLEASHHKPGKGNTIMRMKLRDVRTGSTFDTSYRPEEKFEQAIIETVPAQYLYKMDDTAYFMNNETYDQYEIPTVNIENELLYILENSEVKIQFYGTEVIGVQIPTTVELTVAETQPSIKGATVTGSGKPATMETGLVVNVPDFIEAGQKLVINTAEGTYVSRA

SEQ ID NO: 3585 - DNA, 555 bp, Streptococcus pyogenes
atgattgaagcaagtaagcttaaagcaggtatgacatttgaagcagaaggaaaattaatccgtgtccttgaagctagccaccacaaaccaggtaaaggaaacactatcatgcgtatgaaactacgtgatgtgcgtacaggttctacttttgacacaacttaccgcccagatgaaaaatttgagcaagccatcattgaaactgtcccagcacaatacctatacaaaatggatgacactgcttacttcatgaacactgacacttatgatcagtacgaaattccagttgctaacgttgagcaagaattgctttacattcttgaaaactcagacgtgaaaatccaattttatggaagtgaagtgattggggtaacggttccaacaactgttgaattgaccgttgcggaaacacaaccatctattaaaggagcgacagtgacgggttcagggaaacctgcaactcttgagacaggacttgttgttaacgttccagactttatcgaagctggccaaaaactaatcattaacactgcagaaggtacttacgtttctcgtgct

SEQ ID NO: 3586 - protein, 185 aa, Streptococcus pyogenes
MIEASKLKAGMTFEAEGKLIRVLEASHHKPGKGNTIMRMKLRDVRTGSTFDTTYRPDEKFEQAIIETVPAQYLYKMDDTAYFMNTDTYDQYEIPVANVEQELLYILENSDVKIQFYGSEVIGVTVPTTVELTVAETQPSIKGATVTGSGKPATLETGLVVNVPDFIEAGQKLIINTAEGTYVSRA

SEQ ID NO: 3587 - DNA, 387 bp, Streptococcus agalactiae
atgacaactgaaaatcttggagaaattgtcatttcaccacgtgtacttgaggtaattacaggtattgctgcaactaaagttgatggtgttcattcgttacgtaacaaagcggtaacggatagccttagtaagaaatctctaggtagaggtgtctaccttaaaaatgaagaagatgatacagtagctgcagatatttatgtttacttgcagtatggtgtaaatgtaccagcagtttcaattgctattcaacaagctgtcaaaacagctgtatatgacatggcagaagtaaaaatttcttcggtcaatatccatgttgaaggtattgttccagagaaaacaccaaaaccagacttgaagtcattgtttgatgaggatttcttagatgac

SEQ ID NO: 3588 - protein, 129 aa, Streptococcus agalactiae
MTTENLGEIVISPRVLEVITGIAATKVDGVHSLRNKAVTDSLSKKSLGRGVYLKNEEDDTVAADIYVYLQYGVNVPAVSIAIQQAVKTAVYDMAEVKISSVNIHVEGIVPEKTPKPDLKSLFDEDFLDD

SEQ ID NO: 3589 - DNA, 387 bp, Streptococcus pyogenes
atgacaactgaatatatcggtgaaatcgtcatttcaccacgagtgcttgaggttattacggggattgctacgacacaagttgagggcgtccactcactccataacaagaaaatggcagatagctttaacaaagcaagtcttggtaaaggggtttatctccagacagaagaagatggaagtgttacagcagatatttatgtttacttgcaatatggagtcaaggtcccgactgtatctatgaatattcaaaaaacagtcaaatctgctgtgtacgatatggcagaagtgcctatttctgcagttaatatccatgttgaaggtattgttgcggaaaagacaccaaaaccagatttgaagtcactttttgatgaggatttcttggatgac

SEQ ID NO: 3590 - protein, 129 aa, Streptococcus pyogenes
MTTEYIGEIVISPRVLEVITGIATTQVEGVHSLHNKKMADSFNKASLGKGVYLQTEEDGSVTADIYVYLQYGVKVPTVSMNIQKTVKSAVYDMAEVPISAVNIHVEGIVAEKTPKPDLKSLFDEDFLDD

SEQ ID NO: 3591 - DNA, 432 bp, Streptococcus agalactiae
atgactagtgtatttaaagattcaagacgtgatttacgtgaacgtgcttttcaaacactatttagcttagaaactggtggagagtttattgatgcggctcactttgcttatggttatgataaaacagtatctgaagacaaagttttagaggttccaatctttttacttaatcttgttaatggtgttgtagatcacaaagatgaattagatactttgatttctagtcacttaaaatcaggatggagcttagaacgtctaacattggttgataaatctctcttacgcttaggcctctatgaaattaaatattttgatgaaacgcctgatcgtgtagctctaaatgagattatcgagattgctaaaaaatattcagatgagacgtcagcaaaatttgtcaatggtttattaagtcaatttataacaaatgaaaat

SEQ ID NO: 3592 - protein, 144 aa, Streptococcus agalactiae
MTSVFKDSRRDLRERAFQTLFSLETGGEFIDAAHFAYGYDKTVSEDKVLEVPIFLLNLVNGVVDHKDELDTLISSHLKSGWSLERLTLVDKSLLRLGLYEIKYFDETPDRVALNEIIEIAKKYSDETSAKFVNGLLSQFITNEN

SEQ ID NO: 3593 - DNA, 468 bp, Streptococcus pyogenes
ttgatgaggatttcttggatgactaacagctttcaaaattcaagaagagatttgcgtgaacgtgcctttcaggctttatttaacatagagatgggagctgagttattggcagcttctcagtttgcctatggttatgataaagtaacaggggaggacgctcaagtattggagctgccgatttttttattaagtcttgtgacgggtgtcaataatcataaagaagagttggataacttgatatcaactcatttgaaaaaaggttggtcgttagaacgcttgacactaacagacaaaacgttattacgactaggtctttttgaaatcaagtattttgacaaaacaccagatcgtgttgcactaaacgaaatcattgaagtagttaaaaaatattctgatgaaacctctgctaaatttattaatggcttacttagccaatatgtctcgggagctccttcagcaaataaatca

SEQ ID NO: 3594 - protein, 156 aa, Streptococcus pyogenes
LMRISWMTNSFQNSRRDLRERAFQALFNIEMGAELLAASQFAYGYDKVTGEDAQVLELPIFLLSLVTGVNNHKEELDNLISTHLKKGWSLERLTLTDKTLLRLGLFEIKYFDKTPDRVALNEIIEVVKKYSDETSAKFINGLLSQYVSGAPSANKS

SEQ ID NO: 3595 - DNA, 960 bp, Streptococcus agalactiae
atggttgcaaaattaacagatgttgctgcacttgccggtgttagcccaacgactgtatcacgcgttattaacaaaaaaggctatttatctcaaaaaacagtcaccaaagtcaatgaagccatgagaacccttggttataaacctaataatttagcacgtagcttacagggaaagtccgctaaattaattggactcattttccccaacatccgtaacattttttacgctgaattaattgaacaccttgaaattgagttgtttaagcatggttataaaactatcttatgtaatagtgaaaaggatcctatcaaagaaaaagaatacctcgaaatgctaggagcaaatcaagtagacggtatcatttcaagtagtcacaacctaggaattgatgattacgagaaagttgaggctcccatagtagcattcgatagaaatttagctccacacatccctatcgtctcatctgataatttctttggaggaaaaatggctgctcaaacccttaaaaaacatggctgtcaaaagatgattatgattacagggaatgataattcagattctcctactggacttaggcggctaggtttttcctatgaatcaaaggaatccaaagttatcacagtcacaaatgggctatctaacatgagacgtgagatggaattaaaatcaattatctcgactcacaaaccagatggtatttttacatcagacgacttaactgctttattagtaatcaaacttatcagccaactagggttgtccattccagaagatatcaaagtgattggatatgatggtacaagtttcattcaagattacgtcccacatctaaccactattaaacaacctattcgagaaattgcgcaattgatggttgagatactcctagctaagattgaggggcaaaagacaaataaggattatattttaccagtcagtctcatccctggtagtagcgtt

SEQ ID NO: 3596 - protein, 320 aa, Streptococcus agalactiae
MVAKLTDVAALAGVSPTTVSRVINKKGYLSQKTVTKVNEAMRTLGYKPNNLARSLQGKSAKLIGLIFPNIRNIFYAELIEHLEIELFKHGYKTILCNSEKDPIKEKEYLEMLGANQVDGIISSSHNLGIDDYEKVEAPIVAFDRNLAPHIPIVSSDNFFGGKMAAQTLKKHGCQKMIMITGNDNSDSPTGLRRLGFSYESKESKVITVTNGLSNMRREMELKSIISTHKPDGIFTSDDLTALLVIKLISQLGLSIPEDIKVIGYDGTSFIQDYVPHLTTIKQPIREIAQLMVEILLAKIEGQKTNKDYILPVSLIPGSSV

SEQ ID NO: 3597 - DNA, 963 bp, Streptococcus pyogenes
gtggtcgcaaaattaacagacgtggcagccttggcgggtgtcagtccaacaactgtttcgcgagtaatcaacaaaaaaggctacctttcccaaaaaacagtgaataaggtgaataaggccatgcgtgaattgggctacaagcctaacaatctcgctagaagtttgcaaggtaaatcaacccaactcattgggcttatcttccccaacattagcaatatcttttacgctgaattaattgaacatttggaaattgaattgtttaaacagggctacaaaactattatttgcaatagtgaacataatcccgtcaaagaacgcgaatatttagaaatgcttgcggccaatcaagtggacggcattatttcttccagtcataatttgggaattgaggattatgagcgtgtcgaagctcctattgtagcttttgaccgtaatctagcgccaaatatcccggttatttcttcagataattttgaaggtggtaaattagccgcacaaactttgcaaaaacacggttgtcaaaacattgtcatgattacaggtaatgacaattctgattcgcccacagggttgcgccagctagggtttaactaccagctcaaacgaagtgcagaaatcatcaaattaccaaataacctatctcctgttagacgcgaaatggaaattaaatccattttggcaacccgaaaacctgatggccttttcgtttctgatgatttaactgctatcctcattatgaaagtagccaaacaacttcacattactattccagaggatatgaaagtcataggttatgatggaacgacatttatccagcaatatgttcctcaattagcgaccattcgtcaacctattgatgagattgctaaattgagtgtcgaaatactcatcaaaaaaattaaaaaagaaaaaaccagtaaagactatattttaccgattacgctacttccaggagcaagtatt

SEQ ID NO: 3598 - protein, 321 aa, Streptococcus pyogenes
VVAKLTDVAALAGVSPTTVSRVINKKGYLSQKTVNKVNKAMRELGYKPNNLARSLQGKSTQLIGLIFPNISNIFYAELIEHLEIELFKQGYKTIICNSEHNPVKEREYLEMLAANQVDGIISSSHNLGIEDYERVEAPIVAFDRNLAPNIPVISSDNFEGGKLAAQTLQKHGCQNIVMITGNDNSDSPTGLRQLGFNYQLKRSAEIIKLPNNLSPVRREMEIKSILATRKPDGLFVSDDLTAILIMKVAKQLHITIPEDMKVIGYDGTTFIQQYVPQLATIRQPIDEIAKLSVEILIKKIKKEKTSKDYILPITLLPGASI

SEQ ID NO: 3599 - DNA, 1437 bp, Streptococcus agalactiae
atgaatttacccactgaaatccgctatcgtccttatgatgaatggactgaagaagataaggaaaatattgtaaagaatgtctcaaaatccccttggagagcaacttatcacttagaagctaaaacagggcttttaaatgacccaaatggcttctcttactttaatggaaaattccatcttttttaccaaaattggccctttggagctgcacatggtttaaaacaatgggtacatacagaatcagatgatttagttcatttcaaagaaacaggaatcaagcttaaacctgaccatgtcaatgatagccatggtgcatactccggttctgcattagccattgacgataagctttttcttttttatactggtaatgtccgtgacatgaaatggaaccgtgacccccgccaaattggagcatggatgacaaatgatggcaagattacaaaatttgataaagtccttatttcacaaccaaatgatgtcactgagcattttcgtgaccctcagattttcaattatgataatcaattctatgctgttatcggggcgcaaaatagtaaaaaatgcggattcattaaattatataaagcacttaataatgacatccatcattgggagtttgtgggagatttagattttggtggtactggatctgagtatatgattgaatgtccaaatattatttttgtcaaaggaaaacctgtattactttatagtcctcaaggactagataaaaacgaattggactaccaaaacatttatccaaatacctacaaaatcggacaatatttcgatgctaactcatctaagatagttgaaccatcccctatctataatttagattatggttttgaagcctatgctactcaaggatttaacacttctgatggtcgtgcctttatcgtgagttggataggcttgccagatattgattatcctagcgatcaatttgattatcaaggagctatgagtttagttaaagagttaagcataaaaaatgggaacctttatcaatatcccgttcctgctatgaaaaatcttcgtcaacatcaagcagaatttaaaacacaacttcaaactaacaacacctatgaattagaattactggttcctagaaatgatctttcttcatttgttctctttgctaatccgaaaggacaaggactatccattactattgatactgtaaaggggaaagttatcattgaccgctcacaagccggacagcagtacgccacagaatttggtactagtcgccagtgtgacattccaaaagatgctactagtatcaatatttttatcgataagtccatctttgaaatctttataaataaaggagaaaaagtatttacgggacgagtctttccagatgcagaacaatcagggattcaactaaaagaagggcacgttcatggtaaatattttgaattaaaatat

SEQ ID NO: 3600 - protein, 479 aa, Streptococcus agalactiae
MNLPTEIRYRPYDEWTEEDKENIVKNVSKSPWRATYHLEAKTGLLNDPNGFSYFNGKFHLFYQNWPFGAAHGLKQWVHTESDDLVHFKETGIKLKPDHVNDSHGAYSGSALAIDDKLFLFYTGNVRDMKWNRDPRQIGAWMTNDGKITKFDKVLISQPNDVTEHFRDPQIFNYDNQFYAVIGAQNSKKCGFIKLYKALNNDIHHWEFVGDLDFGGTGSEYMIECPNIIFVKGKPVLLYSPQGLDKNELDYQNIYPNTYKIGQYFDANSSKIVEPSPIYNLDYGFEAYATQGFNTSDGRAFIVSWIGLPDIDYPSDQFDYQGAMSLVKELSIKNGNLYQYPVPAMKNLRQHQAEFKTQLQTNNTYELELLVPRNDLSSFVLFANPKGQGLSITIDTVKGKVIIDRSQAGQQYATEFGTSRQCDIPKDATSINIFIDKSIFEIFINKGEKVFTGRVFPDAEQSGIQLKEGHVHGKYFELKY

SEQ ID NO: 3601 - DNA, 1440 bp, Streptococcus pyogenes
ttgatggatctaccacaagctattcgctaccgcccttacaaagagtggagctcaaaagactaccaagctattactgaaaaaatggcccaatccccatggcacagccaatttcatgtcgaacctaagacaggattactcaatgaccccaatgggttttcttatttcaacggtcgctaccatcttttttatcaaaactggccttatggcgctgcgcacggtctgaaacaatgggtacacatgacatccacagacctcgtccattttacggaaacaaggagccgccttctgccagaccacgctcacgatagtcatggggcttactcaggttctgcatatgctattgatgacaagctcttcctcttttacactggtaatgttcgcgatgccaattgggtcagaacaccattacaggttggcgcatggatggataaacaaggaaatatttccaaaataccacaggttttgattgaacagcccgatgatgttacagaacattttcgggatcctcagcttttttcttatcaaggtcaattctatgctattattggcgcccaaggtttagatggcaaaggaaaaatcaaactttacaaagctgtggacaatcatgtggacaactggcgatttatagccgatttggactttgacgattctggtacggaatacatgattgaatgccccaaccttgtgtttgtcgatgacaagcctgttttgattttcagcccacaaggactggctaaagctgatttagattatcaaaatatctaccccaatacctataaaatttttgaaagcttcaatccagaaactggccaattgctgggtggaggggcccttcaaaatcttgactttggttttgaagcttatgccactcaagcctttagtagtccagatggcagggttctagccgtgtcttggattgggttaccagatattgattatccgacagatcgttatgactatcaaggagctcttagtttagtgaaagaattaaggattaaagacggaattctctatcaaacacctgtttcagccctacaaaatcttcgagggccagcagaattatttcataataaaatagacagttctaactgttatgaattggaattgacgattccaggccaaaaaaagcttgacctgctcctatttgccgaccaaaaagggaatggcctaagattgaaagtggatacaacaaaaggacagttaagcattgaccgaagtcgggcaggggttcaatatgcccaagactatggtacggtgcgctcttgccaaatcccacaaggccatgttacacttaatgtctatgtggacaattccattcttgaaatctttattaaccaagggcaaaaagtcctaactagtcgggttttcccaacccacggacaaacaggtatccaagtagtagaaggacaagcttttggacattattatgaaatgaggtat

SEQ ID NO: 3602 - protein, 480 aa, Streptococcus pyogenes
LMDLPQAIRYRPYKEWSSKDYQAITEKMAQSPWHSQFHVEPKTGLLNDPNGFSYFNGRYHLFYQNWPYGAAHGLKQWVHMTSTDLVHFTETRSRLLPDHAHDSHGAYSGSAYAIDDKLFLFYTGNVRDANWVRTPLQVGAWMDKQGNISKIPQVLIEQPDDVTEHFRDPQLFSYQGQFYAIIGAQGLDGKGKIKLYKAVDNHVDNWRFIADLDFDDSGTEYMIECPNLVFVDDKPVLIFSPQGLAKADLDYQNIYPNTYKIFESFNPETGQLLGGGALQNLDFGFEAYATQAFSSPDGRVLAVSWIGLPDIDYPTDRYDYQGALSLVKELRIKDGILYQTPVSALQNLRGPAELFHNKIDSSNCYELELTIPGQKKLDLLLFADQKGNGLRLKVDTTKGQLSIDRSRAGVQYAQDYGTVRSCQIPQGHVTLNVYVDNSILEIFINQGQKVLTSRVFPTHGQTGIQVVEGQAFGHYYEMRY

SEQ ID NO: 3603 - DNA, 171 bp, Streptococcus agalactiae
atgggatgggcatcacctgaggccactgcccaagcgtttggaagggcagagttgaccatcatcaatcctaatacgagaccgataacaggatttccaccaaaaactctaaaagctgaccaagaaatcaaggcaggaaaaaaagcaaaggccgtgtcagtcaaaacgacagta

SEQ ID NO: 3604 - protein, 57 aa, Streptococcus agalactiae
MGWASPEATAQAFGRAELTIINPNTRPITGFPPKTLKADQEIKAGKKAKAVSVKTTV

SEQ ID NO: 3605 - DNA, 1917 bp, Streptococcus agalactiae
atggcttcaaatacagaaattgctaaacaagtcattaatgcgattggtggtgctagtaatgtgcgtagcgtagcacactgtgccactcgtcttcgcgttatggtaaaagatgagacagtcattgataaaaatactgttgaaaatatcgaaaaagttcagggagcatttttcaattcaggtcaatatcaaattatttttggaactggtactgttaataagatttatgatgaagtagtggctcaaggtttgccaacttcgtcaacctctgatcaaaaggcagaagcagctaaacaagggaatgctttccaacgagctattcgtactttcggtgatgtttttgttccattgttgccagccattgttgctactggtttatttatggggattcgcggtgcgattaataatgatacagttttagctttatttgggacgacttcaaaagcattttcaagttctaatttttatacctatactgtcgttttgactgacacggcctttgctttttttcctgccttgatttcttggtcagcttttagagtttttggtggaaatcctgttatcggtctcgtattaggattgatgatggtcaactctgcccttccaaacgcttgggcagtggcctcaggtgatgcccatcccataaaatttttcggttttattccagtagttggttatcaaaattcagtattgccggcattctttgtaggtttacttggtgctaaacttgaaaaatggttgcataagaaaatcccagatgttcttgatttactattagtgccgttcctaacttttacagttatgtcaattttagcactttttgtcattggtcctattttccattcagttgaaaactatgttttagcagggacaaaatttgtccttaatttacctcttggcctgtcaggtcttattttaggtggtgttcatcagataatcgttgttacaggtgttcatcatatctttaatttacttgaagctcagttaattgctgctgatgggaaagatccatttaatgctattattacagctgctatgacagcacaagcaggtgccactttggcagttggtgttaaaacaaaaaataaaaaattaaaagcccttgcttttccggcagcgctttcagctggacttggtattacagaaccggctatatttggagtaaacttacgttttggtaagccatttattatgggattaattgcaggagcagcaggtggctggttagcttcaatattgaaattagcaggaactggttttggtattaccattatcccaggaacattactttatttaaatggtcaaattgttaagtaccttattatggtaattggaactacgtctttggcttttgtattaacttatatgtttggatatgaagataaagatgaaaaagcagtagctgaagttagtcctttggttgaagaaacagatgacgatccaacaattactcaaactagccaattaagggcagaaacgattgttagccctcttgatggacaggttattgctcttgatacagtaagtgacccagttttttcatcaggtattatgggagatggccttgctattaaaccaagaggtaatacaatttactcacctgttgatggttttgtccaaattgcttttgaaacaggtcatgcttacggtatcaaatcagataaaggtgcagaaattttgattcatataggtattgatactgtcaccatgaatggcacagggtttacttctaaagtcaaggcagaccaaaaagtgaaaaaaggtgatattcttggcacctttgattcagccaagattgcagaagcaggtctggataatacagctatgattattgtgactaatacagctgattttgctgatgttgtaccattggtaaaagagggtgttgttactacaggtgacatgattattgatgttaag

SEQ ID NO: 3606 - protein, 639 aa, Streptococcus agalactiae
MASNTEIAKQVINAIGGASNVRSVAHCATRLRVMVKDETVIDKNTVENIEKVQGAFFNSGQYQIIFGTGTVNKIYDEVVAQGLPTSSTSDQKAEAAKQGNAFQRAIRTFGDVFVPLLPAIVATGLFMGIRGAINNDTVLALFGTTSKAFSSSNFYTYTVVLTDTAFAFFPALISWSAFRVFGGNPVIGLVLGLMMVNSALPNAWAVASGDAHPIKFFGFIPVVGYQNSVLPAFFVGLLGAKLEKWLHKKIPDVLDLLLVPFLTFTVMSILALFVIGPIFHSVENYVLAGTKFVLNLPLGLSGLILGGVHQIIVVTGVHHIFNLLEAQLIAADGKDPFNAIITAAMTAQAGATLAVGVKTKNKKLKALAFPAALSAGLGITEPAIFGVNLRFGKPFIMGLIAGAAGGWLASILKLAGTGFGITIIPGTLLYLNGQIVKYLIMVIGTTSLAFVLTYMFGYEDKDEKAVAEVSPLVEETDDDPTITQTSQLRAETIVSPLDGQVIALDTVSDPVFSSGIMGDGLAIKPRGNTIYSPVDGFVQIAFETGHAYGIKSDKGAEILIHIGIDTVTMNGTGFTSKVKADQKVKKGDILGTFDSAKIAEAGLDNTAMIIVTNTADFADVVPLVKEGVVTTGDMIIDVK

SEQ ID NO: 3607 - DNA, 1860 bp, Streptococcus pyogenes
atggataatcgtcagattgcagctgaagtgattgaggctttaggtggccgagaaaatgtgagaagtgttgcccactgtgcaactcgccttcgcgtgatggtttatgatgaaggaaagattgataaggaaaaagcagaagctattgacaaggttaaaggagctttctttaactctggtcaatatcagatgatttttggaactggtaccgttaataacatttatgacgaagttgttgctcttggtttacccacgtcatcaaccagtgagcaaaaggcagaagcaggcaaacatggcaatatcttccaacgggcgattcgtacgtttggagatgtctttgttcccattattccagctattgtagcaacgggtctctttatgggggttcgtggtttggtgacccagccagctattatggatttatttggggtgcatgagtacggggaaaattttctcatgtacactcgtattctaacggatacagcctttgtctacttgccagctttggtggcttggtcagcctttagggtctttgggggtaatcctattatcggtattgttttaggattgatgctggtttccaatgagttgcctaatgcttgggtagttgcctctggtggagatgttaagccgctaaccttctttggatttgttcctgttgttggttatcaaggtaccgttttacccgccttctttgttggtctggtaggagctaagttggagaaatggttgcacaaaaaggttccagaagctttggacttattggtcacaccgtttttaacgtttgctattatgagtaccttgggactatttgtgattggaccagttttccattctcttgaaaaccttgttctggctgggacacaggccgtcttgcatttgccgtttggcattgcaggcttgattgttgggggaatccaacaattaatcgtagtgactggtattcaccatatctttaacttcctagaagcgcagctgattgccaataccggaaaagatcctttcaatgcttacctaacagcagcaacagctgctcaagctggagctaccttagctgttgctgttaaaaccaaatcaacaaaactaaaaggtctggcctttccatcaaccttgtcagctcttttagggattactgaaccagctatttttggggtcaacctccgttatccaaaagtctttgtttcaggtcttattggtggtgccttaggtggttgggtcgctgggctctttggcattgcaggaactggttttgggattacggtcttaccaggaactctcctttacttgaatggccaattattacaataccttgtgactatgcttgtcggtcttggggtagcctttgcaattgcttatacttggggttatcaagatagagaaacccttccgttaccagctgtcgaagttgatcaaacggctgatcagccagccttagcagaggaaactttatatagtcctttgaatggaacagttgtagacttatctgcggtttcagaccctgttttttcatcaggtgctatgggtcaaggcttagcaattaagccagaagataataccctatactcaccagttgatggtaaagttgaaattgtctttgaaacaggtcatgcctatgctataacgtcaagtcaaggagcagaagtgttacttcatattggtattgataccgagtcgatggcaggagatggctttgaatctcttgtagcagtaggtcaggcggttaaaaaaggggatcttcttggacactttgatcctagcaagattgcagaagctggactagatgacaccaccatgatgattgtgagcaatatcgctgactatcaaagcgtggacattcttgctcaaggacatgttttgaggtgg

SEQ ID NO: 3608 - protein, 620 aa, Streptococcus pyogenes
MDNRQIAAEVIEALGGRENVRSVAHCATRLRVMVYDEGKIDKEKAEAIDKVKGAFFNSGQYQMIFGTGTVNNIYDEVVALGLPTSSTSEQKAEAGKHGNIFQRAIRTFGDVFVPIIPAIVATGLFMGVRGLVTQPAIMDLFGVHEYGENFLMYTRILTDTAFVYLPALVAWSAFRVFGGNPIIGIVLGLMLVSNELPNAWVVASGGDVKPLTFFGFVPVVGYQGTVLPAFFVGLVGAKLEKWLHKKVPEALDLLVTPFLTFAIMSTLGLFVIGPVFHSLENLVLAGTQAVLHLPFGIAGLIVGGIQQLIVVTGIHHIFNFLEAQLIANTGKDPFNAYLTAATAAQAGATLAVAVKTKSTKLKGLAFPSTLSALLGITEPAIFGVNLRYPKVFVSGLIGGALGGWVAGLFGIAGTGFGITVLPGTLLYLNGQLLQYLVTMLVGLGVAFAIAYTWGYQDRETLPLPAVEVDQTADQPALAEETLYSPLNGTVVDLSAVSDPVFSSGAMGQGLAIKPEDNTLYSPVDGKVEIVFETGHAYAITSSQGAEVLLHIGIDTESMAGDGFESLVAVGQAVKKGDLLGHFDPSKIAEAGLDDTTMMIVSNIADYQSVDILAQGHVLRW

SEQ ID NO: 3609 - DNA, 879 bp, Streptococcus agalactiae
atgacaaagttatatggtagtattgaagcaggtgggacaaagtttgtttgtgcagttggtgatgaggaattaaaagttgtagaaaaaatgcaatttccaacaacgacgcctcaagaaacgattaaaaagactgttgatttctttaaaagatttgaaaagaagttagaggcagttgctattggttcttttggtcccattgatattgataaaaaatcaaagacatacggttatatcacaacgaccccaaagttgcattgggctaatgttgatttactcggcttaatttctaaagatttcaatgttccattttatttcacaacagatgttaatagctctgcctatggtgaagttatagctcgtaacaatattgattcacttgtttattacaccattggtacgggaattggtgcaggagctatacaaaagggtgaatttataggaggaactggtcatactgaagcaggtcatacttatatggcgatgcatccgcaggaccaagcaaatgattttaaaggtatctgtccgtttcataatagctgtttagaaggtttggcatctggtccaactctagaagctaggactggtattcgtggtgaattgattgaagaaaattcaatggtttgggatgttcaagcctattatattgctcaggctgcaatacaagcaactgtattatatcgtccacaagtcattgtatttggtggaggcgtcatggcacaagagcacatgttaagacgtgttcgccagacatttgcaactttattaaatgggtatttaccagttcccgatttgtctgattatattgtgacaccagctatagaagaaaatggttctgcaacgttaggaaattttgctttagcaaagaaaatatcaaaaggt

SEQ ID NO: 3610 - protein, 293 aa, Streptococcus agalactiae
MTKLYGSIEAGGTKFVCAVGDEELKVVEKMQFPTTTPQETIKKTVDFFKRFEKKLEAVAIGSFGPIDIDKKSKTYGYITTTPKLHWANVDLLGLISKDFNVPFYFTTDVNSSAYGEVIARNNIDSLVYYTIGTGIGAGAIQKGEFIGGTGHTEAGHTYMAMHPQDQANDFKGICPFHNSCLEGLASGPTLEARTGIRGELIEENSMVWDVQAYYIAQAAIQATVLYRPQVIVFGGGVMAQEHMLRRVRQTFATLLNGYLPVPDLSDYIVTPAIEENGSATLGNFALAKKISKG

SEQ ID NO: 3611 - DNA, 882 bp, Streptococcus pyogenes
atgggaaaattatatggaagcattgaagctggtgggacaaagtttgtctgtgccgtgggtgatgaggagtttacagtggtggataaaacacaatttccgaccaccacaccagaagaaaccatcgcgcgaaccatcgcttattttaaagcttttgaggcagatttggctggaatggcgattggttcttttggaccaattgatattgatccgtcgtcagagacttacggttatatcacaaccactcctaaatcaggctgggctaatgtggatttgttaggacaactttcggctgcttttaagattccttttgatgtgacaacagatgttaatagctctgcttatggtgaggtgcttgctcgtcctggtgtggaaagtttggtctattacaccataggtactggtattggggcgggagctattcaacatggccactttattgggggtttaggtcatacagaagcgggtcatacctatgtcatgccccatcctgatgatatggccaagggatttttaggtgtttgcccttttcataaagggtgtctggaagggatggcagcaggtccaagtattgaggccagaacgggagtgagaggtgaacggcttgatcaggaagctgatgtttgggacattcaagccttctacattgcccaagcagcgctgcaagcaactatgctttaccgtcctcaagtgattgtttttggcggaggtgtcatggcgcaagaacatatggtgttgcgcgtgcatgataaattcactgcccttttaagcggttatttgccagtccctgatttgacagactacattgttactccagctgttgctgataatggctccgctactctgggaaattttgctttggccaagttggctgcacaaggaaaa

SEQ ID NO: 3612 - protein, 294 aa, Streptococcus pyogenes
MGKLYGSIEAGGTKFVCAVGDEEFTVVDKTQFPTTTPEETIARTIAYFKAFEADLAGMAIGSFGPIDIDPSSETYGYITTTPKSGWANVDLLGQLSAAFKIPFDVTTDVNSSAYGEVLARPGVESLVYYTIGTGIGAGAIQHGHFIGGLGHTEAGHTYVMPHPDDMAKGFLGVCPFHKGCLEGMAAGPSIEARTGVRGERLDQEADVWDIQAFYIAQAALQATMLYRPQVIVFGGGVMAQEHMVLRVHDKFTALLSGYLPVPDLTDYIVTPAVADNGSATLGNFALAKLAAQGK

SEQ ID NO: 3613 - DNA, 945 bp, Streptococcus agalactiae
atgtcggaaccattatttttagaagcaagcatgcacgataaaatctggggtggaacaaagttaagggatgaatttggctatgatattccaagtgaaacaacaggagaatattgggctatttcagctcatcctaacggtgtctcaagagttaagaatggtcgctttaaaggttgttttttagataagctgtatcaaggtgaaaaaagcttatttggcaaccctgatgatactgtctttcctttactaactaaaatcttagatgctaatgactggcttagtgtacaggttcatccggatgatgcttatgctcttaaacatgaaggtgaacttggtaaaacagaatgttggtatattatttctgctgatgaaggatctgaaattatctatggtcataatgctaaaactaaagaagaacttcgccaaatgattgaatctggagattgggaacatcttttaacccgaattcctgttaaatcaggggatttttactacgttccaagtgggacaatgcatgctataggtaaagggatattaattttagaaacacagcaatctagtgatactacttatcgtgtttatgattttgatcgtccagatgcttcaggaaaattacgtgatttacacattgaacaatcaatagatgttctcacgattggtaaacctgccaatactgttcctgccaatatgaagttaaaacatctatcttcaactttattagtttcaaatgatttctttacagtttataaatgggaaatttctggtgttaccaactttaaacaatttgcaccctaccttttggttagtgtcttagacggagcgggtcacattacagtagataacaaagtttatacacttaaaaaaggtgaccactttatcttgccaaatgatgttgtcaaatgggatattgatggacagttagaaattatagcaagtcatgttaaaaaa

SEQ ID NO: 3614 - protein, 315 aa, Streptococcus agalactiae
MSEPLFLEASMHDKIWGGTKLRDEFGYDIPSETTGEYWAISAHPNGVSRVKNGRFKGCFLDKLYQGEKSLFGNPDDTVFPLLTKILDANDWLSVQVHPDDAYALKHEGELGKTECWYIISADEGSEIIYGHNAKTKEELRQMIESGDWEHLLTRIPVKSGDFYYVPSGTMHAIGKGILILETQQSSDTTYRVYDFDRPDASGKLRDLHIEQSIDVLTIGKPANTVPANMKLKHLSSTLLVSNDFFTVYKWEISGVTNFKQFAPYLLVSVLDGAGHITVDNKVYTLKKGDHFILPNDVVKWDIDGQLEIIASHVKK

SEQ ID NO: 3615 - DNA, 951 bp, Streptococcus pyogenes
atgtcagaaccattatttctaaaatcaaccatgcacgacaggatttggggtggcaccaagttgagagatgtctttgcttacaacatcccaagtgacaccacaggtgagtattgggctatttctgctcatcctaatggtgtttcgacagttactaatggacgttatcaaggacaacctttaaacacattatatgcgcaagagccggccttgtttgggaatccaaaggaagaagtttttccactgttaactaagattttagatgctaatgactggctaagtgtccaagttcatcctgatgatgcttatggacgtgaacatgaaggagaattaggcaagacagaatgctggtatattatttctgccgaagagggttctgaaattgtatacggccatcaggccaagtccaaagaagaccttcgtgccatgattgaagcaggcgcttgggatgatttgctgactcgtgtcccagtcaaagcaggcgattttttctatgttccaagtggcaccatgcatgcgatcggcaagggaattcttattttagaaacccagcagtcatctgataccacttatcgggtttatgattttgaccgtaaggacgttaatggtaatcttcgtgaccttcatattgaaaagtctattgatgtcttaacgattggtaagccagaaaatagcgtgccagccactatggttttggataatatggtagcaacaactttagtctcaacaccatttttcactgtttacaaatgggtaactagtcaaatggttgacatgaaacaagctgcgccttatcttttagtgagtgttttaaaaggtcaaggaaaactctatgtggaccagaaggcttatgagctagaaaaaggcatgcactttatcttgcctaacgatgttaaatcgtggtcatttgatggtcaattagaaatgattgtgagtcaccccaatcaactcgtt

SEQ ID NO: 3616 - protein, 317 aa, Streptococcus pyogenes
MSEPLFLKSTMHDRIWGGTKLRDVFAYNIPSDTTGEYWAISAHPNGVSTVTNGRYQGQPLNTLYAQEPALFGNPKEEVFPLLTKILDANDWLSVQVHPDDAYGREHEGELGKTECWYIISAEEGSEIVYGHQAKSKEDLRAMIEAGAWDDLLTRVPVKAGDFFYVPSGTMHAIGKGILILETQQSSDTTYRVYDFDRKDVNGNLRDLHIEKSIDVLTIGKPENSVPATMVLDNMVATTLVSTPFFTVYKWVTSQMVDMKQAAPYLLVSVLKGQGKLYVDQKAYELEKGMHFILPNDVKSWSFDGQLEMIVSHPNQLV

SEQ ID NO: 3617 - DNA, 2556 bp, Streptococcus agalactiae
gtggtgataagagtatcgaaaggaattagaatggcaaatattctacgcactgttattgaaaatgacaagggtgaattaaaaaaattagataaaatagctaagaaagttgactcttacgcagatcatatggctgcgttatcagatgaagctttacaagcaaaaactccagaatttaaagaacgttatcaaaatggtgaaactttagatcaattgttaccggaagcgtttgcggtagttcgtgaagcttctaaacgtgtattaggtttatacccataccacgtccaaattatgggtggtatcgttcttcaccatggtgatattccagaaatgcgtactggtgagggaaaaactttaacagcgacaatgcctgtttatctaaatgctatctcaggattaggtgttcatgttattactgttaatgagtatttatcaacacgtgatgcgaccgaaatgggtgaggtttatagttggcttggattatctgtagggattaacttagcagctaagtcaccatttgaaaaacgcgaagcttacaattgtgatatcacatactcaactaacgcagaagtcggatttgactaccttcgagacaatatggttgttcgccaagaagatatggtgcaacgcccactcaactatgctttggttgatgaggttgactctgtattaatcgatgaagctaggacgccattgattgtttcaggtcctgtaagctctgagatgaaccaactgtatacacgtgcggacatgtttgtaaaaacgcttaatagcgatgattatatcattgatgttccaacaaaaacaattggtttatcagatacaggtattgacaaggctgaaaactatttccatctaaataacttgtatgatctcgaaaatgttgccttaactcactacattgataacgctcttcgagctaactatattatgttgttaaatattgattatgtggttagtgaagaacaagagattttaattgtggaccaatttaccggtcgtacgatggaaggacgtcgtttctcagatggcttacaccaagctattgaagcaaaagagtcagtgccaatccaagaagaatcaaaaacgagcgcttcaattacttaccaaaatatgttccgtatgtaccataaattagcaggaatgactggtactggtaagactgaggaagaagagtttcgtgaaatttataatatgcgcgttattcctatcccaacaaatcgtcctgttcaacgtatagatcattcagatctactttatccaactcttgactctaaatttagagcggtggtagcagatgtcaaagaacgttatgaacaaggacaacctgtactggttggtacagtagctgttgaaacgtcagacttaatttctagaaaattagttgctgctggagtaccacatgaagttttgaatgctaaaaatcactttaaagaagctcaaatcattatgaatgctgggcaacgtggtgctgttacaatcgcaaccaacatggctggtcgtggtactgatatcaagcttggtgaaggggttcgtgaacttggtggtttatgtgttattggtacagagcgtcatgaaagccgtcgtattgataaccagcttcgtggtcgttcgggtcgtcaaggagatccaggtgaatcacaattctatctttcgttagaagatgatttgatgcgtcgctttggtacagatcgtattaaagtggttcttgagcgaatgaatttagctgaagatgatacagttattaaatcaaaaatgttgacacgacaagttgaatcagctcaacgccgcgttgaaggtaataactatgacacacgtaaacaagtcttgcaatacgatgatgttatgcgtgaacaacgtgagattatttatgctaaccgtagagaagtgattactgctgagcgtgatttaggaccagagctcaaagggatgattaaacgtacgattaaaagagcagttgatgcacatagcagaagcgataaaaatactgcagcagaagctattgttaattttgcaagatcggcgttattagatgaagaagctatcacagtttcagaacttcgtggtctaaaagaggctgaaattaaagaacttctttatgaacgtgccttagctgtttatgagcaacaaattgctaaattaaaagatccagaagctattatcgaattccaaaaagtcttaatcttgatggtagtggataatcaatggacagagcatattgatgccttagatcaattacgtaactccgttggacttcgtggttatgctcaaaataacccaatcgttgagtatcaatcagaaggtttccgtatgttccaagatatgattggttcgattgagtttgatgtgacacgtacattgatgaaagctcaaattcatgaacaagagcgtgaacgtgcttctcaacatgctacgacaacagcagagcaaaatatctcggcacaacatgtacctatgaataatgaatcaccagaataccaagggattaaacgtaatgataaatgtccttgtggctctggcatgaagtttaaaaattgtcatggtctgagatgtttacaa

SEQ ID NO: 3618 - protein, 852 aa, Streptococcus agalactiae
MVIRVSKGIRMANILRTVIENDKGELKKLDKIAKKVDSYADHMAALSDEALQAKTPEFKERYQNGETLDQLLPEAFAVVREASKRVLGLYPYHVQIMGGIVLHHGDIPEMRTGEGKTLTATMPVYLNAISGLGVHVITVNEYLSTRDATEMGEVYSWLGLSVGINLAAKSPFEKREAYNCDITYSTNAEVGFDYLRDNMVVRQEDMVQRPLNYALVDEVDSVLIDEARTPLIVSGPVSSEMNQLYTRADMFVKTLNSDDYIIDVPTKTIGLSDTGIDKAENYFHLNNLYDLENVALTHYIDNALRANYIMLLNIDYVVSEEQEILIVDQFTGRTMEGRRFSDGLHQAIEAKESVPIQEESKTSASITYQNMFRMYHKLAGMTGTGKTEEEEFREIYNMRVIPIPTNRPVQRIDHSDLLYPTLDSKFRAVVADVKERYEQGQPVLVGTVAVETSDLISRKLVAAGVPHEVLNAKNHFKEAQIIMNAGQRGAVTIATNMAGRGTDIKLGEGVRELGGLCVIGTERHESRRIDNQLRGRSGRQGDPGESQFYLSLEDDLMRRFGTDRIKVVLERMNLAEDDTVIKSKMLTRQVESAQRRVEGNNYDTRKQVLQYDDVMREQREIIYANRREVITAERDLGPELKGMIKRTIKRAVDAHSRSDKNTAAEAIVNFARSALLDEEAITVSELRGLKEAEIKELLYERALAVYEQQIAKLKDPEAIIEFQKVLILMVVDNQWTEHIDALDQLRNSVGLRGYAQNNPIVEYQSEGFRMFQDMIGSIEFDVTRTLMKAQIHEQERERASQHATTTAEQNISAQHVPMNNESPEYQGIKRNDKCPCGSGMKFKNCHGLRCLQ

SEQ ID NO: 3619 - DNA, 2517 bp, Streptococcus pyogenes
atggccaatattctacgcaaagttatcgaaaatgacaaaggcgaactaagaaaattagaaaaaattgcaaaaaaagtagaatcctacgcagaccaaatggcgtcattgtcggatagagatctacaaggaaaaacacttgaatttaaagaacgctatcaaaaaggtgagaccctcgaacaactattacctgaagctttcgcagttgttcgtgaagcagcaaaacgtgtgttgggcttgttcccttatcgtgttcaaattatgggaggaattgttcttcataacggggatgtccctgaaatgcgtactggtgaaggaaaaactcttacagccaccatgccagtttatctcaatgctattgctggtgagggtgttcacgttattactgttaatgagtatctttcaacgcgtgacgctaccgaaatgggtgaagtgtatagctggttaggtctttcagttgggatcaacctagctgctaagtctcctgctgaaaaacgtgaagcttataattgtgatattacttattcaaccaactctgaagtcggttttgattaccttcgtgacaacatggttgttcgccaggaagacatggtacaacgcccactcaattttgccttggttgatgaagtggactcagtcttaattgacgaggcaaggacacctttaattgtttctggtgctgttagctctgaaaccaatcaattgtatattcgtgctgacatgtttgtaaaaactctgacgtcagtggattatgttattgatgtgcccactaaaacgattggattaagcgattcaggtattgataaagctgagagttactttaacttgagcaatctttacgatattgaaaatgtagccttgactcactttatagacaacgcccttcgtgcaaactatattatgttgttagatatcgattatgtggtcagcgaagatggtgagattcttattgttgaccaatttacaggtcgtacgatggaagggcgtcgcttctcagacggcttgcaccaagctattgaggcaaaagaaggcgttcgtattcaggaagaatcaaaaaccagcgcctcaatcacttaccaaaatatgtttcgtatgtacaaaaaattggcaggtatgactggtactgcgaagaccgaggaagaagaatttcgcgaagtttataacatgcgtattattccaattccaaccaatcgtccaattgcccgtattgatcacactgatttgctttacccgaccttagaatcaaagtttagagcagttgtggaagacgttaaaacgcgtcatgcaaaaggacaacctatccttgtaggtacggttgctgttgaaactagtgatttgatttcacgcaagctggttgaagcagggattcctcatgaggttttgaatgctaaaaatcactttaaagaagctcaaatcattatgaatgctgggcaacgtggtgctgttacaatcgcaactaacatggctggtcgtggtactgatatcaagcttggtgaaggtgttcgtgaacttggtgggttatgtgtcattggtacagagcgtcatgaaagccgtcgtatcgataaccagcttcgtggacgttcaggtcgtcaaggagatccaggtgaatcccaattctatctttcattagaagatgatttgatgagacgtttcggctctgatcgtataaaagcctttttggatcggatgaaattagatgaagaagacactgttattaaatcaggtatgttagggcgtcaagtggaatctgctcaaaaacgggttgaaggaaataactatgatacccgtaaacaggtcttacaatatgatgatgtgatgcgtgaacagcgtgaaattatctatgctaaccgtcgtgatgtcataactgctaatcgagatcttggcccagaaattaaagctatgatcaagcgtactatcgaccgtgctgtagatgctcatgcacgtagcaatcgtaaagatgctatagatgctattgtaacttttgctaggacctcgctggtaccagaagagtttattagtgctaaagagttacgtggtttaaaagatgatcaaatcaaagagaagctttatcaaagagcgcttgctatctacgaccagcaactatcaaaacttcgtgatcaagaagctattattgaattccaaaaagtactcattttgatgattgtggataacaaatggactgaacacattgatgccttagatcaacttcgtaatgctgttggacttcgggggtatgctcaaaataaccctgtggtggaataccaagcagaaggtttcaagatgttccaagatatgattggtgctatcgagtttgatgtaacacgtaccatgatgaaagcacaaattcacgaacaagaacgtgaacgtgcaagtcaacgtgccacaacagcagcacctcaaaacatccaatcgcagcagtcagctaacaccgatgatttacccaaagtggagcgtaacgaagcttgtccatgtggttcaggcaaaaaattcaaaaattgtcacggtcgtaaatccttctca

SEQ ID NO: 3620 - protein, 839 aa, Streptococcus pyogenes
MANILRKVIENDKGELRKLEKIAKKVESYADQMASLSDRDLQGKTLEFKERYQKGETLEQLLPEAFAVVREAAKRVLGLFPYRVQIMGGIVLHNGDVPEMRTGEGKTLTATMPVYLNAIAGEGVHVITVNEYLSTRDATEMGEVYSWLGLSVGINLAAKSPAEKREAYNCDITYSTNSEVGFDYLRDNMVVRQEDMVQRPLNFALVDEVDSVLIDEARTPLIVSGAVSSETNQLYIRADMFVKTLTSVDYVIDVPTKTIGLSDSGIDKAESYFNLSNLYDIENVALTHFIDNALRANYIMLLDIDYVVSEDGEILIVDQFTGRTMEGRRFSDGLHQAIEAKEGVRIQEESKTSASITYQNMFRMYKKLAGMTGTAKTEEEEFREVYNMRIIPIPTNRPIARIDHTDLLYPTLESKFRAVVEDVKTRHAKGQPILVGTVAVETSDLISRKLVEAGIPHEVLNAKNHFKEAQIIMNAGQRGAVTIATNMAGRGTDIKLGEGVRELGGLCVIGTERHESRRIDNQLRGRSGRQGDPGESQFYLSLEDDLMRRFGSDRIKAFLDRMKLDEEDTVIKSGMLGRQVESAQKRVEGNNYDTRKQVLQYDDVMREQREIIYANRRDVITANRDLGPEIKAMIKRTIDRAVDAHARSNRKDAIDAIVTFARTSLVPEEFISAKELRGLKDDQIKEKLYQRALAIYDQQLSKLRDQEAIIEFQKVLILMIVDNKWTEHIDALDQLRNAVGLRGYAQNNPVVEYQAEGFKMFQDMIGAIEFDVTRTMMKAQIHEQERERASQRATTAAPQNIQSQQSANTDDLPKVERNEACPCGSGKKFKNCHGRKSFS

SEQ ID NO: 3621 - DNA, 1005 bp, Streptococcus agalactiae
atgggatttcatcagttaagtgataaaattaatattgaaatattgaagcagaaaactagcttagatctagaagttagccaaaaaaaattagccaaagaagaagagttaaaaaatatcataaaaggtgaggatcagcggtttctagtaatagtaggtccttgttctgcggataatccaaaggcggtgctaacttatgcaaagcgtttagctaaattggaagctgcctttaaagataaaatgtttttggttatgagagtttataccgctaagccaagaacgaatggtgatggttataaaggcttagttcaccattctgacaaactaggagttttttttcaagcacgtaagatgcactatgacatcattcgagagactggactcctgacagctgatgaattactttatccagagatgttatcagtgatggatgatttagtttcttactatgctattggtgcgcgttcagtggaagatcagggacaccgttttatatcttcaggtatagatgcaccagtaggtatgaaaaatccaacgtctggtaatttaagagtcatgtttaatgcggtctatgcagcacaaaatcaacaggaattattctatcaaaataagcaagttagaacagatggtaatttgctgtcacatgttattttgagaggatatcataatgccgactatcgaagtatccctaattatcattatgaaaaccttttagaaactattactcattatgaagagactgatttgcaaaatccctttattgttgttgatacaaatcatgacaattcaggtaagcaatttttagaacaaattcgcattgtgaaatcagtacttgcagaccgacagtggcatactaaaattagaaactatgttcgtggttttttgatagaatcttatttagaagatggaagacaagataaaccagatgtttttggtaagtctatcacagatccatgtctaggttgggataaaacagaaatgctaattagggatatttacaatagtttg

SEQ ID NO: 3622 - protein, 335 aa, Streptococcus agalactiae
MGFHQLSDKINIEILKQKTSLDLEVSQKKLAKEEELKNIIKGEDQRFLVIVGPCSADNPKAVLTYAKRLAKLEAAFKDKMFLVMRVYTAKPRTNGDGYKGLVHHSDKLGVFFQARKMHYDIIRETGLLTADELLYPEMLSVMDDLVSYYAIGARSVEDQGHRFISSGIDAPVGMKNPTSGNLRVMFNAVYAAQNQQELFYQNKQVRTDGNLLSHVILRGYHNADYRSIPNYHYENLLETITHYEETDLQNPFIVVDTNHDNSGKQFLEQIRIVKSVLADRQWHTKIRNYVRGFLIESYLEDGRQDKPDVFGKSITDPCLGWDKTEMLIRDIYNSL

SEQ ID NO: 3623 - DNA, 750 bp, Streptococcus pyogenes
atgattgacattatgtctgactttcaaaataagacttgttctaagaataattttattgttggaccttgttccattgaatcttatgatcacattagattagcagcttcaagtgccaaaaaacttggttacaactattttagaggaggcgcctataaaccaagaacatctgctgcttcttttcaaggccttggcctgcaaggaattcgttacttgcatgaggtttgtcaggaatttggcttactatcggtcagtgaaatcatgtccgagcgccaattagaagaagcctatgactatctcgatgtcattcaggttggtgcccgcaacatgcaaaattttgaatttttaaaaaccttgtcacacatcgataagcctattttgtttaaacgaggcttgatggctactatcgaggaatatttgggcgccctttcctacttacaagacactggaaaatctaacattatcttatgcgaacgtggcgttcgtggctacgatgtggagactagaaatatgcttgatattatggcagtccctattattcaacaaaagacagatttaccgattattgtggacgtatctcattcgacaggcagacgagatttactcttacctgctgctaagatagcgaaggctgtcggtgccaatggcatcatgatggaggttcatcctgatcccgaccatgcgctgtcagatgctgcccagcaaattgattataagcaattagaacagttggggcaggaactttggcaagat

SEQ ID NO: 3624 - protein, 250 aa, Streptococcus pyogenes
MIDIMSDFQNKTCSKNNFIVGPCSIESYDHIRLAASSAKKLGYNYFRGGAYKPRTSAASFQGLGLQGIRYLHEVCQEFGLLSVSEIMSERQLEEAYDYLDVIQVGARNMQNFEFLKTLSHIDKPILFKRGLMATIEEYLGALSYLQDTGKSNIILCERGVRGYDVETRNMLDIMAVPIIQQKTDLPIIVDVSHSTGRRDLLLPAAKIAKAVGANGIMMEVHPDPDHALSDAAQQIDYKQLEQLGQELWQD

SEQ ID NO: 3625 - DNA, 357 bp, Streptococcus agalactiae
atgattgttggacacggaattgatttacaagagatagaggcgattactaaagcatatgagcgtaatcaacgttttgcagaacgcgttttgaccgaacaagaattgcttctttttaaaggaatttccaatcccaagcgtcagatgtcttttttaacagggcgatgggcagcaaaagaggcttatagcaaagcacttggaacaggaattgggaaagttaattttcatgatatcgaaattttatcggatgataaaggagcgcctttgattacaaaagaaccgtttaatggaaaatcttttgtttcaatatctcatagtggtaattatgcacaagctagtgttattttggaggaagaaaaa

SEQ ID NO: 3626 - protein, 119 aa, Streptococcus agalactiae
MIVGHGIDLQEIEAITKAYERNQRFAERVLTEQELLLFKGISNPKRQMSFLTGRWAAKEAYSKALGTGIGKVNFHDIEILSDDKGAPLITKEPFNGKSFVSISHSGNYAQASVILEEEK

SEQ ID NO: 3627 - DNA, 354 bp, Streptococcus pyogenes
atgattgttggacatggaatagacttacaagagatttcagctattgaaaaagtttatcaaagaaatcctcgctttgctcaaaaaattttaactgagcaggaattggctatttttgagagttttccttacaaacgtcgactcaactatttggcaggacgctggtcaggtaaggaagcttttgctaaggctatagggacaggtattgggcggttaacctttcaagatattgagattttaaatgatgttagaggatgtcccattctgacaaaatctccgtttaaaggaaatagttttattagcatctcacatagtggcaattatgtacaggctagtgttattttggaggataaaaaa

SEQ ID NO: 3628 - protein, 118 aa, Streptococcus pyogenes
MIVGHGIDLQEISAIEKVYQRNPRFAQKILTEQELAIFESFPYKRRLNYLAGRWSGKEAFAKAIGTGIGRLTFQDIEILNDVRGCPILTKSPFKGNSFISISHSGNYVQASVILEDKK

SEQ ID NO: 3629 - DNA, 1098 bp, Streptococcus agalactiae
atgatttcaagttatcatagaccaaccagagccttgatagatttagaggcgattgcaaataacgttaaatctgtacaagagcacattccaagtgataaaaaaacatttgctgtagttaaggctaatgcttatgggcatggtgctgttgaagtttcaaaatacattgagtctattgtagatggtttttgcgtatccaatttagatgaggctattgagctacgtcaagcaggaattgtaaaaatgatattggtattaggtgttgttatgcctgagcaggttatactagccaaaaatgaaaatattactctaacagttgctagcttggagtggttacgtttatgtcagacatcagcagtagatttatctggtctagaagtacatatcaaagttgatagtggaatgggacgtataggtgttcgccagttagatgaaggaaataagctaatttctgaattgggggaaagtggtgcctctgtcaaggggattttcacccattttgcaacagctgatgaagccgataactgtaaattcaatcaacaacttactttttttaaagactttatttcaggattagataattgtccggaccttgttcatgctagtaattctgctacaagcctttggcatagtgagacaatttttaatgccgttagattgggtgttgttatgtacggcttaaatccaagtggaactgatttagacttaccttaccctataaaccctgctttaagtttagagtctgagctagtacatgttaaacaactacacgatggttctcaagttggctatggcgcaacctatcaagttactggagacgaatttgttggaacagtaccgattggctacgctgatggatggacacgagatatgcaaggattttcagttatagtaaatggagaactttgtgaaattattgggcgtgtctcgatggatcaaatgactatccgtttacctcaaaaatatactatcggaactaaagtaaccttgattggtcaacaaggtagttgtaacattacaactacggacgtcgctcaaaaaagacagacgattaattatgaagtactttgtcttttaagcgatcgtattccgagatattat

SEQ ID NO: 3630 - protein, 366 aa, Streptococcus agalactiae
MISSYHRPTRALIDLEAIANNVKSVQEHIPSDKKTFAVVKANAYGHGAVEVSKYIESIVDGFCVSNLDEAIELRQAGIVKMILVLGVVMPEQVILAKNENITLTVASLEWLRLCQTSAVDLSGLEVHIKVDSGMGRIGVRQLDEGNKLISELGESGASVKGIFTHFATADEADNCKFNQQLTFFKDFISGLDNCPDLVHASNSATSLWHSETIFNAVRLGVVMYGLNPSGTDLDLPYPINPALSLESELVHVKQLHDGSQVGYGATYQVTGDEFVGTVPIGYADGWTRDMQGFSVIVNGELCEIIGRVSMDQMTIRLPQKYTIGTKVTLIGQQGSCNITTTDVAQKRQTINYEVLCLLSDRIPRYY

SEQ ID NO: 3631 - DNA, 1098 bp, Streptococcus pyogenes
atgatttcaagtttccatcgcccaacagttgcaagggtcaacttacaagctattaaggagaatgttgccagtgttcaaaagcatattccactaggggtaaaaacgtatgcagttgtcaaggctgatgcttatggtcatggtgctgtccaggtgtcaaaagcactcctacctcaagtggatgggtactgtgtgtcaaatcttgatgaggctttgcaattacgtcaagcaggtattgataaagagattttaattcttggggttttgctgccaaatgaattagagttagcagttgctaatgctattactgttacaatcgctagtttagactggatagctttagctagactggagaaaaaagaatgtcaaggcttaaaagttcatgtaaaagttgattctggtatggggcggatcgggcttcgttcttcaaaagaagtcaatttattgattgatagtctaaaagagttgggtgctgatgtagaaggtattttcactcattttgccacagctgatgaggcagatgatactaaatttaaccagcagttacagttttttaaaaagctgatagctggacttgaggataagcctcgtttagtacatgctagtaattcagccacaagtatctggcatagtgataccatttttaatgctgttcgtttaggaattgtcagttatggtttgaatccaagtggttctgatctaagcttaccgtttccactgcaagaggctttatctctagaatctagcttagtgcatgtcaagatgatttcagctggtgatacagtcggttatggagctacttatactgccaaaaagtctgaatatgtagggactgtcccaatcggttatgcagatggctggaccaggaacatgcaaggcttttcggtgttagttgatggacaattctgcgaaattatagggcgtgtatcgatggatcaactgaccatacgacttcccaaagcatatcctttaggaacaaaagtcactttgattggcagcaatcagcaaaaaaatatttctacaacagatatcgcaaattaccgtaatacaatcaattatgaagttctatgccttttaagtgaccgtattcctcggatatat

SEQ ID NO: 3632 - protein, 366 aa, Streptococcus pyogenes
MISSFHRPTVARVNLQAIKENVASVQKHIPLGVKTYAVVKADAYGHGAVQVSKALLPQVDGYCVSNLDEALQLRQAGIDKEILILGVLLPNELELAVANAITVTIASLDWIALARLEKKECQGLKVHVKVDSGMGRIGLRSSKEVNLLIDSLKELGADVEGIFTHFATADEADDTKFNQQLQFFKKLIAGLEDKPRLVHASNSATSIWHSDTIFNAVRLGIVSYGLNPSGSDLSLPFPLQEALSLESSLVHVKMISAGDTVGYGATYTAKKSEYVGTVPIGYADGWTRNMQGFSVLVDGQFCEIIGRVSMDQLTIRLPKAYPLGTKVTLIGSNQQKNISTTDIANYRNTINYEVLCLLSDRIPRIY

SEQ ID NO: 3633 - DNA, 1536 bp, Streptococcus agalactiae
atgtcaaaacaaaaagtaatggcaactttgttgttatccactttagtcttatcgctatcatcacctttagtgaccttagcagaaactattaatccagaaacaagcctgacaatggcaacagcatcaacagaaagttcttctgaagcagagaaacaggaaaaaacacaacctacagattcagaaactgcttcaccttcagccgaaggaagtatctcaacagaaaaaacagagattggtacgacagagacatcatcaagcaatgaatcatcatcaagttcatcacatcaatcttcttccaacgaagatgctaaaacatctgattctgcttcaacagcatctactcctagcactaatactacaaacagtagtcaagcagacagtaagccaggtcaatcaacaaagactgaattaaaacctgagcctaccttaccattagtagagcctaaaataactcccgctccgtctcagatagaaagtgttcagacaaatcagaatgcttctgttcctgctttatcctttgatgataacttattatcaacaccgatttcaccagtgacagcaacgccattctacgtagaacactggtctggtcaggatgcctactctcactatttattgtcacatcgttacggtatcaaagctgaacaattagatgggtacttaaaatctttagggattcaatatgattctaatcgtatcaatggtgctaagttattacaatgggaaaaagatagtggtttagatgtccgtgctattgtagctattgctgtccttgaaagttcattgggaactcaaggagtggctaagatgccaggtgctaatatgtttggttatggtgcctttgatcatgactctagccatgctagtgcttataatgatgaagaagcaattatgttgttgacaaaaaatacaattattaaaaacaacaactctagctttgaaatccaagatttgaaagcacagaaattatcttctggacaacttaatacagttactgagggtggtgtttattatacagataactctggaactggtaaacgtcgtgcccagattatggaagatttagaccgctggattgatcaacatggagggacaccagaaattcctgctgccttgaaagctttatcgacagcaagtttagcagatttaccaagtggttttagcttatcaacagcagttaacacagctagctatattgcatcaacttatccatggggtgaatgtacatggtatgtctttaaccgcgctaaagagttaggttatacatttgatccatttatgggtaatggtggagattggcaacataaggctggttttgaaacaacacattcaccaaaagtaggctatgctgtatcattttcaccaggacaagctggtgctgatggcacttacggtcacgtagctattgttgaagaagttaaaaaagatggttcagttcttatttcagaatctaatgcaatgggacgtggtattgtctcttaccgtacttttagttcagcacaagctgcacaattaacttatgttattggccataaa

SEQ ID NO: 3634 - protein, 512 aa, Streptococcus agalactiae
MSKQKVMATLLLSTLVLSLSSPLVTLAETINPETSLTMATASTESSSEAEKQEKTQPTDSETASPSAEGSISTEKTEIGTTETSSSNESSSSSSHQSSSNEDAKTSDSASTASTPSTNTTNSSQADSKPGQSTKTELKPEPTLPLVEPKITPAPSQIESVQTNQNASVPALSFDDNLLSTPISPVTATPFYVEHWSGQDAYSHYLLSHRYGIKAEQLDGYLKSLGIQYDSNRINGAKLLQWEKDSGLDVRAIVAIAVLESSLGTQGVAKMPGANMFGYGAFDHDSSHASAYNDEEAIMLLTKNTIIKNNNSSFEIQDLKAQKLSSGQLNTVTEGGVYYTDNSGTGKRRAQIMEDLDRWIDQHGGTPEIPAALKALSTASLADLPSGFSLSTAVNTASYIASTYPWGECTWYVFNRAKELGYTFDPFMGNGGDWQHKAGFETTHSPKVGYAVSFSPGQAGADGTYGHVAIVEEVKKDGSVLISESNAMGRGIVSYRTFSSAQAAQLTYVIGHK

SEQ ID NO: 3635 - DNA, 2013 bp, Streptococcus agalactiae
atgctattacaatcaccaatttctaatcttaagggatttggaccaaaatcagcagaaaaatttcagaaattagatatttatacagtagaagatttacttctttattatccgtttcgctatgaagattttaaatcaaaatctgtttttgatttagtggatggtgaaaaagcagtcattacaggcctagtcgttactccagctaatgtacaatattatggttttaaacgtaaccgtttaagttttaagttgcgtcaaggggaagctgtcttaaatgttagtttttttaatcaaccctatttagctgataaaatagaacttggtcaagaggtagctgtctttggtaaatgggatgcaactaaatcagctattactgggatgaaggttttagctcaagttgaagatgacatgcaacctgtttatcgcgtagctcagggaatttcacagtctactttgattaaagctattaagtcagcttttgaaatcagtgcgcatttggaattgaaggaaaatttaccagctactttattggaaaaataccgattgatgggtcgtagtcaggcttgtttagctatgcatttcccaaaagatatcacagagtataagcaagcgctccgtcggattaaatttgaagaattattttactttcaaatgaaccttcaagttttgaaatccgaaaataaatctgaaacaaatggtttgcctattctttatagtaaacatgctatggagacaaaaatttcctctttaccttttattctaacgaatgctcaaaagcgctctttagatgaaatattatctgatatgtcatcgggagctcatatgaatcgtttattgcaaggagatgtaggatcaggaaagacagtcattgctggtctatcaatgtatgcagcttatacagcaggttttcaatcggctttgatggttccaacggaaatcctagctgaacaacactacattagtctgcaagagttatttccagatttatcaatcgctatattaacttcgggtatgaaagcagctgttaagcgtacggttttagcagctattgcaaatggctcggttgatatgattgtaggaactcatgctcttatccaggactcggtacagtaccataaactggggcttgtaattacagacgagcaacatcgttttggtgttaaacagcgtagaattttccgtgaaaagggagaaaatcctgatgttttaatgatgacagccaccccaattccccgaactctagcaatcacagcttttggagaaatggatgtttctattattgatgaattacctgccggtcgtaaacctattattacacgctgggtgaaacacgagcagctaggtactgtgttggaatgggtaaaaggtgaattgcaaaaagatgctcaagtgtatgtcatttcaccgttgattgaagagtcagaagctttagatttaaagaatgcagtagcattgcatgctgaattatctacttattttgaaggaattgctaaggttgctcttgtacatggacgtatgaaaaatgatgaaaaagatgctataatgcaagatttcaaggataaaaaaagtcatattttagtatctacaacagttattgaagtaggggtaaatgtcccaaatgcaacgatcatgattattatggatgccgatcgttttggattaagccagctacatcaacttcgtgggcgtgttggtcgtggatataaacaatcatacgctgttttagtggctaatcccaaaactgattctgggaaaaaacgaatgacaatcatgacagaaacgacagatggtttcgttttagctgagtcggatttaaaaatgcgtggttctggtgaaatctttggtactcgtcagtctggaattccagaatttcaagtagctgatatcgttgaggattatcctattttagaagaagccagacgtgttgctagtgatattgtcaaagataataattggaaagaaaatacagaatgggcacttattctagataatttacgccaacattcagattttgat

SEQ ID NO: 3636 - protein, 671 aa, Streptococcus agalactiae
MLLQSPISNLKGFGPKSAEKFQKLDIYTVEDLLLYYPFRYEDFKSKSVFDLVDGEKAVITGLVVTPANVQYYGFKRNRLSFKLRQGEAVLNVSFFNQPYLADKIELGQEVAVFGKWDATKSAITGMKVLAQVEDDMQPVYRVAQGISQSTLIKAIKSAFEISAHLELKENLPATLLEKYRLMGRSQACLAMHFPKDITEYKQALRRIKFEELFYFQMNLQVLKSENKSETNGLPILYSKHAMETKISSLPFILTNAQKRSLDEILSDMSSGAHMNRLLQGDVGSGKTVIAGLSMYAAYTAGFQSALMVPTEILAEQHYISLQELFPDLSIAILTSGMKAAVKRTVLAAIANGSVDMIVGTHALIQDSVQYHKLGLVITDEQHRFGVKQRRIFREKGENPDVLMMTATPIPRTLAITAFGEMDVSIIDELPAGRKPIITRWVKHEQLGTVLEWVKGELQKDAQVYVISPLIEESEALDLKNAVALHAELSTYFEGIAKVALVHGRMKNDEKDAIMQDFKDKKSHILVSTTVIEVGVNVPNATIMIIMDADRFGLSQLHQLRGRVGRGYKQSYAVLVANPKTDSGKKRMTIMTETTDGFVLAESDLKMRGSGEIFGTRQSGIPEFQVADIVEDYPILEEARRVASDIVKDNNWKENTEWALILDNLRQHSDFD

SEQ ID NO: 3637 - DNA, 2013 bp, Streptococcus pyogenes
atgatattaacagctcctatgtccaacttaaagggatttggaccaaaatcagcagaaaaatttcagaaattagatatttatacagtagaagatttactgctttattatccgtttcgctatgaagattttaaatcaaaatctgtttttgatttagtggatggtgaaaaagcagtcattacaggcttagtcgttactccagctaatgtacaatattatggttttaaacgtaaccgtttaagtttcaaattgcgtcaaggggaagctgtcttaaatgttagtttttttaatcaaccctatttagctgataaaatagaacttggtcaagaggtagctgtttttggtaaatgggatgccactaaatcggctattactgggatgaaggttttagctcaagttgaagatgacatgcaacctgtttatcgcgtagctcagggaatttcacagtctactttgattaaagctattaagtcagcttttgaaatcgatgcgcatttggaattgaaggaaaatttaccagctactttattggaaaaataccgattgatgggtcgtagtcaggcttgtttagctatgcatttcccaaaagatatcacagagtataagcaagcgctccgtcggattaaatttgaagaattattttactttcaaatgaaccttcaagttttgaaagccgaaaataaatctgaaacaaatggtttgcctattctttatagtaaacgtgctatggagacaaagatttcctctttaccttttattctaacgaatgctcaaaagcgctctttagatgacatattatctgatatgtcatcgggagctcatatgaatcgtttattgcaaggagatgtaggatcaggaaagacagtcattgctggtctatcaatgtatgcagcttatacagcaggttttcaatcggctttgatggttccaacggaaatcctagctgaacaacactacattagtctgcaagagttatttccagatttatcaatcgctatattaacttcgggtatgaaagcagctgtcaagcgtacggttttagcagctattgcaaatggctcggttgatatgattgtaggaactcatgctcttatccaagactcggtacagtaccataaactggggcttgtcattacagacgagcaacatcgttttggtgttaaacagcgtagaattttccgtgaaaagggagaaaatcctgatgttttaatgatgacagccaccccaattccccgaactctagcaatcacagcttttggagaaatggatgtttctattattgatgaattacctgccggtcgtaaacctattatgacacgctgggtgaaacacgagcagctaggtactgtgttggaatgggtaaaaggtgaattgcaaaaagatgctcaagtgtatgtcatttcaccgttgattgaagaatcagaagctttagatttaaagaatgcagtagcattgcatgctgaattatctacttattttgaaggaattgctaaggttgctcttgtacatggacgtatgaaaaatgatgaaaaagatgctataatgcaagatttcaaggataaaaaaagtcatattttagtatccacaacagttattgaagtaggggtaaatgtcccaaatgcaacgatcatgattattatggatgccgatcgttttggattaagtcagttacatcaacttcgtgggcgtgttggtcgtggatataaacaatcatacgctgttttagtggctaatcccaaaactgattcggggaaaaaacgaatgacaatcatgacagaaacgacagatggtttcgttttagctgagtcggatttaaaaatgcgtggttctggtgaaatctttggtactcgtcagtctggaattccagaatttcaagtagctgatatcgttgaggattatcctattttagaagaagcacgcaaagtttctgcagcgattgtttctgatcctaactggatatatgaaaaacagtggcaattagtggcacaaaatattagaaaaaaagaagtttatgat

SEQ ID NO: 3638 - protein, 671 aa, Streptococcus pyogenes
MILTAPMSNLKGFGPKSAEKFQKLDIYTVEDLLLYYPFRYEDFKSKSVFDLVDGEKAVITGLVVTPANVQYYGFKRNRLSFKLRQGEAVLNVSFFNQPYLADKIELGQEVAVFGKWDATKSAITGMKVLAQVEDDMQPVYRVAQGISQSTLIKAIKSAFEIDAHLELKENLPATLLEKYRLMGRSQACLAMHFPKDITEYKQALRRIKFEELFYFQMNLQVLKAENKSETNGLPILYSKRAMETKISSLPFILTNAQKRSLDDILSDMSSGAHMNRLLQGDVGSGKTVIAGLSMYAAYTAGFQSALMVPTEILAEQHYISLQELFPDLSIAILTSGMKAAVKRTVLAAIANGSVDMIVGTHALIQDSVQYHKLGLVITDEQHRFGVKQRRIFREKGENPDVLMMTATPIPRTLAITAFGEMDVSIIDELPAGRKPIMTRWVKHEQLGTVLEWVKGELQKDAQVYVISPLIEESEALDLKNAVALHAELSTYFEGIAKVALVHGRMKNDEKDAIMQDFKDKKSHILVSTTVIEVGVNVPNATIMIIMDADRFGLSQLHQLRGRVGRGYKQSYAVLVANPKTDSGKKRMTIMTETTDGFVLAESDLKMRGSGEIFGTRQSGIPEFQVADIVEDYPILEEARKVSAAIVSDPNWIYEKQWQLVAQNIRKKEVYD

SEQ ID NO: 3639 - DNA, 918 bp, Streptococcus agalactiae
gtgcatatgttacaaaacattggacaaacaggcattcaagcaactcgaattgctttaggttgtatgagaatgagtgacttgaaaggaaaacaagctgaagaagtagttggaacagcattagatttgggtattaatttttttgatcatgctgatatttatgggggagggctatctgaattacgctttcgagatgcaatcaaacatttaaatgtcaatcgtgacaaaatgattattcaatctaaatgtgggatacgagaaggttactttgatttttctaaagagtatattttatcatcagtagatggtattttagaaagattagggacagaatatttagattttctcattcttcatcgtccagatgtattagttgagcctgaagaagtagcagaagcatttaccaaactgagggcagaaggtaaagtaaaacactttggtgttagcaatcaaaaccggtttcaaatggagttgttacaatcctaccttgacgagcccttagcagtgaatcaacttcagttatcgccagcacatacaccaatgtttgatgcagggttaaatgttaacatgttaaataaagcttcaattgaacatgatgatggcattgttgattattgtcgtcttaaaagagttaccattcaagcttggtctccatttcaaattgatttatctcgtggtttatttgttaatcatccggattataaggaattaaatgaaaccatagctaaactggcaaaaaactacaatgttagcagcgaagctattgtgattgcatggattttacgtcatcctgccaaaatgcaggcgattgttggttcaatgaatccatctcgtttaaaggcgattgataaggctaatgatatcgctttaacccgtaaagaatggtatgatatttaccgtagtgcaggtaatatattgcct

SEQ ID NO: 3640 - protein, 306 aa, Streptococcus agalactiae
MHMLQNIGQTGIQATRIALGCMRMSDLKGKQAEEVVGTALDLGINFFDHADIYGGGLSELRFRDAIKHLNVNRDKMIIQSKCGIREGYFDFSKEYILSSVDGILERLGTEYLDFLILHRPDVLVEPEEVAEAFTKLRAEGKVKHFGVSNQNRFQMELLQSYLDEPLAVNQLQLSPAHTPMFDAGLNVNMLNKASIEHDDGIVDYCRLKRVTIQAWSPFQIDLSRGLFVNHPDYKELNETIAKLAKNYNVSSEAIVIAWILRHPAKMQAIVGSMNPSRLKAIDKANDIALTRKEWYDIYRSAGNILP

SEQ ID NO: 3641 - DNA, 876 bp, Streptococcus agalactiae
atgaattcattaaatggggaaactttactaactggtctaattgccaatcctgcacgccactctctatccccgttaatgtggaatacctcttttcaagaaaaaaacatgaattatgcctatctgacatttgaagtagaagagggtaaattaacagaagctgttcgaggtgtcagggcattgggtattcgtggtgttaatgtttcaatgccatttaaacagagtgttatccctttgctagatgatttatctcctcaagctaaattagtgggtgctgtaaatactatcgttaatcaaggtggaaccggacgtttagtaggccatatgacagatggcattggttgttttaaagctttagcagctcaaggtttcagtgctaaaaataaaataattacaatagctggtattggtggttcaggtaaagcagttgcagttcaagcagctatggagggagttgcggaaattagattatttaatcgtaacagctcaaattacgataaggtcattgacttatcagataaaattaaaaaacagtttcaaataaaggtagtcgttgattatctagaaaataagacagcatttaaagacgctattagaactagtcatttttatattgatgctactagtttaggaatgaggccattagataattatagtttaattaacgatccagaaattttaacaccgaatttagtagttgtcgacttggtttacaagcctaaagaaacagcattgttacgatttgttagacaaaatggagtgaaacatgcttataatggtctagggatgctgatttatcaaggagcagaagcatttcaattaataacgaatcaagaaatgcctattagcagtgttgagagagtattacaaactgaaaat

SEQ ID NO: 3642 - protein, 292 aa, Streptococcus agalactiae
MNSLNGETLLTGLIANPARHSLSPLMWNTSFQEKNMNYAYLTFEVEEGKLTEAVRGVRALGIRGVNVSMPFKQSVIPLLDDLSPQAKLVGAVNTIVNQGGTGRLVGHMTDGIGCFKALAAQGFSAKNKIITIAGIGGSGKAVAVQAAMEGVAEIRLFNRNSSNYDKVIDLSDKIKKQFQIKVVVDYLENKTAFKDAIRTSHFYIDATSLGMRPLDNYSLINDPEILTPNLVVVDLVYKPKETALLRFVRQNGVKHAYNGLGMLIYQGAEAFQLITNQEMPISSVERVLQTEN

SEQ ID NO: 3643 - DNA, 876 bp, Streptococcus pyogenes
atgtcagaacgtttatcaggccacaccctgttggtctctttgcttgctacccctattcgtcatagtttgtctcccaaaatgcacaatgaagcctatgctaaactggggctggattatgcctaccttgcttttgaagtagggacagagcaattagcagatgccgtgcaagggattcgtgccttaggaattcgtggctccaatgtgtctatgccaaataaagaagctattttacccttattggatgacttgtccccagctgctgagttggtcggtgcagtcaatacggttgtcaataaggatggtaaaggacatctcgtggggcatattacagacggtataggagcgctcagagccttggctgacgaaggagtgtcggtaaagaacaaaatcattaccctagcaggagttggtggggctgggaaagctatcgctgtccagctcgcttttgacggcgccaaagaggttcgtttgtttaaccgacaagctacacgtctaagtagcgttcaaaagcttgtgacaaaactgaaccagctaacaaggactaaagtaacccttcaagacttggaagatcagactgcctttaaggaggccatcagggaatctcatctatttattgatgctacaagtgtaggaatgaagcctttagaaaatctaagtttgattaccgaccccgagctcattcgcccagacttggtggtctttgacatcgtgtacagcccagcagaaaccaagttactagcctttgcccgtcaacatggcgcccaaaaagtcattaatgggctaggaatggtgctttatcaaggagcagaagcttttaaattaatcactggtcaagacatgccagttgacgctattaaacctcttttaggtgatgag

SEQ ID NO: 3644 - protein, 292 aa, Streptococcus pyogenes
MSERLSGHTLLVSLLATPIRHSLSPKMHNEAYAKLGLDYAYLAFEVGTEQLADAVQGIRALGIRGSNVSMPNKEAILPLLDDLSPAAELVGAVNTVVNKDGKGHLVGHITDGIGALRALADEGVSVKNKIITLAGVGGAGKAIAVQLAFDGAKEVRLFNRQATRLSSVQKLVTKLNQLTRTKVTLQDLEDQTAFKEAIRESHLFIDATSVGMKPLENLSLITDPELIRPDLVVFDIVYSPAETKLLAFARQHGAQKVINGLGMVLYQGAEAFKLITGQDMPVDAIKPLLGDE

SEQ ID NO: 3645 - DNA, 282 bp, Streptococcus agalactiae
atgataccactatcacccatgccagcatatgctttcacgataggaacagttcctgtaattttatctaaatcaaaacgaactctctcttcagttgctttaaagaaaagcaggtcttgtttcataataatcccaagggggccatgtgtaggggtttggaatgtcgaaacgtttgttgtatgtgtttttgtgacatatttagcagcatgtatctcatcattcatgacaactagcacccccttgtcggcagctttagtactattagcgacacggagggctgatagg

SEQ ID NO: 3646 - protein, 94 aa, Streptococcus agalactiae
MIPLSPMPAYAFTIGTVPVILSKSKRTLSSVALKKSRSCFIIIPRGPCVGVWNVETFVVCVFVTYLAACISSFMTTSTPLSAALVLLATRRADR

SEQ ID NO: 3647 - DNA, 960 bp, Streptococcus agalactiae
atgaaaaaaatccttgttctacacacaggtggaacgatttccatgaatgctaacgagaagggacaggtcatgtccagcgccgataacccaatgaaatacgttgatttatcattagatgaccttgatttgactgttgtagattttctaaatcttcccagtcctcaaatcacccctcatcatatgcttgatatctatcactatctgaagcaacatgccagtaattttgatggtgttgtcattacgcatgggactgacactttagaagaaacagcatattttttagacacaatgatactccctaaaatcccaatcatcattaccggtgctatgagaagcacaaatgaacttggtagcgatggcgtttataattacctatcagccctccgtgtcgctaatagtactaaagctgccgacaagggggtgctagttgtcatgaatgatgagatacatgctgctaaatatgtcacaaaaacacatacaacaaacgtttcgacattccaaacccctacacatggcccccttgggattattatgaaacaagacctgcttttctttaaagcaactgaagagagagttcgttttgatttagataaaattacaggaactgttcctatcgtgaaagcatatgctggcatgggtgatagtggtatcattagctttttaaattctcaaaatattagcggattagttattgaagcactcggtgcagggaatatgcccccaaaagctgcacaagaaatcgaagaattaattgagcaaggtgtccctgttgttctagtgtctcgctgttttaatggtattgctgagccagtttacggatatgaaggtggcggagcaaaattacaagaatctggtgtcatgtttgttaaagaactaaacgctcccaaagccagactcaaattactcattgcactcaatgcaggtctcacagggcaaaatctaaaagactatattgaaggt

SEQ ID NO: 3648 - protein, 320 aa, Streptococcus agalactiae
MKKILVLHTGGTISMNANEKGQVMSSADNPMKYVDLSLDDLDLTVVDFLNLPSPQITPHHMLDIYHYLKQHASNFDGVVITHGTDTLEETAYFLDTMILPKIPIIITGAMRSTNELGSDGVYNYLSALRVANSTKAADKGVLVVMNDEIHAAKYVTKTHTTNVSTFQTPTHGPLGIIMKQDLLFFKATEERVRFDLDKITGTVPIVKAYAGMGDSGIISFLNSQNISGLVIEALGAGNMPPKAAQEIEELIEQGVPVVLVSRCFNGIAEPVYGYEGGGAKLQESGVMFVKELNAPKARLKLLIALNAGLTGQNLKDYIEG

SEQ ID NO: 3649 - DNA, 963 bp, Streptococcus pyogenes
atgaaaaaaatcctagtcttacacactggtggaaccatttctatgcaagctgataactctggtagggttgttccaaatcaagataatcctatgacgaaaatacatgctgcagcccaagatattcagcttaccgttagtgattttctaaatcttccgagtcctcacatcacgcctcaccacatgttatctatttatcatcatattcaagaaagaactgatgtctttgatggtatagtcatcacacatggaacagataccttagaagaaacagcttattttttagataccatggcattgcctactaatatacctgttgtcctaacaggtgctatgaggtcttctaatgaagttggtagtgatggcatatataattaccttaccgcacttagagttgcaagtagtgataaagctaaagaaaaaggggtacttgttgttatgaacgatgaaatccatgctgctaaatatgttactaaaacacatacaaccaatatttcaactttccaaacacccacacacggaccgcttggtatcatcatgaaaaatgacctactttttttcaaaactgctgaacctcgtattcgttttgacttgagatgcatttctggaaccatccccattatcaaagcatacgcaggtatgggcgatggtagtatcttgagtctattaactccaggtagcattcaaggtctagttatcgaagctctaggggcaggaaatgtcccaccattagcagttggggagatcgagcacttaattgctttaggtattcctgtcattcttgtttcccgttgtttcaatggtatggcagaacctgtctatgcttatgaaggtggtggtgcgatgctacaagaagcaggtgttatgtttgtaaaagaattgaatgctccaaaagcccgtctaaagttattaattgctctcaacgccggacttactggtcaagagctaaaagattatattgaagga

SEQ ID NO: 3650 - protein, 321 aa, Streptococcus pyogenes
MKKILVLHTGGTISMQADNSGRVVPNQDNPMTKIHAAAQDIQLTVSDFLNLPSPHITPHHMLSIYHHIQERTDVFDGIVITHGTDTLEETAYFLDTMALPTNIPVVLTGAMRSSNEVGSDGIYNYLTALRVASSDKAKEKGVLVVMNDEIHAAKYVTKTHTTNISTFQTPTHGPLGIIMKNDLLFFKTAEPRIRFDLRCISGTIPIIKAYAGMGDGSILSLLTPGSIQGLVIEALGAGNVPPLAVGEIEHLIALGIPVILVSRCFNGMAEPVYAYEGGGAMLQEAGVMFVKELNAPKARLKLLIALNAGLTGQELKDYIEG

SEQ ID NO: 3651 - DNA, 1380 bp, Streptococcus agalactiae
gtggcaattaaggcagtattttttgatattgatggtacacttcttaatgatcgtaagaatgtacaaaagtcaacaattaaagcaattcgaaatttgaaagaccaaggaatactagtcggtttagcaacggggcgaggtcctagttttgtacaaccttttttagaaaaccttggtttagattttgctgtaacctataatggtcaatatatctatagtagaagtgaaattatttataccaatcaattatctaagacaactgtctatcgtctgattcgttatgctggagcaagaagaagagaaatttcattaggaacagcctcaggattactcggttcaggtattattggtctaggaactagccgtttggggcagattgtatctagccttgttccgagaaaatgggcaaaagcgattgaacgaagctttaagcattttattcgtcggattaaacctcaaaatattgatagcctcatggttatcttacgagaacctatttatcaggtcgttttagttgcaacagagggcgaatcagagcgaattcaaaaacaatttcctcgtgttaaattaacaagaagcagtccttactcaatggatgtcatttctgaagggcagtcaaaagttaagggaattgaacgtgttggtcaacgctatggttttgatctatccgaagtgatagcatttggagattctgataatgatattgagatgttatctcaagttggcattggtgttgccatggggaacgctagtcagcaagtgagagaaaatgcacgttatacaactgctgacaataatgatgatggtatctctaaggcattagcccattatggacttatccaatttgagattgaaaaaacattcagtagtcgtgacgagaatttcaataaagtaaaatccttccatctattaatggatggtgaaactattgaaacgccacgcttatatgacagtaaggaagctggtttcaggtcagactttaaagtagaagaaatcgttgagttcttgtatgctgctagtcaaggtaaccaaaaagtatttgaccaatctatccgtaatttacacttagctattgataaagcaagagataaggttatttctaaagaccatccagaaacaccattagtgggagaagtggatgccttaacagatttactttatctgacttatggctcctttgttcttatgggagtcgacccaaaacctctttttgatacagtacatgaggccaatatggggaaaatctttccagatggcaaagctcattttgatcctgttactcataaaattttaaaaccagacgactgggaagaacatttcgctcctgagccatcaattcgacgtgaattagatagccaaattcagaaatccttaaatcgaaaa

SEQ ID NO: 3652 - protein, 460 aa, Streptococcus agalactiae
MAIKAVFFDIDGTLLNDRKNVQKSTIKAIRNLKDQGILVGLATGRGPSFVQPFLENLGLDFAVTYNGQYIYSRSEIIYTNQLSKTTVYRLIRYAGARRREISLGTASGLLGSGIIGLGTSRLGQIVSSLVPRKWAKAIERSFKHFIRRIKPQNIDSLMVILREPIYQVVLVATEGESERIQKQFPRVKLTRSSPYSMDVISEGQSKVKGIERVGQRYGFDLSEVIAFGDSDNDIEMLSQVGIGVAMGNASQQVRENARYTTADNNDDGISKALAHYGLIQFEIEKTFSSRDENFNKVKSFHLLMDGETIETPRLYDSKEAGFRSDFKVEEIVEFLYAASQGNQKVFDQSIRNLHLAIDKARDKVISKDHPETPLVGEVDALTDLLYLTYGSFVLMGVDPKPLFDTVHEANMGKIFPDGKAHFDPVTHKILKPDDWEEHFAPEPSIRRELDSQIQKSLNRK

SEQ ID NO: 3653 - DNA, 1386 bp, Streptococcus pyogenes
ttgacagtaaaagcagtcttttttgatattgatgggacccttctcaatgatcgtaaaaatatccaaaaaacaacgcaaaaagccatccaacaactcaaaaaacaaggcattatggtcggtttagcaactggtcgtggaccgggatttgtacaaccttttctagaaaattttggattagattttgccgttacttacaatgggcaatatatcttaacaagagataaggtcttatatcagaatcaattgccaaagtcgatgatttacaaagtgattcgctatgccaacgaaaaaaagcgagaaatttctcttggaacagcttctggattagcaggatcgcgtattattgatatggggactagcccatttggacaagtcattagtagttttgtgcccaaaagttgggcaagaacagttgagggtagttttaagcatttgattcgccgaatcaagcctcagagttttagaaatttagtaactattatgcgggagcctatttatcaggttgttctggtagcgtcacaagctgaaactaagaaaatacaagagaagttccctcatataaaaattacaagaagtagtccttattccttggatctgatctctgttgatcaatcaaaaataaaaggaattgaacgtttgggagagatgtttggatttgacttgtctgaagtgatggcttttggagattcagataatgaccttgaaatgttatcaggagttggtatcggtattgctatgggaaatgctgaaactgtggtaaaagatggagcccatttcactaccgactctaataataatgatgggatttccaaagccttagctcactacggtctcatccattttgatatagagaagagctttaaaagccgtgatgaaaattttaataaagtcaaagattttcatcgtctgatggactcagatactattgaaacaccgcgtagttataccatttcagaagctggttataggtcaggctttaaagtagaagaaattgttgagtttctttacgcagcaagcaagggagaccaacaacaatttacacaggctattttcgatttgcatggtgctgttgaccaagcagctaataaggtacaagctaaaaaacatgttgaaacgcccctgattgggcaagttgatgccttagcggatttgctttattttacttatggttcttttgtactgatgggagtagatccacaacctatatttgaagcagtacatgaagcaaatatggctaaaatttttccagatggcaaggcacactttgaccccgttacccataaaattcaaaaacctgactattggcaagagcgtcacgcacctgaagtagccataaaaaaagagttagacaaacaattacaaaaatcactacaacgattcgataaa

SEQ ID NO: 3654 - protein, 462 aa, Streptococcus pyogenes
LTVKAVFFDIDGTLLNDRKNIQKTTQKAIQQLKKQGIMVGLATGRGPGFVQPFLENFGLDFAVTYNGQYILTRDKVLYQNQLPKSMIYKVIRYANEKKREISLGTASGLAGSRIIDMGTSPFGQVISSFVPKSWARTVEGSFKHLIRRIKPQSFRNLVTIMREPIYQVVLVASQAETKKIQEKFPHIKITRSSPYSLDLISVDQSKIKGIERLGEMFGFDLSEVMAFGDSDNDLEMLSGVGIGIAMGNAETVVKDGAHFTTDSNNNDGISKALAHYGLIHFDIEKSFKSRDENFNKVKDFHRLMDSDTIETPRSYTISEAGYRSGFKVEEIVEFLYAASKGDQQQFTQAIFDLHGAVDQAANKVQAKKHVETPLIGQVDALADLLYFTYGSFVLMGVDPQPIFEAVHEANMAKIFPDGKAHFDPVTHKIQKPDYWQERHAPEVAIKKELDKQLQKSLQRFDK

SEQ ID NO: 3655 - DNA, 501 bp, Streptococcus agalactiae
ttgagtgcaagaggttatctcttttggttatatttagaggaggacaggcttatgtcacaaaaatatgaacgcatccttgtcgctattgatggatcaacagaatctgaacttgcttttgaaaaggcagttaacgttgctcttcgcaatgattctgaattaatcttgacacatgttatagatacacgtgctttacaaagctttgcgacatttgatacttatatctatgaaaaattagaaaaagaagcaaaagatgtccttgaggaatatgaaaaacaagctcgtgaaaaaggagcagataaagttagacaagtcattgaatttggtaatcccaaaacattacttgcacatgatattccagaaaaagaaaaagtagacttgattatggttggtgcaacaggtcttaatacctttgaacgtttccytatcggatcttcctcagaatacatccttcgtcacgctaaagtagatttactcattgtacgtgaccctaataaaacaatg

SEQ ID NO: 3656 - protein, 167 aa, Streptococcus agalactiae
  misc_feature (1)..(167): Xaa = Any Amino Acid
MSARGYLFWLYLEEDRLMSQKYERILVAIDGSTESELAFEKAVNVALRNDSELILTHVIDTRALQSFATFDTYIYEKLEKEAKDVLEEYEKQAREKGADKVRQVIEFGNPKTLLAHDIPEKEKVDLIMVGATGLNTFERFXIGSSSEYILRHAKVDLLIVRDPNKTM

SEQ ID NO: 3657 - DNA, 540 bp, Streptococcus pyogenes
atggatcgctttcaaaatgactcaaaaaagagtataatgaaaaaaagaataaaagctattcttgtcaaactgttaaaggaggacagttctatgtcactaaaatataaacgtatcctcgttgctattgatggctcttatgagtctgaattagctttcaataaaggcgttaacgtagcactacgtaacgacgctaccttactactagtacacgttattgatacccgtgccttgcaaagcgtagctacttttgatacttacatctatgaaaaattagaacaagaagctaaggatgttttagatgattttgaaaaacaagcacagatagcaggaattacaaacatcaaacaaattattgaatttggcaaccccaaaaacttactagctcacgatattccagatcgtgagaacgctgatttaattatggtaggagctactggtcttaatacctttgaacgcctccttattggctcatcttctgagtacattatgcgacacgctaagattgacttacttgtagtccgagatagcactaaaacactc

SEQ ID NO: 3658 - protein, 180 aa, Streptococcus pyogenes
MDRFQNDSKKSIMKKRIKAILVKLLKEDSSMSLKYKRILVAIDGSYESELAFNKGVNVALRNDATLLLVHVIDTRALQSVATFDTYIYEKLEQEAKDVLDDFEKQAQIAGITNIKQIIEFGNPKNLLAHDIPDRENADLIMVGATGLNTFERLLIGSSSEYIMRHAKIDLLVVRDSTKTL

SEQ ID NO: 3659 - DNA, 654 bp, Streptococcus agalactiae
atgaagatatttgataaatcaatgaagctggaacatgtagcttatgatattagaggccctgttttagaagaggcggaccgcatgagggcaaatggtgaaaagatattgcggttaaatactggaaatccagctgcctttggcttcgaagcgccagatgaagtcattcgtgatttaattacgaatgcgcgtgaatcagaaggttactctgattcgaaaggtattttttcagctcgtaaggctgttatgcagtattaccagttacaaaacatccatgttgacatggatgatatatacattgttaatggtgttagtgagggaatctctatgtcaatgcaagctttgcttgataatgatgacgaggttctagttccaatgccagattacccgttatggacagcttgtgttagccttgctggtggaaatgctgtgcattatatttgtgatgaggaagctaattggtatcctgatattgatgatatcaaatcaaaaatcacatccaaaacaaaagcaattgtcctcattaatccaaataatccaactggagcagtctatccgcgtgaaattctgcaagagattgtggatatcgctagacaaaatgacttgattattttttcagacgaggtttatgaccgtttctctagagtacgagaagat

SEQ ID NO: 3660 - protein, 218 aa, Streptococcus agalactiae
MKIFDKSMKLEHVAYDIRGPVLEEADRMRANGEKILRLNTGNPAAFGFEAPDEVIRDLITNARESEGYSDSKGIFSARKAVMQYYQLQNIHVDMDDIYIVNGVSEGISMSMQALLDNDDEVLVPMPDYPLWTACVSLAGGNAVHYICDEEANWYPDIDDIKSKITSKTKAIVLINPNNPTGAVYPREILQEIVDIARQNDLIIFSDEVYDRFSRVRED

SEQ ID NO: 3661 - DNA, 1248 bp, Streptococcus pyogenes
ttggtttataatatggaatacgaggtgtatgagactatgaaaattattgaaaaatcatcaaaattagaacatgttgcctatgatattcgagggcctgttttggatgaagctaatcgcatgattgcgagtggtgaaaaaattctgcgtttaaatactggcaatcctgctgcttttggttttgaagcaccagatgaagtgattcgtgatttaattgtcaacgcgaggctaagtgagggctattctgacagtaaagggattttttcagcgcgtaaggctatcatgcagtattgccaactcaagggcttcccagatgttgacattgaagatatttatttgggaaatggcgtgtcagagttgatatccatatcccttcaagctttgctagataatggcgatgaagttttagtaccaatgccggattatcctttatggacggcttgtgtgagtcttggtggaggaaaagcggtccattatctttgtgatgaagaagctggttggtatcctgatattgctgatatcaaatcaaaaatcacgagtcgcaccaaagctattgtggtcatcaatcctaataacccaacaggagccctttatcctaaggagattttagaagacatcgttgctttggcaagagaacaccagctgattatttttgccgatgaaatctatgatcgtttggtgatggatggtaaagagcatattgctattgcaagtttggcacctgatgttttttgtgtatctatgaatggtctttccaaatctcatcgtattgctggttttcgtgttggatggatggtcttatcaggtcctaaagaccatgttaaaggttacattgaagggttaaacatgcttgccaatatgcggttatgctccaatgttttagcccaacaagttgttcaaacttccttaggaggtcatcaatcagttgatgcactgttactgccaggagggcgtatttttgagcaacgtaattttatttatgaagctattaatgctatccctggcttatcggcagttaaacctgaagcaggtctttatttatttccgaaaattgatcgtcagatgtatcgtattgatgatgatgaagaatttgtcttacagttattaaagcaagaaaaagtgatgttggtacatggacgtggttttaactggaaagatccagatcacttccgtattgtttacctaccaagtgtagaagaattagaagatgtccaagaaaagattacacgtgtcttataccagtatagacgt

SEQ ID NO: 3662 - protein, 416 aa, Streptococcus pyogenes
LVYNMEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 3663 - DNA, 267 bp, Streptococcus agalactiae
  misc_feature (1)..(267): n = a, c, g, or t
atggcgaaaaaaccatgggaaaaaaaagttgtggaaaacaatagtcatagaaaagacaaaattacaagaacgagtagaggtgtggtgtcaagtactccttggattaccgctttcttgagtgcattctttgttattgtcgttgctattttatttatagtattttatacttcaaatagaggagaagacagagcaaaagaaacttctggtttttatggtgcttcaagccaaaaagttaatagttctaaaacgaaaaaagcatctnnnnnt

SEQ ID NO: 3664 - protein, 89 aa, Streptococcus agalactiae
  misc_feature (1)..(89): Xaa = Any Amino Acid
MAKKPWEKKVVENNSHRKDKITRTSRGVVSSTPWITAFLSAFFVIVVAILFIVFYTSNRGEDRAKETSGFYGASSQKVNSSKTKKASXX

SEQ ID NO: 3665 - DNA, 474 bp, Streptococcus pyogenes
atggctaaagaaccatgggaagaaaaaattgttgatgatactatagggacacgaacacgtaaatcaagaaatgctttcattagcacgccttggttgactgctttattaagtgtattctttgtcatcattgttgctatactttttattttcttctatacatcaaatagcggtagtaatagacaagctgaaacaaatggtttttatggagcatccactcataaaaaaacaaggaaagcttctaacgctaaaaaaacatcaagtagttcaacaactacagacacaacaccttctagcgaagaaacacttgcttctagtgaaggaactggcgaaacccttactgtattggcaggtgagggggcagcttctattgcagctcgtgcaggtatttctgtggagcagttacaagcacttaatccagagcacatgactcaaggatattggtatgccaatccaggagatcaagtcactattaaa

SEQ ID NO: 3666 - protein, 158 aa, Streptococcus pyogenes
MAKEPWEEKIVDDTIGTRTRKSRNAFISTPWLTALLSVFFVIIVAILFIFFYTSNSGSNRQAETNGFYGASTHKKTRKASNAKKTSSSSTTTDTTPSSEETLASSEGTGETLTVLAGEGAASIAARAGISVEQLQALNPEHMTQGYWYANPGDQVTIK

SEQ ID NO: 3667 - DNA, 195 bp, Streptococcus agalactiae
atgaaagttgcactaattccagaaaaatgtattgcctgcgggctttgccaaacatattcaaatatttttgattatcaagatgatggtatcgttaaattttccgatacagataacctagaaaaagaaattccaagttctgatcaagatactgttttagcagttaaatcatgtcccaccaaagctcttacgattttg

SEQ ID NO: 3668 - protein, 65 aa, Streptococcus agalactiae
MKVALIPEKCIACGLCQTYSNIFDYQDDGIVKFSDTDNLEKEIPSSDQDTVLAVKSCPTKALTIL

SEQ ID NO: 3669 - DNA, 195 bp, Streptococcus pyogenes
atgaaagtatctatcattccagaaaaatgcatcgcttgtggtctatgccaaacctattcatcactttttgattatcatgacaatggtatcgtcacattttcaagctcatctgaaacaagtcagtcaatttgtccttcagataaggacgctattttagctgtcaaatcttgcccaactaaagctcttaccctcgag

SEQ ID NO: 3670 - protein, 65 aa, Streptococcus pyogenes
MKVSIIPEKCIACGLCQTYSSLFDYHDNGIVTFSSSSETSQSICPSDKDAILAVKSCPTKALTLE

SEQ ID NO: 3671 - DNA, 489 bp, Streptococcus agalactiae
atgataaaattatttgggaagatacgttatcactggcaacctgaactttcttgggctattatttattggtcaatagccattgcaccaatttttattggtttatctctgctatatgaaagaactgagattccgagtcaggtatttgttctatttgccatctttattgttttagtgggcattggatttcatcgctattttgttattgaagaagacggatatcttaggattgtatcttttaactttttaagacgaactaagtttccaattgaagatattgctaaaattgaggtcactaaatcaagtgttactatcaaatttaataataaccatgagcgtattttttacatgcgaaaatggcctaaaaaatattttttagatgcactagctattgaacctacatttaagggagaagtggagcttctcgataatttgattaaaatggattattttgaatgttatcgctacgataaaaaagctcttacaaaatcg

SEQ ID NO: 3672 - protein, 163 aa, Streptococcus agalactiae
MIKLFGKIRYHWQPELSWAIIYWSIAIAPIFIGLSLLYERTEIPSQVFVLFAIFIVLVGIGFHRYFVIEEDGYLRIVSFNFLRRTKFPIEDIAKIEVTKSSVTIKFNNNHERIFYMRKWPKKYFLDALAIEPTFKGEVELLDNLIKMDYFECYRYDKKALTKS

SEQ ID NO: 3673 - DNA, 486 bp, Streptococcus pyogenes
atgattaaactatttggtaaaataaggtatcactggcagccagagttgtcttggtctattatttattggtctattgcgtttgcacctatttttgtaggtttatctttgttgtatgagcgcactgaaatacctagtcgggtttttattctatttgctatttttgctgtcctagttggcattggattacatcgttatttcattattgaaaataatggtattttaagaatcgtatcttttaaattgtttggtccacgtaagctacttatttccactattactaagattgaggtgaccaaatcaacactttgtctgcacgttgaagataaaagttatctcttttatatgcgcaaatggcctaaaaaatattttcttgatgccttagcggttaatccatacttccaaggagaagttatattaagtgataactttattaaattagactattttgaagtttatcagcatgataaaaaagcccttactcgaggg

SEQ ID NO: 3674 - protein, 162 aa, Streptococcus pyogenes
MIKLFGKIRYHWQPELSWSIIYWSIAFAPIFVGLSLLYERTEIPSRVFILFAIFAVLVGIGLHRYFIIENNGILRIVSFKLFGPRKLLISTITKIEVTKSTLCLHVEDKSYLFYMRKWPKKYFLDALAVNPYFQGEVILSDNFIKLDYFEVYQHDKKALTRG

SEQ ID NO: 3675 - DNA, 1218 bp, Streptococcus agalactiae
atgtcttacgaaaagcttttagaacgatttttaacatacgtcaaaataaatacaagaagtaatcctaatagtacacaaacgccaacaactcaaagtcaagttgactttgctttaacagttttaaaaccagaaatggaagcaattggtttaaaagatgttcattatttaccttctaatgggtatttggttggaaccttacctgctacaagcgaccgcttacgccataaaataggttttatatcccatatggatacagctgatttcaatgctgaaaatattactccacaaattgttgactataaaggtggagatattgaacttggagactcaggttacattttaagtccaaaagattttccaaatttaaataattaccatgggcaaacactgattacaacagatggtaaaaccttactgggagcagacgataagtctggtatagcagaaatcatgacagctatggaatatttggcttcgcatccagaaattgagcattgtgaaattagagttggctttggaccagacgaagaaattggtataggtgcagataaatttgatgttaaagattttgatgttgattttgcctatacagtggatggtggaccactaggagaattacagtatgaaacctttagtgcagctggtttggagcttacatttgaaggacgaaacgttcaccctggaactgcaaaaaatcaaatgattaatgctttacagcttgctatggattttcatagtcaattaccagaaaatgaacgtcctgaacaaacagatggctatcaaggattttatcacttatatgatttaagtggaacagttgatcaagctaaaagttcatatatcattcgagattttgaggaagttgatttcttaaagcgtaagcacttggctcaagatatcgctgataatatgaatgaagcattacaatctgaacgtgtaaaggttaaactatacgatcaatattacaacatgaagaaagttattgaaaaagacatgacacctatcaacattgctaaagaagtaatggaagagttagacatcaagccaatcatagaaccgattcgtggtggtacagatggctctaaaatttcctttatgggaatccctactcctaatctttttgcaggtggtgaaaacatgcatggacgctttgaattcgttagtctacaaacaatggaaaaagcagttgatgttattttaggcatcgttgctaaggat

SEQ ID NO: 3676 - protein, 406 aa, Streptococcus agalactiae
MSYEKLLERFLTYVKINTRSNPNSTQTPTTQSQVDFALTVLKPEMEAIGLKDVHYLPSNGYLVGTLPATSDRLRHKIGFISHMDTADFNAENITPQIVDYKGGDIELGDSGYILSPKDFPNLNNYHGQTLITTDGKTLLGADDKSGIAEIMTAMEYLASHPEIEHCEIRVGFGPDEEIGIGADKFDVKDFDVDFAYTVDGGPLGELQYETFSAAGLELTFEGRNVHPGTAKNQMINALQLAMDFHSQLPENERPEQTDGYQGFYHLYDLSGTVDQAKSSYIIRDFEEVDFLKRKHLAQDIADNMNEALQSERVKVKLYDQYYNMKKVIEKDMTPINIAKEVMEELDIKPIIEPIRGGTDGSKISFMGIPTPNLFAGGENMHGRFEFVSLQTMEKAVDVILGIVAKD

SEQ ID NO: 3677 - DNA, 1233 bp, Streptococcus pyogenes
ttgaggtggcctatgaagtacgataacttgttagatcgatttataaaatatgtcaaagtgaatacaagaagcgttccagacagtgagactactcctagtacggagagtcaagaagcatttgccttaacgattttaaagcctgaaatggaggcaattggtttgcaagatgttcattataatccagttaatggctatcttattggaactctgcctgccaataatccaaccttgacgcgtaaaattggttttatagcccatatggatacggctgatttcaatgctgaaaatgttaatccgcagattattgacaattatcaaggaggggacattacacttggcagttctaattataagttggatccaaaagcatttccaaatcttaataattatatcggtcaaacattgattaccactgatgggactacacttttaggggcagatgataaatctggtattgctgaaatcatgacagcaatagaattcttgacatcacaaccacaaatagagcactgtgacattaaagtggcttttggccctgatgaagagattggggtcggagctgataagtttgaggtggctgattttgaggtggattttgcttatactatggatggcggtcctttaggcgaattgcaatatgaaactttcagcgctgcagctctagaagtgacttttttaggcagaaatgttcatcctggtacggctaaggatcaaatgattaatgcccttgagttagcaatagattttcatgagaagctacctgctaaagatcggcctgaatacacagatggttatcaaggtttctatcacttaacgggactaactggaacagttgaagaggcacgcgcatcttacattattcgtgattttgaagaagcatcatttgaagctagaaaagtgaaagttgaaaatatagctcaatcgatgaatgctcagctaggaacaaaacgtgtcttggtagagcttaatgaccaatactacaatatgaaaaaagttatcgaaaaagatatgaccgctattgagttagctaaagaagtaatggaagagcttgctatcaagcctgtaatcgaacccatacgtggaggaacagatggctctaaaatttcatttatgggtattcccactcctaatatttttgcagggggtgagaatatgcacgggcgttttgagtttgttagcttacaaacgatggagagagctgtcgatgtcattattggacttgtttgcaaagcc

SEQ ID NO: 3678 - protein, 411 aa, Streptococcus pyogenes
LRWPMKYDNLLDRFIKYVKVNTRSVPDSETTPSTESQEAFALTILKPEMEAIGLQDVHYNPVNGYLIGTLPANNPTLTRKIGFIAHMDTADFNAENVNPQIIDNYQGGDITLGSSNYKLDPKAFPNLNNYIGQTLITTDGTTLLGADDKSGIAEIMTAIEFLTSQPQIEHCDIKVAFGPDEEIGVGADKFEVADFEVDFAYTMDGGPLGELQYETFSAAALEVTFLGRNVHPGTAKDQMINALELAIDFHEKLPAKDRPEYTDGYQGFYHLTGLTGTVEEARASYIIRDFEEASFEARKVKVENIAQSMNAQLGTKRVLVELNDQYYNMKKVIEKDMTAIELAKEVMEELAIKPVIEPIRGGTDGSKISFMGIPTPNIFAGGENMHGRFEFVSLQTMERAVDVIIGLVCKA

SEQ ID NO: 3679 - DNA, 1665 bp, Streptococcus agalactiae
atgctaaataatattgaaaatagaaagtttaccatgtcacaaaaaacaacaaaagttagtcagcaagaacaaatggtcaaagggacggcttggttaacagcagggaatttcattagtcgcttgctgggagccatctatattatcccttggtatgcttggatgggaaagcatgctgccgaagcaaatgctttatttgggatgggatatgaaatctatgctttatttcttttgatatcaactgttggaattccagtagcagttgcaaaacaggtatctaagtataacactttaggtaaagaagagatgagcatttatctggttcggaaaatcttgcagtttatgctgattttaggtggaatttttgcattaattatgtatattggttcacctctatttgcttcacttagtaaaggagggcaagaactcgttccaatattgcgtagtctaactctagctgttttagtttttccttcaatgagtgttttacgtggtttttttcaaggttttaataatttaaaaccgtatgccattagtcaagtcgctgagcagattatacgtgtcatatggatgttattaactgctttctatattatgcgtctaggatcaggagattatattgccgctgtgacacagtcaacattcgccgcctttgtcggtatgtttgctagtatagctgtgctgctttatttcttatggcgttataatatgctatctgccttgattggtaaaactccaaagcacattaaattagatactaaagaaatcctaattgagactattaaggaagcaatcccttttattattactggtgcagcaattcaaattttcaaactgattgatcagttttcatttgggaatacgatggcgctctttacgaattattcaagtgaagaattacgggttatgtttgcttacttttcaagcaaccctggtaaagttacgatgattctaattgctgttgctaccgcaattgctggagttggtattccattgttaacagagaattttgttaagaatgataaaaaagccgccgctcgtttggttgttaataatctacaaatgttactaatgtttttactgccagctgttgcaggatccgttattttagcaaaacctttgtatacagtcttttatgggttaccgcagggacaagctttaggactttttgtcatatctcttattcaaacaattattttatctatttatactgttttagcaccaatgctacaagcattgtttgaaaatcgtaaagctattatttacttcctatatggtctggtggcaaaagttattttacaacttccctccattttccttttccatgcctatggaccacttttctcaacgacagtagctctttgtatcccagtaattcttatgtatttgaaaatacatgaaattacaggatttaaacgccaagctattcgtcgtacaagtgctttagtccttattctaacgctattgatgagctttattatttctatgataatatggttaatgaatctggttattgtacccgatagtagactggtaagtctagtttacattatcgttatcggtgcaataggtttaggggtatatggctttatggcactggccacccatctacttgataaaatgattggtagtcgtgctcaagacttacgccgaaagttgcaccttaac

SEQ ID NO: 3680 - protein, 555 aa, Streptococcus agalactiae
MLNNIENRKFTMSQKTTKVSQQEQMVKGTAWLTAGNFISRLLGAIYIIPWYAWMGKHAAEANALFGMGYEIYALFLLISTVGIPVAVAKQVSKYNTLGKEEMSIYLVRKILQFMLILGGIFALIMYIGSPLFASLSKGGQELVPILRSLTLAVLVFPSMSVLRGFFQGFNNLKPYAISQVAEQIIRVIWMLLTAFYIMRLGSGDYIAAVTQSTFAAFVGMFASIAVLLYFLWRYNMLSALIGKTPKHIKLDTKEILIETIKEAIPFIITGAAIQIFKLIDQFSFGNTMALFTNYSSEELRVMFAYFSSNPGKVTMILIAVATAIAGVGIPLLTENFVKNDKKAAARLVVNNLQMLLMFLLPAVAGSVILAKPLYTVFYGLPQGQALGLFVISLIQTIILSIYTVLAPMLQALFENRKAIIYFLYGLVAKVILQLPSIFLFHAYGPLFSTTVALCIPVILMYLKIHEITGFKRQAIRRTSALVLILTLLMSFIISMIIWLMNLVIVPDSRLVSLVYIIVIGAIGLGVYGFMALATHLLDKMIGSRAQDLRRKLHLN

SEQ ID NO: 3681 - DNA, 1632 bp, Streptococcus pyogenes
atgtcgacagaaaaaaaacaactgacacaagaagaattgatggttcagggagcagcctggtccacagctggtaatttcattagccgacttttgggagtgttatacattattccctggtacatttggatggggcaatacgcgattcaagccaacgctcttttcaatatggggtataatgtttatgcttattttttattgatttcaaccacaggactcaatgttgcgattgctaagcaggttgccaagtacaattccatgggacaaactgagcatagctatcaattaatccgaagtaccctaaaactcatgcttggtctgggccttattttttcagccattatgtatctgggctctcctttatttgcgagcttatctggtggtgatgacacacttgttcccattatgcacagcctttctttagcagtttttatttttcctgtaatgagtgtgattcgaggcatctttcaaggccacaataatatcaagccttatgcagttagtcagattgctgagcaactcattcgggttatctggatgcttttgaccaccttttttatcatgaagttgggttctggtgattacgcttcagcagtgactcagtcaacttttgcagcctttatcgggatggtggctagtatgggtgttctggggtactatctttggaaacagggacttctagcagctatttttagtaagccagatcatactgtttctattgatatcaagggcttgttgcttgaaaccttaaaagaatccatcccctttatcgtaacaggaagtgccattcaagcctttcaattgattgatcaatggacttttgtcaatacgatgactctttttacagattatagccgttctcaattgcttgttttatttggttactttaacgcaaacccagccaaaattacaatggtcttaattgcagtagcagcatctattggtggtgtaggtattgccttgttaactgaaaattatgtcaaaaaagacatgaaagcagctgctcgtttaatcattaacaacattgaaatgttagtgatgtttttgttacctgctcttactggggcaattattttagcaagacctctatattctgttttttacggagctagcgaggagcgtgccattcacctctttgtggcggttctctttcaaaccttgctactggcgctttacaccctcttttcaccgatgcttcaagctctttttgaaaatcgaaaagcgatttactactttgcctatggtatcttgattaagttagttttacagataccgcttatttatttgctacatgcttatggtcctttactagcgacgacgattgctttagtggtgccgatttatttgatgtatcgacgcctatatcaggttactcattttaaccgcaaactgttgcaaaaacgtttattattaaccttaattgaaaccttattaatgggactggtcgtgtttgtggccaactggctattgggctatgcctttaaaccgacaggccgcttgaccagccttctttacctcctcattattggtggcttgggaatgacggtttacacggcactcaccttgctgacgcatcaactggataaattaattggtagcaaagctagtcgccttcgtcagaaattaggctggcat

SEQ ID NO: 3682 - protein, 544 aa, Streptococcus pyogenes
MSTEKKQLTQEELMVQGAAWSTAGNFISRLLGVLYIIPWYIWMGQYAIQANALFNMGYNVYAYFLLISTTGLNVAIAKQVAKYNSMGQTEHSYQLIRSTLKLMLGLGLIFSAIMYLGSPLFASLSGGDDTLVPIMHSLSLAVFIFPVMSVIRGIFQGHNNIKPYAVSQIAEQLIRVIWMLLTTFFIMKLGSGDYASAVTQSTFAAFIGMVASMGVLGYYLWKQGLLAAIFSKPDHTVSIDIKGLLLETLKESIPFIVTGSAIQAFQLIDQWTFVNTMTLFTDYSRSQLLVLFGYFNANPAKITMVLIAVAASIGGVGIALLTENYVKKDMKAAARLIINNIEMLVMFLLPALTGAIILARPLYSVFYGASEERAIHLFVAVLFQTLLLALYTLFSPMLQALFENRKAIYYFAYGILIKLVLQIPLIYLLHAYGPLLATTIALVVPIYLMYRRLYQVTHFNRKLLQKRLLLTLIETLLMGLVVFVANWLLGYAFKPTGRLTSLLYLLIIGGLGMTVYTALTLLTHQLDKLIGSKASRLRQKLGWH

SEQ ID NO: 3683 - DNA, 1452 bp, Streptococcus agalactiae
atgattacaatagataaaattttagaaattttaaaaaatgaccataatttcagagagattttgtttcatgagcattattattataactggacacaaaatgtaacttttaatgccttatcatatgatagtcgtcaaatttcatctgatactttatttttcgctaagggtgctacttttaaaaaagaatatctagattctgcaatcacagcaggcctttctttttacgtttctgagacagattacggcgccgatattccagtgatattagtcaatgatatcaaaaaagccatgagtttgatatctatgtctttctataataacccacaaaacaaacttaaacttctagcttttactggaacaaaaggaaaaacaactgcggcttactttgcttatcatatgttaaaagtaaaccatcgtcctgctatgctctcaactatgaacacaacattagatggtaaatctttctttaaatcacatctcacaacccccgagagtcttgatttatttcggatgatggctacagccgttgagaatcaaatgacacacttaattatggaagtatcaagccaagcatacctaaccaaacgtgtttatggtttaacctttgacgttggcgttttcttaaatattagtcccgatcatattggtcctatcgagcaccctacattcgaagattattttttccacaaacggctcttgatggagaatagcaatgctgttgttgtaaatagtcagatggatcattttaatattgtcaaagaacaggtcgaatatattcctcatgatttctatggagattattctgaaaatgttatcacagaatcaaaggccttttctttccatgtcaaaggaaagttggagaacacctacgatatcaagctgattggaaaattcaatcaagaaaatgctatcgcagctggacttgcttgtctccgacttggtgtttcaattgaagatataaaaaacggaattgcacaaactaccgtccctggccgcatggaagtcctaacacaaaccaacggcgcaaagattttcgttgactatgcccacaacggagacagtttgaagaaattattagctgttgttgaggaacaccaaaaaggggatattatattagtactcggagctcctggtaataaaggtcaaagccgtcgtaaagactttggagatgtcattaatcaacatcctaatctacaagtgatactcactgcagatgatcctaattttgaagatcccttagttatctcacaagaaatagcaagccatattaatcgtccggttactatcatcattgatcgagaagaagcaattgctaatgccagtactcttactaattgcaaactagatgcaattattatcgctggtaaaggagcagatgcttatcaaattatcaaaggaaatcgtgacaattactctggagatttagaagttgcgaaaaaataccttaaacga

SEQ ID NO: 3684 - protein, 484 aa, Streptococcus agalactiae
MITIDKILEILKNDHNFREILFHEHYYYNWTQNVTFNALSYDSRQISSDTLFFAKGATFKKEYLDSAITAGLSFYVSETDYGADIPVILVNDIKKAMSLISMSFYNNPQNKLKLLAFTGTKGKTTAAYFAYHMLKVNHRPAMLSTMNTTLDGKSFFKSHLTTPESLDLFRMMATAVENQMTHLIMEVSSQAYLTKRVYGLTFDVGVFLNISPDHIGPIEHPTFEDYFFHKRLLMENSNAVVVNSQMDHFNIVKEQVEYIPHDFYGDYSENVITESKAFSFHVKGKLENTYDIKLIGKFNQENAIAAGLACLRLGVSIEDIKNGIAQTTVPGRMEVLTQTNGAKIFVDYAHNGDSLKKLLAVVEEHQKGDIILVLGAPGNKGQSRRKDFGDVINQHPNLQVILTADDPNFEDPLVISQEIASHINRPVTIIIDREEAIANASTLTNCKLDAIIIAGKGADAYQIIKGNRDNYSGDLEVAKKYLKR

SEQ ID NO: 3685 - DNA, 1443 bp, Streptococcus pyogenes
atgataaccattgaacaattattagacattttaaaaaaagaccataattttcgtgaggttcttgatgccgacggataccactaccattatcaaggctttagttttgagcgcttgagttacgatagccgtcaagtagatggcaagacccttttttttgctaaaggggcaactttcaaagctgactaccttaaagaagcaatcactaacggattacaactctatatttcagaggtagattacgagcttggtattcccgttgttttggtcactgatatcaaaaaagctatgagtctaattgccatggctttctatggcaaccctcaagaaaagctcaaactactagcttttacaggtactaagggaaagacgacggctgcttattttgcctaccacatgttgaaagaatcctataaacctgccatgttttctaccatgaataccaccttagatggcaagacctttttcaaatcacaactcacaactcctgagagcttggatctttttgctatgatggctgagtgtgtgactaatggcatgacccacttgattatggaagtttctagtcaggcttacctcgttgaccgtgtctatgggcttacgttcgatgttggggttttcctaaatattagtcctgatcatattggcccaatcgagcatccaacgtttgaagattatttctatcataagcgtcttttaatggagaatagcagagctgttgtgatcaatagcgggatggatcatttttcatttctagcggatcaggtagcggatcaagagcatgtgttttatggtcccttgtctgacaaccagatcaccactagccaagccttctcctttgaagctaaaggacaattagctggccattatgacattcaattaattggccattttaaccaagaaaatgctatggcagctggacttgcctgccttcgtttgggtgctagcctagctgatattcaaaaaggtatcgctaagactcgcgtcccaggccgtatggaagtcctcactatgacaaatcatgctaaagtttttgttgattatgcccataatggtgacagcttagaaaaattactcagcgttgtggaagaacatcagacaggcaaattaatgttgattttaggtgcaccaggaaataaaggcgagagcagacgagctgattttggtagggtgattcatcagcatccaaacctcaccgtcattctcactgctgatgaccctaatttcgaggatccagaagatatttcaaaagaaattgccagccatatcgcacgcccagtagagattattagtgaccgtgagcaagctattcaaaaagccatgtctctttgccaaggagcaaaagatgctgtgattatcgctgggaaaggcgcagatgcttatcaaattgttaaaggacaacaagtagcttatgctggtgatttagcaatcgccaaacactacctc

SEQ ID NO: 3686 - protein, 481 aa, Streptococcus pyogenes
MITIEQLLDILKKDHNFREVLDADGYHYHYQGFSFERLSYDSRQVDGKTLFFAKGATFKADYLKEAITNGLQLYISEVDYELGIPVVLVTDIKKAMSLIAMAFYGNPQEKLKLLAFTGTKGKTTAAYFAYHMLKESYKPAMFSTMNTTLDGKTFFKSQLTTPESLDLFAMMAECVTNGMTHLIMEVSSQAYLVDRVYGLTFDVGVFLNISPDHIGPIEHPTFEDYFYHKRLLMENSRAVVINSGMDHFSFLADQVADQEHVFYGPLSDNQITTSQAFSFEAKGQLAGHYDIQLIGHFNQENAMAAGLACLRLGASLADIQKGIAKTRVPGRMEVLTMTNHAKVFVDYAHNGDSLEKLLSVVEEHQTGKLMLILGAPGNKGESRRADFGRVIHQHPNLTVILTADDPNFEDPEDISKEIASHIARPVEIISDREQAIQKAMSLCQGAKDAVIIAGKGADAYQIVKGQQVAYAGDLAIAKHYL

SEQ ID NO: 3687 - DNA, 111 bp, Streptococcus agalactiae
ttgtcaaattgccaaggtatttttggtgtgggaaccgtccataagatattagttcataaactgttatcccttcagttgcttctaacacctgtgggagaagtgcaatcttct

SEQ ID NO: 3688 - protein, 37 aa, Streptococcus agalactiae
MSNCQGIFGVGTVHKILVHKLLSLQLLLTPVGEVQSS

SEQ ID NO: 3689 - DNA, 810 bp, Streptococcus agalactiae
ttgctagaaaggttctctatgtctcacataaaagcagaaaacattatcgtatcttacgatcagaaagaaatcatcaataatctttccctcagtatacttaaccaaaaaataacaacgattattggtgccaatggatgtggaaagtctactcttttgaaggctctcacacgcatccataaaataaaagatggtactatcactattgatggtcatgatattgcacatttacccacaaaggaaattgctaagaagattgcacttctcccacaggtgttagaagcaactgaagggataacagtttatgaactaatatcttatggacggttcccacaccaaaaataccttggcaatttgacaaatgacgatcgcagtaaaatccattgggcgatggaaatgactaacgtagcgcaatttgctaatagagatgttgatgacctttcaggaggtcagaggcaaaaagtatggattgctatggctttagcacaagatacagatactatctttttagacgaacctacaacttatcttgacatgaatcatcaattagaagtcttagaattgctcaaaaaacttaatgacgaaacgcaaaaaacaattattatggtcctacacgacctaaacctgtctgcgcgctattctgattatctagttgcaatgaaaaccggtaaaattatctatgaaggtagtcctagtcagatcatgactaaagatattatcaaagatatttttaagattgatgctcatatcattcaggaccctattagtaaacaacctgttttgttatcttatcaattatcaactgatcaaaat

SEQ ID NO: 3690 - protein, 270 aa, Streptococcus agalactiae
MLERFSMSHIKAENIIVSYDQKEIINNLSLSILNQKITTIIGANGCGKSTLLKALTRIHKIKDGTITIDGHDIAHLPTKEIAKKIALLPQVLEATEGITVYELISYGRFPHQKYLGNLTNDDRSKIHWAMEMTNVAQFANRDVDDLSGGQRQKVWIAMALAQDTDTIFLDEPTTYLDMNHQLEVLELLKKLNDETQKTIIMVLHDLNLSARYSDYLVAMKTGKIIYEGSPSQIMTKDIIKDIFKIDAHIIQDPISKQPVLLSYQLSTDQN

SEQ ID NO: 3691 - DNA, 930 bp, Streptococcus agalactiae
atgaaaaaaattggaattattgtcctcacactactgaccttctttttggtatcttgcggacaacaaactaaacaagaaagcactaaaacaactatttctaaaatgcctaaaattgaaggcttcacctattatggaaaaattcctgaaaatccgaaaaaagtaattaattttacatattcttacactgggtatttattaaaactaggtgttaatgtttcaagttacagtttagacttagaaaaagatagccccgtttttggtaaacaactgaaagaagctaaaaaattaactgctgatgatacagaagctattgccgcacaaaaacctgatttaatcatggttttcgatcaagatccaaacatcaatactctgaaaaaaattgcaccaactttagttattaaatatggtgcacaaaattatttagatatgatgccagccttggggaaagtattcggtaaagaaaaagaagctaatcagtgggttagccaatggaaaactaaaactctcgctgtcaaaaaagatttacaccatatcttaaagcctaacactacttttactattatggatttttatgataaaaatatctatttatatggtaataattttggacgcggtggagaactaatctatgattcactaggttatgctgccccagaaaaagtcaaaaaagatgtctttaaaaaagggtggtttaccgtttcgcaagaagcaatcggtgattacgttggagattatgcccttgttaatataaacaaaacgactaaaaaagcagcttcatcacttaaagaaagtgatgtctggaagaatttaccagctgtcaaaaaagggcacatcatagaaagtaactacgacgtgttttatttctctgaccctctatctttagaagctcaattaaaatcatttacaaaggctatcaaagaaaatacaaat

SEQ ID NO: 3692 - protein, 310 aa, Streptococcus agalactiae
MKKIGIIVLTLLTFFLVSCGQQTKQESTKTTISKMPKIEGFTYYGKIPENPKKVINFTYSYTGYLLKLGVNVSSYSLDLEKDSPVFGKQLKEAKKLTADDTEAIAAQKPDLIMVFDQDPNINTLKKIAPTLVIKYGAQNYLDMMPALGKVFGKEKEANQWVSQWKTKTLAVKKDLHHILKPNTTFTIMDFYDKNIYLYGNNFGRGGELIYDSLGYAAPEKVKKDVFKKGWFTVSQEAIGDYVGDYALVNINKTTKKAASSLKESDVWKNLPAVKKGHIIESNYDVFYFSDPLSLEAQLKSFTKAIKENTN

SEQ ID NO: 3693 - DNA, 930 bp, Streptococcus pyogenes
atgaaaaaattaactctactattaacactctgtttgacaactattaccttaatcgcctgtggtaatcaagcaactaatcattctaacaccgcctcaaaaagtttatcgcctatgcctcaaattgctggtgtgacttattacggagatattcctaaacagcctaagcgagtagtcagtctggcttcaacttacactggttacctcaaaaaattagatatgaatctagtcggggttacttcttatgacaagaaaaaccccatcttagcaaagactgtaaaaaaagcaaagcaagttgctgcaactgatttagaagccgttacaacgcttaagcctgacctcattgttgttggctctacagaagaaaatattaaacaattggcagaaattgcgcctgttatctcgattgaataccgcaaacgtgattatttacaagtgttatctgacttcggccgcatctttaacaaagaagacaaagccaagaagtggttaaaagattggaaaactaaaacagcagcttatgaaaaagaagtcaaggccgttacaggtgacaaagcaacctttactattatggggctttatgaaaaagacgtttacctttttggtaaagactggggacgtggcggagagattatccatcaagctttccattatgatgctcctgaaaaagtgaagactgaagtttttaaacaaggttacctgtcattgtcgcaggaagtcttgccagactatattggtgattatgtcgtcgttgctgcagaagatgataagactggttctgctctatatgaaagcaagctatggcaatccattccagctgtgaaaaaacaccatgtgatcaaagtcaatgccaatgttttttactttactgatcctctttctttagaatatcaattagagactttacgagaggcaatcttatcaagtgaaaac

SEQ ID NO: 3694 - protein, 310 aa, Streptococcus pyogenes
MKKLTLLLTLCLTTITLIACGNQATNHSNTASKSLSPMPQIAGVTYYGDIPKQPKRVVSLASTYTGYLKKLDMNLVGVTSYDKKNPILAKTVKKAKQVAATDLEAVTTLKPDLIVVGSTEENIKQLAEIAPVISIEYRKRDYLQVLSDFGRIFNKEDKAKKWLKDWKTKTAAYEKEVKAVTGDKATFTIMGLYEKDVYLFGKDWGRGGEIIHQAFHYDAPEKVKTEVFKQGYLSLSQEVLPDYIGDYVVVAAEDDKTGSALYESKLWQSIPAVKKHHVIKVNANVFYFTDPLSLEYQLETLREAILSSEN

SEQ ID NO: 3695 - DNA, 123 bp, Streptococcus agalactiae
ttgggaataaaaagcttaataaaatgtggaataatcaatccaatgaaagaaacggttcctatcaaagcgactgatgaagctgataaaaacaaaacaataagtaatagaaacgcagtcattaat

SEQ ID NO: 3696 - protein, 41 aa, Streptococcus agalactiae
MGIKSLIKCGIINPMKETVPIKATDEADKNKTISNRNAVIN

SEQ ID NO: 3697 - DNA, 1023 bp, Streptococcus agalactiae
atgtttaaagcttcaaaaaaactcgttcaaaaaaataagtcaaatcatttttggcttgtttttttcataacacttatactatttcttattggttgttacgccagcttacgatttggtgctatcaatttcaagactagtgatttaataactgttttaaaaaatcccttaaaaaactctaatgctcaggatgttatttttgacattagactaccacgcataattgcagctatcttagtaggtgcagctatgtcacaagcaggtgctattatgcagggagtcactcgaaacgccattgctgatcctggactactaggtattaacgccggagctgggttagcccttgttgtagcatatgcttttttagggagcatgcactatagtacgattctcatagtctgcttactagggtctgtcatttcttgtcttttagtcttcacactctcttatacaaagcaaaagggttaccaccaactacgactcattttagccggagcgatgatctccacactttttacgtctgttggacaagtggttacattatactttaaactcaatcgaactgttatcggttggcaagcaggtggtttatcccaaattaactggaaaatgctaatcataatagcacctatcattattttaggtttacttatttcacaactcctagcacatcaattaactatcttgagccttaatgaatctgtggccaaagcattgggacaaaaaactcaattaatgactgcgtttctattacttattgttttgtttttatcagcttcatcagtcgctttgataggaaccgtttctttcattggattgattattccacattttattaagctttttattcccaaagattatcgtctgttattacctttaataggattttcaggggctactttcatgatctgggtagacttatcatctcgtattataaatcccccttcagagacatcaattagttctataatcagtatcgtagggcttccatgtttcctatggttaattagaaaagggaaaaatcta

SEQ ID NO: 3698 - protein, 341 aa, Streptococcus agalactiae
MFKASKKLVQKNKSNHFWLVFFITLILFLIGCYASLRFGAINFKTSDLITVLKNPLKNSNAQDVIFDIRLPRIIAAILVGAAMSQAGAIMQGVTRNAIADPGLLGINAGAGLALVVAYAFLGSMHYSTILIVCLLGSVISCLLVFTLSYTKQKGYHQLRLILAGAMISTLFTSVGQVVTLYFKLNRTVIGWQAGGLSQINWKMLIIIAPIIILGLLISQLLAHQLTILSLNESVAKALGQKTQLMTAFLLLIVLFLSASSVALIGTVSFIGLIIPHFIKLFIPKDYRLLLPLIGFSGATFMIWVDLSSRIINPPSETSISSIISIVGLPCFLWLIRKGKNL

SEQ ID NO: 3699 - DNA, 939 bp, Streptococcus pyogenes
gtgaaaactaagcatccctttttgtgtctcgagcgtttttgcttaaaaaaaacgcagataatcactaagtcacatatcttttggcttgtctttgtgctacttagttttagcttatgtgttgctatttactgtcatctgcgctttggagccgttgctttatcacatcaggatcttaactctattttatttggaaagcaaaacggccataaagccaatgttttactcgctatacgattaccgagactttttggtgctaccttaactggctctgcgttagctgtttctggaactatcatgcaagcaatcacacgtaatcctatcgctgagcctggccttttaggcattaatgctggagcaggactagccttggtactggcttatgcgtttgtacctcacttgcactattccctcattattctgctttcgttgttagggtctagcctggcagcaaccttagtctttggcctttcttatcaatctggcaaaggctaccatcagctccgccttgtcttagcaggagctatggtttccatactgctatcagcattaggtcaaggtattaccaattactatcatctggcaaatgctgttatcggctggcaagcaggaggtcttgtcggggtcaattggcaaatgatcggctatattgctcctcttattattcttagtctttgtttagcccagctattatcttatcacctgaccgtccttagtctaagtgagtctcaggcaaaagctcttgggcaaaaaaccaacttgatcagtgcagtctttatgattttggttcttattttatcatcagcagctgtagccattgctggaagcatttcttttatcggcttagtcattcctcatcttatgaaacattttacacctcatcattaccgataccttttgccgctttgtgcagtttctggcgctagtttcaatggtatgggt

SEQ ID NO: 3700 - protein, 313 aa, Streptococcus pyogenes
VKTKHPFLCLERFCLKKTQIITKSHIFWLVFVLLSFSLCVAIYCHLRFGAVALSHQDLNSILFGKQNGHKANVLLAIRLPRLFGATLTGSALAVSGTIMQAITRNPIAEPGLLGINAGAGLALVLAYAFVPHLHYSLIILLSLLGSSLAATLVFGLSYQSGKGYHQLRLVLAGAMVSILLSALGQGITNYYHLANAVIGWQAGGLVGVNWQMIGYIAPLIILSLCLAQLLSYHLTVLSLSESQAKALGQKTNLISAVFMILVLILSSAAVAIAGSISFIGLVIPHLMKHFTPHHYRYLLPLCAVSGASFNGMG

SEQ ID NO: 3701 - DNA, 252 bp, Streptococcus agalactiae
ttgctaacattaaatgttcctatggttagagcgattactaatccagctccagcattgataccaagaataccggaatcagctagtggatttttggttaacgtctgtaatagcaacccagcaattcctaaagaagctcccccaaagatacagacaataatacgaggtaaacgaatgttagtaatgataaaaaggaaggcatcatcagattttccacttattagttttaaaacgtcaataacggaagtattagca

SEQ ID NO: 3702 - protein, 84 aa, Streptococcus agalactiae
MLTLNVPMVRAITNPAPALIPRIPESASGFLVNVCNSNPAIPKEAPPKIQTIIRGKRMLVMIKRKASSDFPLISFKTSITEVLA

SEQ ID NO: 3703 - DNA, 999 bp, Streptococcus agalactiae
atgattcaaaaaaataaagctccttttgttttaatatcatctgtcattatcctactattattaatactagtatcaatttcacttggctatgctaatacttccgttattgacgttttaaaactaataagtggaaaatctgatgatgccttcctttttatcattactaacattcgtttacctcgtattattgtctgtatctttgggggagcttctttaggaattgctgggttgctattacagacgttaaccaaaaatccactagctgattccggtattcttggtatcaatgctggagctggattagtaatcgctctaaccataggaacatttaatgttagcaatccaactatattatactttttacccctatttgctatgtttggagggttggtaactatttttcttatctatcttatgtcatacagaagaaatcacaatattagccctacacgattaatcgtcactggtatcggaatatctacaattatttcaggcgttatgattttgattattagtcagtctaataatcaaaaaatggatatgatcgttgaatggcttagtggaaaaattacaattagttcctggactaccattatcacttttatcccgattctcattttgttatggggattagcatatagtcgcagtcgccaccttaatattatgaacctaaacgagcagactgctctcgctctaggacttcatttaaaaaaggaaagaatatatactttgatgctgacaagtagcctcgctgctattagcgtcgtcttaattggtaatattacttttataggcttactcgctgggcacttaagtagacgactattaggaaataaccataaaattatactacctagctgtcttcttattggtgctattatcctattggtatcagatactataggtcgtctcctcttagttggtacgggtattcccactggattggttgtatcaataattggtgccccctattttctctggttgatgacaaaagttgac

SEQ ID NO: 3704 - protein, 333 aa, Streptococcus agalactiae
MIQKNKAPFVLISSVIILLLLILVSISLGYANTSVIDVLKLISGKSDDAFLFIITNIRLPRIIVCIFGGASLGIAGLLLQTLTKNPLADSGILGINAGAGLVIALTIGTFNVSNPTILYFLPLFAMFGGLVTIFLIYLMSYRRNHNISPTRLIVTGIGISTIISGVMILIISQSNNQKMDMIVEWLSGKITISSWTTIITFIPILILLWGLAYSRSRHLNIMNLNEQTALALGLHLKKERIYTLMLTSSLAAISVVLIGNITFIGLLAGHLSRRLLGNNHKIILPSCLLIGAIILLVSDTIGRLLLVGTGIPTGLVVSIIGAPYFLWLMTKVD

SEQ ID NO: 3705 - DNA, 651 bp, Streptococcus agalactiae
atgatattaacgtttaatccaggaaagttagaaagacaagagttttttaaggagcttattaactatctttggatacatgatgatgtaacactaagaaaaataaagtcccactttacagactattctaaaattgaccgtttgttagaagaatatattaatcatggatatatccttcgccaaaataaacgctacagccttaatcttccttttctgagttcgctagatggattagtattagatgatttggttttcatagattctgatagtcaaatctatcagttattacagaagcgaaaatttgtgacaaatttagataacccaaccaatcacttggtatttgtagaagagacagattttgaaagaaacactttgactctttctaattatttctataaactaactaacggttatccactttcaagagaacaaaaaaagctttatcaacttttaggagatgttaattcggaatatgctttaaaatatatgtcaagctttatattgaaatttcttcgcaaggatagtgttaagcaaaaacgtacagttatttttatccaagctttagaattacttggatatattagcttaaaccaagatactacctatcgtttaaatgctaaacttgatgttgaagctttaaagatttacttaaca

SEQ ID NO: 3706 - protein, 217 aa, Streptococcus agalactiae
MILTFNPGKLERQEFFKELINYLWIHDDVTLRKIKSHFTDYSKIDRLLEEYINHGYILRQNKRYSLNLPFLSSLDGLVLDDLVFIDSDSQIYQLLQKRKFVTNLDNPTNHLVFVEETDFERNTLTLSNYFYKLTNGYPLSREQKKLYQLLGDVNSEYALKYMSSFILKFLRKDSVKQKRTVIFIQALELLGYISLNQDTTYRLNAKLDVEALKIYLT

SEQ ID NO: 3707 - DNA, 651 bp, Streptococcus pyogenes
atgataacagtatttcattcagataaactcaccagacaacctttctttcaagaccttatcaattatctcgaccagcatgatcacgttatattacgagagatcaaaaaagcctttcctaatgtgacaggtattgacaaggccatcgaaagctatgttcaagctggctatattcgccgtgaaaataagcgttatggcatcaatcttcctttggtgagttctgatcagcagctggccttagacactatgctttttgtggacacctgttcagctatgtatgaaaatattttagcggttgtttttgagactcagctaacaaaccaaaccaatcgcgtgatgatcaaggaaaagaccaacatcacgagagacgatttgaccctggctaattatttttaccgtctcaaaagaggtgagaagccatcagctgagcagatggacttgtatgacctcttgggggatgtgaatcaggaatatgcccttaaatatatgacaacttttttgcttaaattcacgcgcaaagactttgtgatgcaaaaacgtcctgatatatttgtggaagctctggttacacttggttacctaaaacaagtggagcctacaacataccagctgctaatgaccttggataaagaaagtttaacctttatagcacca

SEQ ID NO: 3708 - protein, 217 aa, Streptococcus pyogenes
MITVFHSDKLTRQPFFQDLINYLDQHDHVILREIKKAFPNVTGIDKAIESYVQAGYIRRENKRYGINLPLVSSDQQLALDTMLFVDTCSAMYENILAVVFETQLTNQTNRVMIKEKTNITRDDLTLANYFYRLKRGEKPSAEQMDLYDLLGDVNQEYALKYMTTFLLKFTRKDFVMQKRPDIFVEALVTLGYLKQVEPTTYQLLMTLDKESLTFIAP

SEQ ID NO: 3709 - DNA, 933 bp, Streptococcus agalactiae
atgtctaaaattttagtctttggtcaccaaaatccagattcagatgctattggatcatcagttgcttttgcatatctagctaaagaagcttgggggcttgacacagaggccgttgctttaggaactccaaatgaagaaacagcatatgttttagattattttggtgttcaagcacctcgagtagtagaatctgcaaaagcagagggtgtagagacagtcattttaactgaccataacgaattccaacaatctatttctgatattaaagatgtgacagtttatggtgttgttgatcatcatcgtgttgctaactttgagactgccaatccgttatatatgcgtttggaaccagttggctcagcatcatcgattgtttaccgtatgtttaaggaaaatggagtatcagtacccaaagagttggctggtttattattatcaggtttgatttcagatactcttcttttgaaatcaccaacaactcatgcttcagatattccagttgcaaaagaactagcagagcttgcaggtgtaaacttagaagaatatggtttagaaatgcttaaagcaggtactaacctctcaagtaagactgcagcggagttgattgatattgatgctaaaacatttgaattaaatggagaagctgttcgtgttgcacaagttaatactgtggacattaacgatattttagcacgtcaagaagagattgaagttgctattcaagaagcaattgtcacagaaggttattctgattttgtattgatgattactgacattgttaattcaaattcagagattttagctctcggttcaaatatggctaaagttgaagcagcttttgaatttacacttgaaaataaccacgcttttcttgctggggcagtatcacgcaaaaaacaagttgttcctcaattgacagaaagctacaatgct

SEQ ID NO: 3710 - protein, 311 aa, Streptococcus agalactiae
MSKILVFGHQNPDSDAIGSSVAFAYLAKEAWGLDTEAVALGTPNEETAYVLDYFGVQAPRVVESAKAEGVETVILTDHNEFQQSISDIKDVTVYGVVDHHRVANFETANPLYMRLEPVGSASSIVYRMFKENGVSVPKELAGLLLSGLISDTLLLKSPTTHASDIPVAKELAELAGVNLEEYGLEMLKAGTNLSSKTAAELIDIDAKTFELNGEAVRVAQVNTVDINDILARQEEIEVAIQEAIVTEGYSDFVLMITDIVNSNSEILALGSNMAKVEAAFEFTLENNHAFLAGAVSRKKQVVPQLTESYNA

SEQ ID NO: 3711 - DNA, 939 bp, Streptococcus pyogenes
atgattatgtcaaaaattttagtttttggtcatcaaaatcctgatacggatgctattgcatcatcttatgcttttgattacttatcccaaaaagcgtttggtttggatactgaagtcgtagctttaggaacacctaacgaagaaacagcttttgcccttgattattttggtgttgaggcaccacgtgtggtagagtctgctaaagcacaagggtctgaacaagtgattttgacagaccacaatgaattccaacaatccattgcagatatccgtgaggttgaggtatatggtgtggttgatcaccaccgtgtggctaattttgaaactgcaaatcctttatacatgcgtgtggaaccagtaggatcagcctcatctattgtttaccgtatgtttaaagaaaatggcatcgaggtgccaaaagcgattgcagggatgctcttgtctggtttgatttcagataccttgttgttgaaatctccaacaactcatgtgtctgatcaccttgtcgctgaagaattggcagagctggcagaagtgaacttggaagactatggaatggctcttttaaaagcaggtacaaaccttgcaagcaaatcagaagtagaattgattggtattgatgccaaaacatttgaattaaatggcaatgctgtgcgcgtggcacaagtgaacactgttgacattgcagaagtcttagaacgtcaagaagctattgaagcagccattaaagatgccatggctgcagaaggttattcagattttgttttgatgatcacggatattgttaactcaaactctgaaattctagctattggagcaaacatggacaaggttgaagcagcctttaacttcacccttgacaacaatcatgccttcttagcaggtgccgtttctcgtaaaaaacaagtggttccacaattgacagaaagttttggagct

SEQ ID NO: 3712 - protein, 313 aa, Streptococcus pyogenes
MIMSKILVFGHQNPDTDAIASSYAFDYLSQKAFGLDTEVVALGTPNEETAFALDYFGVEAPRVVESAKAQGSEQVILTDHNEFQQSIADIREVEVYGVVDHHRVANFETANPLYMRVEPVGSASSIVYRMFKENGIEVPKAIAGMLLSGLISDTLLLKSPTTHVSDHLVAEELAELAEVNLEDYGMALLKAGTNLASKSEVELIGIDAKTFELNGNAVRVAQVNTVDIAEVLERQEAIEAAIKDAMAAEGYSDFVLMITDIVNSNSEILAIGANMDKVEAAFNFTLDNNHAFLAGAVSRKKQVVPQLTESFGA

SEQ ID NO: 3713 - DNA, 786 bp, Streptococcus agalactiae
atggcagaaatagactataaaaaagtaacaggaatgatccattctacagaaagtttcggctctgtggatgggccaggtattcgttttatcatttttatgcaaggatgtaaaatgcgttgtcaatactgtcataatcctgatacttgggaaatggaaactaacaattcaaaggaacgtaccgttgaggatgttctaaaggaagctctccgttataaacatttttggggaaaagatggaggtatcacagtttcaggtggtgaagcaatgctgcaaattgactttattacagccctctttattgaggctaagaaactaggtattcatacgacgctagatacttgtggttttgcttatcgagcaacaccagaataccatgctatccttgaaaaattgttagatgttactgatttggtactccttgacttaaaagaaattgattcagaacaacataaaattgtaactcgtcagtctaacaaaaatattttacagtttgctagatatttatctgatagaggtactccggtatggattcgtcatgttttagttcctggattgactgatattgatgaccatttaaaacgtttgggtgaatttgtccaaacacttgataatgtcgataaatttgaagtattgccttatcatactatgggagagttcaaatggcgtgaattaggaattccgtatccattagctggtgtgaaaccaccaactccagaacgtgttaaaaacgctaaagatatcatgaaaacagaatcctatacagaatatctaaaaaggattcaaaat

SEQ ID NO: 3714 - protein, 262 aa, Streptococcus agalactiae
MAEIDYKKVTGMIHSTESFGSVDGPGIRFIIFMQGCKMRCQYCHNPDTWEMETNNSKERTVEDVLKEALRYKHFWGKDGGITVSGGEAMLQIDFITALFIEAKKLGIHTTLDTCGFAYRATPEYHAILEKLLDVTDLVLLDLKEIDSEQHKIVTRQSNKNILQFARYLSDRGTPVWIRHVLVPGLTDIDDHLKRLGEFVQTLDNVDKFEVLPYHTMGEFKWRELGIPYPLAGVKPPTPERVKNAKDIMKTESYTEYLKRIQN

SEQ ID NO: 3715 - DNA, 861 bp, Streptococcus pyogenes
atgcctagtctttttgatgaaaagtgttataatgaaaatgtaaaaacgtttacaagtaatgaaggagatgcaatgactgagaaagattatggacaagtaacagggatggtgcattcgacagaaagttttggttctgtagatggtccaggcattcgttttatcattttcttgcaaggctgtaaattacgttgccaatattgccataatccggatacttgggagatggaaaccaacaattcaaaaatcagaacagtcaatgatgtcttgaaagaagcccttcagtacaaacatttctggggaaaaaaaggaggaattaccgtatctggtggtgaagctatgcttcaaattgattttatcactgccttattcatcgaagctaaaaaattaggtatccataccacactagacacctgtggctttacctatagaccgacacctgaataccatcaggttcttgataacttattggcagtgaccgatttgattttattggacttaaaagaaattgatgaaaaacaacataaaattgtcacgcgtcagcctaataaaaacatattgcaatttgctaggtatttatccgacaagcagattcctgtctggattcgacatgtcttggttccaggcttgactgatattgatgatcatttgacacgattgggtgagtttgtcaaaaccttgaaaaatgtcgataaatttgaagttttgccttaccataccatgggagaattcaagtggcgtgagctaggtattccttatcagttagaaggtgttaaaccaccaactaaggaacgcgttcaaaatgctaaaaatctgatgcagaccgaatcttacacagaatatatgaatcggattcatcagtca

SEQ ID NO: 3716 - protein, 287 aa, Streptococcus pyogenes
MPSLFDEKCYNENVKTFTSNEGDAMTEKDYGQVTGMVHSTESFGSVDGPGIRFIIFLQGCKLRCQYCHNPDTWEMETNNSKIRTVNDVLKEALQYKHFWGKKGGITVSGGEAMLQIDFITALFIEAKKLGIHTTLDTCGFTYRPTPEYHQVLDNLLAVTDLILLDLKEIDEKQHKIVTRQPNKNILQFARYLSDKQIPVWIRHVLVPGLTDIDDHLTRLGEFVKTLKNVDKFEVLPYHTMGEFKWRELGIPYQLEGVKPPTKERVQNAKNLMQTESYTEYMNRIHQS

SEQ ID NO: 3717 - DNA, 1332 bp, Streptococcus agalactiae
atgcaagaccctggcagtcagagtttgttactacaatttgttattttattaatattaaccctatttaacgccttcttttcagcatctgaaatggctttagtatcgctaaaccgctctaaagtagaacagaaagctgaagaaggggacaaaaggtatcgacgtcttttggacgttcttgaaaatcccaataattttttatcaacaattcaagttggtattacttttattagccttttgcaaggggctagtttatctgcctcactaggacatgtgatttcagggtggctaggaaattcagcaacagcccgtacagcagggagtattattgcgctaatctttttaacatatgtctctattgttctaggagaattatatcctaagcgtattgctatgaatttgaaagatcgtctagcaattgtttcagctcccattattatctttctagggaaaatcgtaagcccctttgtatggttgctctcagcttcaactaacttattgagtagaatcactccgatgacttttgatgatgctgacgagaagatgacacgtgatgaaattgaatatatgttgacgaatagtgaagaaactttggaagctgaagaaattgagatgctgcaagggattttctcgctagatgaaatgatggcgcgtgaagttatggttccgcgcactgatgctttcatgattgacatcaacaatgatgcacaatcaaatattgaaggaattttatcacaaaacttttctcgtgtccctgtttttgatgacgataaagatagagttgttggtgttttacataccaagcgcttattggaagcgggctttaaaactggttttgatactatcgacttgcgaaaaatacttcaggaacctctttttgttccagaaacgatttttgtagatgaccttttaaaagcattacgcaacactcaaaatcaaatggccattttactagatgaatatggtggcgttgctggtttagtaactctagaggatttattggaagaaattgtcggcgaaattgatgatgaaacagatacagctgaacaatttgtcagggaaatcgatgagaatatctatattgttctaggaactatgacgcttaatgaatttaatgattattttgagacagagttagaaagtgatgatgttgatacaattgcgggttattatttaactggtgtgggtagtattccaaaccaagaggaaaaagtagcttacgaagtagacagcaaagataaacacatcactttgattaatgataaagttaaagatggtcgtataacaaaattgaaggtgctattgtctgatatagaacagaatattgaaaaagac

SEQ ID NO: 3718 - protein, 444 aa, Streptococcus agalactiae
MQDPGSQSLLLQFVILLILTLFNAFFSASEMALVSLNRSKVEQKAEEGDKRYRRLLDVLENPNNFLSTIQVGITFISLLQGASLSASLGHVISGWLGNSATARTAGSIIALIFLTYVSIVLGELYPKRIAMNLKDRLAIVSAPIIIFLGKIVSPFVWLLSASTNLLSRITPMTFDDADEKMTRDEIEYMLTNSEETLEAEEIEMLQGIFSLDEMMAREVMVPRTDAFMIDINNDAQSNIEGILSQNFSRVPVFDDDKDRVVGVLHTKRLLEAGFKTGFDTIDLRKILQEPLFVPETIFVDDLLKALRNTQNQMAILLDEYGGVAGLVTLEDLLEEIVGEIDDETDTAEQFVREIDENIYIVLGTMTLNEFNDYFETELESDDVDTIAGYYLTGVGSIPNQEEKVAYEVDSKDKHITLINDKVKDGRITKLKVLLSDIEQNIEKD

SEQ ID NO: 3719 - DNA, 1371 bp, Streptococcus pyogenes
atgaagtcactatattatttttttaggagttacattaacatggaagaccctgtgagtcagtccttagtgattcaatttttattgttagttgttttaaccttgttaaatgcttttttttcagccagtgaaatggccttagtttctctcaatcgttctcgggtggaacaaaaagcagcagacggtgataaaaaatacgctcgtttgttgcgggttttagaggaacctaatcattttttatcaacgattcaagttgggattacctttattagtttactatcaggagcaagtttatcagcttctttgggtaaggtgatctcaggttggctaggtaattcagcgaccgcaaggacagctggtactatcatctccttggttttcttgacttatgtctctattgttttaggagaattgtatccaaaacggattgccatgaacctcaaagacaagttggcgattgtttcagcccctattatcattgggttagggagactggttagtccctttgtatggctcttatcagcttctactaatttactgagccgacttacccctatgacctttgatgatgcagatgagcaaatgacacgtgatgaaatcgagtatatgttatcaaaaagtgaggcgacccttgatgctgaagaaattgagatgttgcaaggagttttctcacttgatgaaatgatggcgcgtgaagtcatggtcccaaggaccgatgctttcatgattgacattaacgatgatccgcttgaaaatattcaggaaatcttaaaacaaagtttttcacgcattcctgtttatgatgtggataaagataaaattatcggtctcatccacactaagcgtctcttggagtcaggtttccgccagggatttgatcagattaacatgcgaaaaatgttacaagaacctctttttgttcccgaaaccatttttgtagatgatctcttacgccagctgcgcaatacccaaaatcagatggctattttgctagatgaatatggtggtgtggcaggacttgtgactttggaagacttgcttgaagaaatcgtcggtgaaatcgatgatgaaaccgataaagcagaacaatttgttcatgagattggagacaatacctatattgttgttggtactatgactttaaatgagtttaatgactattttgataccgaactagaatcagatgatgtagataccattgctggtttttatttgacaggtatcggaaccattccaagccaggagcaaaaagaagcctacgaaatagataacaaagacaaacatttagttctaatcaacgataaagtcaaagatggccgtattacgaaattaaaattaatcctgtctaatatagaacagattattgaggaagac

SEQ ID NO: 3720 - protein, 457 aa, Streptococcus pyogenes
MKSLYYFFRSYINMEDPVSQSLVIQFLLLVVLTLLNAFFSASEMALVSLNRSRVEQKAADGDKKYARLLRVLEEPNHFLSTIQVGITFISLLSGASLSASLGKVISGWLGNSATARTAGTIISLVFLTYVSIVLGELYPKRIAMNLKDKLAIVSAPIIIGLGRLVSPFVWLLSASTNLLSRLTPMTFDDADEQMTRDEIEYMLSKSEATLDAEEIEMLQGVFSLDEMMAREVMVPRTDAFMIDINDDPLENIQEILKQSFSRIPVYDVDKDKIIGLIHTKRLLESGFRQGFDQINMRKMLQEPLFVPETIFVDDLLRQLRNTQNQMAILLDEYGGVAGLVTLEDLLEEIVGEIDDETDKAEQFVHEIGDNTYIVVGTMTLNEFNDYFDTELESDDVDTIAGFYLTGIGTIPSQEQKEAYEIDNKDKHLVLINDKVKDGRITKLKLILSNIEQIIEED

SEQ ID NO: 3721 - DNA, 564 bp, Streptococcus agalactiae
atgattaaaagaccaattcatctttctcatgattttttagcagaagttattgataaagaagcaataacgcttgatgcaactatgggaaatgggaatgatactgtttttttagcgaaaagttctaaaaaagtttatgcatttgatattcaagaagaagcaatagcaaaaacgaaagcaaagctcacggagcaagggatctctaacgctgaacttatcttggatgggcatgaaaatttggaacaatatgttcatacacctttaagagcggctatatttaatctgggatacttaccctcagcggataaaacagttattacaaaaccacacacaactatcaaggcaatcaaaaacgttttagacattttagaagtaggtggacgtctatcacttatggtttattatggtcatgatggtggaaaaagtgagaaagatgcggtgatagcattcgtggaacaattaccacagaataatttcgctacaatgctttatcaaccactcaatcaagttaatacgcctccctttttaattatggtagaaaagttacaatcatatgaaaatgaggtg

SEQ ID NO: 3722 - protein, 188 aa, Streptococcus agalactiae
MIKRPIHLSHDFLAEVIDKEAITLDATMGNGNDTVFLAKSSKKVYAFDIQEEAIAKTKAKLTEQGISNAELILDGHENLEQYVHTPLRAAIFNLGYLPSADKTVITKPHTTIKAIKNVLDILEVGGRLSLMVYYGHDGGKSEKDAVIAFVEQLPQNNFATMLYQPLNQVNTPPFLIMVEKLQSYENEV

SEQ ID NO: 3723 - DNA, 579 bp, Streptococcus pyogenes
ttgacggatttggataggagaaaagtgatgctaaaacgccccattcatctctcgcatgattttttagcggaggttgtggataagtctagtgtggttgttgatgccacgatgggtaatggaaatgatactgcctttttggcacaattagctaaaaaggtttatgcttttgatgtgcaagaacaagctattagaaaaacaagtgagcggttagcgcagctaggattatcgaacgctgagctgattttagcgggtcatgaagcggttgatcagtatgtgacagagccggtgcgcgcagcgatttttaaccttggttatttgcccagcgcagataaatctattattaccttaccaaataccacactccaagctttatcaaaactactaacgttattaatggtaggtgggcgtattgctattatggtctattatgggcatgatggaggcagtttggaaaaagatgctttattagattttgtcaagcaattagaccaaagaaaggtttctgcaatgctttatcagcctcttaatcaggtgaataccccaccttttttaatcatgttggagaaattagcagacttt

SEQ ID NO: 3724 - protein, 193 aa, Streptococcus pyogenes
LTDLDRRKVMLKRPIHLSHDFLAEVVDKSSVVVDATMGNGNDTAFLAQLAKKVYAFDVQEQAIRKTSERLAQLGLSNAELILAGHEAVDQYVTEPVRAAIFNLGYLPSADKSIITLPNTTLQALSKLLTLLMVGGRIAIMVYYGHDGGSLEKDALLDFVKQLDQRKVSAMLYQPLNQVNTPPFLIMLEKLADF

SEQ ID NO: 3725 - DNA, 933 bp, Streptococcus agalactiae
atgaaaaaacgttatcgtgcgattaatgattattatcgagaactctttggagaaaaaatatttaaattacctatagatgctggttttgactgtcctaacagagacggaacagttgctagaggagggtgcactttttgcacagtttctggttcaggggatgctatagttgctccagaagctcctattcgtgaacaattctataaagaaattgatttcatgcatagaaagtggcctgaggttaataaatacttagtctattttcaaaattttaccaatacccatgctaagttagagataattaaagagcgttacgaacaggctattaatgagccaggagttatcggaatcaacatcggaacaaggccggattgcttacctgatgaaactatatactatctcgctgaactttctgaaagaatgcatgtgactttagaattaggccttcagacaacttatgaagcaacttctgcattaataaatagagcacattcatatgacctttacaaaaaaactgttaagagaatacgagaattagctcctaaagtagaaatcgtttctcacctaataaatggccttccaggggagacacatgatatgatggtggaaaatgttcgtcgatgtgttacggataatgatattcagggtataaaattacaccttctgcatcttatgactaatacaagaatgcagagagattaccatgaaggtcgtttacgtttgttaagtcaagaagactatatttcgattatttgtgaccaactggagattattccaaaacatattgttattcaccgaattactggtgatgcgccacgtcatatgttaattggaccgatgtggagccttaataaatgggaagtgcttaatgccattgacaaagaaatggagaaaagacagtcatatcaaggatgtaaagctgaggtaaaacatgat

SEQ ID NO: 3726 - protein, 311 aa, Streptococcus agalactiae
MKKRYRAINDYYRELFGEKIFKLPIDAGFDCPNRDGTVARGGCTFCTVSGSGDAIVAPEAPIREQFYKEIDFMHRKWPEVNKYLVYFQNFTNTHAKLEIIKERYEQAINEPGVIGINIGTRPDCLPDETIYYLAELSERMHVTLELGLQTTYEATSALINRAHSYDLYKKTVKRIRELAPKVEIVSHLINGLPGETHDMMVENVRRCVTDNDIQGIKLHLLHLMTNTRMQRDYHEGRLRLLSQEDYISIICDQLEIIPKHIVIHRITGDAPRHMLIGPMWSLNKWEVLNAIDKEMEKRQSYQGCKAEVKHD

SEQ ID NO: 3727 - DNA, 936 bp, Streptococcus pyogenes
ttgtgctacaatagaaacatgaaaaaaagatatcagacattaaatgagcattaccgtcaactatttggcgcaaaaatgtttaaagttccgattgatgccggctttgattgtcccaatcgtgatggaacggtagctcatggaggatgtactttttgcacagtatcaggttctggagatgctattgtagcaccagatgctccaattaaagagcaattttataaagaaattgattttatgcaccgtaaatggcctgatgtcaatcgctatttggtttattttcaaaactttaccaatactcatgatacagttgatgtgattcgcgaccgttacgaacaagctattaacgaacctggagttgttggtattaatattggcacacggcctgactgtctaccagatgataccattgcttacttagcagaattatcagaacgcatgcatgtgacagtggagctaggcttacagacaacttatgaagaaacttctaggctaattaacagagcacattcttatgatttgtataaagaaacggtgaggcgactaaggcattaccccaacattaatattgtttcgcacttgattaatggattgccaaaagaaactcatgacatgatgcttgaaaatgtgagacgctgtgtaacagacaatgacattcaaggaattaaattgcatttgctgcatttgatgaccaatactagaatgcaaagagattatcatgaaggacgcttaaagttgttgagtcaaaaggactatgtttcgattatttgtgaccagctagagattatccctaagcatattgtgattcaccgtattacaggagatgccccacgcgatatgttgattgggcccatgtggagtctaaataagtgggaagtattgaatgccattgataaagaaatggaaagacgaggaagctttcagggctgtaaagttgac

SEQ ID NO: 3728 - protein, 312 aa, Streptococcus pyogenes
LCYNRNMKKRYQTLNEHYRQLFGAKMFKVPIDAGFDCPNRDGTVAHGGCTFCTVSGSGDAIVAPDAPIKEQFYKEIDFMHRKWPDVNRYLVYFQNFTNTHDTVDVIRDRYEQAINEPGVVGINIGTRPDCLPDDTIAYLAELSERMHVTVELGLQTTYEETSRLINRAHSYDLYKETVRRLRHYPNINIVSHLINGLPKETHDMMLENVRRCVTDNDIQGIKLHLLHLMTNTRMQRDYHEGRLKLLSQKDYVSIICDQLEIIPKHIVIHRITGDAPRDMLIGPMWSLNKWEVLNAIDKEMERRGSFQGCKVD

SEQ ID NO: 3729 - DNA, 639 bp, Streptococcus agalactiae
atgttatctcgtcaaaatagtaaacttattcaagcatttattgctattatcttatttttcagtttaggattggtcatcaaatattggcccgacactgtaatttcatttgaccaaactattcaagaaagtgttagaggacagttgccaaatctttctacaagatttttcaagttaatcactgtgattggtaatactgtaagccagatagctattgcgattatgagcgtcactttctgttaccttaagaagtggtatcctcaagctagatttatcgcagtaaatgctattatctctggtatatgtatactttctttaaaacttatttttcaaagagtaagaccaactttaacccatttagtatttgcaggtggctattcgtttcccagtgggcactcgatgggaacatttatgatatttgggagtattattattttattgcagtactatatgcctaagagtatatggaaactgttgtgccaaggtactttgggtttgctcatttttttaattgggttatctcgtatttacctaggggttcattttccgacagatgttttagctggttttatacttgcttatggtattttgaatctaactgcgtatatctttttagccaaggattggttaaagaaagtgaag

SEQ ID NO: 3730 - protein, 213 aa, Streptococcus agalactiae
MLSRQNSKLIQAFIAIILFFSLGLVIKYWPDTVISFDQTIQESVRGQLPNLSTRFFKLITVIGNTVSQIAIAIMSVTFCYLKKWYPQARFIAVNAIISGICILSLKLIFQRVRPTLTHLVFAGGYSFPSGHSMGTFMIFGSIIILLQYYMPKSIWKLLCQGTLGLLIFLIGLSRIYLGVHFPTDVLAGFILAYGILNLTAYIFLAKDWLKKVK

SEQ ID NO: 3731 - DNA, 666 bp, Streptococcus agalactiae
atgggagaagacaaaggttttttcgcgtacatacgcttacctttggagcttctttcaatttatttaaattggaggaatttttttatgacaaatacacgtaaaatggtgacaatcgccattctttctgccttatcttttgtattgatgatggtttcatttccattaataccaggagcagaatttttaaaggttgatttttcaatccttccgatgttagttgcttttattttatttgatttgaaatcaagttatggtgtactcttattaagatcacttttaaaagttatacttgctaatcgtggtccagaaacgtttattggtttaccgatgaatatggttgctctagctttatttttagcaagtttcgctattttctggaaaaatagagagagtgcaaaagattttattaaagctagtctatttggtacagttagcttgaccgtatctatggtagctctcaactatgtctttgcgattcctttgtatgctatatttgctaactttgatatcagaacatttattggtgtaggcaattaccttttaacaatggttattccatttaatatcgttgagggaattttaatttcgattgttttctatctaacttacgtggcttgtttgccaatattagaaagatataaaaagactaatgttatctcgtcaaaa

SEQ ID NO: 3732 - protein, 222 aa, Streptococcus agalactiae
MGEDKGFFAYIRLPLELLSIYLNWRNFFMTNTRKMVTIAILSALSFVLMMVSFPLIPGAEFLKVDFSILPMLVAFILFDLKSSYGVLLLRSLLKVILANRGPETFIGLPMNMVALALFLASFAIFWKNRESAKDFIKASLFGTVSLTVSMVALNYVFAIPLYAIFANFDIRTFIGVGNYLLTMVIPFNIVEGILISIVFYLTYVACLPILERYKKTNVISSK

SEQ ID NO: 3733 - DNA, 561 bp, Streptococcus pyogenes
atgtcaaaaacacataaaatgattatgattggtatactttctgcgatatcatttctattgatgctagttagctttgccattattccaggcgcagcttttttaaaaattgaatttagtattattcctgttttatttggtttaatgattatggacttaaagagtgcttacttaattttgttattgaggtccttattgaaactctttttgaacaatcgtggggttaatgattttattggtctcccaatgaatattatcgctatcgctttatttgtgacggcttttgccttagtttggaaccgtcaaaaaacgcttagtcaatatgtatttgctagcttactaggcacagggttattaacgtttggcatggttgttcttaattatacttttgccattcctttatatgctatatttgcaaatattgatatcagagcttatattggtgttactaagtatatgatgactatggttattccgtttaatcttgttgaagggttgatatttgcaattaccttttattttgtgtatattgcaagtaaaccaattttagaaagatacttacac

SEQ ID NO: 3734 - protein, 187 aa, Streptococcus pyogenes
MSKTHKMIMIGILSAISFLLMLVSFAIIPGAAFLKIEFSIIPVLFGLMIMDLKSAYLILLLRSLLKLFLNNRGVNDFIGLPMNIIAIALFVTAFALVWNRQKTLSQYVFASLLGTGLLTFGMVVLNYTFAIPLYAIFANIDIRAYIGVTKYMMTMVIPFNLVEGLIFAITFYFVYIASKPILERYLH

SEQ ID NO: 3735 - DNA, 924 bp, Streptococcus agalactiae
atgaaaaagattagaaaaagtttaggacttctactatgttgctttttaggattggtacaattagcgtttttttcggtagccagtgtaaatgctgatacccctaatcaactaacaatcacacagataggacttcagccaaatactacagaggaggggatttcttatcgtttatggactgtgactgacaacttaaaagttgatttattgagccaaatgacagatagcgaattgaaccagaagtataagagtatcttgacttctcctactgatactaatggtcagacaaagatagcactcccaaatggttcgtactttggtcgtgcttataaagctgatcaaagcgtttcaacaatagtacctttttatattgaattaccagatgataagttatcaaatcaattacagataaatcctaagcgaaaagttgaaacaggccgattaaaacttattaaatatacaaaagaaggaaagataaagaaaaggctatccggagtaatatttgtattatacgataaccagaatcagccagttcgctttaaaaatggacgatttacgaccgatcaagatgggattacttcattagtaactgatgataagggagaaattgaggttgaaggtttattacctggtaagtatatttttcgagaagcaaaagcactaactggttaccgtatatctatgaaggatgctgtagttgctgtagttgctaataaaacacaggaagtagaggtagaaaacgaaaaagaaactcctccaccaacaaatcctaaaccatcacaaccgctttttccacaatcatttcttcctaaaacaggaatgattattggtggaggactgacaattcttggttgtattattttgggaattttgtttatctttttaagaaaaactaaaaatagcaaatctgaaagaaacgatacagta

SEQ ID NO: 3736 - protein, 308 aa, Streptococcus agalactiae
MKKIRKSLGLLLCCFLGLVQLAFFSVASVNADTPNQLTITQIGLQPNTTEEGISYRLWTVTDNLKVDLLSQMTDSELNQKYKSILTSPTDTNGQTKIALPNGSYFGRAYKADQSVSTIVPFYIELPDDKLSNQLQINPKRKVETGRLKLIKYTKEGKIKKRLSGVIFVLYDNQNQPVRFKNGRFTTDQDGITSLVTDDKGEIEVEGLLPGKYIFREAKALTGYRISMKDAVVAVVANKTQEVEVENEKETPPPTNPKPSQPLFPQSFLPKTGMIIGGGLTILGCIILGILFIFLRKTKNSKSERNDTV

SEQ ID NO: 3737 - DNA, 882 bp, Streptococcus agalactiae
atgggaggaaaatttcagaaaaaccttaagaaatcggtcgttttaaatcgatggatgaatgtaggcttgatactattgttcttagttggtcttttgataacctcatatccttttatttcaaattggtactataatattaaagctaataatcaagtaactaactttgataatcaaacccaaaaattaaatactaaagagattaatagacgatttgagttagcaaaagcttataatagaacactggacccaagccgcctatcagatccctatactgaaaaagaaaaaaaaggtattgctgaatacgcccacatgcttgagattgctgaaatgattggatatattgatataccgtctatcaagcaaaaattacctatctatgcggggactaccagtagtgttcttgaaaaaggagcaggacaccttgaaggaacctccttgccaattggtggaaaaagttcacatactgttatcacagctcatcgcggcttacctaaagctaagttatttacagatttagataaacttaaaaaaggaaaaattttttatattcataatatcaaagaagttttagcctataaggttgatcaaataagtgttgtaaagccagataatttttctaaattattggttgttaaaggtaaggattatgcgactttgctaacatgtacaccttattcgattaattcacatcgtttactagttagagggcatcgaatcaagtatgtacctcctgttaaagaaaagaactatttaatgaaagaattgcaaacacactataaactttatttcctcttatcaatcctagttattcttatattagtcgctttactattatatttaaaacgaaaatttaaagagagaaagagaaagggaaatcaaaaa

SEQ ID NO: 3738 - protein, 294 aa, Streptococcus agalactiae
MGGKFQKNLKKSVVLNRWMNVGLILLFLVGLLITSYPFISNWYYNIKANNQVTNFDNQTQKLNTKEINRRFELAKAYNRTLDPSRLSDPYTEKEKKGIAEYAHMLEIAEMIGYIDIPSIKQKLPIYAGTTSSVLEKGAGHLEGTSLPIGGKSSHTVITAHRGLPKAKLFTDLDKLKKGKIFYIHNIKEVLAYKVDQISVVKPDNFSKLLVVKGKDYATLLTCTPYSINSHRLLVRGHRIKYVPPVKEKNYLMKELQTHYKLYFLLSILVILILVALLLYLKRKFKERKRKGNQK

SEQ ID NO: 3739 - DNA, 753 bp, Streptococcus pyogenes
gtggaatgctatcgtgatcgtcaattgttatcaacttatcacaaacaagtgactcaaaagaagccctcagaaatggaggaggtgtggcaaaaggctaaggcgtataacgctaggcttgggattcagcctgttccagatgctttttcatttagggatggcattcatgataaaaactacgaaagcctacttcaaattgaaaacaatgatattatgggatatgttgaagtgccctctattaaagtgacgttacccatataccactatacgacagacgaggtgctaactaaaggagcaggtcacttatttggaagtgccttaccagttggtggtgacgggactcacacggttatttctgctcatagaggccttccatcggcagaaatgtttactaatttgaatttagtgaaaaagggagatactttttactttcgtgtgttaaataaagtattggcttataaagttgatcagatactaactgttgaaccagatcaagtcacatcactttctggagtcatggggaaagattatgctactttggttacctgcacaccatatggtgttaacaccaagcgtctattggtccgaggtcatagaattgcatatcattataaaaagtatcaacaggctaaaaaagcaatgaaactcgtggataaatcaagaatgtgggcagaagtagtgtgtgctgctttcggggtggttatagctattattttagtgtttatgtattcgcgagtaagtgctaagaaaagcaag

SEQ ID NO: 3740 - protein, 251 aa, Streptococcus pyogenes
VECYRDRQLLSTYHKQVTQKKPSEMEEVWQKAKAYNARLGIQPVPDAFSFRDGIHDKNYESLLQIENNDIMGYVEVPSIKVTLPIYHYTTDEVLTKGAGHLFGSALPVGGDGTHTVISAHRGLPSAEMFTNLNLVKKGDTFYFRVLNKVLAYKVDQILTVEPDQVTSLSGVMGKDYATLVTCTPYGVNTKRLLVRGHRIAYHYKKYQQAKKAMKLVDKSRMWAEVVCAAFGVVIAIILVFMYSRVSAKKSK

SEQ ID NO: 3741 - DNA, 879 bp, Streptococcus agalactiae
gtgaagactaaaaaaatcatcaaaaaaacaaaaaaaaagaagaagtcaaatcttccttttatcattctttttctaataggtctatctattttattgtatccagtggtatcacgtttttactatacgatagaatctaataatcaaacacaggattttgagagagctgctaaaaaacttagtcagaaagaaatcaatcgacgtatggctctagcacaagcttataatgattctttaaataatgtccatcttgaagatccttatgagaaaaaacgaattcaaaagggggtagcagagtacgcccgtatgttagaggtaagtgaaaaaatcggaacaatttcagttcctaagataggtcaaaaactccctatatttgcaggttcaagtcaagaagttctatctaaaggagcagggcatttagaaggtacctctcttccaattgggggcaatagtacacatactgttataacagcgcattcaggaattccagataaagaactcttttctaaccttaaaaagttaaaaaaaggagataagttttatattcaaaacataaaagaaacgatagcatatcaagtagatcagataaaagtcgttacacccgataacttttcagatttgttggttgttcctggacatgattatgcaaccttattgacttgcaccccgattatgatcaatacacacagacttttagtaaggggacatcgtatcccttataaaggtcctattgatgaaaaattaataaaagacggtcatttaaacacgatttatagatatctattctatatatctttagttattattgcttggttactttggttaataaaacgtcaacgtcaaaaaaatcgtttagcaagtgttagaaaaggaattgaatca

SEQ ID NO: 3742 - protein, 293 aa, Streptococcus agalactiae
MKTKKIIKKTKKKKKSNLPFIILFLIGLSILLYPVVSRFYYTIESNNQTQDFERAAKKLSQKEINRRMALAQAYNDSLNNVHLEDPYEKKRIQKGVAEYARMLEVSEKIGTISVPKIGQKLPIFAGSSQEVLSKGAGHLEGTSLPIGGNSTHTVITAHSGIPDKELFSNLKKLKKGDKFYIQNIKETIAYQVDQIKVVTPDNFSDLLVVPGHDYATLLTCTPIMINTHRLLVRGHRIPYKGPIDEKLIKDGHLNTIYRYLFYISLVIIAWLLWLIKRQRQKNRLASVRKGIES

SEQ ID NO: 3743 - DNA, 2115 bp, Streptococcus agalactiae
atgaaaagaatcaacaaatattttgcaatgttctcggcattgttactgactttaacgtcattgctctcagttgcaccagcgtttgcggatgaagcaacaactaatacagtgactttgcacaagattttgcaaaccgaatcaaatcttaacaaaagtaacttcccaggaactacaggtcttaacggaaaagactacaaaggtggagctatttctgaccttgctggttactttggcgagggatctaaagaaatcgaaggtgcgttctttgctttagctttgaaagaagataaaagtggtaaagtgcaatatgttaaggcaaaagaaggtaacaaattaacaccagccttaattaataaagatggtactcctgaaataacagtaaatattgatgaggccgtgtctggattgacaccagagggagatactggacttgttttcaacaccaaaggattgaaaggcgagtttaaaattgttgaagttaaatcaaaatctacttacaacaataatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaacaatcccacaaacaggtggtattggtacaattcttttcacaattattggtttaagcattatgcttggagcagtagttatcatgaaaagacgccaatcaaaggaagct

SEQ ID NO: 3744 - protein, 705 aa, Streptococcus agalactiae
MKRINKYFAMFSALLLTLTSLLSVAPAFADEATTNTVTLHKILQTESNLNKSNFPGTTGLNGKDYKGGAISDLAGYFGEGSKEIEGAFFALALKEDKSGKVQYVKAKEGNKLTPALINKDGTPEITVNIDEAVSGLTPEGDTGLVFNTKGLKGEFKIVEVKSKSTYNNNGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVTIPQTGGIGTILFTIIGLSIMLGAVVIMKRRQSKEA

SEQ ID NO: 3745 - DNA, 2703 bp, Streptococcus agalactiae
atgagaaaataccaaaaattttctaaaatattgacgttaagtcttttttgtttgtcgcaaataccgcttaataccaatgttttaggggaaagtaccgtaccggaaaatggtgctaaaggaaagttagttgttaaaaagacagatgaccagaacaaaccactttcaaaagctacctttgttttaaaaactactgctcatccagaaagtaaaatagaaaaagtaactgctgagctaacaggtgaagctacttttgataatctcatacctggagattatactttatcagaagaaacagcgcccgaaggttataaaaagactaaccagacttggcaagttaaggttgagagtaatggaaaaactacgatacaaaatagtggtgataaaaattccacaattggacaaaatcaggaagaactagataagcagtatccccccacaggaatttatgaagatacaaaggaatcttataaacttgagcatgttaaaggttcagttccaaatggaaagtcagaggcaaaagcagttaacccatattcaagtgaaggtgagcatataagagaaattccagagggaacattatctaaacgtatttcagaagtaggtgatttagctcataataaatataaaattgagttaactgtcagtggaaaaaccatagtaaaaccagtggacaaacaaaagccgttagatgttgtcttcgtactcgataattctaactcaatgaataacgatggcccaaattttcaaaggcataataaagccaagaaagctgccgaagctcttgggaccgcagtaaaagatattttaggagcaaacagtgataatagggttgcattagttacctatggttcagatatttttgatggtaggagtgtagatgtcgtaaaaggatttaaagaagatgataaatattatggccttcaaactaagttcacaattcagacagagaattatagtcataaacaattaacaaataatgctgaagagattataaaaaggattccgacagaagctcctaaagctaagtggggatctactaccaatggattaactccagagcaacaaaaggagtactatcttagtaaagtaggagaaacatttactatgaaagccttcatggaggcagatgatattttgagtcaagtaaatcgaaatagtcaaaaaattattgttcatgtaactgatggtgttcctacgagatcatatgctattaataattttaaactgggtgcatcatatgaaagccaatttgaacaaatgaaaaaaaatggatatctaaataaaagtaattttctacttactgataagcccgaggatataaaaggaaatggggagagttactttttgtttcccttagatagttatcaaacacagataatctctggaaacttacaaaaacttcattatttagatttaaatcttaattaccctaaaggtacaatttatcgaaatggaccagtgaaagaacatggaacaccaaccaaactttatataaatagtttaaaacagaaaaattatgacatttttaattttggtatcgatatatctggttttagacaagtttataatgaggagtataagaaaaatcaagatggtacttttcaaaaattgaaagaggaagcttttaaactttcagatggagaaatcacagaactaatgaggtcgttctcttccaaacctgagtactacacccctatcgtaacttcagccgatacatctaacaatgaaattttatctaaaattcagcaacaatttgaaacgattttaacaaaagaaaactcaattgttaatggaactatcgaagatcctatgggtgataaaatcaatttacagcttggtaatggacaaacattacagccaagtgattatactttacagggaaatgatggaagtgtaatgaaggatggtattgcaactggtgggcctaataatgatggtggaatacttaagggggttaaattagaatacatcggaaataaactctatgttagaggtttgaatttaggagaaggtcaaaaagtaacactcacatatgatgtgaaactagatgacagttttataagtaacaaattctatgacactaatggtagaacaacattgaatcctaagtcagaggatcctaatacacttagagattttccaatccctaaaattcgtgatgtgagagaatatcctacaataacgattaaaaacgagaagaagttaggtgaaattgaatttataaaagttgataaagataataataagttgcttctcaaaggagctacgtttgaacttcaagaatttaatgaagattataaactttatttaccaataaaaaataataattcaaaagtagtgacgggagaaaacggcaaaatttcttacaaagatttgaaagatggcaaatatcagttaatagaagcagtttcgccggaggattatcaaaaaattactaataaaccaattttaacttttgaagtggttaaaggatcgataaaaaatataatagctgttaataaacagatttctgaatatcatgaggaaggtgacaagcatttaattaccaacacgcatattccaccaaaaggaattattcctatgacaggtgggaaaggaattctatctttcattttaataggtggagctatgatgtctattgcaggtggaatttatatttggaaaaggtataagaaatctagtgatatgtccatcaaaaaagat

SEQ ID NO: 3746 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILSFILIGGAMMSIAGGIYIWKRYKKSSDMSIKKD

SEQ ID NO: 3747 - DNA, 996 bp, Streptococcus agalactiae
ttgagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccattactagaaaaacttggatttcagattgtcaaaaatactattaccggtgacgagtatcgaattcgctatttaatcgcatttttaaatgctcaatttggtatagaagtttatcccatgtctaagatggataaattgctcatcaaacgattgttattagaacactcaactacttttactgcttctcattacttcccaaatacatttattttctttgatacattgttgtctctatcatggaaacgtattaattataatgtagttgtcccttactcatcccttttcactgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatctttttttccgaacatttattt

SEQ ID NO: 3748 - protein, 332 aa, Streptococcus agalactiae
MREFTELIENYLEKDILNQIKLLTLCYDYYPSITLDKSCHQLGLSELLIRKYCHDLTTLFNSQLSLNIEKSTIVYQSNGVTREQAFKYIYHQSHVLQLLKFLITNDSGRLPLTYFSEKFGLSCATAYRIRKHISPLLEKLGFQIVKNTITGDEYRIRYLIAFLNAQFGIEVYPMSKMDKLLIKRLLLEHSTTFTASHYFPNTFIFFDTLLSLSWKRINYNVVVPYSSLFTELQNIFIYDTLQYCVKNVIIDSFKINLKKDDIDYIFLAYLTSHNSFSNPNWTEKRIDNVIAIFENYPKFQKLLQPLKDALPLSGSYHDELVKVAIFFSEHLF

SEQ ID NO: 3749 - DNA, 1491 bp, Streptococcus pyogenes
ttgatagaaaaatacttggaatcatcaatcgaatcaaaatgtcagttaattgtcttgttttttaagacatcttatttgccaataactgaggtagcagaaaaaactggcttaacctttttacaactaaaccattattgtgaggaactgaatgcctttttccctggtagtctgtctatgaccatccaaaaaaggatgatatcttgccaatttacacatccttttaaagaaacttatctttaccaactctatgcatcatctaatgtcttacaattactagcctttttaataaaaaatggttcccactctcgtccccttacggattttgcaagaagtcattttttatcaaactcctcagcttatcggatgcgcgaagcattgattcctttattaagaaactttgaattaaaactctctaagaacaagattgtcggtgaggaatatcgcatccgttacctcatcgctctgctatatagtaagtttggcattaaagtttatgacttgacgcagcaagacaaaaacactattcatagctttttatcccatagttccacccaccttaaaacctctccttggttatcggaatcgttttctttctatgacattttattagctttatcgtggaagcggcatcaattttcggtaactattccccaaaccagaatttttcaacaattaaaaaaactttttgtctacgattctttgaaaaaaagtagccatgatattatcgaaacttactgccaactaaacttttcagcaggagatttggactacctctatttaatttatatcaccgctaataattcttttgcgagcttacaatggacacctgagcatatcagacaatattgtcaactttttgaagaaaatgatacttttcgcctgcttttaaatcctatcatcactcttttacctaacctaaaagagcaaaaggctagtttagtaaaagctcttatgtttttttcaaaatcattcttgtttaatctgcaacattttattcctgagaccaacttattcgtttctccgtactataaaggaaaccaaaaactctatacgtccttaaagttaattgtcgaagagtggatggccaaacttcctggtaagcgtgacttgaaccataagcattttcatcttttttgccactatgtcgagcaaagtctaagaaatatccaacctcctttagttgttgttttcgtagccagtaattttatcaatgctcatctcctaacggattcttttccaaggtatttctcggataaaagcattgattttcattcctattatctattgcaagataatgtttatcaaattcctgatttaaagccagatttggtcatcactcacagtcaactgattccttttgttcaccatgaacttacaaaaggaattgctgttgctgaaatatcttttgatgaatcgattctgtctatccaagaattgatgtatcaagttaaagaggaaaaattccaagctgatttaaccaagcaattaaca

SEQ ID NO: 3750 - protein, 497 aa, Streptococcus pyogenes
LIEKYLESSIESKCQLIVLFFKTSYLPITEVAEKTGLTFLQLNHYCEELNAFFPGSLSMTIQKRMISCQFTHPFKETYLYQLYASSNVLQLLAFLIKNGSHSRPLTDFARSHFLSNSSAYRMREALIPLLRNFELKLSKNKIVGEEYRIRYLIALLYSKFGIKVYDLTQQDKNTIHSFLSHSSTHLKTSPWLSESFSFYDILLALSWKRHQFSVTIPQTRIFQQLKKLFVYDSLKKSSHDIIETYCQLNFSAGDLDYLYLIYITANNSFASLQWTPEHIRQYCQLFEENDTFRLLLNPIITLLPNLKEQKASLVKALMFFSKSFLFNLQHFIPETNLFVSPYYKGNQKLYTSLKLIVEEWMAKLPGKRDLNHKHFHLFCHYVEQSLRNIQPPLVVVFVASNFINAHLLTDSFPRYFSDKSIDFHSYYLLQDNVYQIPDLKPDLVITHSQLIPFVHHELTKGIAVAEISFDESILSIQELMYQVKEEKFQADLTKQLT

SEQ ID NO: 3751 - DNA, 1137 bp, Streptococcus agalactiae
atggaaaataaggtaaaaacagttgctgttttctcaggatattatctacccttcctcggaggtattgaacgttatacagataaaatgacagcagatttggttaagcgtggctaccgtgttgttattgtaacaactaatcatggtgatttaccgattatagatgaagacaagggtagaaaaatttaccgtttaccgaccaaaaatattgtcaagcagcgctatcctattattaacaaaaatcgagaatacaacacgctgatgaaatatgtttcagatgaaaatattgattttgtgatttgtaatacacgttttcagttaacaacgctagaagggctatcttttgcaaagaatcaccatttacctagtattgttttagaccatgggtcaagtcatttttctgtcaataatcgttttttagatttctttggagctatctatgaacatcttctcacagcgcgtgttaagcattatcgtccagatttttatgcggtatccaagagaagcgttgaatggttaaaacattttaatatagaagctaaaggagttatttataattcggtatctgaaagtctaggctctgattttgctggtacggcttaccttgaaaaatctgctgatgatattttcatcacttatgctggtagaattattaaagaaaaaggcattgaattgctcttagaagcattttcgatgtcacagtactctgaaaatgtttatttacagattgcaggagacggacctgaattagcacatttgaaagagaaatatcagtccaaacagattaactttttggggaaattaaactttgaacagactatgtctttaatggcacagactgatatctttgtttacccttcaatgtatccagagggattaccaacctctattttagaagctggtctactttcaagtgctattattgcaacagatcgcggtggaacagttgaagttattgatagccctgagttaggaatcatcatggaagaaaatactcagtcactccatgaatctcttgatttattagtaaaagataaggcattaagagagaaactacaacagaatattgctaaaagaattaaagaacatttcacatgggaaaaaacagttgaaaagttggattatattattcaaaaaaat

SEQ ID NO: 3752 - protein, 379 aa, Streptococcus agalactiae
MENKVKTVAVFSGYYLPFLGGIERYTDKMTADLVKRGYRVVIVTTNHGDLPIIDEDKGRKIYRLPTKNIVKQRYPIINKNREYNTLMKYVSDENIDFVICNTRFQLTTLEGLSFAKNHHLPSIVLDHGSSHFSVNNRFLDFFGAIYEHLLTARVKHYRPDFYAVSKRSVEWLKHFNIEAKGVIYNSVSESLGSDFAGTAYLEKSADDIFITYAGRIIKEKGIELLLEAFSMSQYSENVYLQIAGDGPELAHLKEKYQSKQINFLGKLNFEQTMSLMAQTDIFVYPSMYPEGLPTSILEAGLLSSAIIATDRGGTVEVIDSPELGIIMEENTQSLHESLDLLVKDKALREKLQQNIAKRIKEHFTWEKTVEKLDYIIQKN

SEQ ID NO: 3753 - DNA, 846 bp, Streptococcus agalactiae
atgaaatatttagcgggtattgtcacctttaaccccaatattgaacgcttagatcagaacattcgagcaatttatcctcaagtaagccacatctatatcgtagataatggctcgaaaaataaggaagaaatttctcaattagtagccgattataatgaagaggggcacctaactgttgattatttaacagaaaataaagggattgcatatgctttgaactgtatcggtcaatttgcagtagcacaagaatttgattggttcttgactttagatcaagattcggttgtcctaggtgatttgatagataattatgaaaattaccttcatttacctaaggtcggtatgttatcttgtttgtatcaagatatgaaccgtgaaaatttagtgatgcaagaatttgactataaagaaattgaagagtgtattacttcggctgctttaatgaaaacgagcgttttcgaagaaacatctggctttgcagaagagatgtttattgattttgttgactctgaaatgaattatcgtctgtcagagatgggatataagacttatcaggttaattttattggtctgttacacgaaattggacactcttcacgagttaaaaaatttggccatgtttttcatgtattgaatcattcaccatttcgaaaatattacatgatacgcaatgcgatctatattataaaaaaatatggtaagaagaagcgatacaaatatttagtatttatgcgaaatgaatttgttcgagtgttggtagcagaagagcaaaagagcaaaaaaatagttgctatgattaaaggcttaaaagatggcttattgatgaaagtggataaatatggaaaa

SEQ ID NO: 3754 - protein, 282 aa, Streptococcus agalactiae
MKYLAGIVTFNPNIERLDQNIRAIYPQVSHIYIVDNGSKNKEEISQLVADYNEEGHLTVDYLTENKGIAYALNCIGQFAVAQEFDWFLTLDQDSVVLGDLIDNYENYLHLPKVGMLSCLYQDMNRENLVMQEFDYKEIEECITSAALMKTSVFEETSGFAEEMFIDFVDSEMNYRLSEMGYKTYQVNFIGLLHEIGHSSRVKKFGHVFHVLNHSPFRKYYMIRNAIYIIKKYGKKKRYKYLVFMRNEFVRVLVAEEQKSKKIVAMIKGLKDGLLMKVDKYGK

SEQ ID NO: 3755 - DNA, 1422 bp, Streptococcus agalactiae
atgaaacttttgaaaaatatgttttataatacctcataccagttattgactttgttgttacctttagtaacagttccttatgtttcccgtgtactatctcctcaaggcatcggtattaatgcctatacgagctccattgtcatgtactttactttatttggtgctttagggatatctttgtacggtaatcgtgagatagcttttgtgcagtcaaataagtataagagaagtaagatattttgggaattagttgtattaaaacttgcctctgtatctatagcaacgttattattctttggatttgtcttacttacaaacgaatggcaattattctatttaattcaaggtattaatttattagcgactgcaactgatatttcgtggtattttattggagttgaagactttaagataattgtcattcgtaataccattgttaagcttattacagttgttttgaccttcttagttgtgaagacgccagatgacctagcactttatatgtttttaattgcatttgcatcattactcggaaatttaacagtctggcatcatttaaagcatgaaatcatcaagataccatttagtagattagatatcttaatacatctaagaccaactttaatgttatttttaccccaaatcaccatgcagatttatctctctcttaacaagagtatgctgggagcaatggatagtgtggtcagtgctggatattttgatcaatctgataaaattattcgtattttatttaccattgtttcagcaatcggaggagttttcttaccaaggctctccagtctattttcttcaggaaaagaaaagcaagctaaggctttacttttgaaacttgttgatttaagcaatgctatctcaatgttaatgattgcgggagtggtaggagtttcgtcgacatttgccgtcttcttttttgggaaagggtatgaagctgtcggtccgctaatggctgttgagtctttgatgatcatttgcatttcttatggtaacgctttagggacacagtatctactggcttcaagacgtacaaaagcttacacaatgtctgcagttattggacttgtggcaaatgttgtgcttaatatacttttaataccaattttaggtgctatgggagctattatctctacagttattactgaatttattgtctccctatatcaagctatctctttaagagatgtatttacttttaaagaattaacaagaggaatgctgcgctatttaattgctgctactcttagtggagctgtactctattatatcaatactcaaatgtcagtatcattggtaaattatgtcattcaaagtttagtagcagtaactatctatgtcggtatcgtttttataaccaaagcaccagtcattcagttatttagagattttagaaaagagcatagaaca

SEQ ID NO: 3756 - protein, 474 aa, Streptococcus agalactiae
MKLLKNMFYNTSYQLLTLLLPLVTVPYVSRVLSPQGIGINAYTSSIVMYFTLFGALGISLYGNREIAFVQSNKYKRSKIFWELVVLKLASVSIATLLFFGFVLLTNEWQLFYLIQGINLLATATDISWYFIGVEDFKIIVIRNTIVKLITVVLTFLVVKTPDDLALYMFLIAFASLLGNLTVWHHLKHEIIKIPFSRLDILIHLRPTLMLFLPQITMQIYLSLNKSMLGAMDSVVSAGYFDQSDKIIRILFTIVSAIGGVFLPRLSSLFSSGKEKQAKALLLKLVDLSNAISMLMIAGVVGVSSTFAVFFFGKGYEAVGPLMAVESLMIICISYGNALGTQYLLASRRTKAYTMSAVIGLVANVVLNILLIPILGAMGAIISTVITEFIVSLYQAISLRDVFTFKELTRGMLRYLIAATLSGAVLYYINTQMSVSLVNYVIQSLVAVTIYVGIVFITKAPVIQLFRDFRKEHRT

SEQ ID NO: 3757 - DNA, 120 bp, Streptococcus agalactiae
atgactaaaagaatcaatcctataagagcaatactaagatttttagtcaacgatttatcaactaaaagatttatcaaaagcgataaaaatgctccaaatacaatatatccagtcgagtca

SEQ ID NO: 3758 - protein, 40 aa, Streptococcus agalactiae
MTKRINPIRAILRFLVNDLSTKRFIKSDKNAPNTIYPVES

SEQ ID NO: 3759 - DNA, 117 bp, Streptococcus agalactiae
atgagggcaaccaaggtgattgagacaaaggaactaaataaccttgctactgtaatcattacccccatagaaggatacacaaatttgcctaaaaataagccaactgctggcacaaga

SEQ ID NO: 3760 - protein, 39 aa, Streptococcus agalactiae
MRATKVIETKELNNLATVIITPIEGYTNLPKNKPTAGTR

SEQ ID NO: 3761 - DNA, 1362 bp, Streptococcus agalactiae
atgaacctcaaaaaagttcgtctatttgaaaagttttttctagacaagaacttgcataaaacatattttatattaggcttaacgattactattgtattgagcctattaatgccatttttcaatgaacctgatggacaataccatttagctgtgtctggtcgtatttcaaataacattattgatacttcttactatggagaatataatattgattcaggtatgagacgacaatcgacctcctatagagatggtactagatttgaaaaatactatttaaataaagccaattttgttgatggtaatcatttgcctcgtgagataaactattctaaacataactttgttttttggggtcatcttgtgccagcagttggcttatttttaggcaaatttgtgtatccttctatgggggtaatgattacagtagcaaggttatttagttcctttgtctcaatcaccttggttgccctcattatccggtatgtgaaaaaaggaaagttaatctactttgctattttcctcagtcccgtagttctaaattcatttgctagtctatcttatgactcgactggatatattgtatttggagcatttttatcgcttttgataaatcttttagttgataaatcgttgactaaaaatcttagtattgctcttataggattgattcttttagtcattgttgcatgtaagcagaattactggctgtttttattgctagtaataccggtattattgcaggttaacaatcctaaattaatgggctataatcagaagctatcacatttatttcaaggtcttaaatctaaaaagctattttggctatgtctaacctttttgtcacttgctatagtttatgttctgaccgcaagacatggtggtgtccttgctgttttaagacgttatgtaatgacatttggctataattatgctggtatcaatattttaagtaatgacattacttcctggcttgcctctccatatccaagtcagaattttattcccacttgggtatcatcagtatggtatctcatggtctttctagtatggttttctgaagaaaaatttgttaagtcaaaaaatatgggatttcttttcttagctagtttctttgtgggaattcttggtgtcttttttatcatgttagaatatcgtggagcgccaacaagctacattgaaggagttcaaggacgttactttactgttacattgcttttggtacaagtttttgcatcaagtattccagcgcgtctaaatgaggcaggaaggaaagtggtgccgtatgcgttaactggcttggtaattgtatcaaatgccttattgttatttgatactgttattagtttaattatgaggagaaac

SEQ ID NO: 3762 - protein, 454 aa, Streptococcus agalactiae
MNLKKVRLFEKFFLDKNLHKTYFILGLTITIVLSLLMPFFNEPDGQYHLAVSGRISNNIIDTSYYGEYNIDSGMRRQSTSYRDGTRFEKYYLNKANFVDGNHLPREINYSKHNFVFWGHLVPAVGLFLGKFVYPSMGVMITVARLFSSFVSITLVALIIRYVKKGKLIYFAIFLSPVVLNSFASLSYDSTGYIVFGAFLSLLINLLVDKSLTKNLSIALIGLILLVIVACKQNYWLFLLLVIPVLLQVNNPKLMGYNQKLSHLFQGLKSKKLFWLCLTFLSLAIVYVLTARHGGVLAVLRRYVMTFGYNYAGINILSNDITSWLASPYPSQNFIPTWVSSVWYLMVFLVWFSEEKFVKSKNMGFLFLASFFVGILGVFFIMLEYRGAPTSYIEGVQGRYFTVTLLLVQVFASSIPARLNEAGRKVVPYALTGLVIVSNALLLFDTVISLIMRRN

SEQ ID NO: 3763 - DNA, 945 bp, Streptococcus agalactiae
atggtaaaaacagcagttttgatggcaacatataatggtcaaggtttcatccacgatcagctagattcaattagaaatcaaacgttgagaccagactatgtcttaatgagggacgatggctctactgatgatactgtaaaggtggttgaagactatataaaagagcaccgtttagatggttggtcaataactagtaatgataaaaatttaggttggcgtttaaattttcgtcaattacttattgatgtgttagcctatgaggttgactatgtcttttttagtgatcaagatgacacatggtatcatcataaaaataagatgcaagttgatattatggaagaacgccaagatataaaccttcttagcgccgatattgatatcaaaaagttatcagaagaggctactattcccaataattttaagttcaatggtgaggaaacaatttctaagtatccattagacttttcatatcataactatcgtcaaggttggactttttgtttacgcaagtcgtttgttgatcaagtaatgactttttacagtgataatttaattttgtcacatgataatctttttgcaggggtatctggtgtcattggttcaggttacaatttaaacagaagtgttggtgaacataagcgacatgctgagaatgcaagtgggaatatcttgaatatgagctcaagttacgaaaggcatttacaagaactgtattttgttttgagttactatatcatccttgtaccatttttagaaaaaagtagctctagtcaattaagggaagctaaagcttatctggattttaatcagcaacgttataaaaatgctcaaaataaagattttgtagcaatacttaaacaaatgatgactaaaaaacggttctatgatagcttttcaaatcgcattcgtgacttggtgtttttattaaaagatataaaaaggagt

SEQ ID NO: 3764 - protein, 315 aa, Streptococcus agalactiae
MVKTAVLMATYNGQGFIHDQLDSIRNQTLRPDYVLMRDDGSTDDTVKVVEDYIKEHRLDGWSITSNDKNLGWRLNFRQLLIDVLAYEVDYVFFSDQDDTWYHHKNKMQVDIMEERQDINLLSADIDIKKLSEEATIPNNFKFNGEETISKYPLDFSYHNYRQGWTFCLRKSFVDQVMTFYSDNLILSHDNLFAGVSGVIGSGYNLNRSVGEHKRHAENASGNILNMSSSYERHLQELYFVLSYYIILVPFLEKSSSSQLREAKAYLDFNQQRYKNAQNKDFVAILKQMMTKKRFYDSFSNRIRDLVFLLKDIKRS

SEQ ID NO: 3765 - DNA, 945 bp, Streptococcus agalactiae
ttgaggagtaatatggtaaagacagcagttttaatggcgacatacaatggcgaaatatttatatctgaacaacttgattcaattcgccaacagacattaaaaccagattatgtattattgagggatgattgttcaacggatgaaacagtcaatgtcgtcaataactatatcgcaaaacatgagttagaaggctggaaaattgttaaaaacgacaaaaacttaggctggcgtttaaattttcgtcaattacttattgatgtgttagcctatgaggttgactatgtcttttttagtgatcaagatgatatttggtatcttgataaaaacgaacgacagtttgccattatgtcagataaacctcaaattgaggttttgagtgcagacgttgatatcaaaacgatgtctacagaagccagtgttccacattttctaactttttcttctagtgatagaatcagtcagtatcctaaagtatatgattatcaaacattccgtcccggatggaccattgctatgaagagagattttgcgcaagctatcgctgataattggacttttggagctaatatttcgcacgataatcttatcgagacaactgccagtattattggaaatggttataaccttaacgaaagcgtaggagttcatattcgatatggaggaaacgcaagtggtaatagcaaatttgttttgaattggaagtcgcctaaaacacaacatatcacaggattaaaaacatttgttgatttttacgaaaccatgcagaaggttgtcaacaaatatcaaaatgatgtcgctttaaatcaacgcttagcctttgaaaaagaaagattggaagcttctaaattgtcattaattcataatagtgcttttgtgattaaaaattggcgactctataactctaatagtggacgtatgagagatttattatttgcgtttaaaaag

SEQ ID NO: 3766 - protein, 315 aa, Streptococcus agalactiae
MRSNMVKTAVLMATYNGEIFISEQLDSIRQQTLKPDYVLLRDDCSTDETVNVVNNYIAKHELEGWKIVKNDKNLGWRLNFRQLLIDVLAYEVDYVFFSDQDDIWYLDKNERQFAIMSDKPQIEVLSADVDIKTMSTEASVPHFLTFSSSDRISQYPKVYDYQTFRPGWTIAMKRDFAQAIADNWTFGANISHDNLIETTASIIGNGYNLNESVGVHIRYGGNASGNSKFVLNWKSPKTQHITGLKTFVDFYETMQKVVNKYQNDVALNQRLAFEKERLEASKLSLIHNSAFVIKNWRLYNSNSGRMRDLLFAFKK

SEQ ID NO: 3767 - DNA, 1056 bp, Streptococcus agalactiae
atgatgattaaatttagtaataaaattgtacaagaagatttagcacttattagtaaccaaaattatattaattgggaaagaattgctaataaaggcgttttaataagtggttctaatagtatgttagcgagttatatggtatttttactagcctatctcaatgagacaagaaattaccaaacgcaaattattgcgacagctagaaacattgaaaaagcccgtgataaattttcagatttagttgggaaagattatttcaccttaattccttatgatgtagaagaacgcctagagtatgatggaaaagtggattacattatccatgcagcaagcaatgctagtccaactgctattttgagtaatcctgttagcatcataaaagctaatacaattggtacattgaatttattagactttgcaaaggaaaaaacaattgaaaacttcttgttcttatcaacgcgtgaagtatatggaacatctattaaagaagtgattgatgaagaagcttatggtggatttgatattttagctactagagcttgttacccagaaagcaaacgtatggctgaaactctactgcaaagttactatgatcaatataaggtaccctttactattgctcgtattgcacattcatttggtcctggtatggagcttggtaacgatggtcgtattatgaatgatcttttatcgaatgtcattgatggcaaagatatcgttttaaaaagtagtggtacagcagagcgtgctttctgttatttagcagatgctgtatcagggttatttactattttattaaatggtgaagttggtcaagcttacaatgtagcaaatgaagatcaacccattatgattaaggatttggcacaaaagttagttgatctcttttctgataaaaatatttcagtagtattcgatattcctaaaactatgagtgcaggttatagcaaaatggggagaacacgtctcactatggccaaattagaagcgttgggatggaagcgagaagtttctcttgaatctggaatattaaaaacagtacaagcatttgaggag

SEQ ID NO: 3768 - protein, 352 aa, Streptococcus agalactiae
MMIKFSNKIVQEDLALISNQNYINWERIANKGVLISGSNSMLASYMVFLLAYLNETRNYQTQIIATARNIEKARDKFSDLVGKDYFTLIPYDVEERLEYDGKVDYIIHAASNASPTAILSNPVSIIKANTIGTLNLLDFAKEKTIENFLFLSTREVYGTSIKEVIDEEAYGGFDILATRACYPESKRMAETLLQSYYDQYKVPFTIARIAHSFGPGMELGNDGRIMNDLLSNVIDGKDIVLKSSGTAERAFCYLADAVSGLFTILLNGEVGQAYNVANEDQPIMIKDLAQKLVDLFSDKNISVVFDIPKTMSAGYSKMGRTRLTMAKLEALGWKREVSLESGILKTVQAFEE

SEQ ID NO: 3769 - DNA, 741 bp, Streptococcus agalactiae
ttggtactggaaagaaggttaatgatgaatattggagttatttttgcaggtggtgttggtcgtcgcatgaataccaaaggtaaaccaaagcaattcctagaagtgcatggtaaacccattattgtacacacaattgatattttccaaaatacagaagctattgatgctgtagtagttgtctgtgtatcagactggctagattatatgaataatctggtagagcgtttcaaccttacgaaagtaaaagcagttgttgcaggtggagaaactggccaaatgtcaatttttaaggggcttgaagccgctgaacagctggctacagatgatgccgttgttttaattcatgacggagtacgtccattgattaatgaagaagttattaatgctaatatacagtcagtaaaagaaacaggaagtgcggtaacttcagttcgtgctaaagagacagttgttctagtcaatgattcttctaaaatatctgaagttgttgatcgtactcgttccttcattgctaaagcgccacaaagtttttatctatcagatatcctttctgttgaacgtgatgccattagcaaagggattactgatgcaattgattctagtactttgatgggtatgtacaatcgtgaactcactattgttgagggaccatatgaaaatatcaagataacaacaccagatgatttttatatgtttaaagctttgtatgatgctagagaaaatgaacaaatttatgggatg

SEQ ID NO: 3770 - protein, 247 aa, Streptococcus agalactiae
MVLERRLMMNIGVIFAGGVGRRMNTKGKPKQFLEVHGKPIIVHTIDIFQNTEAIDAVVVVCVSDWLDYMNNLVERFNLTKVKAVVAGGETGQMSIFKGLEAAEQLATDDAVVLIHDGVRPLINEEVINANIQSVKETGSAVTSVRAKETVVLVNDSSKISEVVDRTRSFIAKAPQSFYLSDILSVERDAISKGITDAIDSSTLMGMYNRELTIVEGPYENIKITTPDDFYMFKALYDARENEQIYGM

SEQ ID NO: 3771 - DNA, 822 bp, Streptococcus agalactiae
atgaaagaaatgacggtctcagaaataagagaagttcaacttgaaatgttagcttatattgataaagttgcgcgtgataataaaattgaatattctttaggcggaggcagcctactgggagcaatgagacataaaggattcattccatgggatgacgatattgatttgatgctagaaagaagccagtatgagcgtttgatgaaagcattagctgatgctaataatagcgattttaaattgctacatcattctgttgaaaaaaatctatggccatttgccaagctgtatcacacaaagtcaatgtacttaagtaaaacagatagaattcatccttggacagggatttttattgatatcttcccacttgaccgattaccagagagtgcagaagaacgtcaaagattctttaaaaaagttcactctgctgctgcaaatttgatgtgtacgacttaccccaattttgctagcggttcccgaaagctttatgcaaatgcaaggctaattttggggctaccccgattcatcgcttatcacggccaagctaaaaaacgtgctgaaattgttgatcaagtgatggaaacatataataatcaagaggttccttacatgggttataccgattcaagatatcgcttgaaagaatattttccaagagaaattttttctgagtatgaagatgttatgtttgaaaacattaaaacccgaaaaattaaaaatgagcatgcttatctgaatcaattatatgggggtagttatatggaattacctccagaaagtaagagagaaagtcatagttattacacttggtactggaaagaaggt

SEQ ID NO: 3772 - protein, 274 aa, Streptococcus agalactiae
MKEMTVSEIREVQLEMLAYIDKVARDNKIEYSLGGGSLLGAMRHKGFIPWDDDIDLMLERSQYERLMKALADANNSDFKLLHHSVEKNLWPFAKLYHTKSMYLSKTDRIHPWTGIFIDIFPLDRLPESAEERQRFFKKVHSAAANLMCTTYPNFASGSRKLYANARLILGLPRFIAYHGQAKKRAEIVDQVMETYNNQEVPYMGYTDSRYRLKEYFPREIFSEYEDVMFENIKTRKIKNEHAYLNQLYGGSYMELPPESKRESHSYYTWYWKEG

SEQ ID NO: 3773 - DNA, 1731 bp, Streptococcus agalactiae
atgagtaaaaaacatatttttatttgtctgtttttcatgctttttttagtaggttgccaaaataataaaaaagtaaaaacagataaaaaagtagatattacagcttattattatcataataataccccgcaatacagtgttcagattaatgctattcatttacaaacagcattggataaagtgaggacgggggagtttgagagcaaagactttacacactatacttttgatagtatcaagcggaagtaccaagttagtggtaaaaaagtccttatggataataactatagatttggttctggtataaaaaatactagacaggatgctattgctattgtaaggttactgcttgaaaagaataaagattatttaatttacatgaatggcttagaagagccaagtgttttatataatccagaaaataaacgttataagttcacaaataacaaaggaaaagcaattggtaatattccagttggtttaactgcttttgaaaacagcgcagaaactcaagaatatgtgttgaaaaatattcagaaaaacgaaacgatttatcttggtaatacccgagtagataatcctcgagtaactgttaataacaaaaaaagagatactataggagttgaatacggtaaacgtattacttataggattccaatttattcaaagcagctgactgtcagagttagccctaattttgtagtagatagtactaattataattaccgactttctcaagcgcctattattgcggaagaaggtaaagagggacgtttgtatccaatagatagcagtattagtgtcgatggtgataaaattgttttaaatagtagtggtgatgaaacagagcaaaaagaattattacaaaatagcctgtataaacttcactctattgataagttagactttgatttgacaaatgctgatattaaagagttagagattacaggacatgttgcttcaaaaagagattataatttgtctgttgctcaggaaaagaaaggcgtcatagagactaaacggagtctaatttctgttgataatcaaaaacaagatcaagggatttttgtcgaggattctaaaggctatataaagacacctagtttgagcagttatggtataaattttgccatgtatgacgacaatcaaaatagattattacaaggttcagagtatattttaggaagattgaatgcagataaaaaagtatctctatatcaacctaatggcttttggataaatactcaaaaaacgattaagagtttaaataaagaatatcttaaccaaaatgcttaccatattagaggaaataacattataggtattgatggctattcaaatgacatagacttgaatcctaggttatgggcttataactataaaaaacaagtgaaaagtaaccaatcattatttaaattacgaggtttgtctaataaatataagtatttcttaatacagacaaaatctccaaaaggctacttacaaagcaataaaccattttattttacagtaaataaagatagtgtttctaaagcacaatttggtaactataatataaatggttatataatggacatgcagtacaacaaacaagaatacaatgcacttgcaaacactccaaaaggtcaaaaaacaaagaaaactttcaaacccatgaccctagtgattctttttgcagtagctttatttattttctatattacagctataagatttgtatttaaaagaatg

SEQ ID NO: 3774 - protein, 577 aa, Streptococcus agalactiae
MSKKHIFICLFFMLFLVGCQNNKKVKTDKKVDITAYYYHNNTPQYSVQINAIHLQTALDKVRTGEFESKDFTHYTFDSIKRKYQVSGKKVLMDNNYRFGSGIKNTRQDAIAIVRLLLEKNKDYLIYMNGLEEPSVLYNPENKRYKFTNNKGKAIGNIPVGLTAFENSAETQEYVLKNIQKNETIYLGNTRVDNPRVTVNNKKRDTIGVEYGKRITYRIPIYSKQLTVRVSPNFVVDSTNYNYRLSQAPIIAEEGKEGRLYPIDSSISVDGDKIVLNSSGDETEQKELLQNSLYKLHSIDKLDFDLTNADIKELEITGHVASKRDYNLSVAQEKKGVIETKRSLISVDNQKQDQGIFVEDSKGYIKTPSLSSYGINFAMYDDNQNRLLQGSEYILGRLNADKKVSLYQPNGFWINTQKTIKSLNKEYLNQNAYHIRGNNIIGIDGYSNDIDLNPRLWAYNYKKQVKSNQSLFKLRGLSNKYKYFLIQTKSPKGYLQSNKPFYFTVNKDSVSKAQFGNYNINGYIMDMQYNKQEYNALANTPKGQKTKKTFKPMTLVILFAVALFIFYITAIRFVFKRM

SEQ ID NO: 3775 - DNA, 93 bp, Streptococcus agalactiae
ttggtattgctactagtatcaaataattctaaacaaaacagaaataaaatagcaccaaataacaagaaattcatcgttaaagcgaatccaagg

SEQ ID NO: 3776 - protein, 31 aa, Streptococcus agalactiae
MVLLLVSNNSKQNRNKIAPNNKKFIVKANPR

SEQ ID NO: 3777 - DNA, 759 bp, Streptococcus agalactiae
ttgcaacaaattattacaataagagataagatgatgaaaaaaattttactagtgatacctgcttataatgaagaaggtagtattgcaaagacagtccagactattgtagattttaaggcgtctcgctcactaccttttgagctggattatattgttattaacgatgggtcaaccgatggtactccagagttattagatagattgggtttaaatcatattgaccttgttcaaaatctaggtattggtggctgtgtgcagacaggatacttatacgctaatcgtaatcattacgatgttgccgttcaatttgatggtgatggtcaacatgatattagaagcattgaagatgttgttatgccaatcttaaatgacgaagcagattttgttattggttctcgctttgttgataaaaaacatcaaaattttcaatcgacagcaatgaggcgtcttggcataaatttaatatctgctgctataaaattaacgacgggacacaaagtctatgatacaacaagtggttatagggcagccaacgcggcgctaatagcttatttatcgtgtcattatccagtacaatacccagagcctgaatcaactgctcggattttgaaaaaaggctatcgtttgaaggaagtcacagctaatatgtttgaacgtgaggcaggtacttcaagtataagttccctaaaatcgattttttatatgacggatgttttaacatcaattattattgcagggtttattaaggaggatgataaa

SEQ ID NO: 3778 - protein, 253 aa, Streptococcus agalactiae
MQQIITIRDKMMKKILLVIPAYNEEGSIAKTVQTIVDFKASRSLPFELDYIVINDGSTDGTPELLDRLGLNHIDLVQNLGIGGCVQTGYLYANRNHYDVAVQFDGDGQHDIRSIEDVVMPILNDEADFVIGSRFVDKKHQNFQSTAMRRLGINLISAAIKLTTGHKVYDTTSGYRAANAALIAYLSCHYPVQYPEPESTARILKKGYRLKEVTANMFEREAGTSSISSLKSIFYMTDVLTSIIIAGFIKEDDK

SEQ ID NO: 3779 - DNA, 693 bp, Streptococcus pyogenes
gtgaaaaagttaatcattattcctgcttacaatgaaagcagtaatattgtcaatactatacgtactattgaatcagatgccccggattttgactatatcattattgatgattgctcaacggataatacgttagcaatatgtcaaaaacaggggttcaatgttatttctttgcccattaacctgggaattggcggtgcggtgcaaactggctatcgttatgcacaaagatgtggatatgacgttgcagttcaagtagatggagatggtcagcacaatccatgctatttggaaaaaatggttgaggtattagttcaatcttcagtaaatatggtaattggatcacgatttatcacaaaagaagggtttcagtcatcatttgctcgacgtatcggcataaagtattttacttggcttattgcgctactaacaggaaaaaaaataacagatgcaacgtcaggtctaaggttaattgaccgttcattgattgaacgttttgctaatcattatccagatgattatcctgaacctgaaacagttgttgatgtattggttagtcattttaaagtgaaagaaattcctgttgtaatgaatgagcgacaaggcggtgtgtcatctatctcgttgacgaaatcggtctattatatgattaaagtgactttagctattttagttgttagattgaaaggaaatcgt

SEQ ID NO: 3780 - protein, 231 aa, Streptococcus pyogenes
VKKLIIIPAYNESSNIVNTIRTIESDAPDFDYIIIDDCSTDNTLAICQKQGFNVISLPINLGIGGAVQTGYRYAQRCGYDVAVQVDGDGQHNPCYLEKMVEVLVQSSVNMVIGSRFITKEGFQSSFARRIGIKYFTWLIALLTGKKITDATSGLRLIDRSLIERFANHYPDDYPEPETVVDVLVSHFKVKEIPVVMNERQGGVSSISLTKSVYYMIKVTLAILVVRLKGNR

SEQ ID NO: 3781 - DNA, 939 bp, Streptococcus agalactiae
atgaaagttaatattttaatggccacctacaatggagagaagtttctggcgcagcaaatcgaaagtatccaaaagcaaacctttaaagagtggaacctcctaatcagagatgatggttcaagtgacaagacatgtgatattattagaaactttactgctaaagattctcgaattcgtttcattaatgaaaatgagcaccataatttaggagttattaaatcattttttacgctagttaattacgaagttgcagatttctatttttttagtgatcaagatgatgtatggttgccagaaaagttatctgtaagtttagaggcagcaaagcataaagcatctgatgtaccattacttgtttatactgatttgaaagttgttaatcaagaattaaatattttacaagacagcatgattcgggctcaatcgcaccatgccaatacgacattattaccagaactaactgagaatactgttactggtgggactatgatgataaatcatgcattagctgagaagtggtttactcctaatgatatcttaatgcatgattggtttttagcactcttagcagcaagtttaggagaaatcatttatttggatttaccaactcaactataccgtcaacatgacaataatgttttgggggcgaggacaatggataagagatttaagatacttcgtgaaggtcctaaatctatatttacaaggtattggaaacttatccatgactcacaaaagcaagcttccttaattgttgataagtatggtgatattatgacagctaatgatcttgagctcattaaatgttttataaaaattgacaaacagccttttatgacaagattaaggtggttatggaaatatggttatagcaaaaatcaatttaagcatcaagttgtgtttaaatggttgattgcaacaaattattacaataagaga

SEQ ID NO: 3782 - protein, 313 aa, Streptococcus agalactiae
MKVNILMATYNGEKFLAQQIESIQKQTFKEWNLLIRDDGSSDKTCDIIRNFTAKDSRIRFINENEHHNLGVIKSFFTLVNYEVADFYFFSDQDDVWLPEKLSVSLEAAKHKASDVPLLVYTDLKVVNQELNILQDSMIRAQSHHANTTLLPELTENTVTGGTMMINHALAEKWFTPNDILMHDWFLALLAASLGEIIYLDLPTQLYRQHDNNVLGARTMDKRFKILREGPKSIFTRYWKLIHDSQKQASLIVDKYGDIMTANDLELIKCFIKIDKQPFMTRLRWLWKYGYSKNQFKHQVVFKWLIATNYYNKR

SEQ ID NO: 3783 - DNA, 1182 bp, Streptococcus agalactiae
atggattgtttagctagaatggagaagatgatgcaagatgttttcattataggaagtagagggttgccagctcgttacggtggttttgaaacttttgtttcagaattgattaatcatcaaaaaagtttcgacataaaataccatgttgcatgccttagtgataaagaacatcatactcattttaactttgctgacgctgattgttttactataaatcctccccaattagggccagcacgtgtgattgcttatgatattatggccattaattatgcccttgacttggttaagacacatgatttaaaagagcctattttttatattttaggaaatacaattggtgcctttatttggcattttgccaataaaatacataaagtcggtggcttattgtatgttaatccggatggtttagagtggaagcgatcaaagtggtctcgtcccacacagcgttatttaaaatacgccgaaaaatgtatgactaaaaatgcagacctaattatttctgataatattggtattgaaaattacattcaatctacctactctaatgtgaagacaaggttcattgcttacggtacagagattaattctaggaaattatcgtcagatgatccacgtgtcaaacagttgtttaaaaaatggaatattaagtctaagggttactatctaatcgttggtcgatttgtccctgaaaacaattatgaaacggctattagggagttcatggcttcagatactaagcgtgatttagttattatctgtaaccatcaaaataacccctactttgaaaagttgtccttaaagacaaaccttcaacaagataaaagagttaagtttgtaggtacgctctatgaaaaagatctgctggattatgttcgtcaacaagcctttgcttatattcatgggcatgaagttggcggtactaatccaggactgcttgaggctttagctaatactgatttgaatcttgttctagatgttgatttcaacaaatcagtagcaggtctctcaagtttttactgggctaaaaaagagggggatttagctaagcttattaacgatagtgatcaacaacaggatttatctacttacggtgatcgagcaaaagccattattcaagaaaactatacttggaaaaaaattgttgaagaatatgaggatttgtttttaaatgaaagt

SEQ ID NO: 3784 - protein, 394 aa, Streptococcus agalactiae
MDCLARMEKMMQDVFIIGSRGLPARYGGFETFVSELINHQKSFDIKYHVACLSDKEHHTHFNFADADCFTINPPQLGPARVIAYDIMAINYALDLVKTHDLKEPIFYILGNTIGAFIWHFANKIHKVGGLLYVNPDGLEWKRSKWSRPTQRYLKYAEKCMTKNADLIISDNIGIENYIQSTYSNVKTRFIAYGTEINSRKLSSDDPRVKQLFKKWNIKSKGYYLIVGRFVPENNYETAIREFMASDTKRDLVIICNHQNNPYFEKLSLKTNLQQDKRVKFVGTLYEKDLLDYVRQQAFAYIHGHEVGGTNPGLLEALANTDLNLVLDVDFNKSVAGLSSFYWAKKEGDLAKLINDSDQQQDLSTYGDRAKAIIQENYTWKKIVEEYEDLFLNES

SEQ ID NO: 3785 - DNA, 1152 bp, Streptococcus pyogenes
atgcaggatgtttttatcattggtagcagagggttaccagcgaaatacggtggctttgaaacctttgtcgaagagttgattagtcatcaatcatctaaaaacattcgttatcatgttgcttgtttaagcgatacgaagcataaggttcattttgattataagggggcagattgcttttaccttaatcccccaaaacttggtcctgctagagttattgcttatgatatgatggcaattacctatgccctgtcttatagcgaccaacaccagattcagaaccctattttttatgtgttgggcaatactgtaggcgcttttattgcgccatttgtgaagcagattcacaatcgaggtggacgcttttttatcaatccagacgggttagagtggaaacggtctaaatggtcaagaccagtgcaggcctacctgaagttttccgaaaagcaaatgactagacaggctgatttggtcatttcagataatattggcattgaccgctaccttaaacaagtttatccttggtctaaaacatgttttattgcttatggaacgcagacacaaccttcacgtttggcaacagcagatagcaaggtcagagcttattttcaaacctttgatattagagaaaaggattactatctcattttaggacgctttgttcctgaaaataattacgaaaccgctattaaagaatttatggcttcctcaactaagcgtgatttagtgattatttgtaatcatgaaggcaatgcttactttaagcaattacttgctgagacagagtgtgataaagacccacgcattaaatttgttggtaccctttatgacaaagaactattagcctacattcgagaacaggcttatgcctatatccatggtcatgaggtaggagggactaatccaggccttctagaagcactagcccataccaatcttaatttggttttaggagttgattttaaccagtcggtggctaagtctgctgcgctttattggaccaagcaaaaagggcaattagcagagctgattaaccaagttgatgcaggttttgatagtgatcatctgggcaaagaagccaaagctattattcaagaacattacacttgggaaaaaattgtaggggagtacgaggctttatttttaaatgaacat

SEQ ID NO: 3786 - protein, 384 aa, Streptococcus pyogenes
MQDVFIIGSRGLPAKYGGFETFVEELISHQSSKNIRYHVACLSDTKHKVHFDYKGADCFYLNPPKLGPARVIAYDMMAITYALSYSDQHQIQNPIFYVLGNTVGAFIAPFVKQIHNRGGRFFINPDGLEWKRSKWSRPVQAYLKFSEKQMTRQADLVISDNIGIDRYLKQVYPWSKTCFIAYGTQTQPSRLATADSKVRAYFQTFDIREKDYYLILGRFVPENNYETAIKEFMASSTKRDLVIICNHEGNAYFKQLLAETECDKDPRIKFVGTLYDKELLAYIREQAYAYIHGHEVGGTNPGLLEALAHTNLNLVLGVDFNQSVAKSAALYWTKQKGQLAELINQVDAGFDSDHLGKEAKAIIQEHYTWEKIVGEYEALFLNEH

SEQ ID NO: 3787 - DNA, 852 bp, Streptococcus agalactiae
atgattttaattacaggggcaaacgggcaattaggtagtgaattacgtcaccttttagacgaacgaactcaagagtatgttgctgttgatgtagctgaaatggatattacaaatgccgagatggtggacaaagtctttgaagaggtgaagccatctttagtttaccattgtgcagcttacacagctgttgatgcggcagaagatgaaggaaaagagctagactttgcaatcaatgtcactggtacagagaatgtcgctaaggctgctgctaaacatgatgcaacacttgtttacatttcgacggactacgtgtttgatggtgaaaaaccagtggggcaagaatgggaagtagatgatctgcctgatcccaaaacagagtacggtcgtacaaaacgtatgggtgaagagttagttgaaaaatatacttcaaaattctataccattcgcacagcgtgggtatttggtaactatggtaaaaactttgtctttacgatgcaaaaccttgcaaaaacacacaaaactctaactgttgttaacgaccaacatggacgaccaacatggacacgtactttggctgagtttatgacttatttagctgaaaatcaaaaagattttggttactatcatttatcaaatgatgctaaagaagatacaacatggtatgattttgcggttgaaatcttaaaagacacagatgtggaggttaagcctgttgattctagtcaattcccagcaaaagcaaaacgtcctttaaattcaactatgagtttggaaaaagcgaaagcaacaggatttgtgattcctacttggcaagatgctttaaaagagttctacaagcaggaagttaaaaaa

SEQ ID NO: 3788 - protein, 284 aa, Streptococcus agalactiae
MILITGANGQLGSELRHLLDERTQEYVAVDVAEMDITNAEMVDKVFEEVKPSLVYHCAAYTAVDAAEDEGKELDFAINVTGTENVAKAAAKHDATLVYISTDYVFDGEKPVGQEWEVDDLPDPKTEYGRTKRMGEELVEKYTSKFYTIRTAWVFGNYGKNFVFTMQNLAKTHKTLTVVNDQHGRPTWTRTLAEFMTYLAENQKDFGYYHLSNDAKEDTTWYDFAVEILKDTDVEVKPVDSSQFPAKAKRPLNSTMSLEKAKATGFVIPTWQDALKEFYKQEVKK

SEQ ID NO: 3789 - DNA, 912 bp, Streptococcus pyogenes
atgttagagaacactaagatactgagaaaagtgttctacctatggcaaaaaggagaactgatgattttaattacaggaagcaatggtcaattagggacagaacttcgatacttattagatgaacgaggtgttgattatgtagccgttgatgtcgcagaaatggacatcacaaatgaagacaaagtcgaagctgtttttgcgcaggtcaagccaacattggtctatcattgtgctgcttatacggcagttgatgcagcagaagacgaaggaaaagccttgaatgaggctattaatgtaacaggctcagaaaatattgccaaggcttgtggaaaatatggggctacccttgtttacatttcaacagactacgtatttgatggcaataaaccagtcggtcaagaatgggtagaaacagatcatccagaccctaagacagaatatggccgtacaaaacgtttaggagaactagctgttgaacgatacgcagagcatttttatattatccgtactgcttgggtatttggaaattatggtaaaaactttgtctttaccatggagcagttagcagaaaatcactcccgtttgactgttgtcaatgaccaacacggtcggccaacgtggacaaggaccttggcagaattcatgtgttatttgacagagaatcaaaaagcctttggttactatcacttgtcaaatgatgctaaggaagacaccacttggtatgattttgccaaagaaatcttaaaagacaaggctgttgaagtggtgccagttgattcatcagctttcccagcaaaagccaaacgtcctttaaattcaaccatgaatcttgataaggcaaaagcaacagggtttgttattccaacatggcaagaagccttgaaggcattttaccaacaaggactgaaaaag

SEQ ID NO: 3790 - protein, 304 aa, Streptococcus pyogenes
MLENTKILRKVFYLWQKGELMILITGSNGQLGTELRYLLDERGVDYVAVDVAEMDITNEDKVEAVFAQVKPTLVYHCAAYTAVDAAEDEGKALNEAINVTGSENIAKACGKYGATLVYISTDYVFDGNKPVGQEWVETDHPDPKTEYGRTKRLGELAVERYAEHFYIIRTAWVFGNYGKNFVFTMEQLAENHSRLTVVNDQHGRPTWTRTLAEFMCYLTENQKAFGYYHLSNDAKEDTTWYDFAKEILKDKAVEVVPVDSSAFPAKAKRPLNSTMNLDKAKATGFVIPTWQEALKAFYQQGLKK

SEQ ID NO: 3791 - DNA, 339 bp, Streptococcus agalactiae
atgtcagaagtaaagcaatatagcgaagaagaagttggaaaaataaaagatcgtatcctagaagctttggagatggttatcgatcctgaattgggaatagatattgttaaccttgggttaatttatgagattcgctttgaagataacggtcgaactgaaattgatatgactttaacgactatgggatgcccgttagcagatttattgacagatcaaattcatgatgttatgaaaacagtcccagaggtaactgaaaccgaggtgaaattggtatggtacccagcctggtctgttgataagatgagtcgttatgctcgtatcgctttgggaattcgttca

SEQ ID NO: 3792 - protein, 113 aa, Streptococcus agalactiae
MSEVKQYSEEEVGKIKDRILEALEMVIDPELGIDIVNLGLIYEIRFEDNGRTEIDMTLTTMGCPLADLLTDQIHDVMKTVPEVTETEVKLVWYPAWSVDKMSRYARIALGIRS

SEQ ID NO: 3793 - DNA, 336 bp, Streptococcus pyogenes
atgtctgatacaccaaaatatacacaagatcaggtgatagctatcaagaatagaattcttgaagctttagaaactgttattgatcccgagctaggtattgatgttgttaatctaggcttgatttatgaaattcggtttaatgataacggttatacagagattgatatgacactcacaacaatgggttgtcctttggcagacttgttgacagattacatccatgatgccctgcaagatgtgccagaagtcactaagactgaggtcaaattagtctggtaccctgcttggacggttgataaaatgagccgctatgctaggattgcgctgggtattcgc

SEQ ID NO: 3794 - protein, 112 aa, Streptococcus pyogenes
MSDTPKYTQDQVIAIKNRILEALETVIDPELGIDVVNLGLIYEIRFNDNGYTEIDMTLTTMGCPLADLLTDYIHDALQDVPEVTKTEVKLVWYPAWTVDKMSRYARIALGIR

SEQ ID NO: 3795 - DNA, 1140 bp, Streptococcus agalactiae
ttgctcaaaaaagaaatatggaatgaggaacctatggcagagaaaaaaggaaatacaacttttaatgttcaagttgcggattttattcgcaatcataaaaaacaaggtactgcaattgatgatgaggtaacagaaaaacttgttattccttttgttttagatgcagatcaaattgatgatttgttagaacgattgacagacggtggcatttcaatcacagataaagaaggcaatccttcaacaaagtatgtggtagaagggccaaaacctgaagaattgactgatgaagagctcataggaagtaattctgctaaagtcaatgacccagtacgtatgtacttgaaggaaattggtgttgttcctcttttaacgaatgaagaagaaaaagaattggctgttgcggttgctgagggagatttaatggctaaacaacgtttagctgaagcaaaccttcgtcttgttgtctcaattgcaaaacgttatgttggacgtggaatgcaatttcttgatttaattcaagagggtaacatggggctcatgaaagctgttgataaatttgattattcaaagggattcaaattttcaacttatgcaacatggtggattcgtcaagctataacacgtgcaattgcagatcaagcacgtacgattcgtattcctgttcatatggttgaaacgattaataaattggtccgtgaacaacgtaatcttcttcaagaacttggtcaagatccaactcctgagcaaatcgcagaacgcatggatatgacaccagataaagtacgtgaaatcctaaaaattgctcaagagccggtatcgctagaaacgccaatcggtgaggaagatgatagccatttgggtgatttcattgaagacgaagttattgaaaatccagtagattatactacacgtgttgttcttcgtgagcaattagatgaggttttagatactcttactgaccgtgaagagaatgttcttcgtttacgctttggtcttgacgatggtaaaatgcgtacgttagaggacgtaggtaaagtatttaatgttactcgtgagcgcattcgtcagattgaagctaaagcccttagaaaacttcgccatcctagtcgtagcaagcaacttaaagatttcatggaagat

SEQ ID NO: 3796 - protein, 380 aa, Streptococcus agalactiae
MLKKEIWNEEPMAEKKGNTTFNVQVADFIRNHKKQGTAIDDEVTEKLVIPFVLDADQIDDLLERLTDGGISITDKEGNPSTKYVVEGPKPEELTDEELIGSNSAKVNDPVRMYLKEIGVVPLLTNEEEKELAVAVAEGDLMAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMDMTPDKVREILKIAQEPVSLETPIGEEDDSHLGDFIEDEVIENPVDYTTRVVLREQLDEVLDTLTDREENVLRLRFGLDDGKMRTLEDVGKVFNVTRERIRQIEAKALRKLRHPSRSKQLKDFMED

SEQ ID NO: 3797 - DNA, 1107 bp, Streptococcus pyogenes
atgacaaaacaaaaagaaataacaacttttaacgttcaagttgcggagtttattcgccatcacaaaaaagaaggaacagcgattgatgatgacgtgaccgaaaaacttgtcattccatttgctttggatgctgatcagattgatgacttacttgagcggttaacagatggtggtatctcgattacggataaagaaggtaacccatcatcaaaatacattgttgaagaaccaaaaccagaagaattaactgatgaagaattaattggtagtaattcagctaaagtaaacgaccctgtccgcatgtacctcaaagaaattggtgtggtaccgcttttaacaagtgaagaggaaaaagaattggctgttgcggttgccaagggagatttaatggctaaacaacgtttagcggaagcaaaccttcgtcttgttgtctcaattgcaaaacgttatgttggacgtggaatgcaatttcttgatttaattcaagaaggtaacatgggactcatgaaagctgttgataaatttgattattcaaaaggattcaaattctcaacttatgcaacatggtggattcgtcaagctataacacgcgcaattgcagatcaagcacgtacgattcgtatccctgttcatatggttgaaaccattaataaattggttcgtgaacaacgtaaccttcttcaagaacttggtcaagatccaacgccagaacaaatcgcagaacgtatggaaatgactccagacaaggttcgtgaaattctaaaaattgctcaagaacctgtttctttagaaacaccaattggggaagaagatgatagtcacttaggtgattttatcgaagatgaagttattgaaaatccagtagattatacgacgcgtgttgttcttcgtgagcaattggatgaagttttagatacgcttactgaccgtgaagagaacgttcttcgcctacgctttggccttgacgatggtaaaatgcgtacgttagaggacgtaggtaaagtctttaatgttactcgtgagcgcattcgacagattgaagctaaagcccttagaaaacttcgccatcctagtcgtagtaaacaattaagagactttatagaggac

SEQ ID NO: 3798 - protein, 369 aa, Streptococcus pyogenes
MTKQKEITTFNVQVAEFIRHHKKEGTAIDDDVTEKLVIPFALDADQIDDLLERLTDGGISITDKEGNPSSKYIVEEPKPEELTDEELIGSNSAKVNDPVRMYLKEIGVVPLLTSEEEKELAVAVAKGDLMAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMEMTPDKVREILKIAQEPVSLETPIGEEDDSHLGDFIEDEVIENPVDYTTRVVLREQLDEVLDTLTDREENVLRLRFGLDDGKMRTLEDVGKVFNVTRERIRQIEAKALRKLRHPSRSKQLRDFIED

SEQ ID NO: 3799 - DNA, 120 bp, Streptococcus agalactiae
atgttggtaatcttccacaaatttaaagacatcaccagagcgaccacaaccaaaacaatgaaaaaactgcctatcttcgataacattaaaagatggcgttttttctttatgaaatgggca

SEQ ID NO: 3800 - protein, 40 aa, Streptococcus agalactiae
MLVIFHKFKDITRATTTKTMKKLPIFDNIKRWRFFFMKWA

SEQ ID NO: 3801 - DNA, 1887 bp, Streptococcus agalactiae
gtgaagaagaaatccttgaaaaagcttttgaaaaaatttacacagaaaagaaaaaatgatataatcaaatgtaaaactataatgggttatttctgtggaggtcatgacttggcaattgataaagaaaaaatttctgaaatcaagaacagtgttaacattgttgatgtcatcggtgaagttgtcggtttgacaaaaacaggacgcaatcatcttggtttatgcccatttcataaagaaaaaacgccatcttttaatgttatcgaagataggcagttttttcattgttttggttgtggtcgctctggtgatgtctttaaatttgtggaagattaccaacatattagttttttagatagtgtacaagttctagctgaacgttcaggaatacctctagatactaattttaaggggcaagttcctaaaaaacctaaagctaatcagtcgcttttagatattcatagagttgcttcgggattttaccatgcctatttaatgacaactaatgatggtgaacgcgctagacaataccttgccgagcgcggagtgacagaggacttaattaaacattttcaaataggattatcgccgggagggcaggattttctatatcgtcgtctggcaaaagagtttgatgaaaaaactttgatgtcttctggtttgttcaattattcagaaaatagcaatcagttttacgattcatttaataatagaattatgtttccgttaactaatgatattggtgaagtcattgcgttttcaggacgagtttggactcaagaggacattgatagaaaacaagctaaatataaaaattctcgtgccacccctatttttaataagtcttacgagctttaccatttagataaagcgcgtgctgtaattaataaagcacacgaagtttacctaatggaaggctttatggatgttattgcagcttatcgtgcaggaattgagaatgttgttgcttctatggggaccgctttaaccaatgaacatgttagacaccttaaaagatttactaagaaagttgttctgacttatgatggtgatagagctggtcaaaacgcaattgacaagtctttagaactgctatcagatatgactgttgatatcgttaggatacctaataaaatggaccctgatgaatttctacaagcaaattcagcagaagattttaaacaactcttagaaaatgggcgcatcagtaatacagagttttatatccactacttaaagcctgaaaacaccgataatttacaatctgaaattgcttatgttgaaaaaatagcgaaattaattgctaaatctccatcgataacagcacaaaattcatatattacaaaagtggctgaactcttgccagattttgattattttcaagtagaacaatcggttaataacgaacgattgcatcatagaagtcaacagcaagcttcatcttcagtacaaacaagtgctacagtgcaattaccacagacaggtaagttatcagctatcactaaaacagaaatgcaattgtttcatcgattattgaatcatccctacctgttaaatgaattccgtaatagggataatttttattttgatacaacagaaatacaagttttatatgagttgctaaaagaaagtggtgagatcacgtcttatgatttatcacaagaaagtgacaaagttaatcgtacttattatataattttagaggaacaattacctgtagaagtatctattggagagattgaagccgtcgaaaaggcacgtgaccgtttattgaaagaacgtgatttaagaaaacaaagccagttaattagacaatctagtaatcaaggtgatgaagaaggagccttggctgcattagaaaatttaattgctcaaaaaagaaatatggaa

SEQ ID NO: 3802 - protein, 629 aa, Streptococcus agalactiae
MKKKSLKKLLKKFTQKRKNDIIKCKTIMGYFCGGHDLAIDKEKISEIKNSVNIVDVIGEVVGLTKTGRNHLGLCPFHKEKTPSFNVIEDRQFFHCFGCGRSGDVFKFVEDYQHISFLDSVQVLAERSGIPLDTNFKGQVPKKPKANQSLLDIHRVASGFYHAYLMTTNDGERARQYLAERGVTEDLIKHFQIGLSPGGQDFLYRRLAKEFDEKTLMSSGLFNYSENSNQFYDSFNNRIMFPLTNDIGEVIAFSGRVWTQEDIDRKQAKYKNSRATPIFNKSYELYHLDKARAVINKAHEVYLMEGFMDVIAAYRAGIENVVASMGTALTNEHVRHLKRFTKKVVLTYDGDRAGQNAIDKSLELLSDMTVDIVRIPNKMDPDEFLQANSAEDFKQLLENGRISNTEFYIHYLKPENTDNLQSEIAYVEKIAKLIAKSPSITAQNSYITKVAELLPDFDYFQVEQSVNNERLHHRSQQQASSSVQTSATVQLPQTGKLSAITKTEMQLFHRLLNHPYLLNEFRNRDNFYFDTTEIQVLYELLKESGEITSYDLSQESDKVNRTYYIILEEQLPVEVSIGEIEAVEKARDRLLKERDLRKQSQLIRQSSNQGDEEGALAALENLIAQKRNME

SEQ ID NO: 3803 - DNA, 1812 bp, Streptococcus pyogenes
atgggatttttatggggaggtgacgatttggcaattgacaaagaaatgatttcccaagtaaaaaatagcgttaatattgtcgatgtcattggagaagtggtcaaactttcccgatcagggcggcattacctcgggctttgcccatttcataaggaaaagacaccctcttttaatgttgttgaagacagacaattttttcactgctttggctgtggaaaatcaggggatgtttttaaatttattgaggaataccgccaagtccccttcttagaaagtgttcagattattgccgataagactggtatgtcgcttaatataccgccaagtcaggcagtacttgctagccaacacaagcaccctaatcacgctttgatgacacttcatgaggatgctgctaaattttaccatgcagttttgatgaccactaccattggtcaagaagctaggaagtacctttaccagagaggcttggatgaccaattaattgagcatttcaatattggtttagccccagatgagtcagattatctttatcaagctctttctaaaaaatacgaggaaggtcaattggttgcttcaggattgtttcacttgtccgatcaatccaataccatttacgacgcctttcgaaatcgtatcatgtttcccttatcagatgaccgagggcatattattgccttttcaggacgtatctggacggcagctgatatggaaaagagacaggcaaagtataaaaattcaagaggaacagttctttttaacaaatcttatgaattgtatcatctggacaaggcaaggcctgttattgccaaaacccatgaagtgtttctaatggaagggtttatggacgtgattgccgcttaccgttccggctatgaaaatgctgttgcttcaatggggacggcattgactcaagaacatgtcaatcaccttaagcaagtcactaaaaaagttgttttgatttatgatggtgacgatgctggacaacatgctattgcaaaatcactagaattgcttaaagattttgttgtcgaaattgtcagaatccccaataaaatggatcctgacgaatttgtacaacggcattccccagaagcatttgcagatttgcttaagcagtcacggatcagtagtgttgaattttttattgattacctaaaacctactaatgtagacaatttgcaatcacaaattgtttatgtggagaaaatggcaccattgattgctcaatcaccatccatcacagctcaacattcgtatattaacaagattgctgatttgttgccaaactttgactattttcaagtagaacaatcagtaaatgcattaaggattcaagataggcaaaaacatcaaggtcaaatagctcaagccgtcagcaatcttgtgaccttaccaatgccaaaaagtttgacagctattgctaagacagaaagtcatctcatgcatcggctcttacatcatgactatttattaaatgaatttcgacatcgtgatgatttttattttgatacctctaccttagaattactttatcaacggctgaagcaacaaggacacattacatcttatgatttgtcagagatgtcagaggaagttaaccgtgcttattacaatgttttagaagaaaaccttcccaaagaagtagctcttggtgagattgatgatattttatccaaacgtgccaaacttttagcagagcgcgatcttcacaaacaagggaaaaaagttagagaatctagtaacaaaggcgatcatcaagcggctctagaagtactagaacattttattgcgcagaaacgaaaaatggaa

SEQ ID NO: 3804 - protein, 604 aa, Streptococcus pyogenes
MGFLWGGDDLAIDKEMISQVKNSVNIVDVIGEVVKLSRSGRHYLGLCPFHKEKTPSFNVVEDRQFFHCFGCGKSGDVFKFIEEYRQVPFLESVQIIADKTGMSLNIPPSQAVLASQHKHPNHALMTLHEDAAKFYHAVLMTTTIGQEARKYLYQRGLDDQLIEHFNIGLAPDESDYLYQALSKKYEEGQLVASGLFHLSDQSNTIYDAFRNRIMFPLSDDRGHIIAFSGRIWTAADMEKRQAKYKNSRGTVLFNKSYELYHLDKARPVIAKTHEVFLMEGFMDVIAAYRSGYENAVASMGTALTQEHVNHLKQVTKKVVLIYDGDDAGQHAIAKSLELLKDFVVEIVRIPNKMDPDEFVQRHSPEAFADLLKQSRISSVEFFIDYLKPTNVDNLQSQIVYVEKMAPLIAQSPSITAQHSYINKIADLLPNFDYFQVEQSVNALRIQDRQKHQGQIAQAVSNLVTLPMPKSLTAIAKTESHLMHRLLHHDYLLNEFRHRDDFYFDTSTLELLYQRLKQQGHITSYDLSEMSEEVNRAYYNVLEENLPKEVALGEIDDILSKRAKLLAERDLHKQGKKVRESSNKGDHQAALEVLEHFIAQKRKME

SEQ ID NO: 3805 - DNA, 441 bp, Streptococcus agalactiae
ttggatttctcaaaagaaatctgctataatgaacgtgaattaaataatattaaggagcttgttcacatgattaaagaactaaaagaatttttatttaagggtaatgttttagaccttgctgttgctgttattttaggtgcagcttttaatgctatcatcacttcacttgttaaagacgttattacaccgcttatccttaatcctgtattaaaagctgctggcgtttcaaatatcgcacagctttcatggaatggtgttgcttacggtaatttcttaagtgcagttattaatttcttaatcgttggtactactttattcttcatcgttaaagctgctaacaaggttatggctaagaaacctgctgaagaagaaattattgaagttgttgaaccaacacaagagcaattacttgctgaaatccgcgacttactcgctaacaaa

SEQ ID NO: 3806 - protein, 147 aa, Streptococcus agalactiae
MDFSKEICYNERELNNIKELVHMIKELKEFLFKGNVLDLAVAVILGAAFNAIITSLVKDVITPLILNPVLKAAGVSNIAQLSWNGVAYGNFLSAVINFLIVGTTLFFIVKAANKVMAKKPAEEEIIEVVEPTQEQLLAEIRDLLANK

SEQ ID NO: 3807 - DNA, 360 bp, Streptococcus pyogenes
atggttaaagaattaaaagcatttttgtttagaggaaacattattgaacttgctgtagcagttatcatcgggggagcttttggtgctattgtcacttcttttgtgaacgatattatcacaccgcttattttaaacccagctttgaaagctgcaaatgttgaaaacatcactcaattgtcatggaatggtgttaaatatggtagctttttaggagccgttattaattttcttatcatcggtaccagtcttttctttgttgtaaaagccgctgaaaaagctatgcctaaaaaggaaaaagaagctgcagctcctactcaagaagaattattgacagaaatccgtgatttgttggctcaaaaa

SEQ ID NO: 3808 - protein, 120 aa, Streptococcus pyogenes
MVKELKAFLFRGNIIELAVAVIIGGAFGAIVTSFVNDIITPLILNPALKAANVENITQLSWNGVKYGSFLGAVINFLIIGTSLFFVVKAAEKAMPKKEKEAAAPTQEELLTEIRDLLAQK

SEQ ID NO: 3809 - DNA, 108 bp, Streptococcus agalactiae
gtgactaaagctggtactcttcaagaatcacgtaaacgtgaattctacgaaaaaccttctgtaaaacgtaaacgtaaatcagaagcagctcgcaaacgtaaaaaattc

SEQ ID NO: 3810 - protein, 36 aa, Streptococcus agalactiae
MTKAGTLQESRKREFYEKPSVKRKRKSEAARKRKKF

SEQ ID NO: 3811 - DNA, 210 bp, Streptococcus pyogenes
gtgaaaatgttacaatatcttgaggaggtgaaacacatgtcaaaaacagtagtacgtaagaatgaatctcttgacgatgctcttcgtcgcttcaaacgttctgttactaaagctggtactcttcaagaatcacgtaaacgtgaattctacgaaaaaccttctgtaaaacgtaaacgtaaatcagaagcagctcgcaaacgtaaaaaattc

SEQ ID NO: 3812 - protein, 70 aa, Streptococcus pyogenes
VKMLQYLEEVKHMSKTVVRKNESLDDALRRFKRSVTKAGTLQESRKREFYEKPSVKRKRKSEAARKRKKF

SEQ ID NO: 3813 - DNA, 1443 bp, Streptococcus agalactiae
gtgaaaaaaacaattggtattataggtatgggagttagtggtttagctgttctactagcactttctcgtaaaaaagagaaagagttaaaacagttagctattttttgttttgatgatactgtccactttggacgaggaattccttttcaagaagacgttgactcagctttaatcaattccccaatcaacgatatttcatttgattatcgccatatgtctgacttcatggattggttagaagaaaattactatgacacaaatctaacctatgtatcaaggacactttacggacaatacctttcagaaagaactaagttacttttagataaactccctgtcacggttattaaaacaagagtggataaactaaactatttatcagatgagcaacaatggcaagtctatattcaagataagctttttcctgtcacatttgatgaattacacttagcttgtggtgctctgcctgttatagaaccttatcatttggaagggaagaccgattatatcaaagacccttatcctatcaaatacttggctcaggaaaattggaagggaaaaacagttgctatcatcgggactggtctagctgcaattgatgttataaaatggttgctactcaatacacaatcttctgttaaagcattttcaagaaccaactacttccctagcgtccgtattgttaatgatttaccacttacttggcacttttttaccaatgataaccttaaagcatttctatcacatccttcaaaaaccttcactattgccgattttaatgatttgatgtctggcgaattggagcatcttggctttaaaaactggaaaaatacaacagaaacttttttatccccaggaattgatggtctcaagttagcctttaaataccctaagcaactctatctattacaacaattagcttcacgaatcactgtctggttaactgacctttggccactcatgtcattatcagataagaaagagtataaagcactctatggaaaagcgattattaacttgcgaaatcctatgcctgatgaatctgctaaagtaattttgaaagctgcacaaaaagggactttttctctgatcaataacgtcaagacaattacaaaaaatgacgaaggattttcaatagaaaaagaaaaacaaaatcatatatctgtcgatcgcgtcattaacgctactggttaccagttaaacactaaaaactggacaaaagccaatccacttctaaaatcgctcatcaatcaagaattttgtcaaattgacgatcaaggagggattactattttaactgaaaatgcacaagttttgtctccaaaatatggtccaatgccaggtttatatgcgcatggtgcactggttaatggtgtcgtttatcagaataactctacaattaaaattcaacaaatggcagagcgagccttttctgataataaa

SEQ ID NO: 3814 - protein, 481 aa, Streptococcus agalactiae
MKKTIGIIGMGVSGLAVLLALSRKKEKELKQLAIFCFDDTVHFGRGIPFQEDVDSALINSPINDISFDYRHMSDFMDWLEENYYDTNLTYVSRTLYGQYLSERTKLLLDKLPVTVIKTRVDKLNYLSDEQQWQVYIQDKLFPVTFDELHLACGALPVIEPYHLEGKTDYIKDPYPIKYLAQENWKGKTVAIIGTGLAAIDVIKWLLLNTQSSVKAFSRTNYFPSVRIVNDLPLTWHFFTNDNLKAFLSHPSKTFTIADFNDLMSGELEHLGFKNWKNTTETFLSPGIDGLKLAFKYPKQLYLLQQLASRITVWLTDLWPLMSLSDKKEYKALYGKAIINLRNPMPDESAKVILKAAQKGTFSLINNVKTITKNDEGFSIEKEKQNHISVDRVINATGYQLNTKNWTKANPLLKSLINQEFCQIDDQGGITILTENAQVLSPKYGPMPGLYAHGALVNGVVYQNNSTIKIQQMAERAFSDNK

SEQ ID NO: 3815 - DNA, 669 bp, Streptococcus agalactiae
atgctcgaattaaaaaatattgcttatcgttataaggggaacgacaataaaacattagaaaatatcaattatagttttcagtcaggggtattttatactatattagggaattctggttcagggaaaacaacccttctatccttgatggcaggtcttgattcgcctactgagggacaagtattatttaacaaaaaagatattaaagaagcaggttatgctcagcatcgcaaaaagaatatagctttggtctttcaaaattataaccttttagactatctaaccccattggaaaatgttcagttggtaaaacctactgcagataaacaattattgttggatttaggtttaaaagaagatatgttaacgcgaaatatcttgagattatcaggagggcaacaacaacgtgtagctattgcgagagctttggttgtaggaacaccagctattttacttgatgaacctacggggaatttagattttgacatttcgcgtgatattacgatgcgtcttaaagattttgcgcataaggaaaaacgatgtgttattatggtgacacatagtagagagatcgctcatatggctgatactgctttacaattgataggagataacttaaaagaattatcaaaagaaagtatagcacagtctatattacaacaaaggaattta

SEQ ID NO: 3816 - protein, 223 aa, Streptococcus agalactiae
MLELKNIAYRYKGNDNKTLENINYSFQSGVFYTILGNSGSGKTTLLSLMAGLDSPTEGQVLFNKKDIKEAGYAQHRKKNIALVFQNYNLLDYLTPLENVQLVKPTADKQLLLDLGLKEDMLTRNILRLSGGQQQRVAIARALVVGTPAILLDEPTGNLDFDISRDITMRLKDFAHKEKRCVIMVTHSREIAHMADTALQLIGDNLKELSKESIAQSILQQRNL

SEQ ID NO: 3817 - DNA, 318 bp, Streptococcus agalactiae
atgattgctattccagcctttgctttatcagtacttatcagtcaatttattggtcaaaaattagcagactccttagtgtatcaggcctctagaactgtcagagcagactttatgaaagggtttgggaatatgcagcttggggctgatagtgatacagatatgtttatgcaaacgattaagacgttaaatgtacaagtgaagcctgaggaagtctggttagtaattctagttggtttagcaatcgtcttatttgctattattactactagtttaattattgctcgctacaaaccaaggggaatcttatcaaaactgtcc

SEQ ID NO: 3818 - protein, 106 aa, Streptococcus agalactiae
MIAIPAFALSVLISQFIGQKLADSLVYQASRTVRADFMKGFGNMQLGADSDTDMFMQTIKTLNVQVKPEEVWLVILVGLAIVLFAIITTSLIIARYKPRGILSKLS

SEQ ID NO: 3819 - DNA, 264 bp, Streptococcus agalactiae
atgttttcaaaagaccccgttagaaacagtaaggataaaacattagttgaagcaactattgttggcatatataaaggtaaaacggtacaaaaatcaaattacccttatgagatgctagaaaatacagccttttcagatacgcaattgattaaggatttatacggctattctaaaggtaaggccttttatcgccaaacaactgtatatcctaaaaagaatgctgatatagaaactcttaaaagttttatcaaaaaacaatcctat

SEQ ID NO: 3820 - protein, 88 aa, Streptococcus agalactiae
MFSKDPVRNSKDKTLVEATIVGIYKGKTVQKSNYPYEMLENTAFSDTQLIKDLYGYSKGKAFYRQTTVYPKKNADIETLKSFIKKQSY

SEQ ID NO: 3821 - DNA, 441 bp, Streptococcus agalactiae
atgaatttatttaaacgttcctttttatatgttagccgtaaaaagcgtaagagtatcactttattcgtatgtttatggctagttgcttctacattaattagcggtattgcggtaaaaaatgctggtcttactgctaagaagacattttcaaggcaaactggatcaattttgcatatttcatcggatagtactgaccttgttggtgatggttacggatctggagaaatccctgaaaaagcaatagttaacatagcaagtaatccaaatgttaagcgcgttaataataatttgatggcttatgctggactaacctcggaaaaaatggttacacgaccaaatgataaagaacaatataaagaacaagttttacaagttcatggtaatagttactccgatacagatcctaaatacacagcggggatgatttctcttaagggaggg

SEQ ID NO: 3822 - protein, 147 aa, Streptococcus agalactiae
MNLFKRSFLYVSRKKRKSITLFVCLWLVASTLISGIAVKNAGLTAKKTFSRQTGSILHISSDSTDLVGDGYGSGEIPEKAIVNIASNPNVKRVNNNLMAYAGLTSEKMVTRPNDKEQYKEQVLQVHGNSYSDTDPKYTAGMISLKGG

SEQ ID NO: 3823 - DNA, 1317 bp, Streptococcus agalactiae
ttgatagataacgtagaagtcgatagagaatatctaacgacttctatcgttattctagagattattaagatagaaaaaggagggaaaatagtgaacctatggacattaagtttagcttatttgaaacgtcaaaaaatgaaaacagtaaccttgttcttagtttttctaactataggcacatgtttaatcagtctgatgagtattcagcattctttggaaaaaaatatcctaacaaaacaagggaaaagcatttatttaacctccaaagaaaaggcttattggcctgaacaagcatacgaagctttgaaaaaagcaaaaatggttgagtcagtagaggcaagtttaagcattgatgttggtagccgtttaaaatctgtatcaccatataactcttctaaagaagagaatcaagttacattagcaggttatcaaagtacagaagatttacgagcttttcagacaaaagcattggtcttaaagaaaggaagccatttagcggccgataatacaaaacaagtactagttccattgaagttagcacaaaagaatcatttaagtgtgggtaacaaattgagattaggcaaagaaaatgttactattgcaggaatttatgatgcgaatagtgctaagtctaaaaatacttttaatcccaatattgataatacattgattgctcaggcaacattggttaggaagattagtaaacaaaaaggttatcagacggttgcagtgcgcttaagtgataaacgtttagtggatacagttatccaaaacatcaaacaatggccgcttgatttcgggaaattagatgttcaaacagctaaagagttttatggagattcttatcgtaatatcgagacattgcatcgtctagtgggacgaatcattcttattgttagtctcgtggcgatggcaatattagttgtcatgctaacattttggattaataaccgcattaaagagacgggaattttactcgctatcggaaaaactaagtttgaaatcataggtcattatctgatagaagtactgttagtagcaggtgctgccttcacactatctattattggtggtgtctttcttggaaaaacatttgcagctggccttttatcacaagttaatggtggtgtgagttcacaaattgtacaaaatagtagtctaattattgatagaattgataacctcgctgtttctgttggagtaatggatgtctttagactctatgctcagggtgctttaatttgcttatttgcagttgtattatctagttattctattcttaaactacaaccaaagcaaatattgtcacgaatgtca

SEQ ID NO: 3824 - protein, 439 aa, Streptococcus agalactiae
MIDNVEVDREYLTTSIVILEIIKIEKGGKIVNLWTLSLAYLKRQKMKTVTLFLVFLTIGTCLISLMSIQHSLEKNILTKQGKSIYLTSKEKAYWPEQAYEALKKAKMVESVEASLSIDVGSRLKSVSPYNSSKEENQVTLAGYQSTEDLRAFQTKALVLKKGSHLAADNTKQVLVPLKLAQKNHLSVGNKLRLGKENVTIAGIYDANSAKSKNTFNPNIDNTLIAQATLVRKISKQKGYQTVAVRLSDKRLVDTVIQNIKQWPLDFGKLDVQTAKEFYGDSYRNIETLHRLVGRIILIVSLVAMAILVVMLTFWINNRIKETGILLAIGKTKFEIIGHYLIEVLLVAGAAFTLSIIGGVFLGKTFAAGLLSQVNGGVSSQIVQNSSLIIDRIDNLAVSVGVMDVFRLYAQGALICLFAVVLSSYSILKLQPKQILSRMS

SEQ ID NO: 3825 - DNA, 1059 bp, Streptococcus agalactiae
atgaataaaataacgacattatcaaccatcgccctgactttaatgctttgcgttggatgttctgccaataaagataatcaaaaaactaaaactgaggatcctaagcaagaaaacgtaactgcaaatccgaaggaagacaaggcaacagcagccaagcgaatgaagttaacgaaagaacttgaaaaatataataaaggcacagagagctttattagtaacaaacaatatcaaaaatatatcaaaacacctatcaaagaatatggtcaaaaggttgaagtcaaaggcaagaagatgaatgtctatactgttggagaaggtaaagtaccaattgtctttattcctggtcaagggacggtgactgccaaacatcagtaccataatttgattagtaatttaagtaaaactcataaggttgtggtagttgagccatttggttcaggtttaagtgatgtcattgaccaaccacgaaatctagctaatattacctcagatatccacgaagctttacaaaaagttggtattaccggaaaatatgtaattgcctctcattcaattggtggtgtttatgcccttaaatacatcagtacttatccaaaggaagtgctaggattaataggtttagatacatcaacgccgggtatggaaggtggtaagcaagttgatttcgctgctccagtgttaaaagaattacctaaaattcctaaagtatccgacgatattaatgcacaattttttgctattggacataagatacttaataattctaatatgaaagaagaagcgaagaattcttctaatatgattaacgaaagtgccaactataagattccaaagggaattcctgctatgtatttattagcacgtgaaagtgacttagggcttcaattacgtagtttagatataccaattaaaggcagttggcaagagcaacataaggagttatcagaagatccaaaagaagtctctattcatacactagacggaactcaccaaatttatgatactaaccttaaagaagtaattgattatactaaccaatttatgaaaacatttgagaaa

SEQ ID NO: 3826 - protein, 353 aa, Streptococcus agalactiae
MNKITTLSTIALTLMLCVGCSANKDNQKTKTEDPKQENVTANPKEDKATAAKRMKLTKELEKYNKGTESFISNKQYQKYIKTPIKEYGQKVEVKGKKMNVYTVGEGKVPIVFIPGQGTVTAKHQYHNLISNLSKTHKVVVVEPFGSGLSDVIDQPRNLANITSDIHEALQKVGITGKYVIASHSIGGVYALKYISTYPKEVLGLIGLDTSTPGMEGGKQVDFAAPVLKELPKIPKVSDDINAQFFAIGHKILNNSNMKEEAKNSSNMINESANYKIPKGIPAMYLLARESDLGLQLRSLDIPIKGSWQEQHKELSEDPKEVSIHTLDGTHQIYDTNLKEVIDYTNQFMKTFEK

SEQ ID NO: 3827 - DNA, 1044 bp, Streptococcus agalactiae
atgaaatacctaagtcaaggagaaaaaatgaataaaataacgaaattatcaaccgttgccctcgctttgatgctttgcgttggatgttctgccaataaagataatcaaaaaactaaaactgagcagcctaagcaagaaaagtcaatcgctaagcaaaaacaagagagagaagcagaaaaagctatgattgctaaaggtgctattgacctaactaaatataaagcgaaaccaattgaagattacggacaaaaaattgatgtcggtgacggtaaaaaaatgaacatatatacaatgggtcaagggaaaattccgctagtagtcttccctggtcaagctgaaatttcaccacgttatgcttacaaaaacttgcttgatagattagggaaaaaatataaaatttatacggttgaaccgctcggttatgggcttagtgatatgacagataagccacgtacgattgaaaatattaccaaagagattcatacagctcttgaaaaagtcggtgtcaaaaatttctatcttatggctcactcgttaggtggcatatacggtctaaattatgctaagacatattctaacgatgtcaaaggtttcattggcatggatacaagcacaccaaatatggaaggtgatggcacaactggagaatcttcagcttcaaccttaaaatgggcagaatccattccagaagttgataagaaaaccaatgaacaatacttatcaatcggtgctaaaaaatcaggtaataaaacagagcgcgataaagataggcgtgttagtgacaatcttcataaaatggaaaaagttaagttccctaaaggtatgccagctaagtatttcttagctaatgagtcagcagaagatataaaaatgcgtaaaaaaatattccctaagcttaaaagctgggaacaacaacatattgacttatctgaagatccaaaagacgtttctgttgagacactagatgctagccacttgatttatcatacgcaatataaacatatggcgaaggctattgacgagtggattcaatcgcatgaaaaa

SEQ ID NO: 3828 - protein, 348 aa, Streptococcus agalactiae
MKYLSQGEKMNKITKLSTVALALMLCVGCSANKDNQKTKTEQPKQEKSIAKQKQEREAEKAMIAKGAIDLTKYKAKPIEDYGQKIDVGDGKKMNIYTMGQGKIPLVVFPGQAEISPRYAYKNLLDRLGKKYKIYTVEPLGYGLSDMTDKPRTIENITKEIHTALEKVGVKNFYLMAHSLGGIYGLNYAKTYSNDVKGFIGMDTSTPNMEGDGTTGESSASTLKWAESIPEVDKKTNEQYLSIGAKKSGNKTERDKDRRVSDNLHKMEKVKFPKGMPAKYFLANESAEDIKMRKKIFPKLKSWEQQHIDLSEDPKDVSVETLDASHLIYHTQYKHMAKAIDEWIQSHEK

SEQ ID NO: 3829 - DNA, 1029 bp, Streptococcus agalactiae
atgaagaatataacaaagctatcaactgttgctttaagcctactactttgtacggcgtgtgctgcatcaaacacgtctacatctaaaacacagtctcatcatcctaaacaaactaaactcacagataagcaaaaagaagaacccaaaaacaaagaagctgctgatcaagagatgcatccccaaggcgctgttgatttgacaaaatataaggcaaaaccggtcaaagattatggtaaaaaaatcgatgttggtgatggcaagaaaatgaacatttatgaaactggtcagggaaaaattccaattgtttttattcctggtcaagctgagatttcgccacgctatgcttataagaatttaattgagcggttaagtaaaaaatataaaatttatacagtagaaccattaggctatggtctcagtgatattcctactaaaccacgtacgctagaaaacattacaaaagaaattcacacaggcctaaataaaattggagttaaaaatttctaccttgcagctcactcacttggcggtatgtattctttaaattatgctaaaaattatccagaagaagtcagaggatttattggtatggataccagtacaccttggatggaaggggaacaaaaaacaaagtatgaccctgaaagtgctaaatgggcaatgaaattaccagatgttgatgataagactaacgaacagtatctgtcaattgcgaaaaaaattaacggcaataagtctcaacgagatgaagatgagcgcttaggtgataatcttggtaaattgaagaatgtaaaattccctaaagggatgccaactaagtattttcttgctgatcaatctgtggagggaatcaagctacgtcaagcagattttaaaggtttgaaaaattgggatcagcagcatattgatttatctgaagatccaaaagatgcttccgttgaaatttttaaaggtagtcacaatattttccaaacacaatatgaacatatggctaaagctattgatggatttatccaatcccatcaaaag

SEQ ID NO: 3830 - protein, 343 aa, Streptococcus agalactiae
MKNITKLSTVALSLLLCTACAASNTSTSKTQSHHPKQTKLTDKQKEEPKNKEAADQEMHPQGAVDLTKYKAKPVKDYGKKIDVGDGKKMNIYETGQGKIPIVFIPGQAEISPRYAYKNLIERLSKKYKIYTVEPLGYGLSDIPTKPRTLENITKEIHTGLNKIGVKNFYLAAHSLGGMYSLNYAKNYPEEVRGFIGMDTSTPWMEGEQKTKYDPESAKWAMKLPDVDDKTNEQYLSIAKKINGNKSQRDEDERLGDNLGKLKNVKFPKGMPTKYFLADQSVEGIKLRQADFKGLKNWDQQHIDLSEDPKDASVEIFKGSHNIFQTQYEHMAKAIDGFIQSHQK

SEQ ID NO: 3831 - DNA, 108 bp, Streptococcus agalactiae
ttgagagctaacatcccagtacgtaatttccaagaattttatgatgcctttggtgttaaaaaaggcgattcaatgtatctaaaaccagaaaaacgtttgacactttgg

SEQ ID NO: 3832 - protein, 36 aa, Streptococcus agalactiae
MRANIPVRNFQEFYDAFGVKKGDSMYLKPEKRLTLW

SEQ ID NO: 3833 - DNA, 816 bp, Streptococcus agalactiae
ttgggtgattattatggtaagaaatattttggtgaggcagctaaaaaagacgtcgaacatatggctaagaaaatcattaatgtctataaaacacggttaaaaaacaacacttggttatcagaaaatacaaaagcaatggccattaagaaacttgataacatgagattaatgattggctatccagaagattatcctgatctttatcgtcagtaccaatttgatagtaaagcaagcttctttgaaaacaatgataactacagaaaattatcgaacaagaaaacatttgaagaatttaaccagtctaatcaacgtgaacattggcaaatgagtgccaatgctgtaaatgcttataatgatcctaataccaattccatagtctttccagcagcgatttttcaatcaccactctacgataaaactaaaacagttagtcaaaattatggagctatcggagcaattattggtcatgaaatttcacactcatttgatattaatggtatgaaatatgacgagaaagggaatcttcacgattggtggactaaagaagatttaaaacattataagaaaaaaacacaagctatgattgaccaatgggatggccttaaagcagatggcggtaaagttgatggtaaattaactttagcagaaaatattgcagataatggtggtgttatggcatctctagaagctcttaagactgaaaaaatccaaactataaagaattttttgaatcatgggcaagtatttggcgtcaaaaagcaaccaaagaacaaagtaagtcctcaattcagtcagatgttcatgcaccatatgaat

SEQ ID NO: 3834 - protein, 272 aa, Streptococcus agalactiae
MGDYYGKKYFGEAAKKDVEHMAKKIINVYKTRLKNNTWLSENTKAMAIKKLDNMRLMIGYPEDYPDLYRQYQFDSKASFFENNDNYRKLSNKKTFEEFNQSNQREHWQMSANAVNAYNDPNTNSIVFPAAIFQSPLYDKTKTVSQNYGAIGAIIGHEISHSFDINGMKYDEKGNLHDWWTKEDLKHYKKKTQAMIDQWDGLKADGGKVDGKLTLAENIADNGGVMASLEALKTEKIQTIKNFLNHGQVFGVKKQPKNKVSPQFSQMFMHHMN

SEQ ID NO: 3835 - DNA, 1092 bp, Streptococcus agalactiae
gtgtcatttatgcaaagaaaatcctatttaaaatccatgagtgttcttactttaacagcttgtcttatatcaggatatgtggttaaagatattgctatgttacatgcagtatctgccagtgagaagaaagcaaataatgtcagtccgagagaaaatctctacagggctgtcaatgataattggctagccaatacaaaactcaaacaagggcagactagtgttaatagtttttcagaaattgaggataaattaaagcaactgttagtgtctgatatggctaaaatggcctcaggaaagattgaaacaaccaatgatgaacagaaaaaaatggttgcatactataaacaaggtatggactttaaaacaagagataaaaatggtctcaaacctctaaaaccagttttacaaaaacttgaagcagtctcttcaatgaaagactttcaaagtttggcccatgattttgtgatgagtggttttgttttaccatttggtttgactgtggaaaccaatgctcgagataatagccaaaagcaattggtgcttcgtcaagcacccgcattacttgaatcacctgaccaatataagaagggcaataaagaaggtgaggctaaattatcagcttaccgtacttcagcaatggctttgcttaaacaagctggaaaaagtaacattgaagatagaaaactagttaaacaagctatagcatttgatagactcttatcagaaaaaacgcaagttgatcaaagtaaaatcacagctgaaagtgagacagctgcggggcgatataaccctgaaagtatggaaacggttcacaattacgccaaggaatttgactttaaagaattgattgaaaaactagttgggccaacgaataaggcagtcaatgtagaagataaaacttattttaaacaggttaatgatgttataaatagtaaacaattagccaatatgaaagcatggatgatgatttctatgctagttgatcaatcagattttctaggagaacaaaatcgtcaagcagcgagtgcttttaagaatgttgcgtctggtttgactcagattgaatcgaaagaaaaaatgcttacacccaat

SEQ ID NO: 3836 - protein, 364 aa, Streptococcus agalactiae
MSFMQRKSYLKSMSVLTLTACLISGYVVKDIAMLHAVSASEKKANNVSPRENLYRAVNDNWLANTKLKQGQTSVNSFSEIEDKLKQLLVSDMAKMASGKIETTNDEQKKMVAYYKQGMDFKTRDKNGLKPLKPVLQKLEAVSSMKDFQSLAHDFVMSGFVLPFGLTVETNARDNSQKQLVLRQAPALLESPDQYKKGNKEGEAKLSAYRTSAMALLKQAGKSNIEDRKLVKQAIAFDRLLSEKTQVDQSKITAESETAAGRYNPESMETVHNYAKEFDFKELIEKLVGPTNKAVNVEDKTYFKQVNDVINSKQLANMKAWMMISMLVDQSDFLGEQNRQAASAFKNVASGLTQIESKEKMLTPN

SEQ ID NO: 3837 - DNA, 3243 bp, Streptococcus agalactiae
ttgaataataaaggtgtcggtggcgatggtgtccaaatttatcaatactatatcaaaatggacaacaataaaccttacttaagtcccaaagataagactactgtagagaagttagaagatcgctggaaaaaaattactttcaaagttcaggatactggcattggtttgaaagacgtttatcttcaatctgttaagtatgttggtggtggcaataataatttagaccttatcacacctccaggatttaaaaaagaagataaaaaagttgaaaaaccaaaattagaccgtccaccaggaattgatttaccagcaccaacttcaatgagaagttttgattattcaaccccaccgggaactaagccaagcaaacccaaagatagtttatcaactcctccaggtttcccagatttaaacacgccgccggatgaagcaccaaaggatagtaaaaaagacgctattgaagataaatcaggagcaattaaatatgctaagtctcttcaacttagctttgttgatggccctattttagctagcaaagtaaatggcaaaatattacaagtcgaatctgatggcaaattagtcattcctagaaatgctttgtcagctaatcaatttgatgacactagtcttaaaatttatcgtaataataatcgcaataaagaaattactatcacaacagattattttgcagatacaaaatatgtcaatatcacagcggttgactatttgagcaatactacttttgagcaattagctactggtgaaacagtagattaccatgccattgtattttcaagctttgctgctattaaagacaagggtggtaagatttatgttaacgataaattgcaagaaacttctcgtatagcgcttaaagataaatctgttaagattggtattgaattaccaaatgatgtcagacatattgatagtttatctgttcgtcgtttgaatgaggttaaaactgttgataatatcttgaaaaatgatgaacaagacattaatctcagcaaaacttaccaattaaaatacaacccgacaaatcgtcgtctagagtttactattaataacattaactcaagttcagaaatcatgaccactttcaaagatggaaagatgccagaattggttgaacaaaaagatgtttctttggatataaacgatatggacatgagtaagtttaaaactattcgacttggacgaaaggattctgaatttaagggacaacttattgcaaaaactggaacagttgaattagatatgtttttcaaacaatctcaagacccagcttcaattattaaaaaaatataccttatccaaaatggtgttccaaatgaattgaaaaaatttgactctagttttggtttaactgaaagtcagatagatggatactatatttataaagatgcaattaaccttaaatttaaattaaccagtggtgcaagtcttaaagttgtttataaagggcaagaagatccatatagtcatcagaaagaagatatgactaaaaaaggtgaacagctcagtcattcaactcaagccaatgaaaatacagcaaaagtaacctttgctaatattgactggtcacattatagtaaggttactgtgaatggaaaagaagttgttaaaggtagtgagttacctttaactaaaggatggacaacatttgtattacataaaacagaaaattcattaaatgttaaaagtttgattatggagacgggtagtgtaagtaagaaagttcaacaacttcctttaagtcctagattatctaaaaataagcatatgagggatatgctacttactatgcaaaaagattcagcgtattacgaaacaagtgacagtctagtccttcgaattaatctcactgcagatactaaacttaattttaatgctgttaaaggagcgagtgctcttactgaaaatatgatgatgagacagtttgcagttgctggaccacaagatgatcctgttagtgaacataaatacccatcagtatttctcttaactcctgccttattggaaactgctagtgaggcaactctaaatggtaaggaaatcacagcatctggtattatcggtcacatcaaggatggtgataaaagcaagcatgttgaagtcaaaatggtgaatgaaaatggagacatgctaggaacccctgttattattcaaggtaaagacttgactaatcgaacaaaaccattaatgagtggacgtagagtactttatgccggtaaacaatatgagttccgggctaaattaccacttagtcgttttaacacttggattagggttgaagtggtaacagaagcaggagagaaagcaagtattgttcgtcgcatgttctttgaccaatcagttccagagcttaacacagcagttgctaaacgtgatttgacttctgatactgctcttatccacatcgttgccaaagatgactctctaaaactaaaattatatcaagatgattcattacttgaatctgttgataaaaccggtctttatagttttagaaatggtgtagaaatcactaaagatatgacagtaccactagaatttggagataatattattaagttatctgctgttgacttatcaaattatcgtcgtaatgagacccttcatatctatagaaaccgttttgatgttaaagcaagccaaatgacagctgacaaaggagctaaagtaactgtggatatgttgatgaagcacttagttgttccagaaatggcaggagcttatacattaacaatcgacgaagctccaaacacaaatgaatcaggaatgttaacaaacgctaaagtatcgattcattatgtaaatggtggtgttgataaagttgatgttccgattaaagtagttgacttagaagctattcgtaaagctgaagaagcacgtaaagctgaagaagcacgtaaagctgaagaagcacgtaaagctgaagagggacataaaacccaagaagcacctatagttgaagaaggctacaaggttaataacgttcatcaaactgatactacagttaaagcgtctgatttaccaaagactaagacagtttccgcagttcatatggctagaacagacaataaacagataacttcacatcagacacatgttgaaaaacaaattaaaaatacattgccatccactggtgacagcaaacgtggttattatatcactggaatggctatcgttatgctgagtgtattatttagtttagctaaaaagtttaaaagcaaatat

SEQ ID NO: 3838 - protein, 1081 aa, Streptococcus agalactiae
MNNKGVGGDGVQIYQYYIKMDNNKPYLSPKDKTTVEKLEDRWKKITFKVQDTGIGLKDVYLQSVKYVGGGNNNLDLITPPGFKKEDKKVEKPKLDRPPGIDLPAPTSMRSFDYSTPPGTKPSKPKDSLSTPPGFPDLNTPPDEAPKDSKKDAIEDKSGAIKYAKSLQLSFVDGPILASKVNGKILQVESDGKLVIPRNALSANQFDDTSLKIYRNNNRNKEITITTDYFADTKYVNITAVDYLSNTTFEQLATGETVDYHAIVFSSFAAIKDKGGKIYVNDKLQETSRIALKDKSVKIGIELPNDVRHIDSLSVRRLNEVKTVDNILKNDEQDINLSKTYQLKYNPTNRRLEFTINNINSSSEIMTTFKDGKMPELVEQKDVSLDINDMDMSKFKTIRLGRKDSEFKGQLIAKTGTVELDMFFKQSQDPASIIKKIYLIQNGVPNELKKFDSSFGLTESQIDGYYIYKDAINLKFKLTSGASLKVVYKGQEDPYSHQKEDMTKKGEQLSHSTQANENTAKVTFANIDWSHYSKVTVNGKEVVKGSELPLTKGWTTFVLHKTENSLNVKSLIMETGSVSKKVQQLPLSPRLSKNKHMRDMLLTMQKDSAYYETSDSLVLRINLTADTKLNFNAVKGASALTENMMMRQFAVAGPQDDPVSEHKYPSVFLLTPALLETASEATLNGKEITASGIIGHIKDGDKSKHVEVKMVNENGDMLGTPVIIQGKDLTNRTKPLMSGRRVLYAGKQYEFRAKLPLSRFNTWIRVEVVTEAGEKASIVRRMFFDQSVPELNTAVAKRDLTSDTALIHIVAKDDSLKLKLYQDDSLLESVDKTGLYSFRNGVEITKDMTVPLEFGDNIIKLSAVDLSNYRRNETLHIYRNRFDVKASQMTADKGAKVTVDMLMKHLVVPEMAGAYTLTIDEAPNTNESGMLTNAKVSIHYVNGGVDKVDVPIKVVDLEAIRKAEEARKAEEARKAEEARKAEEGHKTQEAPIVEEGYKVNNVHQTDTTVKASDLPKTKTVSAVHMARTDNKQITSHQTHVEKQIKNTLPSTGDSKRGYYITGMAIVMLSVLFSLAKKFKSKY

SEQ ID NO: 3839 - DNA, 2655 bp, Streptococcus agalactiae
gtgactaaaccacagggggcggttgctgagaaagctactccggctgtgccaaagcctcaaaaagtaagagtaattgttgaatttaataaggaatctatcttagattatgcgacagaacagaaaaaaacagttgcacagttaaatcaagctgatgttgagaaaaaattacaaagcatcaagcaagagcaagataaagttcttaagaatattgaaaaaagtgttcactttgattcaagcaaagtgaagcgttacgatgctattattaatggtgtcgcacttgatattcaagctcaagaaattgaaaaattaaaaacgattgctgatgttagaagggtctatgtctcacaagaatatgttcagacaaaacctttactatcttcctcagggcaacttattggtttgccagaagtttggaacaactcccagtataaaggtgagggaactgttgttgcagttattgattcaggggttgatttcaaacaccaagcactaaaaatcaaagaaccaaatcgtgctaagtataataaaactagtattgaaaaactgattcatgaaaagaatctcaaaggaaaattctattccgaaaaagtaccttatggttataactattatgactataatgataacctcaaggatagctacggtgtaatgcatggtatgcatgtaacaggtatcgtaggagctaatgatgataatcaaaaattgtatggtgttgcaccaaatgctcaaattttagcgatgaaggtattttcagatgaccaacaaaatcccacaaccttcacagatgtgtggctaaaagctctagacgatgctattttactaaaagctgatgttgttaatatgagtcttggaacacctgctggatttgtacatgaggggaaagactatcctgaacttgaagttattgcaagagcgtgtaaggcaggaatcgtcattgcagtagcagcaggtaatgaaggaaatatcactgacggtaatacttatggtgttaagccgctagcagaaaattatgatacagccttgattgccaacccagccctcgatgataataccttggctgttgcctctatggagaaccttaaaaagcatgctcatgttttgaaatttaaagataaaaaatctggaacagaagttacagaagtcattaatcttcatgttgccccaaacgcttcaaaaactattattggattggctgtagatttgggagcaggagctccttcggaattgtcaaaacattttgatttaagtggtaaaatcgccatgcttgaaattccagaagataataaatctaatggatttttagaaaaagtacaggcgattactaagttaaatccagctgctatcttgctttacaataatgcgaaggttaaagatgatttaggcagtcaattattagttgaatcagaagcagctaaatttaatattgctcgcattaccagaagcacgtataacaatatcaaaaataatagcaataaaattattactattttaacagagcgtcaagctattgataatagtttagcaggacaattatcttcttattcttcttggggacctacaccagacttacgtctaaaacctgagattacagctccaggtggtcatattttctcaactgtggaggataatcaatatgctgataaatcaggaacatcaatggctgcacctcaggtagctggggcagctgcagttttaaaacaatacattacagataaaaaaattcctgttgataatgctgctgattttattaaattactcttgatgaacactgcacagccaattatcaataaacaatcaaaagatggcaaaacaccttactttgtgcgccaacaaggtagcggagcaatgaatcttgccaaagctcttgttacgacagtcgttgcaactgtaacagggactaacgataataatgcagatggtaagttggagttacgtgaattaaaagagaaaaaatttaaagcacgcattctacttcgtaactttggaaaaactaataaaacgtatatcatctcatcagaagcgattgcggacccagttgatgaaaaaggatttcgtacgcaaaattcagaacacctagtatcaaaaaaagctgatgcagttacaaggaaagttactgtagaagcaggtaagacattagctgttgaccttgatgtggattattctgatgcagaggctttaactcgcaataatttcttggaaggttatcttaacttaaaagatactgaaggtgtagccgatttacacttaccatttttaggtttttacggttcatggacagagcaaaaagctattgatgcttttgaaggcatttctgaaattggtaacggtgacaaaaaacgtcgcgttcaattctatgttaataaagaaaccaacaagacctcatcaacctttacaactaacggcatgttgagtcttccaatctataacaatacagtatttttctctcctaatagtcctttctatgacaaagcaggagttcgtattgcagctttgcgtaatatggagtatgttcaatattctattatagatccagataccaataaagaagttcgtgtacttggtagatcacacgacgttagaaaactttatcgcctagattatcgtaatagttttgccatgatgccagattctatttgggatggtaagattaaagat

SEQ ID NO: 3840 - protein, 885 aa, Streptococcus agalactiae
MTKPQGAVAEKATPAVPKPQKVRVIVEFNKESILDYATEQKKTVAQLNQADVEKKLQSIKQEQDKVLKNIEKSVHFDSSKVKRYDAIINGVALDIQAQEIEKLKTIADVRRVYVSQEYVQTKPLLSSSGQLIGLPEVWNNSQYKGEGTVVAVIDSGVDFKHQALKIKEPNRAKYNKTSIEKLIHEKNLKGKFYSEKVPYGYNYYDYNDNLKDSYGVMHGMHVTGIVGANDDNQKLYGVAPNAQILAMKVFSDDQQNPTTFTDVWLKALDDAILLKADVVNMSLGTPAGFVHEGKDYPELEVIARACKAGIVIAVAAGNEGNITDGNTYGVKPLAENYDTALIANPALDDNTLAVASMENLKKHAHVLKFKDKKSGTEVTEVINLHVAPNASKTIIGLAVDLGAGAPSELSKHFDLSGKIAMLEIPEDNKSNGFLEKVQAITKLNPAAILLYNNAKVKDDLGSQLLVESEAAKFNIARITRSTYNNIKNNSNKIITILTERQAIDNSLAGQLSSYSSWGPTPDLRLKPEITAPGGHIFSTVEDNQYADKSGTSMAAPQVAGAAAVLKQYITDKKIPVDNAADFIKLLLMNTAQPIINKQSKDGKTPYFVRQQGSGAMNLAKALVTTVVATVTGTNDNNADGKLELRELKEKKFKARILLRNFGKTNKTYIISSEAIADPVDEKGFRTQNSEHLVSKKADAVTRKVTVEAGKTLAVDLDVDYSDAEALTRNNFLEGYLNLKDTEGVADLHLPFLGFYGSWTEQKAIDAFEGISEIGNGDKKRRVQFYVNKETNKTSSTFTTNGMLSLPIYNNTVFFSPNSPFYDKAGVRIAALRNMEYVQYSIIDPDTNKEVRVLGRSHDVRKLYRLDYRNSFAMMPDSIWDGKIKD

SEQ ID NO: 3841 - DNA, 513 bp, Streptococcus agalactiae
atgacattttataaaaagacggacaaatttggatttaggaaaagtaaagtgtgccgcagcctatgcggtgctttattgggtacagtagcagttgttagtctagctacagcaagtacagagattcacgctgatgaagcaacaacctcacctaccactgtaacgaaagtacctcagccagttcaagcagacacaacagctctaaatacctctaagactcacagtacacaagcaactacaactcctgttgaagctaaggagaataaggttgtcaaaagtgaaactgttcaatctgagagccgagtaatgcctagagataaggtagtagaaaggccagaaacagtaaaagctagtgttaactcagacgttagccaacctattacaaccacacccccaacaattaatgaaaaaacagttgagattcctaacttagctcaagatactaagaaggtagctccaaaagtaactgttacaccagaagttgttaatcagccaaagcagttgcctaaatacgag

SEQ ID NO: 3842 - protein, 171 aa, Streptococcus agalactiae
MTFYKKTDKFGFRKSKVCRSLCGALLGTVAVVSLATASTEIHADEATTSPTTVTKVPQPVQADTTALNTSKTHSTQATTTPVEAKENKVVKSETVQSESRVMPRDKVVERPETVKASVNSDVSQPITTTPPTINEKTVEIPNLAQDTKKVAPKVTVTPEVVNQPKQLPKYE

SEQ ID NO: 3843 - DNA, 573 bp, Streptococcus agalactiae
ttgaatcctttatcagaaaaagacaaagttaactatattatgatttataaaaataggcagtctacattggagaataatttatctggcgatcggttgatgagatatcaacaagcaaatagacaggtaagcaaagataaactgttaacagggagttattttgtgtaccaatgcttaaaaaagttaggttttaccaataagatttgtcaggaatctttttctagtgttagtagttatttaattggtttgccaaaggggaaaattagttactctaattctggtgactatcatattctaacctatgctcccagtggttcaactggggttgatattgagaaatacaaagatagatcagaacaaacctaccaaaactacctaggagaatcagttagtagtgatatggattctaaattattattttataaggcatggttacaaaaagaaatttcctataaatgtgggaaatctatagatattacctatcaaacaatgatagatggctatatttatggttatgcttttgataatacttttaaagtagaagcggtttacttaaaagaattattaccagataac

SEQ ID NO: 3844 - protein, 191 aa, Streptococcus agalactiae
MNPLSEKDKVNYIMIYKNRQSTLENNLSGDRLMRYQQANRQVSKDKLLTGSYFVYQCLKKLGFTNKICQESFSSVSSYLIGLPKGKISYSNSGDYHILTYAPSGSTGVDIEKYKDRSEQTYQNYLGESVSSDMDSKLLFYKAWLQKEISYKCGKSIDITYQTMIDGYIYGYAFDNTFKVEAVYLKELLPDN

SEQ ID NO: 3845 - DNA, 1248 bp, Streptococcus agalactiae
gtggtatctcttttgctattattgaaaaaaggtgataaaatgagtaaatttttatttgctcctttcatgatgaatttaggagagagccaaagattatcaaaactggctaattgtttatatgaacaaggacatgatattcatatccttggagacaattattatccatttttatttaataatgatgcttatcgctatcaccactgtgtagaagataaatctgtttataatagtaagcgatatgatgctttcttttctctttcaacagactttaattttttatcagaagaagaaattgaacgcatctgttctattgaaagagacttgttacgccaagaaaaatttgatgctgtattgacaggttaccgtctatctattgttacaagttgtcgtttagaaagcataccattaatttggattatttcaggggcaacgcatatcagtgaaattgttgaaaactcagaaggaatattgcctaatgggaagataagtaaagctagtaagcctcaaacaaaggattttatcaaaagagtaatcactacttattcaacaaatgttaaaacgtggaataactatattaaaaaatatggtggcaaaacttttaataatgctttagaattatttactggtgatctaaacttggtaacagattactctttgttttatgaatttgataaagattcgtcctataaaacgataggacctattttgatagataatgtaggtttttcaaaatgcagccaaattaatcaagacaataagactgtactgctcagctttggtacttcatttaaacgagattgggtggaatcttttttaaagacattaccaaggcattatcattatttactgacaagctgtggtgaggctataaacattccaggaagttatattgagatagttgattttattgattttaaaaccatagataaagagatttatttcgctattatacacggtgggcaaggaacagtttatgcgatggctgcacaaggtattccctttataggtatccctttctttaacgaacaattttggaatattaagaagttcagtaaagaaaagtgcgcttatttggtaaagaaacctgatgtaagagagatacgtaaagcaattagctgtcttgaaagagactatgatatctataaaagttatatgataagactaagccaaggaattaaagaagaagcagaggcatctttacaaaaagcggaggcagaaattgaatcctttatcagaaaaagacaaagt

SEQ ID NO: 3846 - protein, 416 aa, Streptococcus agalactiae
MVSLLLLLKKGDKMSKFLFAPFMMNLGESQRLSKLANCLYEQGHDIHILGDNYYPFLFNNDAYRYHHCVEDKSVYNSKRYDAFFSLSTDFNFLSEEEIERICSIERDLLRQEKFDAVLTGYRLSIVTSCRLESIPLIWIISGATHISEIVENSEGILPNGKISKASKPQTKDFIKRVITTYSTNVKTWNNYIKKYGGKTFNNALELFTGDLNLVTDYSLFYEFDKDSSYKTIGPILIDNVGFSKCSQINQDNKTVLLSFGTSFKRDWVESFLKTLPRHYHYLLTSCGEAINIPGSYIEIVDFIDFKTIDKEIYFAIIHGGQGTVYAMAAQGIPFIGIPFFNEQFWNIKKFSKEKCAYLVKKPDVREIRKAISCLERDYDIYKSYMIRLSQGIKEEAEASLQKAEAEIESFIRKRQS

SEQ ID NO: 3847 - DNA, 156 bp, Streptococcus agalactiae
atggaagcaacagatgataagatagccattttaagattttctctagcaggtaatgtttctagaggtgaatctaaagatgacaataagacaccactattatttccaccaaaagcaaacgaaaaatttaaagcatttcttattgggtattctctcttt

SEQ ID NO: 3848 - protein, 52 aa, Streptococcus agalactiae
MEATDDKIAILRFSLAGNVSRGESKDDNKTPLLFPPKANEKFKAFLIGYSLF

SEQ ID NO: 3849 - DNA, 2220 bp, Streptococcus agalactiae
ttgtatcccagaaagttggaacaaagaatgagcgtatatgttagtggaataggaattatttcttctttgggaaagaattatagcgagcataaacagcatctcttcgacttaaaagaaggaatttctaaacatttatataaaaatcacgactctattttagaatcttatacaggaagcataactagtgacccagaggttcctgagcaatacaaagatgagacacgtaattttaaatttgcttttaccgcttttgaagaggctcttgcttcttcaggtgttaatttaaaagcttatcataatattgctgtgtgtttagggacctcacttgggggaaagagtgctggtcaaaatgccttgtatcaatttgaagaaggagagcgtcaagtagatgctagtttattagaaaaagcatctgtttaccatattgctgatgaattgatggcttatcatgatattgtgggagcttcgtatgttatttcaaccgcctgttctgcaagtaataatgccgtaatattaggaacacaattacttcaagatggcgattgtgatttagctatttgtggtggctgtgatgagttaagtgatatttctttagcaggcttcacatcactaggagctattaatacagaaatggcatgtcagccctattcttctggaaaaggaatcaatttgggtgagggcgctggttttgttgttcttgtcaaagatcagtccttagctaaatatggaaaaattatcggtggtcttattacttcagatggttatcatataacagcacctaagccaacaggtgaaggggcggcacagattgcaaagcagctagtgactcaagcaggtattgactacagtgagattgactatattaacggtcacggtacaggtactcaagctaatgataaaatggaaaaaaatatgtatggtaagtttttcccgacaacgacattgatcagcagtaccaaggggcaaacgggtcatactctaggggctgcaggtattatcgaattgattaattgtttagcggcaatagaggaacagactgtaccagcaactaaaaatgagattgggatagaaggttttccagaaaattttgtctatcatcaaaagagagaatacccaataagaaatgctttaaatttttcgtttgcttttggtggaaataatagtggtgtcttattgtcatctttagattcacctctagaaacattacctgctagagaaaatcttaaaatggctatcttatcatctgttgcttccatttctaagaatgaatcactttctataacctatgaaaaagttgctagtaatttcaacgactttgaagcattacgctttaaaggggctagaccacccaaaactgtcaacccagcacaatttaggaaaatggatgatttttccaaaatggttgccgtaacaacagctcaagcactaatagaaagcaatattaatctaaaaaaacaagatacttcaaaagtaggaattgtatttacaacactttctggaccagttgaggttgttgaaggtattgaaaagcaaatcacaacagaaggatatgcacatgtttctgcttcacgattcccgtttacagtaatgaatgcagcagctggtatgctttctatcatttttaaaataacaggtcctttatctgtcatttcgacaaatagtggagcgcttgatggtatacaatatgccaaggaaatgatgcgtaacgataatctagactatgtgattcttgtttctgctaatcagtggacagacatgagttttatgtggtggcaacaattaaactatgatagtcaaatgtttgtcggttctgattattgttcagcacaagtcctctctcgtcaagcattggataattctcctataatattaggtagtaaacaattaaaatatagccataaaacattcacagatgtgatgactatttttgatgctgcgcttcaaaatttattatcagacttaggactaaccataaaagatatcaaaggtttcgtttggaatgagcggaagaaggcagttagttcagattatgatttcttagcgaacttgtctgagtattataatatgccaaaccttgcttctggtcagtttggattttcatctaatggtgctggtgaagaactggactatactgttaatgaaagtatagaaaagggctattatttagtcctatcttattcgatcttcggtggtatctcttttgctattattgaaaaaagg

SEQ ID NO: 3850 - protein, 740 aa, Streptococcus agalactiae
MYPRKLEQRMSVYVSGIGIISSLGKNYSEHKQHLFDLKEGISKHLYKNHDSILESYTGSITSDPEVPEQYKDETRNFKFAFTAFEEALASSGVNLKAYHNIAVCLGTSLGGKSAGQNALYQFEEGERQVDASLLEKASVYHIADELMAYHDIVGASYVISTACSASNNAVILGTQLLQDGDCDLAICGGCDELSDISLAGFTSLGAINTEMACQPYSSGKGINLGEGAGFVVLVKDQSLAKYGKIIGGLITSDGYHITAPKPTGEGAAQIAKQLVTQAGIDYSEIDYINGHGTGTQANDKMEKNMYGKFFPTTTLISSTKGQTGHTLGAAGIIELINCLAAIEEQTVPATKNEIGIEGFPENFVYHQKREYPIRNALNFSFAFGGNNSGVLLSSLDSPLETLPARENLKMAILSSVASISKNESLSITYEKVASNFNDFEALRFKGARPPKTVNPAQFRKMDDFSKMVAVTTAQALIESNINLKKQDTSKVGIVFTTLSGPVEVVEGIEKQITTEGYAHVSASRFPFTVMNAAAGMLSIIFKITGPLSVISTNSGALDGIQYAKEMMRNDNLDYVILVSANQWTDMSFMWWQQLNYDSQMFVGSDYCSAQVLSRQALDNSPIILGSKQLKYSHKTFTDVMTIFDAALQNLLSDLGLTIKDIKGFVWNERKKAVSSDYDFLANLSEYYNMPNLASGQFGFSSNGAGEELDYTVNESIEKGYYLVLSYSIFGGISFAIIEKR

SEQ ID NO: 3851 - DNA, 1230 bp, Streptococcus pyogenes
atgacatttaaaagagtagtggtaacaggttatggtctaacatctccaatcgggcatgatcctgaaacgttttggaacaatctgaaagctggccaaattggtattggtcctattactaaatttgacacgactgattatgcagtcaagaatgctgctgaaattcaggattttccatttgacaaatactttgtgaaaaaagatttgaaccgtttcgatagatattctctttatgctctttacgcagcgaaagaggctattaatcatgctgatttaaatattgagatggttgattccgatcgatttggcgttattgttgcttcaggtattggtggaattgcggagattgaagagcaagtgattcgcttacatgaaaaagggccaaaacgtgtgaagccaatgacgttgccaaaagcgctaccaaatatggctgcaggaaatgtcgccatgtctttaaaagctcaaggagtatgtaaatcaattaatactgcctgcgcttcttcaaatgatgcgattggggatgcctttcgtgccattaaatttgggactcaagatgtgatgatagttggtgggtcagaggcggccataaccaagtttgccattgctggcttccaaagtttaacagctctctcaacaactgaagatccaagcagaagctctattccatttgataaagaccgcaatggttttatcatgggagaaggatcaggaatgcttgttttagaaagcctagaacatgcgcaagaacgcggggcgacaatcttagcagaaattgtgggttatggaaatacctgcgatgcctaccatatgacatctccaaatcctgagggattaggagctcgtaaagccatccacttagccttacaagaagctggtattgaagccagtgctattaattatgtcaatgcgcacggaacttcaaccccagctaatgaaaaaggagagagtcaagcaattgtagccgttcttggtaaggatgttccggtgtcttcaacaaaatcgtttacgggtcaccttcttggagcagcaggcgctattgaagctattgccactatcgaggctatgcgtcataactatgttccgatgacggctgggacacaagctttatcagaggatatcgaagcaaatgtcatctttggagaaggaaaagaaacagctatcaactatgccatttcaaatacttttggatttggtggtcataatgctgtattagctttcaaatgttgggaggag

SEQ ID NO: 3852 - protein, 410 aa, Streptococcus pyogenes
MTFKRVVVTGYGLTSPIGHDPETFWNNLKAGQIGIGPITKFDTTDYAVKNAAEIQDFPFDKYFVKKDLNRFDRYSLYALYAAKEAINHADLNIEMVDSDRFGVIVASGIGGIAEIEEQVIRLHEKGPKRVKPMTLPKALPNMAAGNVAMSLKAQGVCKSINTACASSNDAIGDAFRAIKFGTQDVMIVGGSEAAITKFAIAGFQSLTALSTTEDPSRSSIPFDKDRNGFIMGEGSGMLVLESLEHAQERGATILAEIVGYGNTCDAYHMTSPNPEGLGARKAIHLALQEAGIEASAINYVNAHGTSTPANEKGESQAIVAVLGKDVPVSSTKSFTGHLLGAAGAIEAIATIEAMRHNYVPMTAGTQALSEDIEANVIFGEGKETAINYAISNTFGFGGHNAVLAFKCWEE

SEQ ID NO: 3853 - DNA, 951 bp, Streptococcus agalactiae
atgaatactatttataatacattgagaacagataaaggttataaagtttatgaggggtatttatatgaaattactggtgaagaatgtgaagaagccttagaccttgtgattcctaagaatattgtatttgcagatacagatacttgtggctacacttttttactcaatgaagatggaacagtttatgatgatgtgactttctacaaatttgatgataaatattggttggctagtcataaagctttggattcttatttagacaacatcaattttgactataccgtaacagatatttctgacgagtataaaatgctgcaaattgaaggaagatattcgggagaaattgctcagtcattttatgaatatgatatttcaacacttaattttcgtactttgatagagatgacttataaaggtgagaaaggttatcttgctagatttggtttttctggagaatttggctatcaatttttcctaccatcttctatttttgctacttttgtttcggatgtctgtgaaggtatagcagagtatggggatgaacttgatagatatttaaggtttgaagtgggacaacccattactgatatttatcaacaagaagaatattctttatatgaaataggttattcttggaatctagatttcacaaaggaagaatttagaggtcgcgatagcttgttagagcacatcagatcagcaacagttaaaagtgttggattctcaacgaaggaaaaactcgcttcaggaacaccagtgctatttgatgaccaaattgttggaaagattttttggatagcagacgagaaagactcttcggaaaattacctaggtttgatgattgttaaccaaacatatgctcattcaggagttacttttgtaacagaagatggccaaattttgaaaacacaatcaagcccttattgtatcccagaaagttggaacaaagaa

SEQ ID NO: 3854 - protein, 317 aa, Streptococcus agalactiae
MNTIYNTLRTDKGYKVYEGYLYEITGEECEEALDLVIPKNIVFADTDTCGYTFLLNEDGTVYDDVTFYKFDDKYWLASHKALDSYLDNINFDYTVTDISDEYKMLQIEGRYSGEIAQSFYEYDISTLNFRTLIEMTYKGEKGYLARFGFSGEFGYQFFLPSSIFATFVSDVCEGIAEYGDELDRYLRFEVGQPITDIYQQEEYSLYEIGYSWNLDFTKEEFRGRDSLLEHIRSATVKSVGFSTKEKLASGTPVLFDDQIVGKIFWIADEKDSSENYLGLMIVNQTYAHSGVTFVTEDGQILKTQSSPYCIPESWNKE

SEQ ID NO: 3855 - DNA, 2001 bp, Streptococcus agalactiae
atgaaagatgataataaattaaagatttctgaagcttccttagaagattattctgaagtggttcatttatttaataggaatcatgtttatcaatttccagacggtaggcctttaactgttgatgaccttgatttaacgttaaaagttaaagaagtgacacatttatttttactgaaaaatcatggtgttttgattggaacatcagctttctttaaatttattacctatggttgtttagattggaatagtagctttagtggttttcttttaattgattcgaaaagtcgtagtggacaggcaatcacttatctatataaaactatcttaaagaagataacaaaactgaagttttctaatatctataccgaaatcagtaactacaataaaccctccttagctttatcaaaattgaatggcttcaaagagtatgataagacatatgaagacatactgcattgtcgatcattgcgtagtcacctccctaagatattgaatacgtttcgtatttcgaattattatggtaaaacatacgacatatcaacttttcaaattatggaggaaattgaaaatcccttggaagaggagacagaaattaggaccaaagtctctgatgaagaaatattatttaaagcagaagatagtgcttcacttccttattatttaaaaatgagcttgtttcaaatggaaattgctaagttagataaccgttatgttttacaagttgactttttatcggaacaagtaaagagggttcgggttaaaactggaaaatatcacttggcaaacttaacgagggctcaccctagcctaactttaagtcgttttgccaattattattacattcaagcaactgtggaaaccctttatggtaatatcgatgttcaactggaacgtcgaaaaaagcattatagagatgcaactatttgtcttaagagaacttttcaaggttatgatttacttatctctccaaatggcagccttatttttgaaaagcagaaaagaaagatacttgaagatagttttttgatttttagccaacctttggacaagaaattagttgtaaaagaagaagaaaatcacattacaatcaaatgtttctatcaaggtgctttaattgagaaaatcatgacatttacaagtgacgaagaaatcacttgtgtttataaatgtaatcaaaaggctaaagagatgttcccaaaattattgaaacagactttcaagttacactgccaagagcagttgattagagatagtgaaggttatcttgtgaatgttccaggaagttacccgattgagcatgatgattttcttcgagcagataagtttgaagatagacaattccattattacctcccgaatgaagataaaatgatttcctattctcctcctggcaaagccagcaatcaaatgcaatttagacccttatgtcttattgatacagatagcctttcttttccactgacttatcattttaggatttcacaagcatcatcggaggaggcgttaatcaatctaaaaaaacagccaatatgggacagcaactaccaagcgtcagcaactgaccttttaaaacatatctctaacctaacattagaagaagagaaggattatggcatcaagagaatgatagctaacagaaagcattatcctagtcacaaactggttttagcctataatcagattgttttgcctaagaatgaaattccaagagacagtgaattatattctatttcttttgattatcgaattagaggaaagtttgtccaaatccgccaaggggaacatgtcaaatatgataataaatcctatgttttggaaaatagtcaacaattagtattgtatgtagctagcgatgataaatatatactaatttctgctaaaaatggaatattttattcttacaaagagaacaatcatttaaaaataaggtgcatgtttaaaaggaactcaccttatgctacaaatgtgagcattacagaatatagaaagtgtgaagaaaaa

SEQ ID NO: 3856 - protein, 667 aa, Streptococcus agalactiae
MKDDNKLKISEASLEDYSEVVHLFNRNHVYQFPDGRPLTVDDLDLTLKVKEVTHLFLLKNHGVLIGTSAFFKFITYGCLDWNSSFSGFLLIDSKSRSGQAITYLYKTILKKITKLKFSNIYTEISNYNKPSLALSKLNGFKEYDKTYEDILHCRSLRSHLPKILNTFRISNYYGKTYDISTFQIMEEIENPLEEETEIRTKVSDEEILFKAEDSASLPYYLKMSLFQMEIAKLDNRYVLQVDFLSEQVKRVRVKTGKYHLANLTRAHPSLTLSRFANYYYIQATVETLYGNIDVQLERRKKHYRDATICLKRTFQGYDLLISPNGSLIFEKQKRKILEDSFLIFSQPLDKKLVVKEEENHITIKCFYQGALIEKIMTFTSDEEITCVYKCNQKAKEMFPKLLKQTFKLHCQEQLIRDSEGYLVNVPGSYPIEHDDFLRADKFEDRQFHYYLPNEDKMISYSPPGKASNQMQFRPLCLIDTDSLSFPLTYHFRISQASSEEALINLKKQPIWDSNYQASATDLLKHISNLTLEEEKDYGIKRMIANRKHYPSHKLVLAYNQIVLPKNEIPRDSELYSISFDYRIRGKFVQIRQGEHVKYDNKSYVLENSQQLVLYVASDDKYILISAKNGIFYSYKENNHLKIRCMFKRNSPYATNVSITEYRKCEEK

SEQ ID NO: 3857 - DNA, 876 bp, Streptococcus agalactiae
atgtttgaactaatttctagaaatcgtaaagtttacacgcgagatcggttagcgtttttcatgtcttttttatcagttattatcttaattttggtctatcagattttcttgggaaaaattcaattagatgctataaaagcagcattgaggagtaatacagtatccagtgatactattcacatggttaattattggctcattgcaggtttgacgactattatttcaatgactagtacattaggtgcctttggagttatggtgtccgacaaagaaaaaaaattaaatgaagattttaaggtcagtcctatatcaaatatcaaaattgaattgtcctatgctatatttgccgttttatttggtattgtcatgacgatgttctcttgcatctttgctatcggtatttttaacggctttaattccttgctagagtattcagctatggattatttaactattttagggatcgtttccttagggactgttttatctgcggcgatgattttacctattttagcctttattcatactagttcagcttttacgactcttagcacaattgtagggacttttattggttttatttcaggagtatatctctcaattggctcggtaggaaaagcattacaacaggttatgacatggtttccattgactcaaatcaattctcttttgaaacaggtcttaatgaagggttctattgcgaaggtatttgacaaagccaacgaagccactgtctctaactataaagaatcatatggtgttgttttgcgtaatgctgatggagaaaggctgagtaatcactttatgttgatttatatcattgccctcattcttattttattggcaattcattttattattaaaaaggttaaaaaa

SEQ ID NO: 3858 - protein, 292 aa, Streptococcus agalactiae
MFELISRNRKVYTRDRLAFFMSFLSVIILILVYQIFLGKIQLDAIKAALRSNTVSSDTIHMVNYWLIAGLTTIISMTSTLGAFGVMVSDKEKKLNEDFKVSPISNIKIELSYAIFAVLFGIVMTMFSCIFAIGIFNGFNSLLEYSAMDYLTILGIVSLGTVLSAAMILPILAFIHTSSAFTTLSTIVGTFIGFISGVYLSIGSVGKALQQVMTWFPLTQINSLLKQVLMKGSIAKVFDKANEATVSNYKESYGVVLRNADGERLSNHFMLIYIIALILILLAIHFIIKKVKK

SEQ ID NO: 3859 - DNA, 975 bp, Streptococcus agalactiae
atgagaataaaaaagaggttgcctcaggaaggatgttggtatcagaaaatggaaattaaactcaaaaatattggaaaaaaatatggttcttttgaagcattgagagacattaatctcatctttgaagagggaaaattttatggccttcttggacctaatggagctggtaaaacaactttatttaaccttttaattcaaaattttaagcaaacgtcaggcgatattaagtgggaggtggatggaaaacctctatctattaaagatttttatcgtcacattggtattgtcttccaaagtaatcgcttagatgataatttaacggttgaggaaaatctaatttctagaggtgctttgtacggtttatctaaatcacaagtacgtaatcgccttaaagatcttcaaacgtatctagatatcacagcaataaaaaaacaaaaatatggcagtttatcaggaggtcaaaaacgaaaagttgatattgcacgcgccttgctgccacaaccttctctattattattagatgaaccaacgactggtttagaccctcaatctcgtcgcgatttatgggatgctatcgcacaactaaatcaacaatcgcagatgacagttgtactaattactcattatcttgaagaaatgtctgcttgtgatgttttaaatgttcttattgaaggaaacatttattattcgggagatattaaaagctttattgagcaacattccacaacaaacttgaatgtggtattgaaaccagaaaagtcattagaccaactttcgatagctgattttgttaataaatgtcaagtcctttcagaaagggagatagtatttaaggatatttctgttgaggaaatgatgcaggttatctcagacaatcaagataaatctattattgagacatttaatgttgaatattcgaacttagaggcggcgtatctcaacttgcttagagaaaaagaaaggaaaaacaatgtt

SEQ ID NO: 3860 - protein, 325 aa, Streptococcus agalactiae
MRIKKRLPQEGCWYQKMEIKLKNIGKKYGSFEALRDINLIFEEGKFYGLLGPNGAGKTTLFNLLIQNFKQTSGDIKWEVDGKPLSIKDFYRHIGIVFQSNRLDDNLTVEENLISRGALYGLSKSQVRNRLKDLQTYLDITAIKKQKYGSLSGGQKRKVDIARALLPQPSLLLLDEPTTGLDPQSRRDLWDAIAQLNQQSQMTVVLITHYLEEMSACDVLNVLIEGNIYYSGDIKSFIEQHSTTNLNVVLKPEKSLDQLSIADFVNKCQVLSEREIVFKDISVEEMMQVISDNQDKSIIETFNVEYSNLEAAYLNLLREKERKNNV

SEQ ID NO: 3861 - DNA, 303 bp, Streptococcus agalactiae
atgattaactgggctgaagaacgtaaaataataaaaacacgtcaagaagtagttgatgaaattaaaggtattttgattgactctttaatgttggatattgataaagatctgattatgaatgatcaaccattatttggtcgtggattagagctagactctattgatgccctagaactgtcaatagggatttcaacaacgtttggtgttgaactaaatgatgatgatatttcaatattatcatcagtaaatagactagcagattttgtgattgaaaatagtgaggatatagatgaccaagctaag

SEQ ID NO: 3862 - protein, 101 aa, Streptococcus agalactiae
MINWAEERKIIKTRQEVVDEIKGILIDSLMLDIDKDLIMNDQPLFGRGLELDSIDALELSIGISTTFGVELNDDDISILSSVNRLADFVIENSEDIDDQAK

SEQ ID NO: 3863 - DNA, 720 bp, Streptococcus agalactiae
atgaaagtagcaatagttactggtggtaccagaggaattggaagggctattacaaaagagttatacaaagaaggttacaaagtcattgctatttataatagcaatgatgctaaggcaagagctttacaagaggagttaccaaaattagacgtttataaatgcaatatttcagatgcaaaagcagtacaaaaattggtgactaaaatttttagagaatatggcggtattgattgtttagttaataatgctggtattgttagagatggctttttcttgatgatgtctaaggaaaaatggatggatgtcattaacataaatattatggggctagttaacatgagtaaagccgtgttaaaaatcatgaaggctaagcgtatacagggaaaggttatcaatatttcttcaactagtggtatagcagggcagatagggcaagcgaactattcagcaacgaaaggcgctatcatttccattactaaaactctagcgaaagaatttgcatcagatggtattacgattaattgtgtaagtccaggattcattgaaacagatatgacaaatgaattgcaaaataaagaagagctaaaagagcatcttattcctctaaaaaggtttggacaacctgaagaggtggcttggctcgtaagctttttagcaagtgagaaggcaaactatattacaggaaaaaatattgtgattgatggaggaatgattaatgat

SEQ ID NO: 3864 - protein, 240 aa, Streptococcus agalactiae
MKVAIVTGGTRGIGRAITKELYKEGYKVIAIYNSNDAKARALQEELPKLDVYKCNISDAKAVQKLVTKIFREYGGIDCLVNNAGIVRDGFFLMMSKEKWMDVININIMGLVNMSKAVLKIMKAKRIQGKVINISSTSGIAGQIGQANYSATKGAIISITKTLAKEFASDGITINCVSPGFIETDMTNELQNKEELKEHLIPLKRFGQPEEVAWLVSFLASEKANYITGKNIVIDGGMIND

SEQ ID NO: 3865 - DNA, 732 bp, Streptococcus pyogenes
atggaaattaaaggaaaaaatatatttatcacaggctcaacgagaggtatcggtttagcaatggctcatcaattcgccagtttagaagctaatattgtcttaaatggtcgctctgctatctctgaggagcttgttgctagttttactgactacggcgttacagttgttaccatctctggggatgtttcagaagcatcagaagctaaacgtatggtcaatgaagctatcgaaagtttaggttcgattgatgttttagttaacaatgctggcattactaatgataaattgatgcttaaaatgacggaagaggattttgagcgcgtcttgaaaatcaatttgaccggtgcttttaacatgactcaatcagtgttaaaaccaatgatcaaggcccgccaaggagcaattattaatgtctctagtgtggttggtttaacaggcaatattgggcaagcaaactatgctgcttctaaggcaggaatgattggttttaccaagtctgttgcccgtgaagttgctgctcgtaacatttgcgtgaatgctattgctccaggatttatcgagtccgacatgacaggtgtccttcctgaaaaaatgcaagagcaaatcttaagtcaaatcccaatgaaacgtattggaaaagctcaagaagttgctcacttagcaagcttcttggtggaacaagattatattacgggacaagttatcgctattgatggcggtatgacaatgcaa

SEQ ID NO: 3866 - protein, 244 aa, Streptococcus pyogenes
MEIKGKNIFITGSTRGIGLAMAHQFASLEANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPMKRIGKAQEVAHLASFLVEQDYITGQVIAIDGGMTMQ

SEQ ID NO: 3867 - DNA, 846 bp, Streptococcus agalactiae
atgaaaacagtaataatatatggaggacagggtaatgttcagtcaaaacacctttgtcaactagttaaaactccaaaaggtgaaattcttttttcaaagttacaagcaactgatttagaatcatatcagttaatgatggatgtcattaaccacaaggtaagtttagacaatgttcatgcgtctatgttagcaaattttttatataatgattggctaacaaacgatgaaaaaatagtatctgggataggattttcagctcatagcgccggtattttcaatgtgttatatgctagtggtagtactagttttgaaaacattattcactttattaaacgtcgtgcccaacttatagaaaattgtcatgtgtctgaagagctttggcttttgatggttgaaaacattgatatgtttagtaaggatgttttaaaagaacagtctgagaaagtaaaattagctattattactgatgatagagctggtgtaattgctatggatcaagtcaaccgttctttctttgatgacgtgatgactaacaaaggttatttttataaattaaagcagttaggcgtaaaagcaccatatcatactgattttttaaatgaatctaaagagcagtataaacaattgattgaaagcctagatatttcgcaaaatgatgactatgactatatttttcattgtgatcaattggtagatgaaattttatatcagtggaccaatctctttaactggcgtgcgattaaggaaactatcatagaaaaggatgcggagattattgatatttctcctaataggtttatttctagtcagttgcaaaaaatgaaaaagagggggaggaaacagtta

SEQ ID NO: 3868 - protein, 282 aa, Streptococcus agalactiae
MKTVIIYGGQGNVQSKHLCQLVKTPKGEILFSKLQATDLESYQLMMDVINHKVSLDNVHASMLANFLYNDWLTNDEKIVSGIGFSAHSAGIFNVLYASGSTSFENIIHFIKRRAQLIENCHVSEELWLLMVENIDMFSKDVLKEQSEKVKLAIITDDRAGVIAMDQVNRSFFDDVMTNKGYFYKLKQLGVKAPYHTDFLNESKEQYKQLIESLDISQNDDYDYIFHCDQLVDEILYQWTNLFNWRAIKETIIEKDAEIIDISPNRFISSQLQKMKKRGRKQL

SEQ ID NO: 3869 - DNA, 120 bp, Streptococcus agalactiae
atggcttgccttactaatcaagaacccgcactctcatatacttctactcctttatgccaaagtattagtgataccataaaagaaatcaaggaaatcaagataaccccaccaatattaaaa

SEQ ID NO: 3870 - protein, 40 aa, Streptococcus agalactiae
MACLTNQEPALSYTSTPLCQSISDTIKEIKEIKITPPILK

SEQ ID NO: 3871 - DNA, 783 bp, Streptococcus agalactiae
atgacaaaatatcagcgaatgcactttatttttattaaacaatacatgaagcaaatcatggagtataaaatagacttttttgtaggcgttttaggagtatttttaacacaagggttaaatcttttatttctgaatgttctttttcaacatatcccttctttagaaggatggacttttcagcaaatagcttttatttatggtttttctctcctcccaaaaggaattgatcaccttttctttgataacttgtgggctcttggtcaaaggcttattcgaaaaggagaatttgataagtatttaaccaggccgatcagtcctttatttcatgtcctagttgaaacctttcaagtagatgcattgggggagttattggttggttttattctgttatctaccacagtatctagtataagctggaccgtgccaaaagtattattatttatatttattatcccctttgcaactttgatttatacctccttgaagattgctacgtcaagtatcgctttttggaccaaacaatctggtgctgttatctatattttttatatgtttaatgactttgctaagtatcctgtcgcaatatataataatctattgcgttggatcattagttttgtcattccatttgcttttacagcttattatcccgctgcttacttcttacaagatagaaatgtctattttaatattggtggggttatcttgatttccttgatttcttttatggtatcactaatactttggcataaaggagtagaagtatatgagagtgcgggttct

SEQ ID NO: 3872 - protein, 261 aa, Streptococcus agalactiae
MTKYQRMHFIFIKQYMKQIMEYKIDFFVGVLGVFLTQGLNLLFLNVLFQHIPSLEGWTFQQIAFIYGFSLLPKGIDHLFFDNLWALGQRLIRKGEFDKYLTRPISPLFHVLVETFQVDALGELLVGFILLSTTVSSISWTVPKVLLFIFIIPFATLIYTSLKIATSSIAFWTKQSGAVIYIFYMFNDFAKYPVAIYNNLLRWIISFVIPFAFTAYYPAAYFLQDRNVYFNIGGVILISLISFMVSLILWHKGVEVYESAGS

SEQ ID NO: 3873 - DNA, 783 bp, Streptococcus pyogenes
atggcaaaattgagatgtatgcacgctatttttatcaaacaatacctcaaacaaattatggaatacaaggttgattttgtggtgggagtgctaggtgtttttctcactcagggacttaatctgctctttttatcggtacttttccaacatatcccttctttagaaggctggacgtttgaacaaattgcctttatttatggcttttgtttgattccaaagggaattgatcacctcttttttgacaatctttgggctttagggcaacggcttgtccgcaaaggagaatttgacaagtacctcaccagaccaattagtcctttgtttcatgttttagttgagacctttcaagtggatgccctgggtgaattattggttggggttatcttattagtgaccacggctggtagtatcgtatggactcttcctaaggtgcttttgtttattttggttattccttttgcgaccttgatttacacctctttaaaaattgcgaccgccagcatttctttttggaccaagcagtctggggcagttatctatattttttacatgttcaatgacttttctaagtaccctatgtccatttaccattcctttttgcggtggttaatcagttttatcattccctttgcttttacagcttattaccctgcttcttattttttaacaggtcaacacctgctctttaatattggaggcttggtagtggtgtcgttactggttttggccttgtcgcttaagctttggaaatggggcctggatgcttatgaaagtgcaggttcc

SEQ ID NO: 3874 - protein, 261 aa, Streptococcus pyogenes
MAKLRCMHAIFIKQYLKQIMEYKVDFVVGVLGVFLTQGLNLLFLSVLFQHIPSLEGWTFEQIAFIYGFCLIPKGIDHLFFDNLWALGQRLVRKGEFDKYLTRPISPLFHVLVETFQVDALGELLVGVILLVTTAGSIVWTLPKVLLFILVIPFATLIYTSLKIATASISFWTKQSGAVIYIFYMFNDFSKYPMSIYHSFLRWLISFIIPFAFTAYYPASYFLTGQHLLFNIGGLVVVSLLVLALSLKLWKWGLDAYESAGS

SEQ ID NO: 3875 - DNA, 816 bp, Streptococcus agalactiae
atgaacagaatttggagacgttataaaccttttattagtacaggaatccaaggattaatcacatatcgtgttgatttcatcctttataggataggtgatgtgataggagcatttgttgcattttatctatggaaagcagttttcgattcctcaagtcaatccttaatccaaggttttcagctgtcagatatgattctctatattattatgagttttgtgactaatttattaacaagaactgatagttcatttatgataggtgacgaagtaaaagacggttcaattattatgcgactcttacgtccagttcactttgctgcttcctaccttttcatggagattggttctagatggctcatctttttaagtataggggtaccgtttttgcttgttattacgggggtacgcctcttcttggggactgatttgattcaagctatagtgttagtggtattttatattattagcattattttagcttttttgattaacttcttttttaatatttgttttggcttctcggcatttgtttttaaaaatttatgggggtcaaacctgttaaaaaattcgttagtcgcatttatgtcggggagcttgattcctcttactttttttccgaaaatcgttgctgatattttaggatttttaccattttcatctttaatttacacaccagtaatgattattattggtaaatatgatggcagtcaaattgtgcaagccttacttttacaaatattttggctaatagtaatggtagctttatctcaattaatatggaaaaaagtacagttgcatatcactatccaaggaggt

SEQ ID NO: 3876 - protein, 272 aa, Streptococcus agalactiae
MNRIWRRYKPFISTGIQGLITYRVDFILYRIGDVIGAFVAFYLWKAVFDSSSQSLIQGFQLSDMILYIIMSFVTNLLTRTDSSFMIGDEVKDGSIIMRLLRPVHFAASYLFMEIGSRWLIFLSIGVPFLLVITGVRLFLGTDLIQAIVLVVFYIISIILAFLINFFFNICFGFSAFVFKNLWGSNLLKNSLVAFMSGSLIPLTFFPKIVADILGFLPFSSLIYTPVMIIIGKYDGSQIVQALLLQIFWLIVMVALSQLIWKKVQLHITIQGG

SEQ ID NO: 3877 - DNA, 858 bp, Streptococcus pyogenes
ttgaggatattgttcgtcgtttctaccgaaaggagctttaagatgtggtcattttggaaacgttatagaccctttctcagtgcaggaattcaggaattaataacctatcgcgttaatttctttttgtatcgtattggagatgtcatgggggcttttgtggcttattacctctggaaggctgtttttgattcgtctaagcaatccttaatcaatggttttactctgtctgacatgaccttttacattatcatgagttttgtgaccactttactgaccaaatcagacagctcctttatgattggcgaagaagtgaaagatggttctatcatcatgcgcctgcttcgaccagttcattttgcagcctcttacctctttatggaaattggttttcgctggattgtgctaatgagtgtcggctttccttttttaatggtcttatctggtattaaagtcatggcggggctgtctatcttgcaagtcctagccagcagttgtctgtatttagttagccttttattagcttttttaatcaatttttatttcaacatttgttttggctcttcagcatttgtctttaaaaacctttgggggtctaatttattgaaaaatgccttggttgcctttatgtcaggcagtttgattccattggctttttttcctaaaatggtttctatagtgcttagttttctaccgttttcctctttggtttacacgccagttatgattgtcattgggaaatacagccttagtcagataatggtggccctaagtttgcaaatcttttggttactggtgatggtagtcttatcgcaagtcatctggaaaaaggttcagtaccatttaacgattcaaggaggg

SEQ ID NO: 3878 - protein, 286 aa, Streptococcus pyogenes
LRILFVVSTERSFKMWSFWKRYRPFLSAGIQELITYRVNFFLYRIGDVMGAFVAYYLWKAVFDSSKQSLINGFTLSDMTFYIIMSFVTTLLTKSDSSFMIGEEVKDGSIIMRLLRPVHFAASYLFMEIGFRWIVLMSVGFPFLMVLSGIKVMAGLSILQVLASSCLYLVSLLLAFLINFYFNICFGSSAFVFKNLWGSNLLKNALVAFMSGSLIPLAFFPKMVSIVLSFLPFSSLVYTPVMIVIGKYSLSQIMVALSLQIFWLLVMVVLSQVIWKKVQYHLTIQGG

SEQ ID NO: 3879 - DNA, 1011 bp, Streptococcus agalactiae
ttgagtaaaagaggtattaatatgtcaatgattgaagtttctcaccttcagaaaaattttataaaaaccgttaaagcaccagggttaaaaggagcatttcaatcatttcttcgtcctgaaaaacacacctttgaagctgttaaagatttaacatttgatgtgcctaaaggacaaattctgggatttattggagcgaacggtgcaggaaaatctacaacaattaaaatgttaactgggattttaaaaccaacttcgggcttttgccgtattgatggcaaattgccacaagaaaaccgacaaaattatgttaaggatattggagtcgtttttgggcaacgtacgcagttatggtgggatttagctctacaagaaacctatacagtgttaaaagaaatctatgacgttcctgataaagaatttcgcaaacgcatggcttttttaaatgaggttttggaactaaatgactttataaaggatcctgttagaactttgtctctcggacagcgtatgagagcggatatcgcagcttctttattacataacccaaaggttcttttcttagatgaacccaccattggcttggacgtttcagtgaaagataatatccgacgtgcaatcacacaaattaatcaagaagaagagacaacgattttactaacgacacatgacctcagtgatattgaacaactttgtcatcgtatttttatgattgatagaggacaagaaatatttgatggcacagtttctcagctaaaagagacatttggaaagatgaaaactctttcttttgatttgcgcccaggacaagagcatatcagctctagtttaattggaaagtcggagattaatattaaacgtaatgacttagttttagatattcagtatgatagttctcgctaccaaactgctgacataattcagcagacattagcagatttttctgtacgtgaccttaaaatgacagatgcggatattgaagatatcattcgtcgcttctatagaaatgagcta

SEQ ID NO: 3880 - protein, 337 aa, Streptococcus agalactiae
MSKRGINMSMIEVSHLQKNFIKTVKAPGLKGAFQSFLRPEKHTFEAVKDLTFDVPKGQILGFIGANGAGKSTTIKMLTGILKPTSGFCRIDGKLPQENRQNYVKDIGVVFGQRTQLWWDLALQETYTVLKEIYDVPDKEFRKRMAFLNEVLELNDFIKDPVRTLSLGQRMRADIAASLLHNPKVLFLDEPTIGLDVSVKDNIRRAITQINQEEETTILLTTHDLSDIEQLCHRIFMIDRGQEIFDGTVSQLKETFGKMKTLSFDLRPGQEHISSSLIGKSEINIKRNDLVLDIQYDSSRYQTADIIQQTLADFSVRDLKMTDADIEDIIRRFYRNEL

SEQ ID NO: 3881 - DNA, 990 bp, Streptococcus pyogenes
atggtcatgatagaagtgtcccaccttcaaaaaaatttttccaaaaccattaaagagccaggattaaagggagccttgaagtcgtttgttcatcccccaagagaaatctttgaggcggttaaggacttatcttttgaggtacccaaagggcaaattttaggttttattggcgccaatggtgcaggaaaatcaacaacgattaagatgttaacaggtattttaaagcctacatcaggttactgtcgcattaacggaaagattccacaagataatcgtcaatattatgtgagagacattggagctgtttttggtcaacgaacacaactatggtgggatttggccttgcaagagacctatgtcgttttaaaagaaatttacgatgtacctgaaaaagcctttcgcaagcgcatggattttttaaatgaggttttggacctgaatgagtttattaaggatcctgtccggaccttatcactcggtcagcggatgcgagctgatattgctgcctccttgttgcataatcctaaagtattgtttttagatgaaccaacgattggacttgatgtttctgtgaaggacaacattcggcgtgccattactcaaattaatcaagaagaagagacaactattttactgacgacccatgatttgagtgatattgaacagctctgtgatcggattatcatgattgataaagggcaagaaatctttgatggaacggtgacccaattaaagcaaagctttggaaaaatgaagagtctgtcttttgagttgaagccagggcaggagcaggtggtctcacagtttatgggcttacctgacatcacagtggaacggcatgagcttagtttagacattcaatatgacagttcgcgctatcaaactgcggacattattcaaaaaaccatggctgattttgcggtcagggatgtgaagatgactgatgtagatattgaggatattgttcgtcgtttctaccgaaaggagctt

SEQ ID NO: 3882 - protein, 330 aa, Streptococcus pyogenes
MVMIEVSHLQKNFSKTIKEPGLKGALKSFVHPPREIFEAVKDLSFEVPKGQILGFIGANGAGKSTTIKMLTGILKPTSGYCRINGKIPQDNRQYYVRDIGAVFGQRTQLWWDLALQETYVVLKEIYDVPEKAFRKRMDFLNEVLDLNEFIKDPVRTLSLGQRMRADIAASLLHNPKVLFLDEPTIGLDVSVKDNIRRAITQINQEEETTILLTTHDLSDIEQLCDRIIMIDKGQEIFDGTVTQLKQSFGKMKSLSFELKPGQEQVVSQFMGLPDITVERHELSLDIQYDSSRYQTADIIQKTMADFAVRDVKMTDVDIEDIVRRFYRKEL

SEQ ID NO: 3883 - DNA, 1170 bp, Streptococcus agalactiae
atgatattaaggaggttatttatggtacgtaaatttttaaaatcgctcctatctctctttcttatagcagtaatcgccaccggtatttcagtggcatgtttcttttttattccagaaaataaagggaatattacaccgattttattgcatcgctttatgcgaaaaaataatgttaatggaatgatgattgttagcgataatactggtaaaccgattaccatctcgcatgggattaaccgtggggaagttgaaacggatattgaaaataataaattatttccaatggcttctctccaaaaactcatgacaggaattattatccaaagattaattgatcaagatgtcttgagtgaagacgaccgattgtctcagttctttccccaagtaaaaggtagtaatagtattaccatccaccaattgttgacccatacgagtgggttaagagaaaaaggtgttaaggtgtctccttatctaaaaaatgagagagaacaattacaattttgcttaaaacactataactttgttaataagaaatcgtggtattattctaatatcaactttagtttcctaacaggtatagccactcaagttacgggaaggacctacgctgaacttgttgatgatgtgataaaaaatcctttgcgattagatgatacccaaagttaccaatcagttgttaatcatgacttagttagcccaatgcgaaagaacggcaagttaaataaaattaatatctttaatcaagtatccacagcatatggagctggagattttttcacaactccgctgaacttttgggtgttgatgcggtctttttctaaagggtactttttcccaacggatgaatataccaaacatcaaaatgatgcgatatcacattattatggtgggctttacatgcatggtcgtatagttaattctaatgggacctttttccagtattcaagttttggttatgcagatctaaagacgcatgatacaatggtgctttttatgaataacaaagtctatagtgatgctagtcacgtggcaccaaaagcatttgaatattatcaaaaatttatgttccttaataagattttccacttagtcttttactttgtattttctttctttttaatgcttttaatacgtcattcgtttaggaaaagaaggtataagaaacgtctc

SEQ ID NO: 3884 - protein, 390 aa, Streptococcus agalactiae
MILRRLFMVRKFLKSLLSLFLIAVIATGISVACFFFIPENKGNITPILLHRFMRKNNVNGMMIVSDNTGKPITISHGINRGEVETDIENNKLFPMASLQKLMTGIIIQRLIDQDVLSEDDRLSQFFPQVKGSNSITIHQLLTHTSGLREKGVKVSPYLKNEREQLQFCLKHYNFVNKKSWYYSNINFSFLTGIATQVTGRTYAELVDDVIKNPLRLDDTQSYQSVVNHDLVSPMRKNGKLNKINIFNQVSTAYGAGDFFTTPLNFWVLMRSFSKGYFFPTDEYTKHQNDAISHYYGGLYMHGRIVNSNGTFFQYSSFGYADLKTHDTMVLFMNNKVYSDASHVAPKAFEYYQKFMFLNKIFHLVFYFVFSFFLMLLIRHSFRKRRYKKRL

SEQ ID NO: 3885 - DNA, 948 bp, Streptococcus pyogenes
atggtttacgaaatgactttggcggtcattaaatgtattgaaaaccatcttcacaaaaaagtatacaaaggggccagtctggctctctttcaatctggtcgatggcaagaataccatatcggaacaattgatggaagacgaccagttgatgctaacttagtttatgacttggctagtgtttcaaaagttgttggtgtggccacaatatgcaatattttattgaataatggtacgttagcattagatgatcccttaaaggtatattatcctagtattgctgatgcgactgtcactattcgacagttattgactcataccagtggtcttgatccttatattcctaacagagatgttttaaatgcacaacaattaagaaaagcacttaatcatcttactcaaaaagaaaataaaaacttttattacacagatgtcaatttcctcttgttaggcttcatgttagaagagctctttagtgaatctttagaccagatatttgacaagactatctttactccctttgggatgtatcatacgtcttttggccctcgtccagaagctgtaccaacattaaagggtgtgagtgatggagaagttcatgatcccaaagcaaaaatcttaaaaaaacattctggatctgcggggctattttcaactcttgcagatttagaaagttttagcaatcattatcttaatgatccattttcagattgtctgtggcgcaactacagccaacaaacaattgagcggtcactagggtggaatttagatggcgattggattagtcatacaggttacacagggccgtttctaatgcttaataaaaaagagcaaacggcagctatttttttgaccaaccgtacttacgacgaggatgataaaagtaaatggttaaaagaacgtcagttgctttacaatgcactaaagcatgatctgacaacccccgtatcg

SEQ ID NO: 3886 - protein, 316 aa, Streptococcus pyogenes
MVYEMTLAVIKCIENHLHKKVYKGASLALFQSGRWQEYHIGTIDGRRPVDANLVYDLASVSKVVGVATICNILLNNGTLALDDPLKVYYPSIADATVTIRQLLTHTSGLDPYIPNRDVLNAQQLRKALNHLTQKENKNFYYTDVNFLLLGFMLEELFSESLDQIFDKTIFTPFGMYHTSFGPRPEAVPTLKGVSDGEVHDPKAKILKKHSGSAGLFSTLADLESFSNHYLNDPFSDCLWRNYSQQTIERSLGWNLDGDWISHTGYTGPFLMLNKKEQTAAIFLTNRTYDEDDKSKWLKERQLLYNALKHDLTTPVS

SEQ ID NO: 3887 - DNA, 267 bp, Streptococcus agalactiae
atggtgagcttgcttctcttgaaagtaaagcaggaggagttgatagagtttcataatgttttttatagagaagcgatatcttcttatcttgaaacagaaaattttgagaaggctaaagtgactgaagagaattaccaagtttttttaggaatccgtacttatcagaagagttataactatcaagatcatagtgagaatctaaaaggaaatattgaggtagcaatgataggagttgaaaataatattagcgacgaacatattttttgc

SEQ ID NO: 3888 - protein, 89 aa, Streptococcus agalactiae
MVSLLLLKVKQEELIEFHNVFYREAISSYLETENFEKAKVTEENYQVFLGIRTYQKSYNYQDHSENLKGNIEVAMIGVENNISDEHIFC

SEQ ID NO: 3889 - DNA, 117 bp, Streptococcus agalactiae
atgaattctctttttaaaatattcaaagtttctaaagctaaatgtttgtgcttgatgattttgatgagattattggttgctcaagtttggtgtttgaataaggcgattcaaggacat

SEQ ID NO: 3890 - protein, 39 aa, Streptococcus agalactiae
MNSLFKIFKVSKAKCLCLMILMRLLVAQVWCLNKAIQGH

SEQ ID NO: 3891 - DNA, 219 bp, Streptococcus agalactiae
atgcatacataccatatcctatataacggctatcgttttaagaacaatttatttatgttggcagaaaataataataggaagcagaaaaatccaataatattcaagagaaaaagtataggtgatagctctctaaaaaaatttgatattgaaactataagaaaccctgtagatacgatagttgaaacaacctttttcttatccatattaataaccacccct

SEQ ID NO: 3892 - protein, 73 aa, Streptococcus agalactiae
MHTYHILYNGYRFKNNLFMLAENNNRKQKNPIIFKRKSIGDSSLKKFDIETIRNPVDTIVETTFFLSILITTP

SEQ ID NO: 3893 - DNA, 171 bp, Streptococcus agalactiae
ttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacg

SEQ ID NO: 3894 - protein, 57 aa, Streptococcus agalactiae
MLDDSEKYGDYTISRKRYKSFESSLQLYILQSHRLEIWNYEPIPLITRKINSLERLT

SEQ ID NO: 3895 - DNA, 228 bp, Streptococcus agalactiae
atgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaaaaaaagttattgattaccttattattacatactaaaggtttaatcattgatatg

SEQ ID NO: 3896 - protein, 76 aa, Streptococcus agalactiae
MGITLVFNKLSDEQKEKLMHVGKSYFDYQENALIPQLGFLYSKLTKKIELDNRLSPTEKKLLITLLLHTKGLIIDM

SEQ ID NO: 3897 - DNA, 90 bp, Streptococcus agalactiae
atgggaaatggtcaggattgggttggaacagccgaaagactagatggtgaaactgatacagttccaaaagaaggtactattctctctttt

SEQ ID NO: 3898 - protein, 30 aa, Streptococcus agalactiae
MGNGQDWVGTAERLDGETDTVPKEGTILSF

SEQ ID NO: 3899 - DNA, 156 bp, Streptococcus agalactiae
atggaaaaacaggattcacgagttctcatccattgggaggggaattctggggacaagctcattgaacaccaaaccagcgcaacggggtggtactaccaagtcgatcgtagctttagtcaaccaaaaggggaaccgcccagaatgatccaaaggcac

SEQ ID NO: 3900 - protein, 52 aa, Streptococcus agalactiae
MEKQDSRVLIHWEGNSGDKLIEHQTSATGWYYQVDRSFSQPKGEPPRMIQRH

SEQ ID NO: 3901 - DNA, 126 bp, Streptococcus agalactiae
gtgcgtagcgttgctacaacgaagcaaagggtaaaaatcctttattttaagcactttttcaagcattttgtctttattgaaaagagtgattttaacataaaaaaggtattaaaaaacatattgacg

SEQ ID NO: 3902 - protein, 42 aa, Streptococcus agalactiae
MRSVATTKQRVKILYFKHFFKHFVFIEKSDFNIKKVLKNILT

SEQ ID NO: 3903 - DNA, 636 bp, Streptococcus agalactiae
atgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaaggg

SEQ ID NO: 3904 - protein, 212 aa, Streptococcus agalactiae
MKPLGVIPYLLVARDPYSDRSRYLDPKVLSSSFGAFFPADNIKVAWSNNSSTLFTPPINANYTTQIQAIGTTIKSQIPESILTVTDKKSRKFSINKIDEAKEGLVGATFTLSKRTTVAADHQVQGDFIPVSKETTVGRTTLTFDNLKPGFYDLKETKAPNAYVLDPKTYVVVVQNSGKTTIVDEANFKEADYPMADNTSHVECVALLQRSKG

SEQ ID NO: 3905 - DNA, 99 bp, Streptococcus agalactiae
ttgtacttcatgaaggtcctaaagaccattttaaaagcagaattgccagttgttacgttatcatctatgaagctaaagaattcagttgttcgcttttct

SEQ ID NO: 3906 - protein, 33 aa, Streptococcus agalactiae
MYFMKVLKTILKAELPVVTLSSMKLKNSVVRFS

SEQ ID NO: 3907 - DNA, 102 bp, Streptococcus agalactiae
ttggatgttcaaagcgatgagaattttgcttttaaaatttttaaagttgcgaaagccaaaggcttgtcgcttgatgtctttgataagcttgttggtcgcttc

SEQ ID NO: 3908 - protein, 34 aa, Streptococcus agalactiae
MDVQSDENFAFKIFKVAKAKGLSLDVFDKLVGRF

SEQ ID NO: 3909 - DNA, 207 bp, Streptococcus pyogenes
atgagtaaacaggaagtaagagactcattgtcaactgtagtgggtgacttatcattaacaacgagagagaatcagattggttctctctttttggatgttcaaagcgatgaggattttggttttaaagttgtcaaagttctgaaatctaaaggcattgtacttaatgcccttgatgagtctgtttgtggcttcaagtttgtcgttgaa

SEQ ID NO: 3910 - protein, 69 aa, Streptococcus pyogenes
MSKQEVRDSLSTVVGDLSLTTRENQIGSLFLDVQSDEDFGFKVVKVLKSKGIVLNALDESVCGFKFVVE

SEQ ID NO: 3911 - DNA, 567 bp, Streptococcus agalactiae
atgttagaagtcagagagcaggttgaccatgtgatgattccaaaaatcaatcaggatttaccaatctacgctggttcagaagaggacaatctgcaacggggagttggtcatctagaagggataagtttgccgattggaggggcttctacacatgcggtcttgagcggtcaaagaggtatgccagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagc

SEQ ID NO: 3912 - protein, 189 aa, Streptococcus agalactiae
MLEVREQVDHVMIPKINQDLPIYAGSEEDNLQRGVGHLEGISLPIGGASTHAVLSGQRGMPAARLFADLDKMKKGDYFYVTNLKETLAYQVDRIMVIEPSQLDAVSIEEDKDYVTLLTCTPYMGSLSTVMGDLSLTTRENQLGSLSFWMFKAMRILLLKFLKLRKPKACRLMSLISLLVASNLALERDS

SEQ ID NO: 3913 - DNA, 2709 bp, Streptococcus agalactiae
atgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattg

SEQ ID NO: 3914 - protein, 903 aa, Streptococcus agalactiae
MMIVNNGYLEGRKMKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 3915 - DNA, 849 bp, Streptococcus agalactiae
atgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaa

SEQ ID NO: 3916 - protein, 283 aa, Streptococcus agalactiae
MKKRLVKIVTIIRNNKIRTLIFVMGSLILLFPIVSQVSYYLASHQNINQFKREVAKIDTNTVERRIALANAYNETLSRNPLLIDPFTSKQKEGLREYARMLEVHEQIGHVAIPSIGVDIPIYAGTSETVLQKGSGHLEGTSLPVGGLSTHSVLTAHRGLPTARLFTDLNKVKKGQIFYVTNIKETLAYKVVSIKVVDPTALSEVKIVNGKDYITLLTCTPYMINSHRLLVKGERIPYDSTEAEKHKEQTVQDYRLSLVLKILLVLLIGLFIVIMMRRWMQHRQ

SEQ ID NO: 3917 - DNA, 915 bp, Streptococcus agalactiae
atgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaa

SEQ ID NO: 3918 - protein, 305 aa, Streptococcus agalactiae
MGQKSKISLATNIRIWIFRLIFLAGFLVLAFPIVSQVMYFQASHANINAFKEAVTKIDRVEINRRLELAYAYNASIAGAKTNGEYPALKDPYSAEQKQAGVVEYARMLEVKEQIGHVIIPRINQDIPIYAGSAEENLQRGVGHLEGTSLPVGGESTHAVLTAHRGLPTAKLFTNLDKVTVGDRFYIEHIGGKIAYQVDQIKVIAPDQLEDLYVIQGEDHVTLLTCTPYMINSHRLLVRGKRIPYVEKTVQKDSKTFRQQQYLTYAMWVVVGLILLSLLIWFKKTKQKKRRKNEKAASQNSHNNSK

SEQ ID NO: 3919 - DNA, 921 bp, Streptococcus agalactiae
atgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggat

SEQ ID NO: 3920 - protein, 307 aa, Streptococcus agalactiae
MKQTLKLMFSFLLMLGTMFGISQTVLAQETHQLTIVHLEARDIDRPNPQLEIAPKEGTPIEGVLYQLYQLKSTEDGDLLAHWNSLTITELKKQAQQVFEATTNQQGKATFNQLPDGIYYGLAVKAGEKNRNVSAFLVDLSEDKVIYPKIIWSTGELDLLKVGVDGDTKKPLAGVVFELYEKNGRTPIRVKNGVHSQDIDAAKHLETDSSGHIRISGLIHGDYVLKEIETQSGYQIGQAETAVTIEKSKTVTVTIENKKVPTPKVPSRGGLIPKTGEQQAMALVIIGGILIALALRLLSKHRKHQNKD

SEQ ID NO: 3921 - DNA, 1743 bp, Streptococcus agalactiae
gtgctaaactttaatagttttgtgcttaataataatcagcacttacaaagaacaaagggaaaagcgaggagagaacttttaatgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataac

SEQ ID NO: 3922 - protein, 581 aa, Streptococcus agalactiae
MLNFNSFVLNNNQHLQRTKGKARRELLMKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 3923 - DNA, 117 bp, Streptococcus agalactiae
atgattgatgacttgttggcaactagcctcaaactgtgtttggaaaaaggcatcgatagacacaagaagactacgtatactggtagtaggaaaacaagggacaagctttatatagga

SEQ ID NO: 3924 - protein, 39 aa, Streptococcus agalactiae
MIDDLLATSLKLCLEKGIDRHKKTTYTGSRKTRDKLYIG

SEQ ID NO: 3925 - DNA, 1230 bp, Streptococcus agalactiae
atgataatgaaggcggtctatcaaatggttacattcgattttaaacatgttcaaacattgcataccatatctcaactacctatttcagtcatgtcacgagacaaggaactcgttcagttatatggtaacgaagactatctgttgccttactatcagtttttaaaacatttagctatcccttataaccaagatatcactgtttatgagggtctttttgaagaatcattcttaatttttcctgtctgtcaatatcttattgctattggaccattttatccctatagccctgatatcaataggcaagaacagttatccagtcgctttctagaacaattttctcatcgtaataaaaaagaaatcttatcctatataaagcttgtcccttgttttcctactaccagtatacgtagtcttcttgtgtctatcgatgcctttttccaaacacagtttgaggctagttgccaacaagtcatcaatcatttattagaagagtcagaacagattgttgcggatcctgatattgttcttcacctaaaacatactaagaaaaactcttttcagttacccactgttttaaaccatctcaatcacattattgatctcgttaagctgggtaacactcaactgttaaagcaagaaattaatcgcctcccatcatccagtgttacctcatcttcaatccctgccctaagagctgaaaagaacttaactgttgtttacttaacaaaattactagaattaagtttcgaggaaaatactgatgtggctaaaagttatgcgctggtaaagcactatatggctttaaacgaagaggctcctgatcttattgatgtttcaagaattcgctgtgcagctcttattgatttttcagaatccttaaccaataagagcatctctgacaagcagcaaatgtacaatagtattctccattatgtggacaaccacctctactccaaactcaaagtatctgatattgccaactacctatatatctcagattcccacttacgctcagtttttaaaaaatactctgacatttccttgcaaagttatattctaaaggcaaaaattaaggagggacaattactactgcaaagaggggtaccgattggggaagtagcgaaattattacatttttacgacaccacacattttcttaaaacctttaaaaaatacgtgggaatatcttcaaacgaatatcttactaaatatcgtgagacctcatgccag

SEQ ID NO: 3926 - protein, 410 aa, Streptococcus agalactiae
MIMKAVYQMVTFDFKHVQTLHTISQLPISVMSRDKELVQLYGNEDYLLPYYQFLKHLAIPYNQDITVYEGLFEESFLIFPVCQYLIAIGPFYPYSPDINRQEQLSSRFLEQFSHRNKKEILSYIKLVPCFPTTSIRSLLVSIDAFFQTQFEASCQQVINHLLEESEQIVADPDIVLHLKHTKKNSFQLPTVLNHLNHIIDLVKLGNTQLLKQEINRLPSSSVTSSSIPALRAEKNLTVVYLTKLLELSFEENTDVAKSYALVKHYMALNEEAPDLIDVSRIRCAALIDFSESLTNKSISDKQQMYNSILHYVDNHLYSKLKVSDIANYLYISDSHLRSVFKKYSDISLQSYILKAKIKEGQLLLQRGVPIGEVAKLLHFYDTTHFLKTFKKYVGISSNEYLTKYRETSCQ

SEQ ID NO: 3927 - DNA, 345 bp, Streptococcus agalactiae
atggataaaattattaaatcaatttctgcctctggtgccttcaggtcttatgtcctcgatagcaccgagactgttaaattggctcaggaaaaacatcataccttgtcgtcttcaacagttgctcttggtcgcaccctgattgctaatcaaatattagcggctaatcaaaaaggcgatagcaagattacggttaaagtcatcggtgattcttcctttggtcatattatctctgttgcagataccaaagggcatgttaaggggtacatccaaaatactggtgttgacatcaaaaaacggtcacaggtgaagttttggttggcccttttatggggaatggtcattttg

SEQ ID NO: 3928 - protein, 115 aa, Streptococcus agalactiae
MDKIIKSISASGAFRSYVLDSTETVKLAQEKHHTLSSSTVALGRTLIANQILAANQKGDSKITVKVIGDSSFGHIISVADTKGHVKGYIQNTGVDIKKRSQVKFWLALLWGMVIL

SEQ ID NO: 3929 - DNA, 870 bp, Streptococcus pyogenes
atggataaaataattaaatcaatagcacaatcaggggcttttagggcttatgtccttgatagcactgagacggttgcattagctcaagaaaaacacaacacgctgtcatcgtctactgttgcgcttggccgtaccttgatcgccaaccagattttggcggctaatcaaaaaggcgatagtaaaatcaccgtcaaagtgattggtgattcttcttttggacacattatctctgtggcagataccaaaggacatgtgaaaggttacattcaaaatactggtgtcgatattaaaaagaccgcaacaggtgaagtccttgttgggccttttatggggaatggtcattttgtgacgattattgattatggcacaggtaacccttacacctcaacaacgcctcttattactggggaaattggtgaggattttgcctactacttaaccgaatcagagcaaacaccatctgcaatcggacttaatgtgcttttagatgaaaatgataaggttaaggttgctggtggctttatggtgcaggtgctaccaggcgcttctgaagaagagattgctcgctatgaaaaacgcctgcaagaaatgcctgccatttctcacctactagcttccaaaaatcatgtggatgcccttttggaggccatctatggagatgaaccttacaagcgtctttctgaagaacctctgagttttcagtgtgactgttctagagaacgttttgaagcagccctaatgactttgccaaaagcagatttacaggccatgattgacgaagataagggtgctgagattgtttgccaattttgtggtaccaagtaccaatttaatgaaagtgatttggaggccattatcagtgataaagct

SEQ ID NO: 3930 - protein, 290 aa, Streptococcus pyogenes
MDKIIKSIAQSGAFRAYVLDSTETVALAQEKHNTLSSSTVALGRTLIANQILAANQKGDSKITVKVIGDSSFGHIISVADTKGHVKGYIQNTGVDIKKTATGEVLVGPFMGNGHFVTIIDYGTGNPYTSTTPLITGEIGEDFAYYLTESEQTPSAIGLNVLLDENDKVKVAGGFMVQVLPGASEEEIARYEKRLQEMPAISHLLASKNHVDALLEAIYGDEPYKRLSEEPLSFQCDCSRERFEAALMTLPKADLQAMIDEDKGAEIVCQFCGTKYQFNESDLEAIISDKA

SEQ ID NO: 3931 - DNA, 147 bp, Streptococcus agalactiae
gtgcaggaagttttgattatcgcaagagagaatcatcaagtgactcatgaacacgtgtcaatcttattgacctgcgttcaagaattgattgtggaagtcaatcaaacacagccactcagtcgtgagtttcgtgaaaagtatatgggt

SEQ ID NO: 3932 - protein, 49 aa, Streptococcus agalactiae
MQEVLIIARENHQVTHEHVSILLTCVQELIVEVNQTQPLSREFREKYMG

SEQ ID NO: 3933 - DNA, 819 bp, Streptococcus agalactiae
ttgtgtcgtgttttacgtgtcaatcgctccacttactataaatttctaaaacataagccctcaaaaagagaattggataatcaaatttataaaaaacaaatacttgagatttataccaaagcaaacaaaagacttggtgtgaagtctatcaaagtcattcttcaaagagactacgacacaaaaatctctgaaggaagaatttaccatctgatgaagaatatggcgctccctaaaatggctaccgttaagacaaaaacagctcttaaaaagactcaaaaaacgtatcctcaaaacttactcaaccagaaattttatcctgacaaacctaatcaagtatggtctactgacttcacctatatttctattggatataagaaatatgtctatctctgcgcaatacttgatctctattctagaaaatgtattgcttggaaattgagtcaccgtatggatgcaaagttagcatgtaacactctagaattagctcttaataaaagaaagattgaaggaacacttctctttcattccgaccaagggtcacaatttaaggccagggaatttagaaaaataattgatgacaacaatatcatgcattctttttctaaacctggatatccttatgataatgccgtaactgaagcatttttcaagtatttaaagcatagacaaatcaaccgaaaacattatcaaaatatcaaacaggttcaattagactgctttgaatacattgagaatttttataacaattacatcccacatacggctaatctaggactaacccctaatcagaaagaagaaaattattttaacgcaataaaa

SEQ ID NO: 3934 - protein, 273 aa, Streptococcus agalactiae
MCRVLRVNRSTYYKFLKHKPSKRELDNQIYKKQILEIYTKANKRLGVKSIKVILQRDYDTKISEGRIYHLMKNMALPKMATVKTKTALKKTQKTYPQNLLNQKFYPDKPNQVWSTDFTYISIGYKKYVYLCAILDLYSRKCIAWKLSHRMDAKLACNTLELALNKRKIEGTLLFHSDQGSQFKAREFRKIIDDNNIMHSFSKPGYPYDNAVTEAFFKYLKHRQINRKHYQNIKQVQLDCFEYIENFYNNYIPHTANLGLTPNQKEENYFNAIK

SEQ ID NO: 3935 - DNA, 516 bp, Streptococcus agalactiae
ttgagagtttatgaaaataaagaagagttgaaaaaagaaataagtaaaacatttgagaaatacattatggaatttaataatattccagagaatctaaaagataaaagaattgatgaagttgatagaactccagcagccaacctttcttatcaggttggctggaccaacttggttcttaaatgggaagaagatgaaagaaagggacttcaagtaaaaacaccatcggataaatttaaatggaatcaacttggtgaattatatcagtggttcacagatacctacgctcatttatctctgcaagagttgaaagcaaaattaaatgaaaatattaattctatctatgcaatgattgatttgttgagtgaggaagaattatttgaagcgcatatgagaaagtgggctgatgaagcgactaaaacagcgacttgggaagtgtataagtttattcatgtaaatacggttgcaccttttggaactttcagaactaaaatcagaaaatggaagaagatagtatta

SEQ ID NO: 3936 - protein, 172 aa, Streptococcus agalactiae
MRVYENKEELKKEISKTFEKYIMEFNNIPENLKDKRIDEVDRTPAANLSYQVGWTNLVLKWEEDERKGLQVKTPSDKFKWNQLGELYQWFTDTYAHLSLQELKAKLNENINSIYAMIDLLSEEELFEAHMRKWADEATKTATWEVYKFIHVNTVAPFGTFRTKIRKWKKIVL

SEQ ID NO: 3937 - DNA, 747 bp, Streptococcus agalactiae
atggaggttcttatgaagaaagtgttagtgagtagtcttttggttttagggattacgataacgttacaaacagtagttgaggctaaggggccaaaagtagcttatacacaagagggaatgactgctctttcggacacaaataaagataaagtcactactatttctattgacgagattcaaaaaagcttagaaggtaagaagccgattactgttagttttgatattgatgatacactgcttttcagtagtcaatattttcaatatggtaaagaatatgtaactcctggatcgtttgattttcttcataaacaaaaattctgggatcttgttgcaaaacgaggagatcaagattccattcccaaagaatatgctaaaaaattaattgctatgcatcaaaaacgaggagataaaattgtttttataacaggtaggacaagagggtcaatgtataaggagggcgaggttgataaaacagctaaagccttagctaaagattttaaattagacaaaccaattgctgtaaattatacaggcgataaacctaaaaagccatacaaatatgataaatcatattatattaagaaatatggttcagacattcattatggagatagtgatgacgatattcatgcagctagggaggccggtgctagaccaattagaattttaagagcacctaattctacaaatctacctttaccagaagctggaggctacggtgaagaggttctcgaaaattcagcttac

SEQ ID NO: 3938 - protein, 249 aa, Streptococcus agalactiae
MEVLMKKVLVSSLLVLGITITLQTVVEAKGPKVAYTQEGMTALSDTNKDKVTTISIDEIQKSLEGKKPITVSFDIDDTLLFSSQYFQYGKEYVTPGSFDFLHKQKFWDLVAKRGDQDSIPKEYAKKLIAMHQKRGDKIVFITGRTRGSMYKEGEVDKTAKALAKDFKLDKPIAVNYTGDKPKKPYKYDKSYYIKKYGSDIHYGDSDDDIHAAREAGARPIRILRAPNSTNLPLPEAGGYGEEVLENSAY

SEQ ID NO: 3939 - DNA, 729 bp, Streptococcus pyogenes
atgaaaaaagaatttaccagtatcctgtttacagttagtttttgtggaatcatagcattgcctgtcgaagctagtggccctaaagttccttatacacaagaaggtataacggccatttcaaatcaggcaacagtaaaattgatttctattgctgatatcgcgagcagtttagaaggacaaaaacctataacggttagttttgatatcgatgatactttgttatttactagccaatattttcagtacggcaaagaatatataactccaggctcatttgattttttgcataagcaaaaattttgggacttggtcgctaaacggggagatcaggattctattccaaaagagtatgcaaagcaactaatcgcaatgcatcaaaaacgaggagataaaattgtctttattactggccgaactcgaggatcgatgtataaaaaaggtgagattgataaaacagctaagtcactggctaaagattttaagttagacaagccaatagctatcaattatacaggagataaagctgtgaagccgtatcagtatgataaaacatattatataaagaaaaacggctcacaaattcattacggagatagtgatgaagatataaatgctgccaaagaggcaggtgcaagacctattcgcattttaagagctcctaattcaaccaatcttcctttgccaaaagctggaggatacggagaagaggttttagaaaattcggcttat

SEQ ID NO: 3940 - protein, 243 aa, Streptococcus pyogenes
MKKEFTSILFTVSFCGIIALPVEASGPKVPYTQEGITAISNQATVKLISIADIASSLEGQKPITVSFDIDDTLLFTSQYFQYGKEYITPGSFDFLHKQKFWDLVAKRGDQDSIPKEYAKQLIAMHQKRGDKIVFITGRTRGSMYKKGEIDKTAKSLAKDFKLDKPIAINYTGDKAVKPYQYDKTYYIKKNGSQIHYGDSDEDINAAKEAGARPIRILRAPNSTNLPLPKAGGYGEEVLENSAY

SEQ ID NO: 3941 - DNA, 219 bp, Streptococcus agalactiae
ttgccaactatgcagctgttagatgagttagttcttccaaaagacattaccatagcagatgtcagtcaaagtatccaagaatttgaaatagaaagagatgcccttcaagaattttttgacgatatgctgaagacttatacaacctaccaagaaatgaaagattatattaaatctcgtgaagcgaacactcctaagcaagagacagaagaaaaatcactt

SEQ ID NO: 3942 - protein, 73 aa, Streptococcus agalactiae
MPTMQLLDELVLPKDITIADVSQSIQEFEIERDALQEFFDDMLKTYTTYQEMKDYIKSREANTPKQETEEKSL

SEQ ID NO: 3943 - DNA, 1398 bp, Streptococcus agalactiae
gtgtataaactaaagacttcaaatgatagatataaaaggaaaattatgttacataaaaatgatattattgaaactgaaattagcgacattagccatgagggaatgggtattgccaaagtagatggctttgttttctttgttgaaaatgctcttccaggtgagattattaagatgcgcgtcttgaaattacgtaagcgtataggatatggaaaagttgaggaatatttaacgacttctcctcaccgaaatgaaggattagactatacctatttacgtacagggattgctgatttgggacatcttacttatgaacaacagctgttatttaaacaaaaacaagtagctgataacctttataaaattgctcatatatctgatgttttagtagaacctactcttggtatgacaatccctttggcatatcgaaataaagctcaggtaccagttcgtcgtgttgatggacagctagagacaggttttttcagaaaaaattcacatactctggtatccattgaagattatttaattcaggaaaaagagattgatgctctgattaattttacacgagatttattaagaaaatttgatgttaaaccatatgacgaagagcagcaatctggtttaattagaaatctcgttgttcgtcgaggacattatacagggcaattaatgttggttttggtgacaacacgtcctaaaatattccgcattgaccaaatgattgaaaagttggtgtctgcctttccttctgttgtttcaattatgcaaaatattaatgatcgtaatagcaacgttatttttgggaaagaatttcgtactctatatggttctgatactattgaggaccaaatgttaggaaatacttacgctatatcagcccaatctttttaccaagttaatactgaaatggctgaaaaactgtaccaaaaagcaatcgatttttcagatttaaactcagaggatatcgttattgatgcctattcaggtataggaacaattggcttatctgttgctaaacaagtaaaacatgtttatggtgttgaagttgttgaaaaagcagtaagtgatgccaaagaaaatgctactcgaaatgggataactaacagtacctatgttgctgattcggctgaaaatgcaatggcaaagtggcttaaagaaggtataaaaccaactgttataatggttgatccaccacgaaaaggattaacggagagttttgtatattctgctgcccaaacaaaagcagataaaatcacttatatttcttgtaattcagcgacaatggcgcgtgatatcaaactatttgaagaattagggtatcatttagtaaaaattcaaccagtagacttattcccaatgacacatcatgtggagtgtgtggctctgctcgtaaaagcc

SEQ ID NO: 3944 - protein, 466 aa, Streptococcus agalactiae
MYKLKTSNDRYKRKIMLHKNDIIETEISDISHEGMGIAKVDGFVFFVENALPGEIIKMRVLKLRKRIGYGKVEEYLTTSPHRNEGLDYTYLRTGIADLGHLTYEQQLLFKQKQVADNLYKIAHISDVLVEPTLGMTIPLAYRNKAQVPVRRVDGQLETGFFRKNSHTLVSIEDYLIQEKEIDALINFTRDLLRKFDVKPYDEEQQSGLIRNLVVRRGHYTGQLMLVLVTTRPKIFRIDQMIEKLVSAFPSVVSIMQNINDRNSNVIFGKEFRTLYGSDTIEDQMLGNTYAISAQSFYQVNTEMAEKLYQKAIDFSDLNSEDIVIDAYSGIGTIGLSVAKQVKHVYGVEVVEKAVSDAKENATRNGITNSTYVADSAENAMAKWLKEGIKPTVIMVDPPRKGLTESFVYSAAQTKADKITYISCNSATMARDIKLFEELGYHLVKIQPVDLFPMTHHVECVALLVKA

SEQ ID NO: 3945 - DNA, 1386 bp, Streptococcus pyogenes
atggttagccctagaaaaggaaaaagaataagaatgttgaaaaaaaatgatattatccaagttgctatttcagatttaagccatgagggagcaggtgtcgctaaacacgatggttttgttttctttgttgataatgccttgccagaagaagtgattgacatgcgtgtcttaaaggtcaataaaaacagcggttttggcaaagtagaagcctatcattacctgtcgtcagctagaaatgcagatgtcaatttaacttatttgcgaacaggcattgcagaccttggacatctaacttatgaagaccaactgactttcaaaaagaaacaagttcaggacagcctctataaaattgctggaatcagtgacgtgacagtcgaaagcacgattgggatgacagaacctttagcttaccgaaataaggctcaagttcctgttagacgtgttaatggtcagctagaaacaggctttttccgcaagcattctcatgacttgattcctatttcggattattatattcaggacaaagagattgatcgtctcattaattttacccgtgatttattacgccgctttgatattaaaccgtatgacgaaacagaacaaacaggtctcttgagaaatattgttgttcgccgaggtcattactctggagaaatgatgctggtcttagtgactacacgcccaaaagttttccgtgttgaccaagtcattgaaaaaatcgttgaagcttttccagcagtggtgtctattattcaaaatattaatgataagaacaccaatgcaatctttggtaaagatttcaaaacgctttacggcaaggataccattactgatagcatgcttggaaacaactatgccatttctgctcagtctttctaccaagtgaatacggttatggcagaaaaactctatcaaacagctatagccttttcagacctttctaaagatgatattgtgattgacgcctactcaggtatcggaaccattggcctatcatttgctaaaaccgttaaagctgtttatggtgttgaagtgattgaagcagctgttagagatgctcaacagaatgccgctcttaatggcatcaccaatgcctactttgtcgcagataccgcagaacatgccatggcaacatgggcgaaagatggcatcaaaccaagtgttattctggtagacccgccacgaaaaggcttaacagaaagtttcatccaagccagcgtggcaatgggaccacaaaaaattacctacgtttcctgcaacccagccaccatggcgcgtgacataaagcgttatcaagagttgggttacaaactggccaaagtacagcccgtagatttgtttccgcaaacgcatcacgtcgagtgcgtagtattgctaatcaaggag

SEQ ID NO: 3946 - protein, 462 aa, Streptococcus pyogenes
MVSPRKGKRIRMLKKNDIIQVAISDLSHEGAGVAKHDGFVFFVDNALPEEVIDMRVLKVNKNSGFGKVEAYHYLSSARNADVNLTYLRTGIADLGHLTYEDQLTFKKKQVQDSLYKIAGISDVTVESTIGMTEPLAYRNKAQVPVRRVNGQLETGFFRKHSHDLIPISDYYIQDKEIDRLINFTRDLLRRFDIKPYDETEQTGLLRNIVVRRGHYSGEMMLVLVTTRPKVFRVDQVIEKIVEAFPAVVSIIQNINDKNTNAIFGKDFKTLYGKDTITDSMLGNNYAISAQSFYQVNTVMAEKLYQTAIAFSDLSKDDIVIDAYSGIGTIGLSFAKTVKAVYGVEVIEAAVRDAQQNAALNGITNAYFVADTAEHAMATWAKDGIKPSVILVDPPRKGLTESFIQASVAMGPQKITYVSCNPATMARDIKRYQELGYKLAKVQPVDLFPQTHHVECVVLLIKE

SEQ ID NO: 3947 - DNA, 1371 bp, Streptococcus agalactiae
atgtcaagaaataattacggtcagctaaatcatcatgaagagctacgatataactatcttttaaaaaacatccattatcttaatgaacgtgaaaagatggaatttcagtaccttcattataaaaaaacagcagtacgaccacagagaaggacagaaagtccaccaactaattcttattatgaggaaccttattctgattcttattatcaagatgacgatttttactcagagcctcagctaacctcacaaggtttaccaatttatcaagaagagagagctccgaagaagaaaaaacaaagggccagaaaagaaaaacagagggtgaaggttatggcgcctttccctccaaaggctataaccccccctagaaagaaaaaaaaatttaagggtttcctaaagttcataggtattatattactaattgttttatcaggtatggttttcatgtttgttaaaggaatgcgtgatgtgaataatgggaagtcacattatagccctgcaattattgaagattttaagggaaaagatgctgttgatgggactaatatcttaattttaggtagtgataaacgtgtcagcgagagatctactgatgcgagaacagataccataatggttgctaatgttggtaacaaggataataaggttaagatggtgagttttatgcgagatctcttagtcaatattcctaattatagtacggaaggttactatgatatgaaattaaatgcgtcttttaatttgggagaacaagataatcataaaggagcagagtatgttcgacaaacgttgaaaaatcattttgatattgatataaaatattatgttatggttgactttgagacatttgcagatgctattgatacactgtttcctaatggtgtcaagattaatgctaaatttggacttgtcggtggacaatctgctgattcagttaaagttcctgatgatttaaggatgaaaaatggcgttgtacctagccaaaaaattaaggttgggattcagtacatggatggaaggacccttctaaattatgctcgtttcagaaaagacgatgatggggactttggtcgaacacaacgtcaacaacaagttatgagagctattgtctctcaaataaaagacccacgtcgtctctttacaggttctgctgctatcggtaaagcctatgctttaacttcaagtaatttatcttatagctttgtcctaacagatggcattccaattttatcagatgctaaaaatggtattaagcaaatgacaattccaagagaaggagattgggtagatgattatgaccagtatggtggtcaagggttaacaattgattttgctaagtacaaaaagatcctaaagaaaatgggactgcgt

SEQ ID NO: 3948 - protein, 457 aa, Streptococcus agalactiae
MSRNNYGQLNHHEELRYNYLLKNIHYLNEREKMEFQYLHYKKTAVRPQRRTESPPTNSYYEEPYSDSYYQDDDFYSEPQLTSQGLPIYQEERAPKKKKQRARKEKQRVKVMAPFPPKAITPPRKKKKFKGFLKFIGIILLIVLSGMVFMFVKGMRDVNNGKSHYSPAIIEDFKGKDAVDGTNILILGSDKRVSERSTDARTDTIMVANVGNKDNKVKMVSFMRDLLVNIPNYSTEGYYDMKLNASFNLGEQDNHKGAEYVRQTLKNHFDIDIKYYVMVDFETFADAIDTLFPNGVKINAKFGLVGGQSADSVKVPDDLRMKNGVVPSQKIKVGIQYMDGRTLLNYARFRKDDDGDFGRTQRQQQVMRAIVSQIKDPRRLFTGSAAIGKAYALTSSNLSYSFVLTDGIPILSDAKNGIKQMTIPREGDWVDDYDQYGGQGLTIDFAKYKKILKKMGLR

SEQ ID NO: 3949 - DNA, 1449 bp, Streptococcus pyogenes
atgacaaaataccccatgggtggccttagtcaccatgaagaattacgttatttttatctcctaaggaatttgagttaccttagtgagaatgaaaaaaaagagtttgcttttttaaaatctaaattggaaattggtcgagcttatgctccttctaagcagcattataggaagtcaaaacggcaagaaccttactttgaagatgactactataacgactactcaccaaatgatttactagaagatgatgacgtcaatcatgactcttcttttgttccatatggtttaccgatatatcctaaagaagacagatatttaaacaaaaaaacaaaacttacagctcgtagacctatagatgctccgcagcctattgatgaagacgatgcttttttaacagagtctgttgctcgttgtgctcttcctagatctcaaaaaaggaagcataagaaaaaaggatgtatgaaatggttttttaacattcttggcttattgctaatgactgtgcttatggggttagggttgatgtttgcaaaaggggtttttgatatttctactaataaagctaattacaaaccagctgtttcccaagcttttgatggtcaagaaactcaagatggtacgaacattctgattttgggttctgaccaacgagttactcaaggttctacagatgctcgcacagataccattatggttgtcaatgtcggcaaccatgctaaaaaaataaaaatggtctcttttatgcgtgacactttgattaacattccaggatacagttataatgataattcgtatgatcttaaattaaatagtgcatttaatcttggagagcaagaagatcaccacggagcagagtacgttcgacgggccttaaaacataattttgatatcgacattaagtattatgtgatggtagattttgaaacatttgcagaagctattgacaccttgtttccaaatggtgttaagattgatgccaaatttgcgacagtaggtggtgtagctgttgactccgtagaagttccagatgacttgcgaatgaaaaatggggttgttcccaaccaaaccatcgaagttggagaacaacgcatggatggtagaaccttgctcaactatgctcgtttccgtaaagatgacgaaggagatttcggacgaaccgtccggcagcaacaggttatgtcagctgttatgtcccaaatcaaagacccaactaaactctttacagggtctgcggctattggtaaaatctatgcgctgacttcgaccaatgtttctttcccatttgttgttaaaaatggtgtttctgttttaggaagtgggaaaaatggagttgagcacgtgaccatcccagaaaatggggattgggttgacgaatacgatatgtatggaggacaagccctttacatagattttgataagtatcagaaaacgttagccaaattaggtctgcgc

SEQ ID NO: 3950 - protein, 483 aa, Streptococcus pyogenes
MTKYPMGGLSHHEELRYFYLLRNLSYLSENEKKEFAFLKSKLEIGRAYAPSKQHYRKSKRQEPYFEDDYYNDYSPNDLLEDDDVNHDSSFVPYGLPIYPKEDRYLNKKTKLTARRPIDAPQPIDEDDAFLTESVARCALPRSQKRKHKKKGCMKWFFNILGLLLMTVLMGLGLMFAKGVFDISTNKANYKPAVSQAFDGQETQDGTNILILGSDQRVTQGSTDARTDTIMVVNVGNHAKKIKMVSFMRDTLINIPGYSYNDNSYDLKLNSAFNLGEQEDHHGAEYVRRALKHNFDIDIKYYVMVDFETFAEAIDTLFPNGVKIDAKFATVGGVAVDSVEVPDDLRMKNGVVPNQTIEVGEQRMDGRTLLNYARFRKDDEGDFGRTVRQQQVMSAVMSQIKDPTKLFTGSAAIGKIYALTSTNVSFPFVVKNGVSVLGSGKNGVEHVTIPENGDWVDEYDMYGGQALYIDFDKYQKTLAKLGLR

SEQ ID NO: 3951 - DNA, 510 bp, Streptococcus agalactiae
atgcctaaggtattattgggattcatgggagttggcaagactagtgttgccaactgcttagaaaatgaagtaattgatatggatagtctgattgaaaaacatattggtatgtcaatttcccgattttttacagaagaaggagaagcctcctttcgtgctttagaatctcaatttttaaacgaacttttaaagaaaaaaaatgaaggacttgtgatagctagtggaggaggtattgtactccttgaagaaaatcgtcgtcttttaactttaaatcgtcataataatattcttttaacaggaagttttgaagtcttatatcatcgtataaaaaaagatgagaagaatagaagaccattatttttaaaccattcaaaagaagaattttatgatatttatcaaaaacgcatgttactctatagtggtttgtctgatatgattattgataccgattatcttacaccacaaaaaatagctactgtaattggagagtcactggttaatttatctaac

SEQ ID NO: 3952 - protein, 170 aa, Streptococcus agalactiae
MPKVLLGFMGVGKTSVANCLENEVIDMDSLIEKHIGMSISRFFTEEGEASFRALESQFLNELLKKKNEGLVIASGGGIVLLEENRRLLTLNRHNNILLTGSFEVLYHRIKKDEKNRRPLFLNHSKEEFYDIYQKRMLLYSGLSDMIIDTDYLTPQKIATVIGESLVNLSN

SEQ ID NO: 3953 - DNA, 489 bp, Streptococcus pyogenes
atgactaaagtgttattgggatttatgggagtggggaaaacaacggtttcgaaacacctaagtatgcactgtaaagatatggatgctattattgaagctaaaatcggtatgtctattgcagctttttttgaacagcatggagaaatagcatttcgaacaattgaaagtcaagtgttaaaagatctattgtttgcaaatgataatagtatcatcgtaacaggtggcggtgtagtggttttacaagaaaatcgacaattactgagaaaaaatcaccagcataatattttattggtagcttcttttgaaactttgtaccagcgtttaaaacatgataaaaagtctcaaagacctctatttcttaagtactctaaggaagcattttatgaattttatcaacaacgtatggtattttatgagggactttcagatttagtaatcagagttgaccatcgtacgcctgaagaagttgccaacatcattgagggttat

SEQ ID NO: 3954 - protein, 163 aa, Streptococcus pyogenes
MTKVLLGFMGVGKTTVSKHLSMHCKDMDAIIEAKIGMSIAAFFEQHGEIAFRTIESQVLKDLLFANDNSIIVTGGGVVVLQENRQLLRKNHQHNILLVASFETLYQRLKHDKKSQRPLFLKYSKEAFYEFYQQRMVFYEGLSDLVIRVDHRTPEEVANIIEGY

SEQ ID NO: 3955 - DNA, 1293 bp, Streptococcus agalactiae
ttgggagttatcatgaaattactgactaatgcaaatactctcaagggaaccatccgtgttcctggcgataaatcaataagtcacagggctattatttttgggagtatatctcagggagttacccgaattgttgatgtcttaagaggcgaggatgttttatcaactatagaggcttttaaacaaatgggggttctaattgaagacgatggcgagataatcactatctatggcaaaggatttgcaggtttaacacaaccgaataatctcttagacatgggaaactctggtacttcaatgcgtctgatagcaggtgtgttagctggtcaagagtttgaagtgacgatggttggagacaatagtttgtcaaagagacctatggatcgtatagcattgcctttaagcaaaatgggagctagaatttcgggagtaactaaccgtgatttaccaccattaaaacttcaaggtacaaaaaaattaaaacctattttttaccatttacccgtagcttctgcacaagtaaaatcagctttaatttttgcggctttacaaactaagggagaatctctcattgtagaaaaagagcaaacaaggaatcatactgaggacatgattcggcaatttggtggacatttggatattaaagataaagaaattcgactcaatggcggtcagagcttagtaggacaagatataagagttcctggtgatatttcgagtgctgccttttggatagtagcgggtcttattattcctaacagtcatattattttagaaaacgtaggtataaacgagacacgaactggaatccttgatgtcgtcagtaaaatgggtggaaaaattaagttatcttcggttgataatcaagtaaaatcagcaacccttacagttgattactctcatctacaagctactcatatttctggggctatgattccacgtctgattgatgaattacctattattgctcttttagcaacacaagctcaaggcaccacagtcatagcagatgctcaggaattaaaggtgaaagagacagatcggattcaggtcgttgtcgaatcgctaaaacagatgggtgctgatattactgctacagcagatggtatgattatacgtggtaatacccctcttcacgctgcttcacttgattgtcatggagatcatagaataggaatgatgatagctattgctgctctcttggtcaaagaaggcgaagtagatttatctggtgaagaagctattaatacaagctatcctaactttttagaacatttggagggattagttaatgcc

SEQ ID NO: 3956 - protein, 431 aa, Streptococcus agalactiae
MGVIMKLLTNANTLKGTIRVPGDKSISHRAIIFGSISQGVTRIVDVLRGEDVLSTIEAFKQMGVLIEDDGEIITIYGKGFAGLTQPNNLLDMGNSGTSMRLIAGVLAGQEFEVTMVGDNSLSKRPMDRIALPLSKMGARISGVTNRDLPPLKLQGTKKLKPIFYHLPVASAQVKSALIFAALQTKGESLIVEKEQTRNHTEDMIRQFGGHLDIKDKEIRLNGGQSLVGQDIRVPGDISSAAFWIVAGLIIPNSHIILENVGINETRTGILDVVSKMGGKIKLSSVDNQVKSATLTVDYSHLQATHISGAMIPRLIDELPIIALLATQAQGTTVIADAQELKVKETDRIQVVVESLKQMGADITATADGMIIRGNTPLHAASLDCHGDHRIGMMIAIAALLVKEGEVDLSGEEAINTSYPNFLEHLEGLVNA

SEQ ID NO: 3957 - DNA, 1290 bp, Streptococcus pyogenes
atgaaacggatgaaattgcgaacaaatgcaggaccattacagggaacgattcaagttccaggagacaagtccattagtcaccgggcagtcatattaggagccgttgctaaaggggaaacacgagtaaaaggactcttaaaaggagaagatgtgctttccacgattcaagcctttaggaatttgggggtccgtatcgaagaaaaagatgaccagcttgtgatagaaggtcaaggttttcaaggattgaacgctccttgtcagacacttaatatgggaaattctggaacctctatgcgcctcattgctggcttattggcaggtcaaccttttagtgtcaaaatgattggcgatgaaagcttatccaaacgtcctatggatcggattgtttatccgttaaagcaaatgggggttgagatatctggagaaacagataggcaatttcctccactacaattgcaaggtaatcgtaatttacaaccaatcacatataccttgcctatctcttctgctcaggttaagtcagctattttattagcagctttgcaagcaaaaggaacaacacaggttgttgaaaaagagattactcgaaaccatacagaagaaatgattcaacaatttggtggacgattgatagttgatggtaaacgcattactttggtgggaccccagcagctcactgctcaagagataactgtccccggagatatttctagtgcagctttttggcttgtcgccggcttaattattcctggttcggagctccttttaaagaatgttggagtcaatccgacacgaacagggattcttgaagtggttgaaaaaatgggagcacagattgtctatgaagatatgaataagaaagagcaagtaactagtattcgagtggtatattctaacatgaaaggaactatcatatcaggaggtcttatccctcgattgattgatgaactgcccatcattgcacttcttgcaacccaagcacaaggaacaacctgtattaaagatgctcaagaattacgagtcaaagaaacagatcgtattcaagtagtaactgatattcttaacagtatgggagctaatatcaaagcgacagcagatggcatgattatcaaaggccctacggtactatatggggctaacacaagtacctatggagatcatcgtattggtatgatgacagcaattgcagccttgcttgttaaacaaggacaggtccatttggataaagaagaagccatcatgacgtcttatccaacgtttttcaaagatttagaaaggctgtgtcatgac

SEQ ID NO: 3958 - protein, 430 aa, Streptococcus pyogenes
MKRMKLRTNAGPLQGTIQVPGDKSISHRAVILGAVAKGETRVKGLLKGEDVLSTIQAFRNLGVRIEEKDDQLVIEGQGFQGLNAPCQTLNMGNSGTSMRLIAGLLAGQPFSVKMIGDESLSKRPMDRIVYPLKQMGVEISGETDRQFPPLQLQGNRNLQPITYTLPISSAQVKSAILLAALQAKGTTQVVEKEITRNHTEEMIQQFGGRLIVDGKRITLVGPQQLTAQEITVPGDISSAAFWLVAGLIIPGSELLLKNVGVNPTRTGILEVVEKMGAQIVYEDMNKKEQVTSIRVVYSNMKGTIISGGLIPRLIDELPIIALLATQAQGTTCIKDAQELRVKETDRIQVVTDILNSMGANIKATADGMIIKGPTVLYGANTSTYGDHRIGMMTAIAALLVKQGQVHLDKEEAIMTSYPTFFKDLERLCHD

SEQ ID NO: 3959 - DNA, 1062 bp, Streptococcus agalactiae
atgaaaagaaaacagtttataaaattaggaattgcaaccttactaacggttatttcgctttacacaccaataaacctagctacaaatcataccacagaaaatattgttactgctcaagagtataaaacaaaagagaatggtactttaccttttaaacacaaacgacaattggttttaggagagttggatgacaaaggtcgtgccacattcgcacatattcagctaaaagttaaagatgaacccaagaaaaagagagtaaaacgtttaaaaacaacccctgttggatggcacaattttaaattctattataatgatggtactcaaaaagcttggctaatgagccgaggccgtcttatttgccaccaatttagtggactaaacaatgaaagaaagaatttagttccaatgacgaattggctaaatactggaaactacaatagcacgaattcatctaaccctgagagcatgctattctatgaaaaacaactaaagacttggctttcgactcataaaaactactacttagattataaagtaacaccaatttatcaaaataatgaactaattccaagaaaaattgaattaaaatatgttggtattgataagactgggaaattattacctatttttatcggaaacaaatccactcaagatcaattcggcatcagcactgttaccttagagaatacctcaccaaatgctaccattgactacctcagcggaaaggctcaaaatactgtcttatcagctaaagaacaaagaaaacttatcgctaagcacgaagaagaaaaacgacttgcagaaaagaaagttgaagaggaaaaagctgctgctgaaactcagaaaaaactggaagaagaacaagcaaggcttgctgctgaagctcaaaggaagcaaaaagaggagcaagcaaggctcgcagctgaaactcagaaaaaacaagaaactctagtacaagaacaaactagtcaaggctacaaacgtgactatagaggaaggtggcatcgtccaaatggacaatacgcttcaaaagcagaaatcgctgctgctggattgcaatgg

SEQ ID NO: 3960 - protein, 354 aa, Streptococcus agalactiae
MKRKQFIKLGIATLLTVISLYTPINLATNHTTENIVTAQEYKTKENGTLPFKHKRQLVLGELDDKGRATFAHIQLKVKDEPKKKRVKRLKTTPVGWHNFKFYYNDGTQKAWLMSRGRLICHQFSGLNNERKNLVPMTNWLNTGNYNSTNSSNPESMLFYEKQLKTWLSTHKNYYLDYKVTPIYQNNELIPRKIELKYVGIDKTGKLLPIFIGNKSTQDQFGISTVTLENTSPNATIDYLSGKAQNTVLSAKEQRKLIAKHEEEKRLAEKKVEEEKAAAETQKKLEEEQARLAAEAQRKQKEEQARLAAETQKKQETLVQEQTSQGYKRDYRGRWHRPNGQYASKAEIAAAGLQW

SEQ ID NO: 3961 - DNA, 756 bp, Streptococcus pyogenes
atgaaattatctaaacaaaaggcaagtttgcttaccgctgttttactgttactttctctttctataacgacaataactgttgacgcagctagggtacgaacttatccgaatgtatcccatgcaaacacacattataaaaatactgtttctagtaagctcttaccttttactgctaattatcagttacaacttggtgagttggataaccttaaccgcgctaccttttcacatatccaactgcaagatagacacgaaactaaagatgtacgcactaaaataaattatgaccctgtgggatggcacaactatcaatttccatacggagatggctcaaaatcttcatgggtaatgaatcgtgggcatctagtcggatatcaattttgtggattaaacgatgaaccaagaaatttagtggcaatgacagcctggctaaacacaggtgcttattcaggagcaaatgacagcaatcctgaagggatgttatactatgaaaaccgtttagattcttggcttgcacttcaccctgacttttggctagattataaagtcactcctatatatagtggcaatgaagtagtgcctcgacaaattgaattacagtatgttggaattgattcatctggtgagttgcttactataaggctaaatagtaataaagaaagtattgatgaaaatggtgttactacagtaatcttagaaaactctgctccaaatatcaaccttgactatttaaatggaactgccactcctaaaaac

SEQ ID NO: 3962 - protein, 252 aa, Streptococcus pyogenes
MKLSKQKASLLTAVLLLLSLSITTITVDAARVRTYPNVSHANTHYKNTVSSKLLPFTANYQLQLGELDNLNRATFSHIQLQDRHETKDVRTKINYDPVGWHNYQFPYGDGSKSSWVMNRGHLVGYQFCGLNDEPRNLVAMTAWLNTGAYSGANDSNPEGMLYYENRLDSWLALHPDFWLDYKVTPIYSGNEVVPRQIELQYVGIDSSGELLTIRLNSNKESIDENGVTTVILENSAPNINLDYLNGTATPKN

SEQ ID NO: 3963 - DNA, 1305 bp, Streptococcus agalactiae
atgtcaattattactgatgtttacgcacgcgaagtccttgactcacgcggtaacccaacacttgaagtagaagtttatacagaatcaggtgctttcggacgtggtatggttccttcaggagcttctactggtgaacacgaagcagttgaacttcgcgacggcgacaagtctcgttacggtggtcttggaacacaaaaagctgttgacaatgtaaataacgttattgcagaagcaatcattggttatgatgtacgcgaccaacaagctatcgaccgtgctatgatcgctcttgacggaactcctaataaaggtaaattaggtgcaaatgctattcttggtgtttctattgccgtagcacgtgctgcagctgattaccttgaagtaccactttacagctaccttggtggattcaacactaaagttcttccaactccaatgatgaacatcatcaacggtggttctcactcagacgctccaatcgcattccaagaattcatgattatgccagttggtgcaccaactttcaaagaagcacttcgttggggtgctgaagtattccatgctcttaagaaaatccttaaagaacgtggtcttgaaacagctgttggtgatgaaggtggatttgcacctaaatttgaaggtactgaagatggcgtagaaactattcttaaagctattgaagcagctggttacgaagctggcgaaaacggaatcatgattggttttgactgtgcttcatcagagttctacgatgcagaacgtaaagtatacgactacagtaaattcgaaggtgaaggtggagcagttcgtactgctgcagaacaaatcgattaccttgaagagttggttaacaaatacccaatcatcactattgaagatggtatggatgaaaacgactgggatggttggaaagctcttacagaacgccttggtggacgtgtacaattagttggtgacgatttcttcgttacaaatactgattacttagcacgtggtatcaaagaagaagctgctaactcaatccttatcaaagttaaccaaatcggtactttgacagaaactttcgaagctattgaaatggctaaagaagctggttacactgcagttgtatcacaccgttcaggtgaaactgaagattcaacaatcgctgatatcgcagttgcaactaacgctggtcaaattaaaacaggttcattatcacgtactgaccgtattgctaaatacaaccaattacttcgtatcgaagaccaacttggtgaagttgctcaatacaaaggtatcaaatcattctacaacttaaaaaaa

SEQ ID NO: 3964 - protein, 435 aa, Streptococcus agalactiae
MSIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 3965 - DNA, 1305 bp, Streptococcus pyogenes
atgtcaattattactgatgtatacgctcgcgaagtccttgactcacgcggtaacccaacacttgaagtagaagtttatacagaatcaggtgcattcggacgtggtatggttccttcaggagcttcaactggtgaacatgaagccgttgaacttcgtgatggtgacaaatctcgttaccttggtctaggtactcaaaaagcagttgataacgttaataacattatcgctgaggcaatcatcggttacgatgttcgcgatcaacaagctatcgaccgtgcaatgatcgctcttgacggtactcctaacaaaggcaaacttggtgctaatgctattcttggtgtttctatcgctgttgctcgtgcagctgctgactatcttgaagtgccactttacacttaccttggcggattcaacactaaagttcttccaactcctatgatgaacatcatcaacggtggatcacactcagatgccccaattgcattccaagagttcatgatcatgccagttggtgcacctactttcaaagaaggtcttcgttggggtgctgaagttttccacgctcttaagaaaattcttaaagaacgcggacttgttacagctgtaggtgacgaaggtggatttgctcctaaatttgaaggaactgaagacggtgtagaaactatccttaaagctattgaagcagctggttacgaagctggtgaaaacggcattatgatcggttttgactgtgcatcatcagaattctacgacaaagaacgtaaagtttacgactatactaaatttgaaggtgaaggcgctgctgttcgtacatctgcagaacaagttgattaccttgaagagttggttaacaaatacccaattattactatcgaagatggtatggatgaaaacgactgggatggttggaaagttcttactgaacgcctaggcaaacgtgttcaattggttggtgacgacttcttcgttacaaacactgaataccttgctcgtggtatcaaagaaaatgcagctaactcaatccttatcaaagttaaccaaatcggtactttgactgaaacgtttgaagctatcgaaatggctaaagaagctggatatactgccgttgtatcacaccgttcaggtgaaactgaagattcaacaatcgctgacatcgcagttgcaacaaacgctggccaaatcaaaacaggttcattgtcacgtacagaccgtattgctaaatacaaccaattacttcgtatcgaagatcaacttggtgaagttgctcaatacaaaggtatcaaatcattctataacttaaaaaaa

SEQ ID NO: 3966 - protein, 435 aa, Streptococcus pyogenes
MSIITDVYAREVLDSRGNPTLEVEVYTESGAFGRGMVPSGASTGEHEAVELRDGDKSRYLGLGTQKAVDNVNNIIAEAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 3967 - DNA, 186 bp, Streptococcus agalactiae
atgacaatagcccaactcattgttaaccaaagagggcttactttagcgttaactccaaagagtaaacctggtagcatcatccataagaatgaagctccagcaaagaaaagtccatacgcaaattttttaggtgatgaaggttgcttacttccccatttagcccataaccaagcaaagaatggtaca

SEQ ID NO: 3968 - protein, 62 aa, Streptococcus agalactiae
MTIAQLIVNQRGLTLALTPKSKPGSIIHKNEAPAKKSPYANFLGDEGCLLPHLAHNQAKNGT

SEQ ID NO: 3969 - DNA, 1080 bp, Streptococcus agalactiae
atggttggtaatttatatggagaaaatgattctcgtcgtgatgctggttttagtatctttgtttttggtattaaccttggtgcttttatttcacccattgtagtggggtacctcggacaagaagtaaatttccatcttggtttctcacttgctgctattggtatgttctttggtctcctccaatataccttagatggaaaaaaatatttgactgaagagagtctcagaccaaacgatcctttaagtcctgaagaaaagtcctctctatataaaaaagttgggcttatccttattggtattgttattgtacttattctacttcacttgatgcatatgctaacaattgaagtaattatcgatatttttagtattattgcaatcgccatcccaattatttattttatcaagattttaagtagtaaaaagatttcttctgttgagcgttctcgagtgtgggcatatatccctctctttatcgcctcaattctattttggtcaattgaagaacaaggttcagttgtcttagccttatttgcagatgaacaaacaaaactttaccttaacttctttgggcatcatattaatttcccatcaagttatttccaaagtatgaaccctctcttcattatgctttatgtaccattctttgcttggttatgggctaaatggggaagtaagcaaccttcatcacctaaaaaatttgcgtatggacttttctttgctggagcttcattcttatggatgatgctaccaggtttactctttggagttaacgctaaagtaagccctctttggttaacaatgagttgggctattgtcatcgttggggaaatgctaatctcaccagttggattatcagcaactagtaagctcgcacctaaagcattccaagctcaaatgatgagcatctggttcttaagtaatgctgcagcacaagctattaacgctcaaatcgttaaattgtacacacctgatactcaaactctttattatggtgttgttggtggtataacagttgtatttggatttatcctcttattttatgttccacgcattgaaaaactaatgtctggagttaaa

SEQ ID NO: 3970 - protein, 360 aa, Streptococcus agalactiae
MVGNLYGENDSRRDAGFSIFVFGINLGAFISPIVVGYLGQEVNFHLGFSLAAIGMFFGLLQYTLDGKKYLTEESLRPNDPLSPEEKSSLYKKVGLILIGIVIVLILLHLMHMLTIEVIIDIFSIIAIAIPIIYFIKILSSKKISSVERSRVWAYIPLFIASILFWSIEEQGSVVLALFADEQTKLYLNFFGHHINFPSSYFQSMNPLFIMLYVPFFAWLWAKWGSKQPSSPKKFAYGLFFAGASFLWMMLPGLLFGVNAKVSPLWLTMSWAIVIVGEMLISPVGLSATSKLAPKAFQAQMMSIWFLSNAAAQAINAQIVKLYTPDTQTLYYGVVGGITVVFGFILLFYVPRIEKLMSGVK

SEQ ID NO: 3971 - DNA, 189 bp, Streptococcus agalactiae
atgtcacgcagtcaaaaagttattttaactaatatgtgtcttattgaagataataaaggacgtattgtgatgcaaatccgtgatcctaaacgttattcttggtcaggagctgctttaccaggcggccatattgaagaaggagaatgctctcgttcgagaagttcacgaggagacaggtttaacaataag

SEQ ID NO: 3972 - protein, 63 aa, Streptococcus agalactiae
MSRSQKVILTNMCLIEDNKGRIVMQIRDPKRYSWSGAALPGGHIEEGECSRSRSSRGDRFNNK

SEQ ID NO: 3973 - DNA, 1323 bp, Streptococcus agalactiae
atgattaacttatttgatagttacactcaatcaagttgggatttacatttttccttgataaaatcaggttatattaaccctactatagctttgaatgatgatggttttttaccagacgacgtaacatcaccctatttatattacactggttttgcaaagacaggtgctggccgcccactttactacaatgaacttagagttcctgatacatgggaaattattggttttagtagtggtgctgatattgttgacttaggtgtcaaaaagggcagaattatttatgcaaacccaaatcataagcgtctaataaaagaggtagactggtttgatgagcaaggtagagtcattttaaaagatcgctttaataagtttgggttctgttttgcacaaaccttttataacgcggatggtcaagcgattcagacgtcatattataataaggataggcaagaggttatatcagagaaccatatgacaggggattatattttaaatgataataatcagtttaaggtttttaaatctaaagttgaatttgtcataaattatcttcaagaagcaaaatttaacttagatagaatcttctataattctctgtcaacaccatttttagtaagcttttaccttaatcgtctagagagtaaagatgttctcttttggcaggagcctctcgtagatgatattccaggaaatatgcgcttattattgaacaatccttccccaaacactaaaattgtaattcaaagttatgaagcttatgctaatgctatgaggttattaactgacgaagaacaaaaacaagttagctttttaggatttatgtatcctcttaaagagacagaaaaattacataaccaagctcttattttgacgaattctgatcaaatcgaagcattagaaagtttagtgacttctcttcctaatttgacttttaacataggtgctttgaccgagatgtctagtgatctcatgaattttggcaaatatgataatgttgtactctacccaaatatcacaacaaatcaaatacaatatttatcaaatatttgtgctttttatcttgatattaatcatcataatgagatattatcagcagttcgctctgcttttgaacatcaacagttaatttttgctttcgaagagactagtcatcaaattcgttttgtatcacctaaaaatatttttccaaaaaaagatatttttacatttatttcgcacttgcagccactaattggcaataaatgtaatatagaaaaagcattaaaacagcagcttgaagattgtcatgtttcaagctctactcagtatcaatctgtaattaat

SEQ ID NO: 3974 - protein, 441 aa, Streptococcus agalactiae
MINLFDSYTQSSWDLHFSLIKSGYINPTIALNDDGFLPDDVTSPYLYYTGFAKTGAGRPLYYNELRVPDTWEIIGFSSGADIVDLGVKKGRIIYANPNHKRLIKEVDWFDEQGRVILKDRFNKFGFCFAQTFYNADGQAIQTSYYNKDRQEVISENHMTGDYILNDNNQFKVFKSKVEFVINYLQEAKFNLDRIFYNSLSTPFLVSFYLNRLESKDVLFWQEPLVDDIPGNMRLLLNNPSPNTKIVIQSYEAYANAMRLLTDEEQKQVSFLGFMYPLKETEKLHNQALILTNSDQIEALESLVTSLPNLTFNIGALTEMSSDLMNFGKYDNVVLYPNITTNQIQYLSNICAFYLDINHHNEILSAVRSAFEHQQLIFAFEETSHQIRFVSPKNIFPKKDIFTFISHLQPLIGNKCNIEKALKQQLEDCHVSSSTQYQSVIN

SEQ ID NO: 3975 - DNA, 1506 bp, Streptococcus agalactiae
atgacagtttataatataaaccatggaattggttgggcaagcagcggtgttgagtacgctcaagcataccgaggttctgttttgagaaaacttggaattgatgctaagtttatttttacagattttttttcagctgataatattattagcctcacgcgaaatataggttttcaggataaagaaattatttggttatataattttttttcagatattgagcttgccccgacaacttttagtatagaagatttgcaaaaacaatatcttggaaaacttgttcgaaaagaagataaaggtcgggtaatcaagtttttctacgaagatgaaaatatctatttaacagtttaccttgataattttaacaaggataaagtgcatcgtgtagaaatcgtttcaaataacaaccttatcagaaaagattattatagttatacacgtactttctcagagtattactatcctaaagatggtgtagctcacctttatcaacgtagattctacaatgaagatgaaagtacagcctttttggagatggtagaaaatagctcaagtcgttttattatcaatggcagacttttaccatccaaagtagctttttttgattattttttggaatcaatgactttcacttcaaaagatattattcttttggatagaggaactgataccgctcagagtcttttgcgccatggtaaacccgctaagctagggactgttgttcatgcggaacattttagtgagaatgctgtgactgctgacactattttatggaataactattacgattatcagtttactaacgctaatagatttgatttttttattacctccactgataaacaaacagaacttttggaacaacaatttaaacaatttacaaatcataatcctagaattataactatcccggtaggctcaattgacaatcttaaaatgccaatggacaatcgccgtccgtactctattttgacagcttcacgcctagctagtgaaaaacatgtagattggttagtacgtgcagttattaggataagagaaattcttcctgaagtgacctttgatatctatggatcaggtggagaagaagaaaaaattagaaatattataaatgcagccaatgcaacggaatacattcgattgatgggacataaaaatctctcgaatgtttatcaaaattatgagttatatttgacagcttctaaaagtgaggggtttggcttaactttacttgaagctattggcgcaggacttcctttgattgggtttgatgttcgttatggtaatcaaacttttatcaaagacggagaaaatggttatctaattcctcgatttgatatggatgatgaggaagctattgtagaagcttttaaagagaaagtgttacaattattccaacaggatcaaaaggctttacgagaagcttcttacgccattgccgaaggattcttaacaaatgaagtagaaggaaaatggtataacttagttaaggagttggtacaagatgat

SEQ ID NO: 3976 - protein, 502 aa, Streptococcus agalactiae
MTVYNINHGIGWASSGVEYAQAYRGSVLRKLGIDAKFIFTDFFSADNIISLTRNIGFQDKEIIWLYNFFSDIELAPTTFSIEDLQKQYLGKLVRKEDKGRVIKFFYEDENIYLTVYLDNFNKDKVHRVEIVSNNNLIRKDYYSYTRTFSEYYYPKDGVAHLYQRRFYNEDESTAFLEMVENSSSRFIINGRLLPSKVAFFDYFLESMTFTSKDIILLDRGTDTAQSLLRHGKPAKLGTVVHAEHFSENAVTADTILWNNYYDYQFTNANRFDFFITSTDKQTELLEQQFKQFTNHNPRIITIPVGSIDNLKMPMDNRRPYSILTASRLASEKHVDWLVRAVIRIREILPEVTFDIYGSGGEEEKIRNIINAANATEYIRLMGHKNLSNVYQNYELYLTASKSEGFGLTLLEAIGAGLPLIGFDVRYGNQTFIKDGENGYLIPRFDMDDEEAIVEAFKEKVLQLFQQDQKALREASYAIAEGFLTNEVEGKWYNLVKELVQDD

SEQ ID NO: 3977 - DNA, 2385 bp, Streptococcus agalactiae
atgatagcctttaatagtttattttcgttagataagaaacgtttaaaaaaacttcagcgtactttaaatactatcaatagtttaaagggccaaatggcaacactatcaaatgaggagttgcaagctaagacaactgaatttagaaaacgtttagttaatggggaaacactagatgatatttgtgctgaagcttttgctgttgttagggaagctgatgagcgcgtattaggtctatttccgtatgatgtacaggtaatcggtggtcttgttctgcaccaaggaaatactgctgagatgaaaactggtgaaggaaaaacattaactgccactatgcctttgtatctcaatgctttagaagggaagggggcaatgttgctgactaataattcctaccttgctattcgagatgcggaagaaatgggaaaagtatatcgttttttaggattgagtgtcggtgtgggagtttctgataatgaggaagaggatagagatgctgcgactaagcgagctgtttatagttcggatattgtctatagtacaagtagtgcactaggctttgattatttaattgataacctagcttcatctaaatctcaaaaatatatgcccaagttacattatgctattgtagatgaagctgatgcagttcttctagatatggcccagactcctttagttatttcaggttcacctcgagtacaatctaatctctataaaatagcagatgaactaattcttagttttgaagaacaagttgattattattttgacaaagagcgtcaggaagtgtggataaaaaaccagggtgttcgtgaagctgagagatattttagaatccctcatttttataaacagtctaatcgagaacttgtgcgacatttgaacttatctttaaaagcacataaattatttgaacgaggaaaagattatgtggttgacgatggtgaaatcaagttgctagatgcgactaatggccgtgttttagaaggtactaaacttcaaggaggtgttcatcaagctattgagcaaaaagagcatcttaatgtcacaccagagtctcgagcaatggcttccattacctatcaaaatctttttagaatgtttactaaattggctggaatgacaggaactggaaaaactgctgaaaaagagtttattgaggtctatgatatggaagtagttagaattccaactaattctcctgttagacgaattgactatcctgataagatttatacaaccttaccagagaaaatccatgcaacgattgaatttgttaaacaggttcatgatacaggacaaccaatcctactagttgccggttctgtgagaatgtcagagctattctcagaattattattactaagtggtatccctcatagcctgttaaatgctcaaagtgcggttaaggaagcacagatgattgcagaagcagggcaaaaaggtgcggtcactgttgcaacgaatatggctggtcgtggtacagatattaagttaggtaagggagtatcagaattaggtggtcttgcagttattggaacggagagaatgaagagtcaaagaatggatttacaattaaggggacgttcgggtcgacaaggcgatattggttttagtcaattttttgtatcatttgaagatgatctaatgatagaatcaggtcctaaatgggcgcaagattactttaggaaaaatcgtgacaaagttaatccagaaaaacctaaagccttaggtcagagaagatttcagaagttattccagcaaactcaggaagctagtgacggtaagggagagtctgcacgtagtcaaacgatagagtttgattcgagtgtacagcttcagcgagagtatgtttatcgtgagagaaatgctttgatcaatggagaaagtggacattttagtccaagacagattattgatacagtgatttcttccttcattgcttatttagatggtgaagtagaaaaagaagaactcatttttgaagtaaatcgttttatatttgataatatgtcttacaatcttcaagggatttctaaagagatgtcacttgaagaaattaaaaactatttattcaaaatagccgatgagattcttcgagaaaagcataatttgcttggtgatagttttggtgactttgaacgtactgctgctttaaaagcgattgatgaagcttggattgaagaagtagattatctacaacaattacgtactgtggcaacagctcgtcaaacggcacagcgtaacccggttttcgaatatcataaagaagcatataaatcctacaatatcatgaaaaaagaaattcgtgaacaaacttttagaaatctacttttgagtgaagtatccttcaatgagaatggagatcttcaaatttattttata

SEQ ID NO: 3978 - protein, 795 aa, Streptococcus agalactiae
MIAFNSLFSLDKKRLKKLQRTLNTINSLKGQMATLSNEELQAKTTEFRKRLVNGETLDDICAEAFAVVREADERVLGLFPYDVQVIGGLVLHQGNTAEMKTGEGKTLTATMPLYLNALEGKGAMLLTNNSYLAIRDAEEMGKVYRFLGLSVGVGVSDNEEEDRDAATKRAVYSSDIVYSTSSALGFDYLIDNLASSKSQKYMPKLHYAIVDEADAVLLDMAQTPLVISGSPRVQSNLYKIADELILSFEEQVDYYFDKERQEVWIKNQGVREAERYFRIPHFYKQSNRELVRHLNLSLKAHKLFERGKDYVVDDGEIKLLDATNGRVLEGTKLQGGVHQAIEQKEHLNVTPESRAMASITYQNLFRMFTKLAGMTGTGKTAEKEFIEVYDMEVVRIPTNSPVRRIDYPDKIYTTLPEKIHATIEFVKQVHDTGQPILLVAGSVRMSELFSELLLLSGIPHSLLNAQSAVKEAQMIAEAGQKGAVTVATNMAGRGTDIKLGKGVSELGGLAVIGTERMKSQRMDLQLRGRSGRQGDIGFSQFFVSFEDDLMIESGPKWAQDYFRKNRDKVNPEKPKALGQRRFQKLFQQTQEASDGKGESARSQTIEFDSSVQLQREYVYRERNALINGESGHFSPRQIIDTVISSFIAYLDGEVEKEELIFEVNRFIFDNMSYNLQGISKEMSLEEIKNYLFKIADEILREKHNLLGDSFGDFERTAALKAIDEAWIEEVDYLQQLRTVATARQTAQRNPVFEYHKEAYKSYNIMKKEIREQTFRNLLLSEVSFNENGDLQIYFI

SEQ ID NO: 3979 - DNA, 990 bp, Streptococcus agalactiae
atgagtacgataagctacatttattgggatgatttttcaaggttttcttataattttggaacaaaattacaatttttaggaaaatcagtatgctttgaaaatccattagctccttctagcacaaacttgtatacatggagctcccagactaattatcagtcaaaaagaatttctcctaacttacctttactaagaaagggaactcgttatagcttgtcattaaatgcagaactcgatttagttagctctctttttgttcgcattgaattttacaatcgctttaatgagtctgttggttttgaactgttaaaaaaagatagtattatttttatctatcctaaagaggcttatacctataccattagtttgattaatgcaggttgtagcgattttacttttcattatttgaaacttgaggaagttacagatagcgttattcaggagaaaaatctatcgacagagtttactattgaagaacatcaagacgttttaaatcttcttttggtcgagaaaaaagatagtgtatatattaataaaatagaaagcatttctcaattgcaacagaaagtcgagttggtcagcaatccctcattaaattctgatagtttgatattacctgagttggaaaaggggttagaagatgcattaaaagtttttcctaacattaagattaatgtcattgcgtatggaacacaaggtaattttgctgctttatattatgctaaaaaatttcccagaataactgcctatattaatgattgttttgctcctttcggaattttacttaaatccttaccacacttgactgccaaacaacaaatatttcttagagaagtctgggatacgagagagacgtctccaaatgtaaagcactatggattggtttcagaaaattcctctttaaatttagtatcaatgatcttatctggtaatgaacatctaccttacctcacacttttaaaaaagcaggacgacaattatgatagcctt

SEQ ID NO: 3980 - protein, 330 aa, Streptococcus agalactiae
MSTISYIYWDDFSRFSYNFGTKLQFLGKSVCFENPLAPSSTNLYTWSSQTNYQSKRISPNLPLLRKGTRYSLSLNAELDLVSSLFVRIEFYNRFNESVGFELLKKDSIIFIYPKEAYTYTISLINAGCSDFTFHYLKLEEVTDSVIQEKNLSTEFTIEEHQDVLNLLLVEKKDSVYINKIESISQLQQKVELVSNPSLNSDSLILPELEKGLEDALKVFPNIKINVIAYGTQGNFAALYYAKKFPRITAYINDCFAPFGILLKSLPHLTAKQQIFLREVWDTRETSPNVKHYGLVSENSSLNLVSMILSGNEHLPYLTLLKKQDDNYDSL

SEQ ID NO: 3981 - DNA, 1557 bp, Streptococcus agalactiae
atgtcaaaaataaaacttacaattcttcaagttggtgaagagaactgggcaactaaagagaatatccctaataatatggaatggctctttattaaaccagatcaaatttctgactttgtaactacagaaaataattatcttacatcgtcaaagttattgcaaaaactacctcgaaaaatatctgctcttttgttgacagagcaaacttatggaccagagttatctagtttatcgtcattctttgaggtttatgaagtattttatcctaaagataaacatgctacggggataacagaagagtttttacgctcgaaaatggcccaacgatatgatagtagctctccagatcagctaattcgtcaattttataaagggctttttataggacaatacggagagaaacttcaagtttcacaaatacaaattagaaatgattttgaaggtgtagtaaactatcagggaaataactatcttgaattagaagggcaatttggtgagaactatagttttttgcttaattttgcttacaatattccattttcatcggatttttataatgagttatttttagaacacattatagagggtgatatagatattcgattggttatctcgttgattgttgatggttctgttgatgatattgctaaagagtggtactttgagaaggaagacctaaatcaacttatttctttagagtccgatattagtggtagccttgcagttaaactttttgctaagggaaagggtatcgttaagttaggtccattgcaccgtcgtaatggtagaggaggattgggcacatttctactaggaggagaacgtcacatagatgctataggtcatgaatttatgacttattttgatccagtagatttcaaaccacctctaactgtttatttttcgggatttcgttcagctgaaggctttgagggattctggatgatgaagagtatgaagactccattcatgttaatttgtgatccacgattacaaggtggtgccttttatataggaagcaaagaatatgaacaaaaaatagttgatgctattcaagaaaaactggcctttttaaattttagttctgatcagttaattttatccggactttcaatggggacttatggtgctacttaccatggtgctaagctaaatcctcatgctattattattggtaaaccaatatttaatttaggaacagttgctcaacgtgaaagattagagagaccagatggatttgctacttcattagatattcaactactcaatcaaggtgacttgaccagttcctcttctgagaagttaaataactatttttggaaatctatagaagaaggagatttttcaaatacgacttttgccttagcctatatgaaaaacgatgactatgatgcgactgccttttctgatttattgcaatattttagaggaaagaagcataagatattaggcagaggttgggatggccgacatggtgattgttctgcagaagttggtgcatggtttacaagtcagtataggcgaatgctatctaatgattttggaaggaaagaagaa

SEQ ID NO: 3982 - protein, 519 aa, Streptococcus agalactiae
MSKIKLTILQVGEENWATKENIPNNMEWLFIKPDQISDFVTTENNYLTSSKLLQKLPRKISALLLTEQTYGPELSSLSSFFEVYEVFYPKDKHATGITEEFLRSKMAQRYDSSSPDQLIRQFYKGLFIGQYGEKLQVSQIQIRNDFEGVVNYQGNNYLELEGQFGENYSFLLNFAYNIPFSSDFYNELFLEHIIEGDIDIRLVISLIVDGSVDDIAKEWYFEKEDLNQLISLESDISGSLAVKLFAKGKGIVKLGPLHRRNGRGGLGTFLLGGERHIDAIGHEFMTYFDPVDFKPPLTVYFSGFRSAEGFEGFWMMKSMKTPFMLICDPRLQGGAFYIGSKEYEQKIVDAIQEKLAFLNFSSDQLILSGLSMGTYGATYHGAKLNPHAIIIGKPIFNLGTVAQRERLERPDGFATSLDIQLLNQGDLTSSSSEKLNNYFWKSIEEGDFSNTTFALAYMKNDDYDATAFSDLLQYFRGKKHKILGRGWDGRHGDCSAEVGAWFTSQYRRMLSNDFGRKEE

SEQ ID NO: 3983 - DNA, 1542 bp, Streptococcus agalactiae
atgtttcattttattccatcttggtataatgaaaatcgtacttggtatgataataattacttgtggtatttcaagccgactaatgtcggttttgatgatactatcaaccaaatgaagatgtttgattatgctggaaaagagagtagattagttgtcttaaactatatgcccaatttacgttattatttacatcgctatgacttgttagaatcaggttattattcagtttttgatgatattcaagaaattgggaatgtaagacagcaaatgattgacttccgacaactcaattggcctgaaggggtggactttacctatactccgtttatagttttggtaaaaaagtcaggagatttaattgctaaggttcaatttggtgaagaaggaaatttaacgcatattgattattttgcaaatgaacaaatagctaagaaatacctctttgatgatagaggatttctatctagtattctctattatgataatggtggtgaagcctatcaagattatttagcaccatcaggggaaaggatcatgagagaatacctaagagaaggtgaccaccatgttgaaattaatcctaagaaagctattcattttttaaagttatcttactccgatattgaagagttgattagagagaaatatctgacctatctccataaagaagttagtaaatcagatactatcattgttagctttaatcaagttcataacgcatttattgttgggaacactagtaaaggaaatttaatattatctgttttctcggagaggaataatgctcacaatgtattggaggattactcttccttatctcgagcagacgctattatttgtgatagactagatattgctgcacaattgaaagaaaaaatagataaaccagttgttcatgtttctccctttgatacgcgtttagctttgggaaaaagtaatcaagttagagatttagaaatatattttgtcgtagatagactttcccataaagaattgcaaaagtctttaacatccttatataaggttatgctcaaaaataatgatataaaagtaacatttgtcagctacgaacgagaatttgaaagtcggcaattgacatatgactaccttaaagaagcaacaaaagtttttgatcagaaattctttagtttatcagacgatgatgccaatcaagttcttatgcaatctgatgaagtagaaaaggaaaaaacacgcctttcttttacccatcctttgtcagaaacagatatcataaaccggttagagtatgtccgtttgattattgatatctcgaaaataccagacttatacacgcaaattgcagggataagttcaggtatccctcagataaatacaatattaacagaatttgttgaacacaggaaaaacggttacattattgaagagatccaagaattggaaaaggcaattccttattattgtgaacaattaactaattggaaccgttctttaatttattctattgataaaatcaatgactatacaggtggtcaattggtagaaagaattataaatagttat

SEQ ID NO: 3984 - protein, 514 aa, Streptococcus agalactiae
MFHFIPSWYNENRTWYDNNYLWYFKPTNVGFDDTINQMKMFDYAGKESRLVVLNYMPNLRYYLHRYDLLESGYYSVFDDIQEIGNVRQQMIDFRQLNWPEGVDFTYTPFIVLVKKSGDLIAKVQFGEEGNLTHIDYFANEQIAKKYLFDDRGFLSSILYYDNGGEAYQDYLAPSGERIMREYLREGDHHVEINPKKAIHFLKLSYSDIEELIREKYLTYLHKEVSKSDTIIVSFNQVHNAFIVGNTSKGNLILSVFSERNNAHNVLEDYSSLSRADAIICDRLDIAAQLKEKIDKPVVHVSPFDTRLALGKSNQVRDLEIYFVVDRLSHKELQKSLTSLYKVMLKNNDIKVTFVSYEREFESRQLTYDYLKEATKVFDQKFFSLSDDDANQVLMQSDEVEKEKTRLSFTHPLSETDIINRLEYVRLIIDISKIPDLYTQIAGISSGIPQINTILTEFVEHRKNGYIIEEIQELEKAIPYYCEQLTNWNRSLIYSIDKINDYTGGQLVERIINSY

SEQ ID NO: 3985 - DNA, 1227 bp, Streptococcus agalactiae
ttgaaattactatatatttttgaaaaaaatattattcttcgtaaaatattgataacattttcattaataatcatttttttacttggtcgctatgttccaatacctggtgtcttgatttctgcttataagggacaagacaataactttgcgacgctttattcaacagtaactggtggtaatttgtctcaggttggggtcttttcattgggtattggtcctatgatgaccacaatgattttactaagactatttacgattggtaaatactctagtggagtatctcaaaaagttcaacagtttcgccaaaatgtggtgatgcttgtcatagcaattattcaagggctagccataaccatatcttttcaatatcataatggtttttctctgaccaaattattactcgcgacaatgatacttgtgactggtgcatatattatttcctggattggtaatctaaatgcggaatacgggtttggtggaatgactattttagtggtggtaggtatgcttgttgggcaatttaataatattcctcttatttttgaattattccaagatggttatcaacttgctatcatcttatttcttttgtggacactagtagcaatgtacttaatgataacttttgaacgttcagaatatcgtataccagtaatgcgtacttcaatccataatcgtctcgttgatgatgcctacatgccaataaaagtaaatgcttcgggggggatggcatttatgtatgtttataccttactaatgttcccccagtatattattattttactaagaagtattttcccaactaatccagatatcacatcatacaatgactattttagtttatcttctattcagggagtggttatttatatgattttaatgcttgttttatcagttgcatttacttttgtgaatatcgatccgactaaaatttctgaggcaatgcgagaaagtggtgattttattcctaattatagacctggtaaagaaacacaaagttatttatcgaaaatctgttatttatttggaacttttagtggttttttcatggctttcttaggaggggtaccattattatttgctcttggaaatgatgatcttaggacagtttcatctatgacagggatttttatgatgatcacagggatgtcatttatgatattggatgaattccaagttattcgtattcgtaaacaatacacttctgtatttgaaaatgaggagaat

SEQ ID NO: 3986 - protein, 409 aa, Streptococcus agalactiae
MKLLYIFEKNIILRKILITFSLIIIFLLGRYVPIPGVLISAYKGQDNNFATLYSTVTGGNLSQVGVFSLGIGPMMTTMILLRLFTIGKYSSGVSQKVQQFRQNVVMLVIAIIQGLAITISFQYHNGFSLTKLLLATMILVTGAYIISWIGNLNAEYGFGGMTILVVVGMLVGQFNNIPLIFELFQDGYQLAIILFLLWTLVAMYLMITFERSEYRIPVMRTSIHNRLVDDAYMPIKVNASGGMAFMYVYTLLMFPQYIIILLRSIFPTNPDITSYNDYFSLSSIQGVVIYMILMLVLSVAFTFVNIDPTKISEAMRESGDFIPNYRPGKETQSYLSKICYLFGTFSGFFMAFLGGVPLLFALGNDDLRTVSSMTGIFMMITGMSFMILDEFQVIRIRKQYTSVFENEEN

SEQ ID NO: 3987 - DNA, 1350 bp, Streptococcus pyogenes
ttgctaaaggtggttcaatcgaagtcatctaatgaggggatactcattatgttcttaaaaatactaaaagacgcgttaaagataaagactgtacggaataaaattttctttactatatttatcattcttgtattccgaattgggacacatattaccgtacctggtgtaaatgccaagagcttagagcaattaagtgaactccctttcttaaatatgttaaacttagttagtggtaatgcgatgagaaatttctcagtattttcaatgggggttagcccatatattactgcttctatcgttgttcagttattgcagatggatattttacctaagtttgttgagtggggcaaacaaggtgaggttggacgtcgtaaattaaatcaagcgacgcgctatatttcacttgttttggcttttgcccaatccattggtatcactgcagggtttaatactttgtcgaacgttgcacttgttaagacaccagacatcaaaacatatttactgatcggggcattactgacaacaggtagcgttattgttacctggcttggagaacaaatcacagataaaggatttggtaatggcgtatcaatgattatctttgcgggtattatttcgtctattccaagtgcaattgcaacaattcgtgaagactattttgtaaatgttaaggcaagtgatttacactcgtcttatctcattgttgggattttaatcatagctgttcttgctattgttttctttacaacatatgtccaacaagcggaatataaaattccaatccaatacacaaagctaatgcaaggtgcacctacaagttcatatcttccattaaaagtaaatccagccggcgttattcccgttatctttgctagctcgattacaactatcccaagtacgattattccttttgttcaaaatggtagagatttaccgtggttaaaccgtttgcaagaaatttttaattatcaaactccagtcggaatgatagtttacgccttgttgattatattgttctcattcttctatacctttgtacaagttaatcctgagaagacagcagaaaatcttcagaagaattcctcatatataccaagtgttcgccctggacgtgagacagaacaatttatgtccgcattgctaaaaaaactagcaaccgtaggagctatcttcttagcatttatctctttagcgccaatagcagcacaacaagctctcaacctttcttctagtattgctttaggtggaactagtttgctcattttgatttcaactggtatcgaaggtatgaaacagcttgagggatatcttctaaagagaaaatatgtcggatttatgaatacagcagaa

SEQ ID NO: 3988 - protein, 450 aa, Streptococcus pyogenes
LLKVVQSKSSNEGILIMFLKILKDALKIKTVRNKIFFTIFIILVFRIGTHITVPGVNAKSLEQLSELPFLNMLNLVSGNAMRNFSVFSMGVSPYITASIVVQLLQMDILPKFVEWGKQGEVGRRKLNQATRYISLVLAFAQSIGITAGFNTLSNVALVKTPDIKTYLLIGALLTTGSVIVTWLGEQITDKGFGNGVSMIIFAGIISSIPSAIATIREDYFVNVKASDLHSSYLIVGILIIAVLAIVFFTTYVQQAEYKIPIQYTKLMQGAPTSSYLPLKVNPAGVIPVIFASSITTIPSTIIPFVQNGRDLPWLNRLQEIFNYQTPVGMIVYALLIILFSFFYTFVQVNPEKTAENLQKNSSYIPSVRPGRETEQFMSALLKKLATVGAIFLAFISLAPIAAQQALNLSSSIALGGTSLLILISTGIEGMKQLEGYLLKRKYVGFMNTAE

SEQ ID NO: 3989 - DNA, 1194 bp, Streptococcus agalactiae
atgagagttattaaagtaaaaacaatttcggaaactttagattatatttctaaacataccgcttcggtagcgcgttttggtgatggagaaattgatattattgcggggaattctattccttaccaggtttatgattctgaacttgctaagcgattagaacgtttattaaatcgacagagtaatgagaagttagttatctgtgtaagtgatgtttttgataatttaggtagatacaacgatttttcacaacaattttggagggatcatctatatcagtataatgatttgtaccaaaaaaattgtcaggctgaatggtatggttcaacttttatttctagaccctatatggatttactggataagagtttgtcagtaacgtactttgaacagctaaaagcattatggaaaaataaagatattttaattgtcgagggtgagacttctcgttcaggcgttggcaatgacttatttaatgatgccaatactatttcgcgtatcatttgtccttcgaaagatgcattttcatctttttatgaaatcaaggaaactatacttgaacatagtagaggtaagctaattttacttatgcttggtccaactgcaaagctattagctgaagatttatcgcagctaggacatcaagctattgatttaggtcatatcgattcagaatatgagtggtttaagatgggagcagtttctaaggtgaaactttctcataaacatacggcagaacataattttgacgaagatattactttaatagaagacaatagttacgaaaatcaaattgtatcaaaaattggtacatcagatagacagtacgctttgacagtgacgttaacagatgatatatgggagctagaacatttattacaaagatgtcctaatactgattttcatattgctgccccagtttattgttcggatagacttaagcagttagtaggttatccaaattattacctacatgaagctattactgaagagcaattcgaagtactcctattaaatagcgatatatatttagatattaatcatggtgaagaagtttggaatgttgttgatagatgtataactgagggtaaaactatatatggaatcagacgggcaagaaaagataatcaatatatttcttttgagcgaaccatggatgattttgaatatttgtgtgacactattaaacaaaataga

SEQ ID NO: 3990 - protein, 398 aa, Streptococcus agalactiae
MRVIKVKTISETLDYISKHTASVARFGDGEIDIIAGNSIPYQVYDSELAKRLERLLNRQSNEKLVICVSDVFDNLGRYNDFSQQFWRDHLYQYNDLYQKNCQAEWYGSTFISRPYMDLLDKSLSVTYFEQLKALWKNKDILIVEGETSRSGVGNDLFNDANTISRIICPSKDAFSSFYEIKETILEHSRGKLILLMLGPTAKLLAEDLSQLGHQAIDLGHIDSEYEWFKMGAVSKVKLSHKHTAEHNFDEDITLIEDNSYENQIVSKIGTSDRQYALTVTLTDDIWELEHLLQRCPNTDFHIAAPVYCSDRLKQLVGYPNYYLHEAITEEQFEVLLLNSDIYLDINHGEEVWNVVDRCITEGKTIYGIRRARKDNQYISFERTMDDFEYLCDTIKQNR

SEQ ID NO: 3991 - DNA, 885 bp, Streptococcus agalactiae
atggaggcaatagtgactgataaattagtttctgttattattccagtctataatgcagcaccatatttagaggggtgtgtaaataccattttaggacaaacataccaagtttttgaaattctactgatagatgacggttctacagatacatctgctagtatctgcgatcaattatccctaagagataaccgtattagagttttccatatcgaaaatggcggtgcttctaaagctagaaactttggattagcacgaattagtccagagagccaatttgttacgtttgttgattcggacgattgggtaaaggaaaattatttggaagtactgctagctcagcaagaaaaatataatgctgatattgttatcagtaattactatatctacagagaaacagaagatatttttggttactacatcactgacaaagattttgttatcgaagaaatctctgctcaaacagctattgatagacaagtgcattggcatttaaatagttcagtattcatcgttatttgggggaaattatatcgaagagaactatttgataccatcaccttcccaatagataaagtatttgaagatgagttggtaagtgttttactttttataaaaagtaaaaaaacaattttagttaatggaagctattatggctatagaattcgtccaaatagcattatgacatcggcgttttcatccaaaagagcagaggatcttatttatatttttgatagtaaattgtcggagattatactatcaggattggattcaactgcaactgtagagagatatttttggttaatgcgtgactataaacagcgcttagaacaagaaaatttacagaaaacaataatatataaagtgatatcaaatcggttatcaagg

SEQ ID NO: 3992 - protein, 295 aa, Streptococcus agalactiae
MEAIVTDKLVSVIIPVYNAAPYLEGCVNTILGQTYQVFEILLIDDGSTDTSASICDQLSLRDNRIRVFHIENGGASKARNFGLARISPESQFVTFVDSDDWVKENYLEVLLAQQEKYNADIVISNYYIYRETEDIFGYYITDKDFVIEEISAQTAIDRQVHWHLNSSVFIVIWGKLYRRELFDTITFPIDKVFEDELVSVLLFIKSKKTILVNGSYYGYRIRPNSIMTSAFSSKRAEDLIYIFDSKLSEIILSGLDSTATVERYFWLMRDYKQRLEQENLQKTIIYKVISNRLSR

SEQ ID NO: 3993 - DNA, 90 bp, Streptococcus agalactiae
gtggctaacttaagtaatcttgggccaaaagaggtccaagcagctatatggaagcaactattggggaatagttcaaccaattcttcaata

SEQ ID NO: 3994 - protein, 30 aa, Streptococcus agalactiae
MANLSNLGPKEVQAAIWKQLLGNSSTNSSI

SEQ ID NO: 3995 - DNA, 93 bp, Streptococcus agalactiae
ttgggccaaaagaggtccaagcagctatatggaagcaactattggggaatagttcaaccaattcttcaatataaagcaaatccacggacgttg

SEQ ID NO: 3996 - protein, 31 aa, Streptococcus agalactiae
MGQKRSKQLYGSNYWGIVQPILQYKANPRTL

SEQ ID NO: 3997 - DNA, 936 bp, Streptococcus agalactiae
atggcttatgcaaggtactacattccgcaactgattgatgcagagaaagttctttatttagatattgatactttggttgttgataacttagataagttgtttgagatagaattaggggactacccgatagcagctatcttagatggagacggtatttattttaactcaggtgttatgctaataaactcgctttactggatgagatatcgagtaacagaaaaacttctggaaataacagaacgagaattggataatggaatttttggagaccaaggggttctcaatcttctttttgataataattggcttaagttagaagataagtataatgctcaagttggaaatgatttaggtgccttttatgaaaattggcaagggtattttgatcgtaactttgaatcgcctactattatccattactgtactcatgataaaccatggaatactttttcttcttcaaggtttagggagacatggtggcaatatgagcaactagattggaatgaggtgtttaattttgaaacgtatctgttacctgagccaacatttgaaaaacacttctttactttcacaacgtccgtggatttgctttatattgaagaattggttgaactattccccaatagttgcttccatatagctgcttggacctcttttggcccaagattacttaagttagccacaaactctaacgttcgtctgtatccttcaataaccagcccactttttgaacaactaatgactaaagcaaattattaccttgatatctcaacttcttggaaggaaatacaattttgtcaaaaagctattgagaaatcaattccgatattgagttttaatgaagcagtgacatttgaatatagggagttaagtcattgctttattaatttggaggatatgcgacagtttttatgtaaaaatggaggcaatagtgac

SEQ ID NO: 3998 - protein, 312 aa, Streptococcus agalactiae
MAYARYYIPQLIDAEKVLYLDIDTLVVDNLDKLFEIELGDYPIAAILDGDGIYFNSGVMLINSLYWMRYRVTEKLLEITERELDNGIFGDQGVLNLLFDNNWLKLEDKYNAQVGNDLGAFYENWQGYFDRNFESPTIIHYCTHDKPWNTFSSSRFRETWWQYEQLDWNEVFNFETYLLPEPTFEKHFFTFTTSVDLLYIEELVELFPNSCFHIAAWTSFGPRLLKLATNSNVRLYPSITSPLFEQLMTKANYYLDISTSWKEIQFCQKAIEKSIPILSFNEAVTFEYRELSHCFINLEDMRQFLCKNGGNSD

SEQ ID NO: 3999 - DNA, 1239 bp, Streptococcus agalactiae
atgaaaaatagaaaagctatcgcgttagcggcagattttggctatcaagagcaagttaagactataattaaatcaatatgctttcataatcaatttattgatttttatatcttaaatgacgattttccagttgaatggtttcaaatgatggaatatcatttatctaaaatggattgcacaatatctaacactaaaatttttaatgaagaaattaaacattttaaatttcaaaaaccgatgccctatcctacttactttcgatactttatacctgaagttattcatgaagataaggtactatatttagactgtgatatgattatcaccagtgatttaacatcgatatttactcttgatatttcaaaatatggtgtagcggctgttcgagatgatttgctcgaagaatatgatggtaaagaagattattttaattcaggtttgctattaattaataatattttttggcgagaacaagggattagtcagcgactgttagattatactagagaaaaccaaggggctcttcaatatcatgaccaggatgttttgaatgatgtactgtgcgataattggctagaacttgatgaaacttataactatcatacaggagcagatatgttatataacctattccaacagtctgaacgtcaattaaatcgcaggaaagatttacctaaagttattcattatacagcgacaaaaccatggaaataccttgaaacatctgttcgttggcgcgatatatggtgggaatataatagacttgaatggcgcgatatttttacaagatggcaagtcaatgatggtgtagatgtttcattgaagaaagtgttacaacctatccatcgagctttcatttttacttactcagattcaattgaaggaattgagaggttggctaaggatttaccaaactggcaatttcatattgctgcctatactcaaatttcagaaaaattgaaacaattggaaatgcattcaaatataaaactttatccacttgtttatcgtttcaaattaaatgagctagttgaaaattcagatatttaccttgatattaatcatggtgatgcagatactcaggttctggagcaagtgaagaaattaggtaaagatattttatccctttctacaacttatcatggtcaaggcaaacaatttgagagagttacggatattattgattatttaaagaatgaacgatttaaagaacatattagaaaggaatattgtgaaaaa

SEQ ID NO: 4000 - protein, 413 aa, Streptococcus agalactiae
MKNRKAIALAADFGYQEQVKTIIKSICFHNQFIDFYILNDDFPVEWFQMMEYHLSKMDCTISNTKIFNEEIKHFKFQKPMPYPTYFRYFIPEVIHEDKVLYLDCDMIITSDLTSIFTLDISKYGVAAVRDDLLEEYDGKEDYFNSGLLLINNIFWREQGISQRLLDYTRENQGALQYHDQDVLNDVLCDNWLELDETYNYHTGADMLYNLFQQSERQLNRRKDLPKVIHYTATKPWKYLETSVRWRDIWWEYNRLEWRDIFTRWQVNDGVDVSLKKVLQPIHRAFIFTYSDSIEGIERLAKDLPNWQFHIAAYTQISEKLKQLEMHSNIKLYPLVYRFKLNELVENSDIYLDINHGDADTQVLEQVKKLGKDILSLSTTYHGQGKQFERVTDIIDYLKNERFKEHIRKEYCEK

SEQ ID NO: 4001 - DNA, 1203 bp, Streptococcus agalactiae
atgaagaaaacaattgttttaggtgcagatttccaatatcgtgatcaagttatgacaactataaaatctattgttagtcataatcaacatttaactatttatatcattaacacagattttcccgtagaatggtttaatatccttaaccattctttagaacagtttgactgtagagtaaaaaatattcccataagttcagatgtctttgaggggatacctaccctgagccatatcagtgtggcgggatttttcagatggtttattccaattcaccttgaagaagagatagttttatatttagatagtgatgtaatagttaggggttctttggatcctctatttgacataaaccttgaagagaatttattaggagctgtagcagatcatttttcaacgctttactatggagatacagcaccagttagttttaattcaggtgttatgctaatcaataattcattatggaaaaaagaagaaatttataatagccttatgaggattgctgataagggttctgctgttggggtaggagatcaagaataccttaatattttgactcagaatcgttggatagatatcggtaaacaatataatgttcagattggtcaagatgtcaatattaatgcatatgggcgaccagatttgtatcatttttatgatgattgcgaacctgttattgttcattataatagtcaagataaaccgtggaataaatatagtcaatcgcgataccgttcagaatggtggtattattttggtttagaatggtcagttatttatgctcaacaacaaaaaaatttgaacaggttaacaggtaaaacactgaatttatttacattaacagcctcagatacattagaacatattgaagtacttgcaaaagctctaccagattatcagtttcatattgcagcacgtagtgatatttcagagaaattagctaatctagaaacttatagcaatattaaagtttataaattagttatcaaccctatcttggaagagcttatacgtaactgtgatgtgtacttggatattaatcattcttacgaagtagaaggtattctagataaaataaaagaagagaataaaccgattttagcctttgattctacagcacatacgacaaaaaatatagaagttatctcagaaacaatgcctgaattgatggttaaaagaataagggaagtaggtcctcttaga

SEQ ID NO: 4002 - protein, 401 aa, Streptococcus agalactiae
MKKTIVLGADFQYRDQVMTTIKSIVSHNQHLTIYIINTDFPVEWFNILNHSLEQFDCRVKNIPISSDVFEGIPTLSHISVAGFFRWFIPIHLEEEIVLYLDSDVIVRGSLDPLFDINLEENLLGAVADHFSTLYYGDTAPVSFNSGVMLINNSLWKKEEIYNSLMRIADKGSAVGVGDQEYLNILTQNRWIDIGKQYNVQIGQDVNINAYGRPDLYHFYDDCEPVIVHYNSQDKPWNKYSQSRYRSEWWYYFGLEWSVIYAQQQKNLNRLTGKTLNLFTLTASDTLEHIEVLAKALPDYQFHIAARSDISEKLANLETYSNIKVYKLVINPILEELIRNCDVYLDINHSYEVEGILDKIKEENKPILAFDSTAHTTKNIEVISETMPELMVKRIREVGPLR

SEQ ID NO: 4003 - DNA, 1080 bp, Streptococcus agalactiae
gtgttaataaaactattatttaactggtatgatatggtctggataagagagagttttaaagagagattaactaaaatgcgagtacatattacaagtatatatgggcagtcaccgcgtagcattgcccttatatcacaaaaactagttaaggatgtcggacgtcaacttggttatgatgaaatgggaatctacttttataatgatcatgctgaaacgcatggtgaaagaagtactaggatggatggtatcattgcgggattaggcagaggggatattgttgtttttcaagtacctacatggaattcaacagaatttgatgaactttttctagataaattacaggcatacggtgctagaattataacttttgtacatgatattgttcccttaatgtttgagtctaatttttatttattagatagagtaattgacatgtataatcgttcggatgttgttattctacctacaaaagcgatgcatgattatctaattgaaaaagggatgactacctctaaagttctttatcaagaagtatgggatcatccagttaatatagacctccctcgtccagaatgtcaaaaagtccttagttttgcaggcgatattcaacgctttccctttgtcaatgactggaaggaaaatatcccgctcatctattatggagacggaagcagactcaattctgaggcaaatgttcatgctcagggatggaaagatgatgtagaattgatgctaagtctttctaagcggggaggatttggcctgtgttggagtgaagatagagaggagttagtcgagcgtcgttattcgaggatgaatgcctcgtataaattatctactttcttggctgctggacttccaattattgctaaccatgatatttcaagtagagactttatcaaacaacacggattaggatttacagttgaaacgctagaagaagctgttgaaaaaattaataatatggaaaaagagacttatgacagctatgtggaaaatgttgagaagatagcaactctcttgcgaaatggttatatcactaaaaaattgttgatagatgctgtgcatatgctttataga

SEQ ID NO: 4004 - protein, 360 aa, Streptococcus agalactiae
MLIKLLFNWYDMVWIRESFKERLTKMRVHITSIYGQSPRSIALISQKLVKDVGRQLGYDEMGIYFYNDHAETHGERSTRMDGIIAGLGRGDIVVFQVPTWNSTEFDELFLDKLQAYGARIITFVHDIVPLMFESNFYLLDRVIDMYNRSDVVILPTKAMHDYLIEKGMTTSKVLYQEVWDHPVNIDLPRPECQKVLSFAGDIQRFPFVNDWKENIPLIYYGDGSRLNSEANVHAQGWKDDVELMLSLSKRGGFGLCWSEDREELVERRYSRMNASYKLSTFLAAGLPIIANHDISSRDFIKQHGLGFTVETLEEAVEKINNMEKETYDSYVENVEKIATLLRNGYITKKLLIDAVHMLYR

SEQ ID NO: 4005 - DNA, 213 bp, Streptococcus agalactiae
gtgcctcgacgtcagccagcaccagcgcttcaacgagtgcgtcaatgtcagccagcaccagtgcttcaaccagtgcctcgatgtcagccagcactagcgcttcaacgagtgcgtcaatgtcagccagcacaagtgcttcaacaagtgcctcgatgtcagccagcacaagtgcttcaacaagtgcctcgatgtcagccagcactagcgcttcaa

SEQ ID NO: 4006 - protein, 71 aa, Streptococcus agalactiae
MPRRQPAPALQRVRQCQPAPVLQPVPRCQPALALQRVRQCQPAQVLQQVPRCQPAQVLQQVPRCQPALALQ

SEQ ID NO: 4007 - DNA, 876 bp, Streptococcus agalactiae
gtggaagcgctggtacttgctgatgtcgatgcactcgttgagacgctggtgctggctgacgtcgtggcactcattgaagcgctagtgctggctgacatcgaggcacttgttgaagcacttgtgctggctgacatcgaggcacttgttgaagcacttgtgctggctgacattgacgcactcgttgaagcgctagtgctggctgacatcgaggcactggttgaagcactggtgctggctgacattgacgcactcgttgaagcgctggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgctgacgtggatgcactggtactggcacttgtggaagcgctagtacttgcacttgttgaggcgctcatacttgctgaggtggaagcactggtactggcactggttgaggcgctggtacttgcacttgttgaagcactcatacttgcacttgttgaagcactggtgctggctgacgtcgacgcactcatggaagcgctggtacttgctgatgtcgaggcactcatggaagcgctggtacttgctgacgtcgacgcactcgtagaagcactttctgataaaagtttaatttcggcattcgcatctgagtcaccacttatattcgtatgccca

SEQ ID NO: 4008 - protein, 292 aa, Streptococcus agalactiae
MEALVLADVDALVETLVLADVVALIEALVLADIEALVEALVLADIEALVEALVLADIDALVEALVLADIEALVEALVLADIDALVEALVLADVEALIEALVLALVEALVLADVEALIEALVLALVEALVLADVEALIEALVLALVEALVLADVEALIEALVLALVEALVLADVEALIEALVLADVDALVLALVEALVLALVEALILAEVEALVLALVEALVLALVEALILALVEALVLADVDALMEALVLADVEALMEALVLADVDALVEALSDKSLISAFASESPLIFVCP

SEQ ID NO: 4009 - DNA, 174 bp, Streptococcus agalactiae
gtgcttatcgattctgaagcacttgttaaagcagatgtacttacagattcacttacacttgttaaagttgaccctgacatagacatacttacagattcactagtacttgttgaggctgactctgacatagatacactattagaatcaataatgtttttcgatactgtcccatct

SEQ ID NO: 4010 - protein, 58 aa, Streptococcus agalactiae
MLIDSEALVKADVLTDSLTLVKVDPDIDILTDSLVLVEADSDIDTLLESIMFFDTVPS

SEQ ID NO: 4011 - DNA, 2910 bp, Streptococcus agalactiae
atgtcccaaaagacttttggcaagcagttaacagttgtagatactaagagtagagtcaagatgcataaatcagaaaaaaactgggtaagaacagtaatgtcgcattttaatctatttaaagcgattaaagggagagcaactgttgaagcagatgtgtgtattcaagatgttgaaaaagaagaccgactatcttcaggaaatttgacctatctcaaaggaatactagctgctggagctctggtaggtggagcgagtttaaccagtcgtgtttatgcagatgagactccagttgttcaagaacaatcaagttctgtaccaacactggcagaacaaacggaagtgactgttaaaacaactactgttcaaaatcatcaagatgggacagtatcgaaaaacattattgattctaatagtgtatctatgtcagagtcagcctcaacaagtactagtgaatctgtaagtatgtctatgtcagggtcaactttaacaagtgtaagtgaatctgtaagtacatctgctttaacaagtgcttcagaatcgataagcacgtcagcctcagaaagtgtttcaaaatctacaagtattagtgaggtttcaaatattcttgaaactcaagcttctttaactgataaaggaagagagtcgttttcggcaaaccagatagtaacagaaagtagcttagttactgatgctggtaaaaatgcttcagtatctagcctaattgaaattacaaaaccaaaatcggagttacagacttccaaaatgtcaaatgagtcgcttataactccagagaaatcccaagtaatgattgcaagcgataaaactgggaatgagagtctaactccgacaattagattaaaatcagttattcagccaaggagtatgaacttgatgactttgagttcggagatggacttgataccactagaagaagtgtctgatactgaaatgttaggtaaagatgtatcaagcgagttgcagaaagttaatattgcgttaaaagataacactcttagtgagcctggaacagttaaattagatagttcagaaaaccttgttttgaactttgccttttcaatcgcttctgttaacgagggagatgtctttactgtaaagctttctgataaccttgacacacaagggattggtactattctaaaagttcaagatataatggatgaaacggggcagttattagcgactgggtcatatagtcctttaacacataatattacatacacctggacaaggtatgcttctacgttgaataatattaaagctagagtcaatatgccagtttggcctgaccagagaataatttctaaaacaacttcagataagcagtgctttactgcaacattgaacaatcaagttgcttcaattgaggaacgtgttcagtataatagtccttcagtgacagaacatactaatgttaagacaaatgtaagatctcggatcatgaagcttgatgatgaaagacagacagaaacttatattactcaaattaatcctgaaggtaaggaaatgtatttcgcatcaggacttgggaatctatatactattatcggttcagatggaacatcaggttcaccagttaatttattaaatgcggaagtaaagattctaaaaactaattcaaaaaatcttacagatagtatggatcaaaattatgattcgcctgagtttgaagatgtgacttcccagtatagttatactaacgatggttctaaaattaccatagattggaaaacaaattctatttcttccactacatcttatgttgttttggtcaaaatacctaaacaaagtggtgtattgtattcaactgtttctgatataaatcaaacatatggttctaaatattcttatgggcatacgaatataagtggtgactcagatgcgaatgccgaaattaaacttttatcagaaagtgcttctacgagtgcgtcgacgtcagcaagtaccagcgcttccatgagtgcctcgacatcagcaagtaccagcgcttccatgagtgcgtcgacgtcagccagcaccagtgcttcaacaagtgcaagtatgagtgcttcaacaagtgcaagtaccagcgcctcaaccagtgccagtaccagtgcttccacctcagcaagtatgagcgcctcaacaagtgcaagtactagcgcttccacaagtgccagtaccagtgcatccacgtcagcaagtactagcgcctcaatgagtgcctcgacgtcagccagcaccagtgcttccacaagtgcaagtactagcgcctcaatgagtgcctcgacgtcagccagcaccagtgcttccacaagtgcaagtactagcgcctcaatgagtgcctcgacgtcagccagcaccagtgcttccacaagtgcaagtactagcgcctcaatgagtgcctcgacgtcagccagcaccagtgcttccacaagtgcaagtactagcgcctcaatgagtgcctcgacgtcagccagcaccagcgcttcaacgagtgcgtcaatgtcagccagcaccagtgcttcaaccagtgcctcgatgtcagccagcactagcgcttcaacgagtgcgtcaatgtcagccagcacaagtgcttcaacaagtgcctcgatgtcagccagcacaagtgcttcaacaagtgcctcgatgtcagccagcactagcgcttcaatgagtgccacgacgtcagccagcaccagcgtctcaacgagtgcatcgacatcagcaagtaccagcgcttccacaagttcttcaagctcagtgacttctaattcatcaaaagagaaggtgtattctgccttaccttctacgggtgaccaagattattctgtaactgctactgccttaggtttaggtttaatgactggtgcaacccttttgggacgaaaaaaatctaaaaaagataaagac

SEQ ID NO: 4012 - protein, 970 aa, Streptococcus agalactiae
MSQKTFGKQLTVVDTKSRVKMHKSEKNWVRTVMSHFNLFKAIKGRATVEADVCIQDVEKEDRLSSGNLTYLKGILAAGALVGGASLTSRVYADETPVVQEQSSSVPTLAEQTEVTVKTTTVQNHQDGTVSKNIIDSNSVSMSESASTSTSESVSMSMSGSTLTSVSESVSTSALTSASESISTSASESVSKSTSISEVSNILETQASLTDKGRESFSANQIVTESSLVTDAGKNASVSSLIEITKPKSELQTSKMSNESLITPEKSQVMIASDKTGNESLTPTIRLKSVIQPRSMNLMTLSSEMDLIPLEEVSDTEMLGKDVSSELQKVNIALKDNTLSEPGTVKLDSSENLVLNFAFSIASVNEGDVFTVKLSDNLDTQGIGTILKVQDIMDETGQLLATGSYSPLTHNITYTWTRYASTLNNIKARVNMPVWPDQRIISKTTSDKQCFTATLNNQVASIEERVQYNSPSVTEHTNVKTNVRSRIMKLDDERQTETYITQINPEGKEMYFASGLGNLYTIIGSDGTSGSPVNLLNAEVKILKTNSKNLTDSMDQNYDSPEFEDVTSQYSYTNDGSKITIDWKTNSISSTTSYVVLVKIPKQSGVLYSTVSDINQTYGSKYSYGHTNISGDSDANAEIKLLSESASTSASTSASTSASMSASTSASTSASMSASTSASTSASTSASMSASTSASTSASTSASTSASTSASMSASTSASTSASTSASTSASTSASTSASMSASTSASTSASTSASTSASMSASTSASTSASTSASTSASMSASTSASTSASTSASTSASMSASTSASTSASTSASTSASMSASTSASTSASTSASMSASTSASTSASMSASTSASTSASMSASTSASTSASMSASTSASTSASMSASTSASMSATTSASTSVSTSASTSASTSASTSSSSSVTSNSSKEKVYSALPSTGDQDYSVTATALGLGLMTGATLLGRKKSKKDKD

SEQ ID NO: 4013 - DNA, 627 bp, Streptococcus agalactiae
ttgtgtaatatgatagaaaattttttagaaaaaaatattcttaataaagttaaattacttactttatgttatgataccccctcactatccttagataccgcctgtaaccgactccacttatcaccagttgagcttaaaaactattgtcataaattaaatgttttatttggtcataaactttctatccatatccaaaaaaaacggattttatgtaagctaaataaacttactcaggaagatgccttaaaaatagtttataatgagtcaaacactttacaacttcttaaatttttaattgatgactcgtctgataaaaaatctctagtagcttttggaaatgatctcttcttatctcgttcttctgtctatcgtctgcgagaaaatttaattcctttaattaaagatttaggattatctttatctaaaaataccattgtaggtgacgaatatcgcattagatatctcatcgcatacctcactactaaatttggtattaaaatttacgatctgtctgctctagatattaagattattcgacaatttttatttgagagtggtactaatataagacctactacgcacctttctgatatctttgttttttttgatacgcttttcattttaacc

SEQ ID NO: 4014 - protein, 209 aa, Streptococcus agalactiae
MCNMIENFLEKNILNKVKLLTLCYDTPSLSLDTACNRLHLSPVELKNYCHKLNVLFGHKLSIHIQKKRILCKLNKLTQEDALKIVYNESNTLQLLKFLIDDSSDKKSLVAFGNDLFLSRSSVYRLRENLIPLIKDLGLSLSKNTIVGDEYRIRYLIAYLTTKFGIKIYDLSALDIKIIRQFLFESGTNIRPTTHLSDIFVFFDTLFILT

SEQ ID NO: 4015 - DNA, 732 bp, Streptococcus agalactiae
atggattatatttttcttatctatcttacaagcgctaactcttttgctgctcaaaagtggactgaaacacatgtcgatgaagtgttagctatttttaaaagtcttcctaaattccaaatgctactacaacctttgaaagaagctcttccatactctgacacctactacgatgagctagtgaaagtcactatttacttttctcgaaacttcatagttggtctgaatcaattaattcctgaaacacttagttttccttcaacattctatcctggaaataatcctaaactaatatccattatcgaaccaatagtcactcattggctaactgaaattggagaatcaaagttcaaaaaaacgcacttcttcttgctctgtgctcaccttgaaagagtaataaagaatagcatgcctcctataaatattgtgttgctgacaactgattttattaataatgaaattttaaaagactatattttgcaatccctttcaacagataaaattagatttcattcctattacttattgacagataatattagtcaaatatcgaccttaaaacccgatttaattatcactaatcgaaaactgtttacctatgttacaaaggaactagctacaaatagtttagtcgctcatattgattacaacgatacaccctctcaaatcagtaatatccaaactattatttctaatattaaagaagaaaaatatcgaaaaatctttgataaaata

SEQ ID NO: 4016 - protein, 244 aa, Streptococcus agalactiae
MDYIFLIYLTSANSFAAQKWTETHVDEVLAIFKSLPKFQMLLQPLKEALPYSDTYYDELVKVTIYFSRNFIVGLNQLIPETLSFPSTFYPGNNPKLISIIEPIVTHWLTEIGESKFKKTHFFLLCAHLERVIKNSMPPINIVLLTTDFINNEILKDYILQSLSTDKIRFHSYYLLTDNISQISTLKPDLIITNRKLFTYVTKELATNSLVAHIDYNDTPSQISNIQTIISNIKEEKYRKIFDKI

SEQ ID NO: 4017 - DNA, 1989 bp, Streptococcus agalactiae
atgatagatagaaaagatactaaccgatttaaattagtttccaaatatagcccttcgggagatcaacctcaagctattgaaacgttggttgacaatattgaaggaggagaaaaagctcagattttaaaaggtgctactggtactggtaaaacctacacaatgagccaagttatcgcccaagttaacaagccaaccttggtgattgcacataataaaaccttagcaggtcaactttatggagagtttaaagaattttttcctgacaatgccgtagagtactttgtttcatattatgattattatcaaccagaagcttatgtgccttcttcggatacttatattgaaaaagatagttcagtcaatgacgaaattgacaaattacgtcactcagcgacttcttcgttattagaaagaaatgacgttattgttgtagcatctgtttcttgtatttacggtttaggttctcctaaagagtatgcagacagtgttgttagccttaggccaggtcaagaaatttcacgtgatcagttattgaacaatctcgttgatattcaatttgagcgtaacgatattgattttcaacgtggaaaatttcgcgttcgtggcgatgttgtagaagtttttcctgcgagtcgtgatgagcatgcctttcgaattgaattttttggtgatgaaattgatcgtataagagaaatagaatcgttaacagggcgtgtgctaggagaagtggaacatttagctattttcccagcaacacactttatgacaaatgatgaacatatggaagaagctatttcaaaaatacaagctgaaatggaaaatcaagtagaactttttgaaaaagaagggaaattgattgaagcgcaacgtattcgacaaaggacagaatatgatattgaaatgcttcgtgaaatgggatatacaaatggtgttgagaactactcacgtcacatggatggtagaagtgaaggtgagccaccttttactttgttagatttcttcccagaagattttttgattatgattgatgagagtcacatgacaatggggcaaatcaaagggatgtataatggagaccgttcgcgtaaagaaatgttggttaattacggtttccgtttaccatctgccttagataaccgtccacttcgtcgtgaagaattcgaaagccatgtccatcaaattgtctatgtatctgcaacgccaggagactatgaaatggagcaaacagatacagttgttgagcaaattatccggccaacaggacttcttgatccagaagttgaagttagaccaagtatggggcagatggatgacttgcttggtgaaatcaatttgaggactgaaaaaggtgagcgtacctttattacaacattgacaaagcgtatggcagaagacttaacagattatctcaaagaaatgggagttaaagttaagtatatgcacagcgatattaaaaccttagaacgtacagagattattcgtgatttacgacttggtgtgtttgatgttttaattggtattaatctcttacgtgaaggaatagatgttcctgaggtttcccttgttgcaatcttagatgctgataaggaaggtttccttcgtaatgagcgtggtcttatccaaacaatcggacgtgcagcacgtaacagtaatggtcatgttattatgtatgctgataaaataacagattctatgcaaagagctatggatgaaaccgctcgccgtcgtcgtttacaaatggattataatgaaaagcatggaattgtgccacaaacaattaaaaaagaaatccgtgatttaattgctattactaaaagtaatgacagcgataagcctgaaaaagttgtcgattacagtagtttatctaaaaaagaaaggcaagctgaaattaaagctcttcaacagcaaatgcaagaagcagctgaattattggactttgagctagctgcacaaatccgagatgttatcttagaactaaaagcaatcgat

SEQ ID NO: 4018 - protein, 663 aa, Streptococcus agalactiae
MIDRKDTNRFKLVSKYSPSGDQPQAIETLVDNIEGGEKAQILKGATGTGKTYTMSQVIAQVNKPTLVIAHNKTLAGQLYGEFKEFFPDNAVEYFVSYYDYYQPEAYVPSSDTYIEKDSSVNDEIDKLRHSATSSLLERNDVIVVASVSCIYGLGSPKEYADSVVSLRPGQEISRDQLLNNLVDIQFERNDIDFQRGKFRVRGDVVEVFPASRDEHAFRIEFFGDEIDRIREIESLTGRVLGEVEHLAIFPATHFMTNDEHMEEAISKIQAEMENQVELFEKEGKLIEAQRIRQRTEYDIEMLREMGYTNGVENYSRHMDGRSEGEPPFTLLDFFPEDFLIMIDESHMTMGQIKGMYNGDRSRKEMLVNYGFRLPSALDNRPLRREEFESHVHQIVYVSATPGDYEMEQTDTVVEQIIRPTGLLDPEVEVRPSMGQMDDLLGEINLRTEKGERTFITTLTKRMAEDLTDYLKEMGVKVKYMHSDIKTLERTEIIRDLRLGVFDVLIGINLLREGIDVPEVSLVAILDADKEGFLRNERGLIQTIGRAARNSNGHVIMYADKITDSMQRAMDETARRRRLQMDYNEKHGIVPQTIKKEIRDLIAITKSNDSDKPEKVVDYSSLSKKERQAEIKALQQQMQEAAELLDFELAAQIRDVILELKAID

SEQ ID NO: 4019 - DNA, 1989 bp, Streptococcus pyogenes
atgattgataaacgtgatgataaaccatttaaactaaaatcaaagtataaaccgtctggtgatcagccacaagctattgaaagcctagttgataatatcgagggcggagaaaaagctcagattctcctaggtgctacaggaacgggaaaaacatacaccatgagccaagtaattagtaaagtaaataaacctaccttagtgatagctcacaataaaaccttagcaggacaattatatggtgaatttaaagaattttttccagacaatgctgtggaatattttgtttcctattatgattactaccaacctgaagcatatgtcccatcaagcgacacctatatcgaaaaagatagttcagtcaatgatgaaatcgataaacttcgccattcagccacctcttctttacttgagcgtaacgatgtcatagtggtagcttctgtatcttgtatttatggactaggttcgccaaaagagtacgcagattcagcagtcagcctacgtccaggtcaggagatatcacgtgacactttgctaaatcaattagtagatattcaatttgagcgtaatgatattgattttcaacgcggctgttttcgtgtacgtggcgatgttgttgaggtctttccagcatccagggatgaacatgcttttcgggtggaatttttcggggatgagattgaccgtatatgtgaaatcgaaagtttaactgggaaaactattggagaagttgaccatttggttttatttccagctactcactttgtaacaaatgatgagcatatggagcaatcaatagccaaaattcaagcagagttagcagagcagttacagttatttgaatctgaaggtaaactactagaagcacagcgattacgccaaagaacggaatatgatattgaaatgttacgtgaaatgggctatactagcggagtcgaaaactattcccgtcatatggatggcaggtcaccaggagaacctccttataccttgttagatttcttcccagaagattttttaattatgattgatgaaagtcacatgacaatgggacaaatcaaaggcatgtataatggtgaccaagccagaaaacaaatgctagttgactatggttttcgattgccatcagctcttgataatcgtcccttaagacgcgaggaatttgaaagtcatgtgcaccaaattgtctatgtttcagcaacgcctggtgaatacgaaatgtcacagactaatacaattattgagcaaattattcgtccgactgggctacttgatcctgaaattgatgtaaggtcaagtatggggcaaatggatgatttgttgggagaaattaaccagcgcgtagcgcgcgatgaacggacgttcatcacaaccttaactaaaaaaatggcagaagatttgactgattatctaaaagagatgggtgtcaaggtcaagtatatgcacagtgatattaaaaccttagagcgaacagaaattattcgtgatttacgacttggtgtttttgatgtcttgattggaatcaatctgctccgtgaagggattgatgtgccagaagttagtcttgtagccattttggatgctgataaagagggtttcctccgtaatgaacgcggcttgattcagaccatcggtagagcagctcgaaacgtagatggtcatgtcattatgtatgcggacaagatgacagattctatgcagcgagctattgacgaaacggctcgtcgtcgtgagattcaaatagcatataacaaagcgcacggcatcgttccacaaactataaaaaaagacatcagaggccttattagtataagtaaaacaagccacaatgatatatcaaaagaagagatggattatgaaagtatgtcaagaggagaacgaaaagaagcgatcaatgctctgcaaaaacaaatgcaagaggcagctgaattacttgatttcgaattggcagctcaaatgcgagacttgattttagaacttaaattaatggac

SEQ ID NO: 4020 - protein, 663 aa, Streptococcus pyogenes
MIDKRDDKPFKLKSKYKPSGDQPQAIESLVDNIEGGEKAQILLGATGTGKTYTMSQVISKVNKPTLVIAHNKTLAGQLYGEFKEFFPDNAVEYFVSYYDYYQPEAYVPSSDTYIEKDSSVNDEIDKLRHSATSSLLERNDVIVVASVSCIYGLGSPKEYADSAVSLRPGQEISRDTLLNQLVDIQFERNDIDFQRGCFRVRGDVVEVFPASRDEHAFRVEFFGDEIDRICEIESLTGKTIGEVDHLVLFPATHFVTNDEHMEQSIAKIQAELAEQLQLFESEGKLLEAQRLRQRTEYDIEMLREMGYTSGVENYSRHMDGRSPGEPPYTLLDFFPEDFLIMIDESHMTMGQIKGMYNGDQARKQMLVDYGFRLPSALDNRPLRREEFESHVHQIVYVSATPGEYEMSQTNTIIEQIIRPTGLLDPEIDVRSSMGQMDDLLGEINQRVARDERTFITTLTKKMAEDLTDYLKEMGVKVKYMHSDIKTLERTEIIRDLRLGVFDVLIGINLLREGIDVPEVSLVAILDADKEGFLRNERGLIQTIGRAARNVDGHVIMYADKMTDSMQRAIDETARRREIQIAYNKAHGIVPQTIKKDIRGLISISKTSHNDISKEEMDYESMSRGERKEAINALQKQMQEAAELLDFELAAQMRDLILELKLMD

SEQ ID NO: 4021 - DNA, 918 bp, Streptococcus agalactiae
atgaataaaaggattttaaatagtcagttcgctgtctataaaaactggccgtcatggctattattgttatttgcttgttttatggtatacctattttttttcgttggtctaactctaggtggtgtgggaattgttctagtgtcttctgtactctataagttttcttcctatactttttttgagtttattaatttatttaataatatctatggagaattaggaacctttagtttttcagcattccttttgcttatctgggtaaaattcgtagaaaaaagacctttttcagaattggggttttctacaaagtttaaaagaactctgtggtcacttataaaaggctggagtataggttttattctattttcaatttctgtcatcactgcttatatattgggaggacttgactttcatagctatgatgtttctaaggcaacgattttctatgttgtaactctccttcctttttggcttattcaaagcggtacggaagaattgctaacacgagggtggcttcttcctctaattaatcatcgttttcatttagctgttgccataggggtctcatccactttatttggcattttgcacttggtaaatgcccatgtcacttttctttctattgtaagtattatatgttcgggagttttaatgtccttgtatatgattaaaagtggtaatatttggagtgttgcagccttacatggagcttggaattttagccaaggtaatctctatggtattgccgtaagtggtcagaaagcaggagcatctcttttgcattttaccgttaaagaaaacgcaccggactggatatcaggtggtgcattcggaatagaaggaagtttgatttctatttttgttctcttagcagcaattatataccttctatggctaattaagactgaagaaacagat

SEQ ID NO: 4022 - protein, 306 aa, Streptococcus agalactiae
MNKRILNSQFAVYKNWPSWLLLLFACFMVYLFFFVGLTLGGVGIVLVSSVLYKFSSYTFFEFINLFNNIYGELGTFSFSAFLLLIWVKFVEKRPFSELGFSTKFKRTLWSLIKGWSIGFILFSISVITAYILGGLDFHSYDVSKATIFYVVTLLPFWLIQSGTEELLTRGWLLPLINHRFHLAVAIGVSSTLFGILHLVNAHVTFLSIVSIICSGVLMSLYMIKSGNIWSVAALHGAWNFSQGNLYGIAVSGQKAGASLLHFTVKENAPDWISGGAFGIEGSLISIFVLLAAIIYLLWLIKTEETD

SEQ ID NO: 4023 - DNA, 2181 bp, Streptococcus agalactiae
atgaagcacaagttaaaagcttttacgcttgctttactctcaatattctttgtgtttggtggaaaggtcagtgcagagactgtgaatattgtttctgatacagcatacgctccattcgaatttaaagattctgatcaaacttataaaggaatcgatgttgacatcgttaacgaagtcgctaagcgtgctggctggaatgttaacatgacgtacccaggttttgatgccgcagttaacgctgttcaatctggacaggcagacgcgctaatggccggaactactgttactgaagcacgtaaaaaagtctttaatttctcagatacttattacgatacttccgttattctttatactaaaaataataataaagtcacaaactacaaacaactaaaaggaaaagtagtcggtgtaaaaaatggaacagctgctcaaagcttcttagaggaaaataaatctaaatacggctataaagttaaaacatttgatacaagtgacctaatgaataacagccttgattctggttctatttacgccgctatggacgatcaaccagttgtgcaatttgcgataaatcaaggaaaagcttacgccattaacatggaaggcgaggcagttggtagctttgcatttgctgtcaaaaaaggtagtggacacgataacctaattaaagaatttaacacagcttttgcacaaatgaaatcagatggcacttataatgacatcatggataaatggcttgggaaagacgctacaaaaacaagcggcaaagcaacaggtaatgccaatgaaaaagcaactcctgtaaagccaagttataaaattgtttctgattcttcattcgcaccattcgaatatcaaaacggtaaagggaaatatactggttttgatatggaattaatcaagaaaattgctaaacagcaaggttttaaacttgatatctcaaatccaggttttgatgccgctttaaatgctgtccaatctggacaagctgacggtgttattgcaggagctacaatcacagaagcacgccaaaaaatctttgatttttctgatccttattacacatctagcgttatcttagcggttaaaaaaggaagcaatgtcaaatcataccaagatttaaaaggaaaaacagttggtgctaaaaatggtactgcctcatatacttggttatcagaccacgcagataagtacaactatcatgttaaagcatttgatgaagcatctacaatgtatgatagtatgaactcaggttcaattgatgctctaatggatgacgaagcagttcttgcttacgctattaatcaaggtcgtaaatttgaaacacctatcaaaggtgaaaaatcaggcgatatcggatttgcagtgaaaaaaggggcaaatccagaattaattaaaatgtttaacaacggtcttgcttcactcaaaaaatcgggtgagtacgataaacttgttaaaaaatacctttccacagccagcacctcttcaaacgataaagctgctaaacctgtagatgaatcaactattttagggttaatttctaataactacaaacaattgctatctggtattggaactactttaagtttaactcttatctcatttgcgattgctatggttattggtattatctttggtatgatgagcgtatcaccaagtaatactctccgcacaatttcaatgatttttgttgatattgtccgtggtattccactcatgattgtggccgcttttattttctggggtattcctaatttaatcgaaagcatcacaggtcaccaaagtccaattaatgacttcgttgctgctactatcgctctttctttaaatggtggtgcgtacattgctgaaattgtacgtggtggtattgaagctgttccttctggtcaaatggaagcaagtcgtagtttaggtatttcttacggcaaaactatgcaaaaggttatcttgcctcaagcagtacgccttatgttaccaaactttatcaaccaatttgtcatctcattaaaggatacaacaattgtatcagcaatcggacttgtggaactcttccaaactggtaaaatcataattgcacgtaactatcaatcattccgtatgtatgctatccttgcaattatgtatcttgtaatcattacccttctcacccgtctagcaaaacgtttagaaaagaggcttaaa

SEQ ID NO: 4024 - protein, 727 aa, Streptococcus agalactiae
MKHKLKAFTLALLSIFFVFGGKVSAETVNIVSDTAYAPFEFKDSDQTYKGIDVDIVNEVAKRAGWNVNMTYPGFDAAVNAVQSGQADALMAGTTVTEARKKVFNFSDTYYDTSVILYTKNNNKVTNYKQLKGKVVGVKNGTAAQSFLEENKSKYGYKVKTFDTSDLMNNSLDSGSIYAAMDDQPVVQFAINQGKAYAINMEGEAVGSFAFAVKKGSGHDNLIKEFNTAFAQMKSDGTYNDIMDKWLGKDATKTSGKATGNANEKATPVKPSYKIVSDSSFAPFEYQNGKGKYTGFDMELIKKIAKQQGFKLDISNPGFDAALNAVQSGQADGVIAGATITEARQKIFDFSDPYYTSSVILAVKKGSNVKSYQDLKGKTVGAKNGTASYTWLSDHADKYNYHVKAFDEASTMYDSMNSGSIDALMDDEAVLAYAINQGRKFETPIKGEKSGDIGFAVKKGANPELIKMFNNGLASLKKSGEYDKLVKKYLSTASTSSNDKAAKPVDESTILGLISNNYKQLLSGIGTTLSLTLISFAIAMVIGIIFGMMSVSPSNTLRTISMIFVDIVRGIPLMIVAAFIFWGIPNLIESITGHQSPINDFVAATIALSLNGGAYIAEIVRGGIEAVPSGQMEASRSLGISYGKTMQKVILPQAVRLMLPNFINQFVISLKDTTIVSAIGLVELFQTGKIIIARNYQSFRMYAILAIMYLVIITLLTRLAKRLEKRLK

SEQ ID NO: 4025 - DNA, 738 bp, Streptococcus agalactiae
atggcagaattaaaaattgatgtccaagatttacacaagtcgtatgggcaaaatgaagttttaaaaggtattgatgctaaattttatgaaggtgatgttgtttgtattattggaccttctggttcaggaaaatcaactttccttcgcacattgaacttacttgaatcaatcacaagtggaaaagttgttgtggacggctttgagttatcaaacccaaaaacagacatagacaaagcacgtgaaaatatcggaatggtatttcaacacttcaatcttttcccacatatgtcagttcttgaaaacatcacttttgctcctatagaacttggtaaagaatctaaagaagcagctgaaaagcatgggatggaattacttgaaaaagttggtttagccgataaagctaatgccaaaccagatagtttatctggaggacaaaaacaacgtgtagctatcgcaagaagcttagcgatgaatccagatatcttactttttgacgaaccaacttctgcacttgatccagaaatggttggagatgttctcaatgttatgaaagatttagctgaacaaggtatgactatgttaattgtgacacacgaaatgggatttgctcgtcaagttgccaatcgtgttatctttacagatggtggtcgtttcctcgaagatgggacacctgagcaaatctttgatacacctcaacacccacgtctccaagacttccttaataaagttttaaacgtt

SEQ ID NO: 4026 - protein, 246 aa, Streptococcus agalactiae
MAELKIDVQDLHKSYGQNEVLKGIDAKFYEGDVVCIIGPSGSGKSTFLRTLNLLESITSGKVVVDGFELSNPKTDIDKARENIGMVFQHFNLFPHMSVLENITFAPIELGKESKEAAEKHGMELLEKVGLADKANAKPDSLSGGQKQRVAIARSLAMNPDILLFDEPTSALDPEMVGDVLNVMKDLAEQGMTMLIVTHEMGFARQVANRVIFTDGGRFLEDGTPEQIFDTPQHPRLQDFLNKVLNV

SEQ ID NO: 4027 - DNA, 738 bp, Streptococcus pyogenes
atgacagaattaaaaattgatgttcaagatttacacaaatcttatggtcaaaatgaagtcttaaaaggaattgatgccaaattctacgaaggcgatgtcgtttgtatcattggtccttctggttctgggaaatcaacctttctacgtaccctcaacctcctagagacgattaccagtggtaaggtcatggtggacggttttgaattatcagatcctaagactaatattgacaaggcacgtgaaaatatcgggatggtattccaacacttcaaccttttccctcacatgactgttcttgagaatattatctttgctcctgttgaattaggtaaagagtctaaagaagttgctaaaaagcatggcatggcacttctagaaaaagtcggactttctgataaggccgacgccttcccaggaagtttatccggcgggcaaaaacagcgtgtcgccatcgccagaagtttagcaatgaacccagatattatgctctttgatgaaccaacttctgctcttgaccccgaaatggttggggacgttttgaacgttatgaaagacttggcagaacaaggcatgaccatgttaattgttactcacgaaatgggatttgctcgccaagtagctaaccgtgttatctttacagacggtggtcaattcttggaggatggtactcctgaagagatttttgatcatcctaagcaccctcgtctcattgaatttttagacaaggtcttaaacgtc

SEQ ID NO: 4028 - protein, 246 aa, Streptococcus pyogenes
MTELKIDVQDLHKSYGQNEVLKGIDAKFYEGDVVCIIGPSGSGKSTFLRTLNLLETITSGKVMVDGFELSDPKTNIDKARENIGMVFQHFNLFPHMTVLENIIFAPVELGKESKEVAKKHGMALLEKVGLSDKADAFPGSLSGGQKQRVAIARSLAMNPDIMLFDEPTSALDPEMVGDVLNVMKDLAEQGMTMLIVTHEMGFARQVANRVIFTDGGQFLEDGTPEEIFDHPKHPRLIEFLDKVLNV

SEQ ID NO: 4029 - DNA, 156 bp, Streptococcus agalactiae
atgggagataaaccgatatcatttcgtgataaagatgggaattttgtttcagcggccgatgtctggaatgctgaaaaattagaagaactctttaacacattaaatcctaatcgtaaacttcgtttagaacgcgaaaaattagcaaaagaaaaagga

SEQ ID NO: 4030 - protein, 52 aa, Streptococcus agalactiae
MGDKPISFRDKDGNFVSAADVWNAEKLEELFNTLNPNRKLRLEREKLAKEKG

SEQ ID NO: 4031 - DNA, 186 bp, Streptococcus pyogenes
gtgttatctttaagatggaggtttctgattatgggtgataaaccgatatcctttaaggataaggatggaaattttgtatcggcagcagatgtttggaatgctgagaaattagaagaattgtttaatcttttaaatcccaatagacgtttgcgcttagaacgtgaaaaattgaaaaaggatgaggct

SEQ ID NO: 4032 - protein, 62 aa, Streptococcus pyogenes
VLSLRWRFLIMGDKPISFKDKDGNFVSAADVWNAEKLEELFNLLNPNRRLRLEREKLKKDEA

SEQ ID NO: 4033 - DNA, 1311 bp, Streptococcus agalactiae
atgagtatgtttttagatactgccaaaattagtgttaaggcaggtcgcggtggtgatggcatggttgcttttcgccgtgagaaatatgtccccaatggaggcccgtggggcggtgatggcggtaaaggcggatcggtcatttttaaagtaaacgaaggtttacgaactttgatggattttcgatataaccgtaattttaaagcaaaagctggtgaaaaagggatgactaaaggtatgcacggtcgaggtgcagaagaccttattgtgtcattaccacctggaacaactgttcgtgatgctactacaggtaaggttattaccgaccttgtggagcatgatcaggaattcgttgtagccagaggtggccgcggtggtcgtggaaatattcgctttgcaaccccacgtaatccagctcctgaaattgctgaaaatggggagcctggtgaagaacgtgaattacaattagaattaaaaattttggctgatgttggtctcgttggtttcccatcagttgggaagtcgacgctacttagtgttgtttcagcagcaaagcctaaaattggtgcctatcattttacgacaattgtccctaatttagggatggttcgtacaaaatcaggtgatagctttgcaatggctgatcttcctggtttgattgaaggggctagtcaaggtgtcggattaggaactcagtttcttagacatattgagcgtacacgtgttattctacatgttattgatatgtcggcaagtgaaggacgagacccttacgatgactatgtttcaattaataatgagttggaaacttacaatcttcgattgatggaacgtccgcaaattattgttgccaataaaatggacatgcctgattcagaagagaatttggcagcattcaaagaaaaattagcagcaaactatgatgagtttgatgacatgcctatgatttttccaatttcaagtttagcacatcaaggactagaaaaccttatggatgcgacggctgaattattagccaatacagaagagtttcttctttatgacgaaactgacatgcaagaagatgaagcatactatggatttaacgaagatgaacgtccatttgagattacacgtgatgatgatgcaacgtgggtattgtatggtgataagctagaaaaactctttgttatgacaaatatggaacgcgatgaatcaataatgaaatttgctcgtcagttacgtggtatgggcgttgatgaagcccttcgagagcgcggagctaaggatggagatattgttcgtataggtaacttcgaatttgaatttgtagat

SEQ ID NO: 4034 - protein, 437 aa, Streptococcus agalactiae
MSMFLDTAKISVKAGRGGDGMVAFRREKYVPNGGPWGGDGGKGGSVIFKVNEGLRTLMDFRYNRNFKAKAGEKGMTKGMHGRGAEDLIVSLPPGTTVRDATTGKVITDLVEHDQEFVVARGGRGGRGNIRFATPRNPAPEIAENGEPGEERELQLELKILADVGLVGFPSVGKSTLLSVVSAAKPKIGAYHFTTIVPNLGMVRTKSGDSFAMADLPGLIEGASQGVGLGTQFLRHIERTRVILHVIDMSASEGRDPYDDYVSINNELETYNLRLMERPQIIVANKMDMPDSEENLAAFKEKLAANYDEFDDMPMIFPISSLAHQGLENLMDATAELLANTEEFLLYDETDMQEDEAYYGFNEDERPFEITRDDDATWVLYGDKLEKLFVMTNMERDESIMKFARQLRGMGVDEALRERGAKDGDIVRIGNFEFEFVD

SEQ ID NO: 4035 - DNA, 1311 bp, Streptococcus pyogenes
atgagtatgtttttagatacggcaaaaatcagtgtccaagcaggccgtggtggcgatggtatggtagcttttcgtcgtgaaaagtacgtcccaaatggcggtccttggggaggagacggcggtaaaggtggctcagttatcttccgagtggacgaaggtttgcgtaccttgatggatttccggtataatcgtaaattcaaggcgaaatctggtgaaaaaggtatgaccaaaggcatgcacggccgtggtgcagaagatttgattgtctttgttcctcaagggacaacggttcgtgatgctgaaactggaaaagtaattacagacttagtagaacatggtcaagaagtggtcattgctaagggtggtcgtggtggccgtgggaatattcgttttgcaactcctcgtaatcctgcgccagagattgctgaaaatggtgagccaggtgaggaacgtcagttagagttagaactcaaaatcttagctgacgttggcttggtcggattcccatctgttgggaaatcaaccttgttaagtgttgtgtcatcagctaaaccgaaaattggtgcctatcattttaccactattgttcctaatcttggaatggttcgtacaaagtcaggtgatagctttgctatggcagatctgccaggtttgattgaaggtgctagccaaggggttggtttaggaactcaattcctccgtcatatcgagcggacacgggttattcttcatgtgattgacatgtctgctagtgagggtcgtgatccttacgaagattatgtttccattaataacgagctggaaacctataatttgcgattgatggagcgcccacagattattgtggctaataaaatggacataccagaggctcaagaaaacttgaaagccttcaagaaaaaattggctgcccaatatgacgagtttgatgatttgccaatgattttccctatttcaagcctagcacatcaaggcttagagaacttgttagaagcaacggcagaattactcgctaaaacagacgaattcttattatatgatgaatctgatctggtggacgaggaagcttactatggctttgctgagactgaaaaagactttgagatcacacgtgacgatgacgctacttgggtcttgtctggtgagaagttagaacgtctctttgtcatgaccaatatggaacgtgatgagtccatcatgaaatttgcccgtcaattgcgcggtatgggggttgacgaagctcttcgtgaacgtggagcaaaagatggggatcctgttcgtattggcaagtttgaatttgaatttgtggat

SEQ ID NO: 4036 - protein, 437 aa, Streptococcus pyogenes
MSMFLDTAKISVQAGRGGDGMVAFRREKYVPNGGPWGGDGGKGGSVIFRVDEGLRTLMDFRYNRKFKAKSGEKGMTKGMHGRGAEDLIVFVPQGTTVRDAETGKVITDLVEHGQEVVIAKGGRGGRGNIRFATPRNPAPEIAENGEPGEERQLELELKILADVGLVGFPSVGKSTLLSVVSSAKPKIGAYHFTTIVPNLGMVRTKSGDSFAMADLPGLIEGASQGVGLGTQFLRHIERTRVILHVIDMSASEGRDPYEDYVSINNELETYNLRLMERPQIIVANKMDIPEAQENLKAFKKKLAAQYDEFDDLPMIFPISSLAHQGLENLLEATAELLAKTDEFLLYDESDLVDEEAYYGFAETEKDFEITRDDDATWVLSGEKLERLFVMTNMERDESIMKFARQLRGMGVDEALRERGAKDGDPVRIGKFEFEFVD

SEQ ID NO: 4037 - DNA, 126 bp, Streptococcus agalactiae
gtggcttttggagataacggacaacgaaaaaaaactgggtttgaaaaactaactctttttgttgttattttgatggtactagtaacagttggtggtttggtatttggtgctattagtgcaatcatg

SEQ ID NO: 4038 - protein, 42 aa, Streptococcus agalactiae
MAFGDNGQRKKTGFEKLTLFVVILMVLVTVGGLVFGAISAIM

SEQ ID NO: 4039 - DNA, 126 bp, Streptococcus pyogenes
gtggcatttggagaaaatggacctcgcaaaaaaacaacctttgaaaaagtgacaatgtttgttgttatcctaatggttcttgtaactgttggcgggcttattgcgagtgccctatcagtattaatg

SEQ ID NO: 4040 - protein, 42 aa, Streptococcus pyogenes
VAFGENGPRKKTTFEKVTMFVVILMVLVTVGGLIASALSVLM

SEQ ID NO: 4041 - DNA, 1239 bp, Streptococcus agalactiae
atggttttacaagatttcgacaaccttttaaaaaaatatgcccaattaattatttctaaaggtttaaatgtccaaaaagggcacactctcgctttaacaatcgatgtggaacaagtccacttagcaaggcttttaactgaagccgcttatgaaaagggagcaagtgaagttattgttgattatacagatgattttatcacgcgccagcgactacttcatgcttcagacgaagttctcacgaatgttccacagtataccgttgataaatctttagcactattaaataagaaggctagtcgattagttgtgaaatcttctaaccctaacgctttcgctactgttgatcctaaacgtttatctgaaacaactagagcaaccgctattgccttagaggaacaaagtagagcaatacaagctaataaagtatcttggaacgtggctgcagctgctggtagagaatgggctgcacttgtcttcccagaattaaaaacaagcgaccaacaagttgatgctctttgggataccattttcaaattaaatcgtatttatgaagatgatcctattgctgcttgggacgcacatgaagctaaattattagaaaaagctactagactaaatcaagaacaatttgatgctcttcattataccgcaccaggtacagatttaacgcttggtatgcctaaaaatcatatttgggaggcagccggtagtctcaacgctcagggagagacttttatcgctaatatgcctactgaagaaatcttttcagcacctgattaccgtcgtgcagatgggtatgtgacaagtacaaaacctctcagttatgctggcgttattatcgaaaatatgacatttacctttaaagacggtaaaattatcaatgtcactgcagaaaaagggcaagaaacagtccaacgcttaatcgaggaaaatgatggggcaagatcgcttggggaagttgcacttgtcccacataaaacaccaatttcactatctggactgattttctttaatactttattcgatgaaaatgcctctaatcacctcgctattggaactgcatatgccttcaatgtagaaggaggaacagaaatgacaagtcaagaattggatgaagctggtttaaatcgttcttcaacacatgttgattttatgattggttcagaacaaatggatattgatggtattcgtgcagatggaactgctgtcccaatctttagaaatggcgaatgggctatt

SEQ ID NO: 4042 - protein, 413 aa, Streptococcus agalactiae
MVLQDFDNLLKKYAQLIISKGLNVQKGHTLALTIDVEQVHLARLLTEAAYEKGASEVIVDYTDDFITRQRLLHASDEVLTNVPQYTVDKSLALLNKKASRLVVKSSNPNAFATVDPKRLSETTRATAIALEEQSRAIQANKVSWNVAAAAGREWAALVFPELKTSDQQVDALWDTIFKLNRIYEDDPIAAWDAHEAKLLEKATRLNQEQFDALHYTAPGTDLTLGMPKNHIWEAAGSLNAQGETFIANMPTEEIFSAPDYRRADGYVTSTKPLSYAGVIIENMTFTFKDGKIINVTAEKGQETVQRLIEENDGARSLGEVALVPHKTPISLSGLIFFNTLFDENASNHLAIGTAYAFNVEGGTEMTSQELDEAGLNRSSTHVDFMIGSEQMDIDGIRADGTAVPIFRNGEWAI

SEQ ID NO: 4043 - DNA, 504 bp, Streptococcus agalactiae
ttgaaccttgaaaatggtattatttactcaaaaaatattgctaagcaattaattgctaaagatccaaaaaacaaagctacttatgagaaaaacagagatgcttatgtagctaaattagaaaaattggataaagaagcaaaatctaaatttaatgccattccagctaataaaaaattaattgttactagtgaaggttgctttaaatatttctcaaaagcttatggagttccatcagcatacatctgggaaattaacactgaagaagaaggtacaccagatcaaattactagcttagttaagaaattaaaacaagtaagaccttcagctttattcgttgaatcaagtgttgacaagcgtcctatgaaatctgtttcaagagaatcaggtatcccaatttacgcagaaatcttcacagactcaattgctaaaaaaggtcaaaagggtgacagctactacgctatgatgaaatggaatcttgataagattgcagaaggtttagcaaaa

SEQ ID NO: 4044 - protein, 168 aa, Streptococcus agalactiae
MNLENGIIYSKNIAKQLIAKDPKNKATYEKNRDAYVAKLEKLDKEAKSKFNAIPANKKLIVTSEGCFKYFSKAYGVPSAYIWEINTEEEGTPDQITSLVKKLKQVRPSALFVESSVDKRPMKSVSRESGIPIYAEIFTDSIAKKGQKGDSYYAMMKWNLDKIAEGLAK

SEQ ID NO: 4045 - DNA, 2052 bp, Streptococcus agalactiae
ttggaagatcaaatgaaacgtaaatactttattcttaatacggtgacggttttaacgttagctgctgcaatgaatactagcagtatctatgctaatagtactgagacaagtgcttcagtagttcctactacaaatactatcgttcaaactaatgacagtaatcctaccgcaaaatttgtatcagaatcaggacaatctgtaataggtcaagtaaaaccagataattctgcggcgcttacaacagttgacacgcctcatcatatttcagctccagatgctttaaaaacaactcaatcaagtcctgtcgttgagagtacttctactaagttaactgaagagacttacaaacaaaaagatggtcaagatttagccaacatggtgagaagtggtcaagttactagtgaggaactcgttaatatggcatacgatattattgctaaagaaaacccatctttaaatgcagtcattactactagacgccaagaagctattgaagaggctagaaaacttaaagataccaatcagccgtttttaggtgttcccttgttagtcaaggggttagggcacagtattaaaggtggtgaaaccaataatggcttgatctatgcagatggaaaaattagcacatttgacagtagctatgtcaaaaaatataaagatttaggatttattattttaggacaaacgaactttccagagtatgggtggcgtaatataacagattctaaattatacggtctaacgcataatccttgggatcttgctcataatgctggtggctcttctggtggaagtgcagcagccattgctagcggaatgacgccaattgctagcggtagtgatgctggtggttctatccgtattccatcttcttggacgggcttggtaggtttaaaaccaacaagaggattggtgagtaatgaaaagccagattcgtatagtacagcagttcattttccattaactaagtcatctagagacgcagaaacattattaacttatctaaagaaaagcgatcaaacgctagtatcagttaatgatttaaaatctttaccaattgcttatactttgaaatcaccaatgggaacagaagttagtcaagatgctaaaaacgctattatggacaacgtcacattcttaagaaaacaaggattcaaagtaacagagatagacttaccaattgatggtagagcattaatgcgtgattattcaaccttggctattggcatgggaggagctttttcaacaattgaaaaagacttaaaaaaacatggttttactaaagaagacgttgatcctattacttgggcagttcatgttatttatcaaaattcagataaggctgaacttaagaaatctattatggaagcccaaaaacatatggatgattatcgtaaggcaatggagaagcttcacaagcaatttcctattttcttatcgccaacgaccgcaagtttagcccctctaaatacagatccatatgtaacagaggaagataaaagagcgatttataatatggaaaacttgagccaagaagaaagaattgctctctttaatcgccagtgggagcctatgttgcgtagaacaccttttacacaaattgctaatatgacaggactcccagctatcagtatcccgacttacttatctgagtctggtttacccatagggacgatgttaatggcaggtgcaaactatgatatggtattaattaaatttgcaactttctttgaaaaacatcatggttttaatgttaaatggcaaagaataatagataaagaagtgaaaccatctactggcctaatacagcctactaactccctctttaaagctcattcatcattagtaaatttagaagaaaattcacaagttactcaagtatctatctctaaaaaatggatgaaatcgtctgttaaaaataaaccatccgtaatggcatatcaaaaagcacttcctaaaacaggtgatacagaatcaagcctatctccagttttagtagtaacccttttattagcttgttttagctttgtaacaaaaaagaatcagaaaagt

SEQ ID NO: 4046 - protein, 684 aa, Streptococcus agalactiae
MEDQMKRKYFILNTVTVLTLAAAMNTSSIYANSTETSASVVPTTNTIVQTNDSNPTAKFVSESGQSVIGQVKPDNSAALTTVDTPHHISAPDALKTTQSSPVVESTSTKLTEETYKQKDGQDLANMVRSGQVTSEELVNMAYDIIAKENPSLNAVITTRRQEAIEEARKLKDTNQPFLGVPLLVKGLGHSIKGGETNNGLIYADGKISTFDSSYVKKYKDLGFIILGQTNFPEYGWRNITDSKLYGLTHNPWDLAHNAGGSSGGSAAAIASGMTPIASGSDAGGSIRIPSSWTGLVGLKPTRGLVSNEKPDSYSTAVHFPLTKSSRDAETLLTYLKKSDQTLVSVNDLKSLPIAYTLKSPMGTEVSQDAKNAIMDNVTFLRKQGFKVTEIDLPIDGRALMRDYSTLAIGMGGAFSTIEKDLKKHGFTKEDVDPITWAVHVIYQNSDKAELKKSIMEAQKHMDDYRKAMEKLHKQFPIFLSPTTASLAPLNTDPYVTEEDKRAIYNMENLSQEERIALFNRQWEPMLRRTPFTQIANMTGLPAISIPTYLSESGLPIGTMLMAGANYDMVLIKFATFFEKHHGFNVKWQRIIDKEVKPSTGLIQPTNSLFKAHSSLVNLEENSQVTQVSISKKWMKSSVKNKPSVMAYQKALPKTGDTESSLSPVLVVTLLLACFSFVTKKNQKS

SEQ ID NO: 4047 - DNA, 1452 bp, Streptococcus pyogenes
atgacttatcaagatgcgacggctatggctattgctgttcagactggtcagaccacaccactagaattagtaacccaggctatttataaggctaaaaagttgaaccctaccttaaatgctattacctcagaacgctttgaagcagccctagaagaagccaaacaaagggatttttcaggtctgccttttgctggtgtgcctctttttttaaaagatttgggacaagaattaaaaggtcactcatcaacctcaggttccagattgtttaaagagtatcaagcgactaaaacggatttatttgtgaaaagattagaagctttaggctttattattttagggcgctccaacacgcctgaatttggctttaaaaatattagcgatagcagtttgcacggaccagtgaatttaccaagggataatacacgaaatgctggtggctcatctgggggagctgctgctctagtgtcatcaggaattagtgcgctagcaactgctagtgatggtggtggttctattcgaattccagcctcgtttaatggcttaattgggctcaaacctagccgtgggcgcatgcctgtcggacctggttcttatcgaagctggcaaggagcctcagttcattttgccttgaccaaatccgttagagatactagaaatctactctactatttacagatggaacaaatggaaagccccttccccctagccaccttaacaaaagatagtatttatcaatcgctacaacgtcccttgacaattgctttttatcaacggttaagtgacggtagcccagtatctttagatactgcaaaagctttaagacaagcagtaacttggctaagagaacaagggcatcagctagttgaattggaagagtttcctgtaaatatgacagaagtgattcgtcattattatattatgaatagtgtggaaacggctgctatgtttgctgatattgaagacacttttggacgtccgatgaccaaagacgatatggaaaccatgacctgggctatttaccaatcaggtaaagacatcccagcttggcgttactcacaggtccttcaaaaatgggatacgtacagtgcaaccatggctagttttcatgagacttatgacctgttgttgacgttcacaaccaacacaccagctcctaagcacggagaacttgtcccagattcgaaactcatggctaacttggctcaagctgaaattttcagcagtgaagagcaattcaatttggtcgaaaccatgtttggtaagagtctggctattaatccttacacagctctgcctaatctaactggccagccagctattagtttacctacttatgaaactaaggaaggtctctcaatgggcattcaactaattgcagccaaaggtagagaggacctattattaggaattgcagaacagtttgaggcagcaggattattgaagattcctcaa

SEQ ID NO: 4048 - protein, 484 aa, Streptococcus pyogenes
MTYQDATAMAIAVQTGQTTPLELVTQAIYKAKKLNPTLNAITSERFEAALEEAKQRDFSGLPFAGVPLFLKDLGQELKGHSSTSGSRLFKEYQATKTDLFVKRLEALGFIILGRSNTPEFGFKNISDSSLHGPVNLPRDNTRNAGGSSGGAAALVSSGISALATASDGGGSIRIPASFNGLIGLKPSRGRMPVGPGSYRSWQGASVHFALTKSVRDTRNLLYYLQMEQMESPFPLATLTKDSIYQSLQRPLTIAFYQRLSDGSPVSLDTAKALRQAVTWLREQGHQLVELEEFPVNMTEVIRHYYIMNSVETAAMFADIEDTFGRPMTKDDMETMTWAIYQSGKDIPAWRYSQVLQKWDTYSATMASFHETYDLLLTFTTNTPAPKHGELVPDSKLMANLAQAEIFSSEEQFNLVETMFGKSLAINPYTALPNLTGQPAISLPTYETKEGLSMGIQLIAAKGREDLLLGIAEQFEAAGLLKIPQ

SEQ ID NO: 4049 - DNA, 720 bp, Streptococcus agalactiae
atgagacttgataaatttttagtagaatgcggacttggttcacgtactcaagtcaaattaatattgaaaaaaaagcagattagtgttaatggtaatagcgagacatctccaaaagtacaggtagatgaatatagagatgagattaaatataatggaactctagtgtcatatgaaaagtttgtttattatatgcttcataaacccaaaggtgttatatcagcaacggatgatccttcgcataaaaccgtgttagatttgctagacaaaactgctcgagataaagctgttttcccagtggggcgtttagatattgatacaacaggccttttgttattaactaataatggggaattagcgcataaaatgttatcacctaaaaaacacgttgataaatgctatgaggtaaaaatctcagggataatgacagaagacgatattttggcatttgataaagggattattctgaaagattttacttgtttaccagcattattagaaattgtggaagtaaatcaggtgaagaagcagagtcttgttaaaatcaccattaaggaaggaaaattccatcaagttaaacgtatggttgctgcgtgtggtaaggaagtcttagagctaaagcgtctaaggatgggaaatctacaattagataaacagctagaaagtggacaatggagacggctaacaataaaagaaatagaaaaattagaaaaatatatgcaa

SEQ ID NO: 4050 - protein, 240 aa, Streptococcus agalactiae
MRLDKFLVECGLGSRTQVKLILKKKQISVNGNSETSPKVQVDEYRDEIKYNGTLVSYEKFVYYMLHKPKGVISATDDPSHKTVLDLLDKTARDKAVFPVGRLDIDTTGLLLLTNNGELAHKMLSPKKHVDKCYEVKISGIMTEDDILAFDKGIILKDFTCLPALLEIVEVNQVKKQSLVKITIKEGKFHQVKRMVAACGKEVLELKRLRMGNLQLDKQLESGQWRRLTIKEIEKLEKYMQ

SEQ ID NO: 4051 - DNA, 732 bp, Streptococcus pyogenes
atgatgcgcttagataaatttttagtggcaactggtgttggaactaggagccaagtcaaacttctcttaaaaaagaaggctattttcgtcaatcaaaaggttgaaacctctgccaaagcacacattgatgaatacaaggatttggtgacgtatcaaggtacgcccttggtctatgaatcctttgtttattacctgttaaacaagccgtcagggtatgtgtcagcaacccaggacagacagcaggctactgttatggagttgttagatgacacggctaggcaaaaagcagtttttcctgtgggtaggttagataaggatacccgtggacttttgctcttgaccaataatggacaactagcccatgaccttttatcccctaaaaaacatgttacgaaagagtacttggctaaagtagcaggcatcatgactgaagctgataaagattattttgctagaggtatttccttaaaggatcaccagtgcctacctgctcatttagaagtgcttgctagtgatttacagcagcaaacaagtttggttaaaattaccatacaagaaggaaaattccatcaggtgaaacgcatggtagcagcctgtggaaaggaagtgcttgacttacagcgtctcagcatgggaccattaaaactagaccctagccttgcagaaggggagtttaggcgcctgacgcctgaggaattgcagagcctggcaccttattgtcagagctcacta

SEQ ID NO: 4052 - protein, 244 aa, Streptococcus pyogenes
MMRLDKFLVATGVGTRSQVKLLLKKKAIFVNQKVETSAKAHIDEYKDLVTYQGTPLVYESFVYYLLNKPSGYVSATQDRQQATVMELLDDTARQKAVFPVGRLDKDTRGLLLLTNNGQLAHDLLSPKKHVTKEYLAKVAGIMTEADKDYFARGISLKDHQCLPAHLEVLASDLQQQTSLVKITIQEGKFHQVKRMVAACGKEVLDLQRLSMGPLKLDPSLAEGEFRRLTPEELQSLAPYCQSSL

SEQ ID NO: 4053 - DNA, 903 bp, Streptococcus agalactiae
atgtttaaaatagatgtttttcactatgaaattcatttttgtcacatagaaaaggagattgttatggaaacatatactttatcgaatactcttaacattcctaaaattggttttgggacatggcaactaactgaaggtgaagaagcttataaggcagtgactcatgctttaaaagttggttatactcatattgatactgctcagatttatggtaatgaacatagtgttggacgtgctataagagacagtggtttggcaagagaaagtatctttttgacaactaagatttggaatgacaaacatgactatcatttagccaaagcttctattgatgaatctctgcagaaattaggtgttgattatattgatcttcttttgattcattggccaaatccaaaagctcttcgtgaaaatgatgcgtggaaagctgggaatgcaggcacttggaaagcgatggaagaagcttataaagaaggaaaggtaaaagctattggtgtttcgaatttcatgaaacatcacttagaggctttatttgaaactgccgaaataaaacctatggttaatcaaattatcctagcaccaggttgtgctcaagaggatttggttcgcttctgtaaaggaaatgatatcttattagaagcttacagtccatttggaacaggtgctatttttgaaaatgaatctataaaagctattgctgaaaaatatggtaaatcagttgcgcaagtagctcttcgctggtcacttgataatggctttttaccattacctaagtcagcgactcccaaaaatattgaagcaaaccttgatatttttgattttcaattaaacgaagatgatattgctaccttaatacaactagattcaggtattaaacccaaagatccagataatgtctcattt

SEQ ID NO: 4054 - protein, 301 aa, Streptococcus agalactiae
MFKIDVFHYEIHFCHIEKEIVMETYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDIATLIQLDSGIKPKDPDNVSF

SEQ ID NO: 4055 - DNA, 744 bp, Streptococcus agalactiae
ttgctacgatatcgcctgctgagattttttctaaattgtgatatgatagcattaataacaggaggatctaaaatgacaaaagaagatatcaaaaaacaagttcgaagagcttttgattttcgtatggcgattcgtgtttataataataatgatattcctaaagaagatatggagtatattttagatactgcttggttgagtccttcttcagtcggtttagaaggctggcgatttttggtactagatagacaaacaattgcaaaatttcgagataaacttaaggaagttgcttggggagcacaatatcaactagatactgctagtcactttgttttactactagctgaaaaaggtgcttattataacgctgatagcatgattaacagtctcattcgacgtggtctaggtgatccagctgcccttgagagtaggatacctctctacaaatccttccaagaaaacgatatgaaaattgattctgaacgttctctttgggattggacagcaaaacaaacttatatcgcactcggtaatatgatgacggctgctgctatgatcggcgtagattcatgcccaattgaaggatttgactatgaaaaggtcaataatatccttagtaaagaaggattaatagacgataagaaagaagctatttcttgtatggtttcatttggttatcgtttgcgtgaacctaaacattcccgtgctaggaaagaacgccaagaagtcattacttgggttgag

SEQ ID NO: 4056 - protein, 248 aa, Streptococcus agalactiae
MLRYRLLRFFLNCDMIALITGGSKMTKEDIKKQVRRAFDFRMAIRVYNNNDIPKEDMEYILDTAWLSPSSVGLEGWRFLVLDRQTIAKFRDKLKEVAWGAQYQLDTASHFVLLLAEKGAYYNADSMINSLIRRGLGDPAALESRIPLYKSFQENDMKIDSERSLWDWTAKQTYIALGNMMTAAAMIGVDSCPIEGFDYEKVNNILSKEGLIDDKKEAISCMVSFGYRLREPKHSRARKERQEVITWVE

SEQ ID NO: 4057 - DNA, 663 bp, Streptococcus pyogenes
atggatcaaaccattcatcaccaaatacagcaagcactacactttagaacagccgttcgtgtttataaggaagaaaagatttctgatgaggatttagcccttatccttgatgctgcttggttaagcccttcttctattggcttagaaggctggcgctttgtcgttttagacaacaagcctattaaagaagaaatcaagccctttgcctggggagcccagtatcaactggaaacagctagtcactttattcttttaatagccgaaaaacatgcaagatacgatagccctgctatcaaaaatagccttttacggcgtggtatcaaagaaggtgatggtctcaacagccgcctaaaactctatgaatctttccaaaaagaggacatggatatggcagataatcctcgggcactctttgattggacagctaaacaaacctatatcgctcttggtaatatgatgatgacagctgctcttttgggcattgatacttgccctattgaaggctttcattatgataaggtcaatcatatcctagctaagcataatgtgattgatttagaaaaagaaggcattgctagcatgttatccctaggctatcgtttgcgagatcccaaacatgctcaagttcgtaagcctaaagaagaagtgatttcagtcgttaaa

SEQ ID NO: 4058 - protein, 221 aa, Streptococcus pyogenes
MDQTIHHQIQQALHFRTAVRVYKEEKISDEDLALILDAAWLSPSSIGLEGWRFVVLDNKPIKEEIKPFAWGAQYQLETASHFILLIAEKHARYDSPAIKNSLLRRGIKEGDGLNSRLKLYESFQKEDMDMADNPRALFDWTAKQTYIALGNMMMTAALLGIDTCPIEGFHYDKVNHILAKHNVIDLEKEGIASMLSLGYRLRDPKHAQVRKPKEEVISVVK

SEQ ID NO: 4059 - DNA, 390 bp, Streptococcus agalactiae
atgccatttttacatacttgtattcgcgttaaagatttggacgcctcaattgctttttatcaagaagcacttggttttaaggaagttcgtcgtaatgactttcctgaaaatcaatttactttagtctatatggccctagaggacgaccctagttacgaattagagttaacctataactatgatcacgaagcttatgatttaggaaatgggtatggtcatattgctgttggtgtagacgatttggaaactacttatgatgcccatcagaaagcaggttactctgtaacaaaaatttctggattaccaggtaaacctaatatgttctactttattcaagatccagatggctataaaattgaagttattcgactcagtcaatttaaagctgac

SEQ ID NO: 4060 - protein, 130 aa, Streptococcus agalactiae
MPFLHTCIRVKDLDASIAFYQEALGFKEVRRNDFPENQFTLVYMALEDDPSYELELTYNYDHEAYDLGNGYGHIAVGVDDLETTYDAHQKAGYSVTKISGLPGKPNMFYFIQDPDGYKIEVIRLSQFKAD

SEQ ID NO: 4061 - DNA, 375 bp, Streptococcus pyogenes
atgaaagcattacatacctgtatccgcgtcaaagaccttgaccagtcggttgctttttacacaagtgccttcccttttaaggaaaactatcgtaaagattttccagatagtcaatttactcttgtttatctggctttagaaggagaaagttatgaattagaattaacctacaattatggtcatggcgactacgacttaggaaatggctatggtcatattgcccttggctctgaacattttgaagcagaccataaaaaacatcgacaagcaggttttccagttaccgatatcaaagaactggctgacaaatctgcccgctattatttcattcaggatccagatggctacaaaattgaagtcattgatttaaacaac

SEQ ID NO: 4062 - protein, 125 aa, Streptococcus pyogenes
MKALHTCIRVKDLDQSVAFYTSAFPFKENYRKDFPDSQFTLVYLALEGESYELELTYNYGHGDYDLGNGYGHIALGSEHFEADHKKHRQAGFPVTDIKELADKSARYYFIQDPDGYKIEVIDLNN

SEQ ID NO: 4063 - DNA, 924 bp, Streptococcus agalactiae
atggctttattatcagttattgtcccttgttataatgaacaagagactgtctcaacttttttaacagaaatcaaaaaagttgaatccgaaatggctcgttacacccattttgaatacattttcgtaaacgatggttctactgatcgtacactcgaacttcttaagaaagcagctaaacaatttgacaatgttcattacctttcattttcacgccattttggtaaagatgctgctttattggctggtttagaacatactactggtgattttatcactgttatggatgttgacttgcaagatccacccactttattaccagaaatgtacctaaaacttcaagaaggttatgatattgtcgctacaaggcgaaaagatcgtaaaggggagccgttgatacgctctctttttgccaagcttttttataaattaatcaatcaagtgtcagatactaaaatggttgatggtgcgcgtgattttcgtctcatgacaaaacaagttgttgacagtattctcgagctaaatgaagtgaatcgcttctcaaaagggattttttcctggattggatatgatgtcgcttatattagttatgagaatcgagaacgaattgcgggtaagacctcatggagtttctttaatctcttaaaatactctctagacggtttcatcaacttctcagaaattccattagctatagctacctggattggaacccttagttcagtactatcacttttagctatcatttttattataattcgaaaattactatttggggatcccgtttcaggttgggcaagcacagttaccattgtactttttatgggtggtattcagttattgtcgctaggaattataggcaaatacatctctaagattttcctagaaactaaaaaacgcccagtctatattgtcaaggaagaggga

SEQ ID NO: 4064 - protein, 308 aa, Streptococcus agalactiae
MALLSVIVPCYNEQETVSTFLTEIKKVESEMARYTHFEYIFVNDGSTDRTLELLKKAAKQFDNVHYLSFSRHFGKDAALLAGLEHTTGDFITVMDVDLQDPPTLLPEMYLKLQEGYDIVATRRKDRKGEPLIRSLFAKLFYKLINQVSDTKMVDGARDFRLMTKQVVDSILELNEVNRFSKGIFSWIGYDVAYISYENRERIAGKTSWSFFNLLKYSLDGFINFSEIPLAIATWIGTLSSVLSLLAIIFIIIRKLLFGDPVSGWASTVTIVLFMGGIQLLSLGIIGKYISKIFLETKKRPVYIVKEEG

SEQ ID NO: 4065 - DNA, 984 bp, Streptococcus pyogenes
ttgaaatatctcagcttttgtgttacaattgccctaaaattccatttgaaagaaaagtctatgacactactatctatcattgtcccctgctttaatgaagaagcaaacattctcccttattttgaagaaatgcatcaactagaaacgtccatgaccaaccaacttgcttttgaatacatttttattgatgatggttctaaggataacaccttgggtattttgcgtgagctagctgctcgctttccaaatgtgcattatctgtctttttcacgccattttggcaaggaagctgggctcttagctggactaaaagaagccaaaggcaattacattactgtgatggatgtggatctgcaagatccacccgaacttttgccaattatgtacgctaagctaaaagaaggttatgacatcgttggcaccaggcgccaaaatagacaaggagaaccactaattcgttcaatgtgttcgaatctattttatggactgatcaaacacttatcagatactgaaatggtcaatggagttcgggattatcggttaatgaccagacaagtcgttgatagcattcttgagttgggagaggttaatcgtttttcaaaagggatcttttcgtgggttggttatcgtatcacctatcttagttttgaaaaccaaaaacgcaaatatggaaaaagtcgttggcatttttgggagttgctccgatattctttagatggctttatcaacttttcagaaatgccgttaaccattgctacctggacagggactttcagctttttgatttctattttcgccatcttatttatcattatcagaaagatactctttggtgatcctgtctctggttgggccagcactgtctctattattttattcatgggaggcattcagctcttttgcatgggtattattggaaaatatatttcaaaaatattccttgaaactaaaaaaaggcctctctatattatcaaagaaaaacat

SEQ ID NO: 4066 - protein, 328 aa, Streptococcus pyogenes
LKYLSFCVTIALKFHLKEKSMTLLSIIVPCFNEEANILPYFEEMHQLETSMTNQLAFEYIFIDDGSKDNTLGILRELAARFPNVHYLSFSRHFGKEAGLLAGLKEAKGNYITVMDVDLQDPPELLPIMYAKLKEGYDIVGTRRQNRQGEPLIRSMCSNLFYGLIKHLSDTEMVNGVRDYRLMTRQVVDSILELGEVNRFSKGIFSWVGYRITYLSFENQKRKYGKSRWHFWELLRYSLDGFINFSEMPLTIATWTGTFSFLISIFAILFIIIRKILFGDPVSGWASTVSIILFMGGIQLFCMGIIGKYISKIFLETKKRPLYIIKEKH

SEQ ID NO: 4067 - DNA, 201 bp, Streptococcus agalactiae
  misc_feature (1)..(201): n = a, c, g, or t
atgtcaaaaaataataatgaccacactcaaaaatctgagaatggtatggtacgcggcctagaaaatcgtcacgtacagttaattgcgattgcagggacaatcggaactgggctttttcttggtgcaggtcgttcaattagcctgacgggtccttcaatagttcttgtctatgctatcactggcgcttnnnnnttaattaat

SEQ ID NO: 4068 - protein, 67 aa, Streptococcus agalactiae
  misc_feature (1)..(67): Xaa = Any Amino Acid
MSKNNNDHTQKSENGMVRGLENRHVQLIAIAGTIGTGLFLGAGRSISLTGPSIVLVYAITGAXXLIN

SEQ ID NO: 4069 - DNA, 1389 bp, Streptococcus pyogenes
atggagtttagaatgtctataaaagaacaaacagacaataacgaactagaaaatggaatggtaaggggcttagaaaatcgtcatgtgcagttaattgcgatcgcaggaacgattggaacaggtctctttttaggggcaggacgctctattgccctaacaggaccatctattatttttgtgtatatgattacaggtgccttcatgtttatgatgatgcgtgccatcggtgaaatgctctattatgatccagatcaacacacctttatcaattttatttccaaatacattggtccaggctggggttatttttcgggtctatcctattggatttcccttatttttattggaatggcagaaatcacagcagtaggtgcttatgtgcaattttggttcccaagctggccagcctggttgattcagttggttttcttagtcttacttagttcgatcaacttaattgctgtgcgcgtttttggggaaacagagttttggtttgccatgattaagattttagctattttagctttgattgcaacagctattttcatggtattgacaggttttgaaactcacacaggccatgctagcctttccaatatttttgaccatttttccatgttcccaaatgggaaactaaagttctttatggccttccaaatggttttctttgcttatcaagctatcgaatttgtgggaattaccacttctgagacggctaacccaagaaaagttctaccaaaggctattcaagaaattccaacccgtattgtgatcttttatgtgggagccttggtctctattatggcaattgtgccatggcatcagttaccagttgatgaatctccttttgtgatggtgttcaaattgattggtattaaatgggcagcagccttgattaactttgtggtcttgacatcagcagcgtcagcgcttaactcaaccctttattcaaccggtcgtcatctctatcagattgctaatgagactccaaacgctttgaccaatcgcttaaagattaatactttatctcgacaaggggtgccaagtcgtgccattattgcttcagcggttgtggttggtatctcagctttgattaatatcctaccaggagttgcagatgcgttctcactcattacggcctcctcatcaggtgtatatattgctatctacgccttaaccatgattgctcactggaagtaccgtcaatctaaggactttatggcagatggttatttgatgccaaaatataaagtgacaacgcctttgacccttgctttctttgcctttgtctttatctctcttttcttacaagaatccacctatatcggcgccattggagcaacgatttggattattatttttgggatttatagcaatgtcaaatttaaa

SEQ ID NO: 4070 - protein, 463 aa, Streptococcus pyogenes
MEFRMSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIIFGIYSNVKFK

SEQ ID NO: 4071 - DNA, 327 bp, Streptococcus agalactiae
atgtcattaccaaattgccctaagtgtaactctgaatatgtctatgaagacggtattttactggtttgtccagaatgtgcttacgagtggaatccagaagaaatcgaagaagaagtaggtttaattgtattggatagcaatggaacgcgcttatcagatggagatactgtgacagttattaaggatttaaaagtaaaaggagcgcctaaggatattaagcaaggcactcgtgttaaaaatattcgtttagttgatggcgatcataatatcgattgtaaaattgatggttttggagctatgaaactaaaatctgagtttgtaaaaaaa

SEQ ID NO: 4072 - protein, 109 aa, Streptococcus agalactiae
MSLPNCPKCNSEYVYEDGILLVCPECAYEWNPEEIEEEVGLIVLDSNGTRLSDGDTVTVIKDLKVKGAPKDIKQGTRVKNIRLVDGDHNIDCKIDGFGAMKLKSEFVKK

SEQ ID NO: 4073 - DNA, 261 bp, Streptococcus pyogenes
atgtgtgcttttgaatggacaccaggcgaagaagcgactgaagaagaaggacttgttgttttggatagcaatggtgtccgactgtctgatggtgataccattactgtggttaaagatttgaaagtaaaaggcgctccaaaagacctgaaacaagggactcgagttaaaaatattcgcctggtggaaggtgatcataatattgattgtaagattgatgggtttggcgcgatgaaattgaaatcagaatttgtcaagaaaatc

SEQ ID NO: 4074 - protein, 87 aa, Streptococcus pyogenes
MCAFEWTPGEEATEEEGLVVLDSNGVRLSDGDTITVVKDLKVKGAPKDLKQGTRVKNIRLVEGDHNIDCKIDGFGAMKLKSEFVKKI

SEQ ID NO: 4075 - DNA, 138 bp, Streptococcus agalactiae
ttggagaaagaggctaagcagatcattgatttaaaaaggaatcttttcaaaattgatgtccgggcacaaaaggatgaagagaaagttttcatgcgtacggcgtggaaaataggctttttcctattgtcaagaagccta

SEQ ID NO: 4076 - protein, 46 aa, Streptococcus agalactiae
MEKEAKQIIDLKRNLFKIDVRAQKDEEKVFMRTAWKIGFFLLSRSL

SEQ ID NO: 4077 - DNA, 1812 bp, Streptococcus agalactiae
atgtgtggtatcgtaggtgtagttggaaatacaaatgcaacggatattttaattcaaggcttagaaaagctagagtaccgaggatatgactcagcaggtatttttgtagtaggtgataacaaaagtcaacttgtgaagtcagtcggtcgaatcgcggagattcaggcaaaagtaggagattctgttagtggtacgacaggtatcggtcatacacgttgggcaacccatggtaaacctactgaaggaaatgcacatcctcacacttcaggatctggtcgttttgtattggtacacaatggtgttattgaaaattaccttcaaattaaagaaacttacttaacaaaacataacctcaagggtgaaactgatacagaaatagctattcatttagttgaacactttgttgaagaagataacttatcagtgcttgaagcctttaaaaaagccttacatattatagaaggatcatacgcatttgctcttattgattctcaagatgctgatacgatttacgtagctaaaaataaatcacctcttctaataggtttgggaaatggttataatatggtgtgttcagatgccatggctatgatacgtgagacaagtgaatatatggaaatccacgataaagaactcgttattgttaaaaaagatagcgttgaagttcaagattatgatggtaatgtcattgaacgtggtagctacacagcagagcttgacttatcagatattggtaaggggacttatccattctacatgcttaaagaaattgatgagcaaccaactgtgatgcgtaagttgatttcaacttatgcgaacgaatctggagatatgaatgtggattctgatattataaaatcagtccaagaagcagatcgtctttacatattggctgcaggaacgtcatatcatgctggttttgctgctaagaccatgatcgaaaaattaactgatacacctgttgaacttggagtttcttcagaatggggttacaacatgccacttttgagtaagaagccaatgtttattttacttagtcaatcgggagaaacagcagatagtagacaagttttagttaaagcaaacgaaatgggaatccctagtttaactataacaaatgtgcctggctcaacactttctcgtgaagcaacctatacgatgctcattcatgcaggacctgaaatcgctgttgcttctacaaaagcatatactgctcaagttgcaacgttagctttcttagcaaaagcggtaggagaagcaaatggtaaggcagaagcaaaagattttgatttggttcatgaattgtcaattgtagcacaatcaattgaagcgaccttatcagaaaaagatgttatctctgagaaggtagagcagttgttaatctcgacacgtaatgccttctacattggtcgtggtaacgactattatgttacaatggaggctgcactgaagctaaaagagatttcttatattcagacagaaggttttgctgcaggtgaattaaaacatggtacaatttcgttgattgaagacaatactcctgttattgctttaatatctgctgattcaactattgcagcgcatactcgtggaaatatccaagaagttgtttctcgcggagcaaatgctttgattattgtagaagaagggttggaacgtgaaggtgatgatattattgttaataaagttcacccattcttatcagccatttcaatggttattccgactcaattaattgcttactatgcttcattacaacgtggcttagatgttgataaaccacgtaatttggcaaaagctgtaactgttgaa

SEQ ID NO: 4078 - protein, 604 aa, Streptococcus agalactiae
MCGIVGVVGNTNATDILIQGLEKLEYRGYDSAGIFVVGDNKSQLVKSVGRIAEIQAKVGDSVSGTTGIGHTRWATHGKPTEGNAHPHTSGSGRFVLVHNGVIENYLQIKETYLTKHNLKGETDTEIAIHLVEHFVEEDNLSVLEAFKKALHIIEGSYAFALIDSQDADTIYVAKNKSPLLIGLGNGYNMVCSDAMAMIRETSEYMEIHDKELVIVKKDSVEVQDYDGNVIERGSYTAELDLSDIGKGTYPFYMLKEIDEQPTVMRKLISTYANESGDMNVDSDIIKSVQEADRLYILAAGTSYHAGFAAKTMIEKLTDTPVELGVSSEWGYNMPLLSKKPMFILLSQSGETADSRQVLVKANEMGIPSLTITNVPGSTLSREATYTMLIHAGPEIAVASTKAYTAQVATLAFLAKAVGEANGKAEAKDFDLVHELSIVAQSIEATLSEKDVISEKVEQLLISTRNAFYIGRGNDYYVTMEAALKLKEISYIQTEGFAAGELKHGTISLIEDNTPVIALISADSTIAAHTRGNIQEVVSRGANALIIVEEGLEREGDDIIVNKVHPFLSAISMVIPTQLIAYYASLQRGLDVDKPRNLAKAVTVE

SEQ ID NO: 4079 - DNA, 1812 bp, Streptococcus pyogenes
atgtgtggaattgttggagttgttggaaatcgcaatgcaacggatattttaatgcaaggccttgaaaagcttgaataccggggttatgattcagcaggaatttttgtggctaatgccaatcaaacaaacttgattaaatcagtggggcggattgctgatttgcgtgccaagattggcattgatgttgctggttcaacagggattggtcacacccgttgggcaacgcatggccaatcaacagaggataatgcccatcctcacacgtcacaaactggacgttttgtacttgttcataatggtgtgattgaaaattaccttcacattaaaacagagttcctagctggacatgattttaaggggcagacagatactgagattgcagtacacttgattggaaaatttgtggaagaagacaagttgtcagtactggaagcttttaaaaaatctttaagcattattgaaggttcctacgcctttgcattaatggatagccaagcaactgatactatttatgtggctaaaaacaagtctccattgttgattggacttggtgaaggttacaacatggtttgttcagatgccatggccatgattcgtgaaaccagtgaatttatggaaattcatgataaggagctagttattttaaccaaagataaggtaactgttacagactacgatggtaaagagctgatacgagattcctacactgctgaattagacttatctgatattggcaaagggacttatcctttctatatgctgaaagaaattgatgagcaaccaaccgtaatgcgtcaattaatttcaacttatgcagatgaaactggtaacgtacaggttgatccggctatcattacctctatccaagaggctgaccgtctttatattttagcggcagggacttcctaccatgctggttttgcaacaaaaaatatgcttgagcaattgacagatacaccagttgagttgggcgtggcttctgagtggggttaccacatgcctctgcttagcaagaaaccaatgtttattctactaagccaatcaggagaaaccgcagatagtcgtcaagttttagtaaaggcaaatgctatgggcattccgagtttgacagtaactaacgttccaggatcaaccttatcacgtgaagcaacatacaccatgttgattcatgctggacctgaaattgctgttgcgtctacaaaagcttacactgcacaaattgctgcccttgcctttttggctaaggcagttggtgaggcaaatggtaagcaagaagctcttgactttaacttggtacatgagttgtcattggttgcccaatctattgaggcgactttgtctgaaaaagatctcgtggcagaaaaggttcaagctttgctagctactactcgtaatgctttttacatcgggcgtggcaatgattattacgttgcgatggaagctgctttgaaattaaaagagatttcttatattcaatgcgaaggctttgcggctggtgaattgaaacatggaaccatttcattaattgaggaggacacgccagtaatcgctttaatatcgtctagtcagttggttgcctctcatacgcgtggtaatattcaagaagttgctgcccgtggggctcatgttttaacagttgtggaagaagggcttgaccgtgagggagatgacattattgtcaataaggttcatcctttcctagccccgattgctatggtcattccaactcaactgattgcttactacgcttcattacaacgtggacttgatgttgataagccacgtaatttggctaaagctgtaacagtagaa

SEQ ID NO: 4080 - protein, 604 aa, Streptococcus pyogenes
MCGIVGVVGNRNATDILMQGLEKLEYRGYDSAGIFVANANQTNLIKSVGRIADLRAKIGIDVAGSTGIGHTRWATHGQSTEDNAHPHTSQTGRFVLVHNGVIENYLHIKTEFLAGHDFKGQTDTEIAVHLIGKFVEEDKLSVLEAFKKSLSIIEGSYAFALMDSQATDTIYVAKNKSPLLIGLGEGYNMVCSDAMAMIRETSEFMEIHDKELVILTKDKVTVTDYDGKELIRDSYTAELDLSDIGKGTYPFYMLKEIDEQPTVMRQLISTYADETGNVQVDPAIITSIQEADRLYILAAGTSYHAGFATKNMLEQLTDTPVELGVASEWGYHMPLLSKKPMFILLSQSGETADSRQVLVKANAMGIPSLTVTNVPGSTLSREATYTMLIHAGPEIAVASTKAYTAQIAALAFLAKAVGEANGKQEALDFNLVHELSLVAQSIEATLSEKDLVAEKVQALLATTRNAFYIGRGNDYYVAMEAALKLKEISYIQCEGFAAGELKHGTISLIEEDTPVIALISSSQLVASHTRGNIQEVAARGAHVLTVVEEGLDREGDDIIVNKVHPFLAPIAMVIPTQLIAYYASLQRGLDVDKPRNLAKAVTVE

SEQ ID NO: 4081 - DNA, 579 bp, Streptococcus agalactiae
atggaaaaaagattaggagtagttatggttaaacgcgattttattagaaatattattttagcattgattgctgtattgattttgattctcttgagatattttgtttttgcaacctttaaagtacataaggatgctacaaattcttattttagcaacggagatgttgttgttgttaatcgtaataggacgcctaagtacaaagactttattgtctataaggttggaaagattttctatattagtcgtgttattggtgagccaaatcaaaaagtgagagtaatggatgatattttatatttgaatgatgttttcaaggatgagccttacattgaaaaaatgaaaaatgcttattctgaaaagaaagacggtcaaatgccctttacttccgacttctcagttgaaacattaacacgaaataaagaaagcagagttcctaagggttcttatcttgtgttaaatgataatcgacaaaataaaaatgatagtcgaaaatttggattaatcaaagagaaagatattcgtggtgttattacctttaaagtataccctctaagtgaatttggttttacagcttcagag

SEQ ID NO: 4082 - protein, 193 aa, Streptococcus agalactiae
MEKRLGVVMVKRDFIRNIILALIAVLILILLRYFVFATFKVHKDATNSYFSNGDVVVVNRNRTPKYKDFIVYKVGKIFYISRVIGEPNQKVRVMDDILYLNDVFKDEPYIEKMKNAYSEKKDGQMPFTSDFSVETLTRNKESRVPKGSYLVLNDNRQNKNDSRKFGLIKEKDIRGVITFKVYPLSEFGFTASE

SEQ ID NO: 4083 - DNA, 555 bp, Streptococcus pyogenes
atggtaaagcgagattttataagaaatatattattgttattaattgtgattattggggctattttgttgagaatctttgttttttcaacttttaaagtttctccagaaacagctaatacttatttaaagagtggtgatttagtcacaatcaaaaaaaatattcagcccaaatataaagattttgtggtttatagagttggaaaaaaagattatgtcagtcgagtcattgctgttgaaggcgatagcgtgacttatatggacgatattttttacctcaataatatggtagagtcacaggcttaccttgaaaagatgaaagcacattacttgaatcatgcaccgtttggcacattgtatacagatgattttacagttgctaccatcacagctgataagtatcaaaaagttcctaaggggaagtatcttcttttgaatgataaccggaaaaatacgaatgacagtcgtcgatttgggttaataaatgcctcgcagattaaaggtttagtgacctttagagttttgcctctcagcgattttggatttgtagaagtagag

SEQ ID NO: 4084 - protein, 185 aa, Streptococcus pyogenes
MVKRDFIRNILLLLIVIIGAILLRIFVFSTFKVSPETANTYLKSGDLVTIKKNIQPKYKDFVVYRVGKKDYVSRVIAVEGDSVTYMDDIFYLNNMVESQAYLEKMKAHYLNHAPFGTLYTDDFTVATITADKYQKVPKGKYLLLNDNRKNTNDSRRFGLINASQIKGLVTFRVLPLSDFGFVEVE

SEQ ID NO: 4085 - DNA, 1500 bp, Streptococcus agalactiae
atgaataaacgcgtaaaaatcgttgcaacacttggtcctgcggttgaattccgtggtggtaagaagtttggtgagtctggatactggggtgaaagccttgacgtagaagcttcagcagaaaaaattgctcaattgattaaagaaggtgctaacgttttccgtttcaacttctcacatggagatcatgctgagcaaggagctcgtatggctactgttcgtaaagcagaagagattgcaggacaaaaagttggcttcctccttgatactaaaggacctgaaattcgtacagaactttttgaagatggtgcagatttccattcatatacaacaggtacaaaattacgtgttgctactaagcaaggtatcaaatcaactccagaagtgattgcattgaatgttgctggtggacttgacatctttgatgacgttgaagttggtaagcaaatccttgttgatgatggtaaactaggtcttactgtgtttgcaaaagataaagacactcgtgaatttgaagtagttgttgagaatgatggccttattggtaaacaaaaaggtgtaaacatcccttatactaaaattcctttcccagcacttgcagaacgcgataatgctgatatccgttttggacttgagcaaggacttaactttattgctatctcatttgtacgtactgctaaagatgttaatgaagttcgtgctatttgtgaagaaactggcaatggacacgttaagttgtttgctaaaattgaaaatcaacaaggtatcgataatattgatgagattatcgaagcagcagatggtattatgattgctcgtggtgatatgggtatcgaagttccatttgaaatggttccagtttaccaaaaaatgatcattactaaagttaatgcagctggtaaagcagttattacagcaacaaatatgcttgaaacaatgactgataaaccacgtgcgactcgttcagaagtatctgatgtcttcaatgctgttattgatggtactgatgctacaatgctttcaggtgagtcagctaatggtaaatacccagttgagtcagttcgtacaatggctactattgataaaaatgctcaaacattactcaatgagtatggtcgcttagactcatctgcattcccacgtaataacaaaactgatgttattgcatctgcggttaaagatgcaacacactcaatggatatcaaacttgttgtaacaattactgaaacaggtaatacagctcgtgccatttctaaattccgtccagatgcagacattttggctgttacatttgatgaaaaagtacaacgttcattgatgattaactggggtgttatccctgtccttgcagacaaaccagcatctacagatgatatgtttgaggttgcagaacgtgtagcacttgaagcaggatttgttgaatcaggcgataatatcgttatcgttgcaggtgttcctgtaggtacaggtggaactaacacaatgcgtgttcgtactgttaaa

SEQ ID NO: 4086 - protein, 500 aa, Streptococcus agalactiae
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGADFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGFVESGDNIVIVAGVPVGTGGTNTMRVRTVK

SEQ ID NO: 4087 - DNA, 1500 bp, Streptococcus pyogenes
atgaataaacgcgtaaaaatcgttgcaacacttggtcctgcggttgaaatccgtggtggtaaaaaatacggagaagatggctactgggctggtcaacttgatgttgaagaatcagcaaaaaaaatcgctgaattaattgaagctggtgcgaatgttttccgtttcaatttctcacacggtgaccacaaagagcaaggtgaccgtatggcaactgttcgccttgcagaagaaattgctcgtcaaaaagttggtttccttttggatactaaaggtcctgaaatgcgtacggaattgtttgcagatgatgctaaagagtttagctatgttactggagaaaaaatccgtgtagcgactacacaaggtattcaatcaactcgcgatgttattgctttgaacgttgctggtagccttgacatctacgatgaagtagaagtaggtcatactattcttatcgatgatggtaaacttggtttgaaagtgatcgacaaagatatcgcaacacgtcaatttatcgttgaagtagaaaacgacggtattattgctaaacaaaaaggtgttaatatccctaacactaaaattcctttcccagcacttgcggaacgcgacaatgctgatatccgttttggtcttgaacaaggacttaactttattgcaatctcatttgttcgtacagccaaagacgttgaggaagttcgtgaaatctgtcgcgaaactggtaacgaccatgtgcaattatttgctaagattgaaaaccaacaaggtatcgataatcttgatgaaatcatcgaagctgctgatggtatcatgattgcacgtggcgacatgggtatcgaagtaccatttgaaatggttccagttttccaaaaaatgattatcactaaagtgaatgcagctggtaaagcagttatcacagcaacaaacatgcttgaaacaatgactgaaaaaccacgtgcgacacgttctgaagtatctgacgtcttcaatgctgttatcgatggtactgatgcaacaatgctttcaggagagtcagctaacggtaaatacccggttgaatctgttcgtacaatggcgactattgatcgtaatgcacaaactcttcttaacgaatatggtcgtttagattcatctgccttcccacgtaccaataaaacagatgttattgcttcagctgttaaagatgccactcattcaatggacatcaaacttgttgtgactattactgagacaggtaatacagctcgtgcgatttctaaattccgtccagatgcggacatcttagctgtaacatttgatgaaaaagtacaacgtgctttgatgattaactggggtgttattcctgttcttgctgaaaaacctgcatctactgatgacatgtttgaagtagcagagcgtgttgctgtggaggcaggcttagttcaatctggggataatattgttattgttgctggtgttccagttggtactggtggaacgaatactatgcgtgttcgtacagtaaaa

SEQ ID NO: 4088 - protein, 500 aa, Streptococcus pyogenes
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWGVIPVLAEKPASTDDMFEVAERVAVEAGLVQSGDNIVIVAGVPVGTGGTNTMRVRTVK

SEQ ID NO: 4089 - DNA, 1020 bp, Streptococcus agalactiae
atgaaacgtattgctgttttaactagtggtggtgacgcccctggtatgaacgctgctatccgtgcagttgttcgtaaagcaatttctgaaggtatggaagtttacggcatcaaccaaggttactatggtatggtgacaggggatattttccctttggatgctaattctgttggggatactatcaaccgtggaggaacgtttttacgttcagcacgttatcctgaatttgctgaacttgaaggtcagcttaaagggattgaacagcttaaaaaacacggtattgaaggtgtagtagttatcggtggtgatggttcttatcatggtgctatgcgtctaactgagcacggtttcccagctgttggtttgccgggtacaattgataacgatatcgttggcactgactatactattggttttgacacagcagttgcgacagcagttgagaatcttgaccgtcttcgtgatacatcagcaagtcataaccgtacttttgttgttgaggttatgggaagaaatgcaggagatatcgctctttggtcaggtatcgctgcaggtgcagatcaaattattgttcctgaagaagagttcaatattgatgaagttgtctcaaatgttagagctggctatgcagctggtaaacatcaccaaatcatcgtccttgcagaaggtgttatgagtggtgatgagtttgcaaaaacaatgaaagcagcaggagacgatagcgatcttcgtgtgacgaatttaggacatctgctccgtggtggtagtccgacggctcgtgatcgtgtcttagcatctcgtatgggagcgtacgctgttcaattgttgaaagaaggtcgtggtggtttagccgttggtgtccacaacgaagaaatggttgaaagtccaattttaggtttagcagaagaaggtgctttgttcagcttgactgatgaaggaaaaatcgttgttaataatccgcataaagcggaccttcgcttggcagcacttaatcgtgaccttgccaaccaaagtagtaaa

SEQ ID NO: 4090 - protein, 340 aa, Streptococcus agalactiae
MKRIAVLTSGGDAPGMNAAIRAVVRKAISEGMEVYGINQGYYGMVTGDIFPLDANSVGDTINRGGTFLRSARYPEFAELEGQLKGIEQLKKHGIEGVVVIGGDGSYHGAMRLTEHGFPAVGLPGTIDNDIVGTDYTIGFDTAVATAVENLDRLRDTSASHNRTFVVEVMGRNAGDIALWSGIAAGADQIIVPEEEFNIDEVVSNVRAGYAAGKHHQIIVLAEGVMSGDEFAKTMKAAGDDSDLRVTNLGHLLRGGSPTARDRVLASRMGAYAVQLLKEGRGGLAVGVHNEEMVESPILGLAEEGALFSLTDEGKIVVNNPHKADLRLAALNRDLANQSSK

SEQ ID NO: 4091 - DNA, 1011 bp, Streptococcus pyogenes
atgaaacgtattgctgttttaaccagtggcggcgacgctcctggtatgaacgctgctattcgtgcagtcgttcgtaaagcaatttcagaaggaatggaagtttatggtatcaaccgtggctatgcaggtatggttgatggcgacattttcccactgggttcaaaagaagttggtgataaaatctcacgtggtggaactttcttatactcagctcgttatccagagtttgctcaacttgaaggtcaattggctggtattgagcaacttaaaaaacatggtattgaaggtgttgttgttattggtggggatggttcttatcatggcgctatgcgcttgacagagcacggcttcccagcggtaggtatcccaggaacaatcgataacgatattgcgggaactgactacactatcggatttgatacagcagttaacacagcagttgaagctattgataaacttcgtgacacctcatcaagtcacggacgtacttttgtggttgaagtgatgggtcgcaatgcgggtgatattgctctttgggcaggtattgctagtggtgctgatcaaatcattgttccagaagaagagtttgatattgaaaaagtggcatcaacaatccaatatgattttgaacacaaaggtaaaaatcaccacattatcgtcttagctgaaggtgttatgagcggtgaagcttttgctcaaaaactgaaagaagctggcgataagagtgaccttcgtgtgacaaatcttggccacattcttcgtgggggttcaccaactgctcgtgaccgtgtcattgcttcttggatgggttcacatgctgttgagctacttaaagatggcaaaggtggtttggctgttggtattcacaatgaagaacttgttgaaagcccaatccttggtactgcagaagaaggtgctttgttcagcttgactgaagaaggcaagattattgttaataatccacacaaagctcgtttagactttgcagctttgaaccgttcattgtcacaa

SEQ ID NO: 4092 - protein, 337 aa, Streptococcus pyogenes
MKRIAVLTSGGDAPGMNAAIRAVVRKAISEGMEVYGINRGYAGMVDGDIFPLGSKEVGDKISRGGTFLYSARYPEFAQLEGQLAGIEQLKKHGIEGVVVIGGDGSYHGAMRLTEHGFPAVGIPGTIDNDIAGTDYTIGFDTAVNTAVEAIDKLRDTSSSHGRTFVVEVMGRNAGDIALWAGIASGADQIIVPEEEFDIEKVASTIQYDFEHKGKNHHIIVLAEGVMSGEAFAQKLKEAGDKSDLRVTNLGHILRGGSPTARDRVIASWMGSHAVELLKDGKGGLAVGIHNEELVESPILGTAEEGALFSLTEEGKIIVNNPHKARLDFAALNRSLSQ

SEQ ID NO: 4093 - DNA, 3102 bp, Streptococcus agalactiae
atgtttgcacaacttgatacaagaaccgtttattcttttatggatagcttggttgatttaaagacatatgtctctaaatcgaaatcattaggatatcaaactattggtatcttggaccacagtaatctttatgcagcatatcattttattcaagaggcgcaaaaggcaaacctaagaccaatagttggatttagctttgatatagtggttgaaaatagatcaatagaagtttactgtattgcgataaatacagttggttataagaatctcttgaagttgtcaacggctcaaatgtctgagaagatgtctctaaatttattgacagaacatcttgaaggggtgcaattgattcttccctatcaagatgttcttgatcagctcaatttaccctttgattatgttattggtgttaatttgacctctccgcagattccatataccaaacccattatagccatagatactgttcgatattttcaaaaaaatgatattgagacattacagatgcttcatgctataagagataatgtcctgttaaaagacgcacaatatgcgagcaaaaatcaagaattaaaaccttgtcaagaaatgactctagcattcaaggaacgttttcctgaagctttagctaacctagaatctttggtagagaatgttgcttatcactttgattctgactttaagttacctatttttaatagagaaattcctgctggagaagaattaagaaccttaactcaaaataacttaaaaagtaaaggtttatggagcgatgcttatcaagagcgtctcgaaaaagaattaacaatcattcacaaaatgggctttgatgactatttccttattgtgtgggatttattaagatttggtcgtagtaagggctactatatgggaatgggacgtggttcagcagcgggaagtttagtctcatatgctttaaatattaccggtatcgatcctgtcaaacataatttaatttttgaacgttttttaaatgaagagcgttattcgatgccagatattgatattgatcttccggatatttatcgtggagaattcttgcgctatgtacgtaatcgatatggttcaatgcattctgcacagattgtaaccttctcaacttttggtgcgaaacaggctattcgagatgtttttaaacgctttggtgcatcagagtatgagttaacaaacataactaaaaaaattcatttcagagataatttgaccagtgtttataaccgcaacttagctttcagacaaataatagatagtaaaattgaataccaaaaagcctatgatattgctaagcgtattgaaggaaatcctagacagacttctattcatgccgctggggtagtaatgagtgacgatttgttaacagatcatattcctttaaaaaacggtgaggatatgatgataacgcaatatgatgctagttctgttgaggataatggtcttctaaaaatggactttctaggtcttcgaaatttgacatttgttcagaaaatgaaggagaaagtcgataaggactacggtatctctatacaattagaaactattgatttagaagataaagagactctaaaactatttgcagctggtcaaacaaaggggatttttcaatttgagcaaagtggagctattaatttgttgcgacgtattaggccagagtgttttgaagatgtggtagctaccaccagcttgaataggcctggtgcaagtgattatactgagaattttataaaccgtcgttttggtaaagaaaaaatcgatttagtagatcctgtcatagctccaattttacaacctacctatggcataatgctctatcaagaacaggttatgcagattgcccagacctacgcaggttttacgctaggcaagtctgatttgctcagacgtgctatgtctaagaaaaattctaaggagatgcaaaagatgtctcaatccttcttagagggtgcagtatctaagggacatcgtcaagaagatgctcgacttatatttgaacgcatggctaaatttgcaggttatgggtttaatcgcagccatgcgtttgcttattcggctttagcttttcaattagcctatttcaaagcccattattccgatgtcttttatgacatcatgataaattattcaaatagtgattatctaatcgatgctattgattttggttttgttattgaaaaaccttcaattaatactatttcatacagagaccgcatctataaaaagaaaatttatttaggtttaaaaaatattaagggtgttcctaacgatttggcttattggatttctaaaaatcaaccgtttcagagtattgaagattttctaatgaggctgccacagcagtttcaaaaaagtggttttatttctccgctaattgctattggagcatttgacgaatttgataataatagacggaaaatcacctctaatcttgattctttatttacatttgtaaatgaactaggtagtttatttgcagatacctcatatcattggctagaagtagaagatttctctaattctgagaaatatgaaatggaacaagatatcttaggagtaggaatcagcccgcaccctttagtggggatttcacaaaaagctagccgtccgtttataccaattagtcaagttcaagaaaatagcgaagctactattttagttcagctaaagcaggtcaaagttattaggacaaaaagttctgggcaacaaatggctttcttgactgttatggatattaattcaaaaatggatattactgtttttcctgaaactttcaatattgtaagagatgatttacaagaagggaaatattattacttgcatggaaaaattcagaagcgagatgagcgattacagatggttttaaacggtgttcaagaagcaacggaggaacgtttttggatacttctaaaaaatcatgataacgacaaaaaaatatcggaaatattgtccaaatacaaagggcatattcctgtctatttgcattatgaaacaactaaagaaactatccaaagcaaagtacatttggttagaaaagatagtggcttagcccttgatttatctgaatttgttgtgaaaacggtttatcaa

SEQ ID NO: 4094 - protein, 1034 aa, Streptococcus agalactiae
MFAQLDTRTVYSFMDSLVDLKTYVSKSKSLGYQTIGILDHSNLYAAYHFIQEAQKANLRPIVGFSFDIVVENRSIEVYCIAINTVGYKNLLKLSTAQMSEKMSLNLLTEHLEGVQLILPYQDVLDQLNLPFDYVIGVNLTSPQIPYTKPIIAIDTVRYFQKNDIETLQMLHAIRDNVLLKDAQYASKNQELKPCQEMTLAFKERFPEALANLESLVENVAYHFDSDFKLPIFNREIPAGEELRTLTQNNLKSKGLWSDAYQERLEKELTIIHKMGFDDYFLIVWDLLRFGRSKGYYMGMGRGSAAGSLVSYALNITGIDPVKHNLIFERFLNEERYSMPDIDIDLPDIYRGEFLRYVRNRYGSMHSAQIVTFSTFGAKQAIRDVFKRFGASEYELTNITKKIHFRDNLTSVYNRNLAFRQIIDSKIEYQKAYDIAKRIEGNPRQTSIHAAGVVMSDDLLTDHIPLKNGEDMMITQYDASSVEDNGLLKMDFLGLRNLTFVQKMKEKVDKDYGISIQLETIDLEDKETLKLFAAGQTKGIFQFEQSGAINLLRRIRPECFEDVVATTSLNRPGASDYTENFINRRFGKEKIDLVDPVIAPILQPTYGIMLYQEQVMQIAQTYAGFTLGKSDLLRRAMSKKNSKEMQKMSQSFLEGAVSKGHRQEDARLIFERMAKFAGYGFNRSHAFAYSALAFQLAYFKAHYSDVFYDIMINYSNSDYLIDAIDFGFVIEKPSINTISYRDRIYKKKIYLGLKNIKGVPNDLAYWISKNQPFQSIEDFLMRLPQQFQKSGFISPLIAIGAFDEFDNNRRKITSNLDSLFTFVNELGSLFADTSYHWLEVEDFSNSEKYEMEQDILGVGISPHPLVGISQKASRPFIPISQVQENSEATILVQLKQVKVIRTKSSGQQMAFLTVMDINSKMDITVFPETFNIVRDDLQEGKYYYLHGKIQKRDERLQMVLNGVQEATEERFWILLKNHDNDKKISEILSKYKGHIPVYLHYETTKETIQSKVHLVRKDSGLALDLSEFVVKTVYQ

SEQ ID NO: 4095 - DNA, 3108 bp, Streptococcus pyogenes
atgtttgctcaacttgatactaaaactgtatactcatttatggatagtttaattgacttaaatcattattttgaacgagcaaagcaatttggttaccacaccataggaatcatggataaggataatctttatggtgcttaccattttattaaaggttgtcaaaaaaatggactgcagccagttttaggtttggaaatagagattctctatcaagagcggcaggtgctccttaacttaatcgcccagaatacacaaggctatcatcagcttttaaaaatttccacggcaaaaatgtctggcaagcttcatatggattacttctgccaacatttggaagggatagcggttattattcctagtaagggttggagcgatacattagtggtcccttttgactactatatcggtgttgatcagtatactgatttatctcatatggattctaagaggcagcttatacccctaaggacagttcgttattttgcgcaagatgatatggaaaccctgcacatgttgcatgccattcgagataacctcagtctggcagagacccctgtggtagaaagtgatcaagagttagcagattgtcaacaactaaccgccttctatcaaacacactgccctcaagctctacagaatttagaagacttagtgtcaggaatctattatgatttcgatacaaatttaaaattgcctcattttaatagagataagtctgccaagcaagaattgcaagacttgactgaggctggtttgaaggaaaaaggattgtggaaagagccttatcaatcgcgcttactacatgaattggtcattatttctgacatgggctttgatgattattttttgattgtgtgggatttacttcgctttggacgcagtaaaggctattatatgggaatgggacgtggctcggcggcaggtagtctagtggcttatgctctgaacattacagggattgatccagttcaacatgatttgctatttgagcgctttttaaacaaagaacgttatagcatgcctgatattgatatcgatcttccagatatttaccgttcagaatttctacggtatgtccgaaatcgttatggtagcgaccattcggcgcaaattgtgaccttttcaacctttggccctaaacaggctattcgtgatgttttcaaacggttcggggttccagaatacgaactgactaatctcactaaaaaaattggttttaaagatagcttggctactgtctatgaaaagtcaatctcttttaggcaggttattaatagtagaactgaatttcaaaaggcttttgccattgccaagcgtatcgaaggaaatccaagacaaacgtccattcacgcagctggtattgtgatgagtgatgatgccttgaccaatcatattcctctaaaatcgggcgatgacatgatgatcacccagtatgatgctcatgcggtcgaagctaatggcctgttaaaaatggattttttggggttaagaaatttgacctttgttcaaaaaatgcaagagaaggttgctaaagactacgggtgtcagattgatattacagccattgatttagaagacccgcaaacgttggcactttttgctaaaggggataccaagggaattttccaatttgaacaaaatggtgctattaatcttttaaaacggattaagccacaacgttttgaagaaattgttgccactaccagtctaaatagaccaggggcaagtgactataccactaatttcattaaacgaagagaaggacaagaaaaaattgatttgattgatcctgtgattgctcccattttagagccaacttacggtattatgctttatcaagaacaagttatgcagattgcacaggtttatgctggttttacgttaggcaaggccgacttgttaaggcgtgccatgtctaaaaaaaatctacaagaaatgcaaaaaatggaagaagactttattgcttctgctaagcacctagggagagctgaagaaacagctagaggactttttaaacggatggaaaaatttgcaggttatggttttaaccgcagccatgcctttgcctattcagctttagcttttcaattggcttatttcaaagcccattacccggctgttttttacgatatcatgatgaattattctagcagtgactatatcacagatgctctagaatcagattttcaagtagcgcaagttaccattaatagtattccttacactgataaaattgaagctagcaagatttacatggggctgaaaaatattaaggggttgccaagggattttgcttattggattatcgagcaaagaccatttaatagcgtagaggattttctcactagaactccagaaaaatatcaaaaaaaggttttccttgagcctctgataaaaataggtctgtttgattgctttgagcctaaccgtaaaaaaattctggacaatttggatggtttactggtatttgttaatgagcttggttctcttttttcagattcttcctttagttgggtagatacgaaagattactcagtaactgaaaaatattctttggaacaggagatcgttggagttggcatgagcaagcatcctttaattgatattgctgagaaaagtacccaaacttttactcctatttcacagttagtcaaagaaagcgaagcagtcgtactgattcaaatagatagcattaggatcattagaaccaaaacaagtgggcagcaaatggcttttttaagtgtgaatgacactaagaaaaagctcgatgtcacactttttccacaagagtatgccatttataaagaccaattaaaagaaggagaattctattacttaaaaggtagaataaaagaaagagaccatcgactgcagatggtgtgtcagcaagtgcaaatggctattagtcaaaaatattggttattagttgaaaaccatcagtttgattcccaaatttctgagattttaggtgcctttccaggaacgactccagttgttattcactatcaaaaaaataaggaaacaattgcattaactaagattcaggttcatgtaacagagaatttaaaggaaaaacttcgtccttttgttctgaaaacggtttttcga

SEQ ID NO: 4096 - protein, 1036 aa, Streptococcus pyogenes
MFAQLDTKTVYSFMDSLIDLNHYFERAKQFGYHTIGIMDKDNLYGAYHFIKGCQKNGLQPVLGLEIEILYQERQVLLNLIAQNTQGYHQLLKISTAKMSGKLHMDYFCQHLEGIAVIIPSKGWSDTLVVPFDYYIGVDQYTDLSHMDSKRQLIPLRTVRYFAQDDMETLHMLHAIRDNLSLAETPVVESDQELADCQQLTAFYQTHCPQALQNLEDLVSGIYYDFDTNLKLPHFNRDKSAKQELQDLTEAGLKEKGLWKEPYQSRLLHELVIISDMGFDDYFLIVWDLLRFGRSKGYYMGMGRGSAAGSLVAYALNITGIDPVQHDLLFERFLNKERYSMPDIDIDLPDIYRSEFLRYVRNRYGSDHSAQIVTFSTFGPKQAIRDVFKRFGVPEYELTNLTKKIGFKDSLATVYEKSISFRQVINSRTEFQKAFAIAKRIEGNPRQTSIHAAGIVMSDDALTNHIPLKSGDDMMITQYDAHAVEANGLLKMDFLGLRNLTFVQKMQEKVAKDYGCQIDITAIDLEDPQTLALFAKGDTKGIFQFEQNGAINLLKRIKPQRFEEIVATTSLNRPGASDYTTNFIKRREGQEKIDLIDPVIAPILEPTYGIMLYQEQVMQIAQVYAGFTLGKADLLRRAMSKKNLQEMQKMEEDFIASAKHLGRAEETARGLFKRMEKFAGYGFNRSHAFAYSALAFQLAYFKAHYPAVFYDIMMNYSSSDYITDALESDFQVAQVTINSIPYTDKIEASKIYMGLKNIKGLPRDFAYWIIEQRPFNSVEDFLTRTPEKYQKKVFLEPLIKIGLFDCFEPNRKKILDNLDGLLVFVNELGSLFSDSSFSWVDTKDYSVTEKYSLEQEIVGVGMSKHPLIDIAEKSTQTFTPISQLVKESEAVVLIQIDSIRIIRTKTSGQQMAFLSVNDTKKKLDVTLFPQEYAIYKDQLKEGEFYYLKGRIKERDHRLQMVCQQVQMAISQKYWLLVENHQFDSQISEILGAFPGTTPVVIHYQKNKETIALTKIQVHVTENLKEKLRPFVLKTVFR

SEQ ID NO: 4097 - DNA, 366 bp, Streptococcus agalactiae
atggcttgggaattcaatgaaaaatcacctatttattcacaaattgctgaacatataaagatgcaaattgttagtcaagaaataaaaagtggtgaccaattgcctaccgtgagagagttagctcaagaagctggtgttaacccaaataccatgcaacgtgccttcactgaattggaacgtgaaggaatggtattctcacaacgtacttccggacgctttgttacagaagacaacttactaattggtaaaattcgtcaacaagttgcaaaagcagagttagcaacttttgtcaacaacatgaaaaaaataggatataaattagatgaaattacggttgctctcgatcattttataaaggagattaat

SEQ ID NO: 4098 - protein, 122 aa, Streptococcus agalactiae
MAWEFNEKSPIYSQIAEHIKMQIVSQEIKSGDQLPTVRELAQEAGVNPNTMQRAFTELEREGMVFSQRTSGRFVTEDNLLIGKIRQQVAKAELATFVNNMKKIGYKLDEITVALDHFIKEIN

SEQ ID NO: 4099 - DNA, 369 bp, Streptococcus pyogenes
atgtcttggaaatttgaggaaaaatctcctatttatgcgcagatagcacaacatgtcatgatgcaaattattagccaagaaatcaagagtggtgatcaacttccaactgttcgtgaatatgcagaaatcgcaggtgttaatcctaacaccatgcaacgagcgtttacagaacttgaacgggaaggaatggtttattcgcaacgtactgctggccgttttgtaactgacgatcaaaaattaattgctcgtaaaagacgagagttagcaattagtgaattagaatcatttatcaccaatatgacaaaaatgggatttagtcacactgagattatccctgttttgacgagctttttaaaggaggattcacaa

SEQ ID NO: 4100 - protein, 123 aa, Streptococcus pyogenes
MSWKFEEKSPIYAQIAQHVMMQIISQEIKSGDQLPTVREYAEIAGVNPNTMQRAFTELEREGMVYSQRTAGRFVTDDQKLIARKRRELAISELESFITNMTKMGFSHTEIIPVLTSFLKEDSQ

SEQ ID NO: 4101 - DNA, 696 bp, Streptococcus agalactiae
atgacacagttattacaacttcatcatgttacaaagaaatatcacaaacatactgctgttaatgatgtgactgtaagtattccaacaggaaagattataggtttattaggtccaaatggtagcggaaaaacaacaatcatcaaaatgataaatggattacttcagccagataagggagatatcgttattgatggttacagaccgtctgttgaaaccaaaaaaattatttcatatctccctgatacttcatatttacaagaaaatatgaaaatcaaagacgtcgttacattatttgaagatttctataacgattttgattcaaaggtagcatatcaactatttgaggatcttaacctaaatcctagggaacgtctaaaaaacctatcaaaagggaacaaggaaaaagttcaattaatacttgttatgagtcgtaaagctaggctctacatccttgatgaacctattggtggtgtagaccctgcagcgcgtgactacattttaaaaacaatcattagcaactactctaatgatgcttctgttttaatttcgactcacttaatttctgacattgaacctatccttgatgaagttatcttccttaaagaaggagaaattgacctacaaggcaatgctgatgacttaagagaagagcacaactgttcgattgatgctctctttcgtgaaagattcaagaaa

SEQ ID NO: 4102 - protein, 232 aa, Streptococcus agalactiae
MTQLLQLHHVTKKYHKHTAVNDVTVSIPTGKIIGLLGPNGSGKTTIIKMINGLLQPDKGDIVIDGYRPSVETKKIISYLPDTSYLQENMKIKDVVTLFEDFYNDFDSKVAYQLFEDLNLNPRERLKNLSKGNKEKVQLILVMSRKARLYILDEPIGGVDPAARDYILKTIISNYSNDASVLISTHLISDIEPILDEVIFLKEGEIDLQGNADDLREEHNCSIDALFRERFKK

SEQ ID NO: 4103 - DNA, 696 bp, Streptococcus pyogenes
atggcacacctattgcaactacatcatgtttcaaaatcttaccgtgaaaaaaaagctattgatgacttaaccattactatcccgaacggtaaaattatcggattattaggtccaaatggaagtggtaaaacaactttaattaaactcattaatggccttttacaaccaaataaaggagaaattgtcattgatggctaccgtccctgtgttgagacaaaaaaaattatttcttatttaccagatactacttatcttaatgaaaatatgagaattaaggacatgttggagttctttagtgatttttacagcgactttgacaaatccaaagcaacaagccttctaagagatttagaactagaccctgaagaccgcttcaaaactctatccaaaggaaacaaagaaaaagtacaattaattcttgtgatgagtcgtaaagccagactctatgtacttgatgaacctattggtggagttgaccctgccgcaagagactacatcctaaaaaccatcattaatagttattgtgaaaatgcttctgttattatctcaacccacttgatttcggacattgaacctatccttgacgaagtcattttcttgaaacaaggaagacttttcttatctggcaatgctgatgatctaagacaagaataccagcaatccattgattccctctttagggaaacttataaggtt

SEQ ID NO: 4104 - protein, 232 aa, Streptococcus pyogenes
MAHLLQLHHVSKSYREKKAIDDLTITIPNGKIIGLLGPNGSGKTTLIKLINGLLQPNKGEIVIDGYRPCVETKKIISYLPDTTYLNENMRIKDMLEFFSDFYSDFDKSKATSLLRDLELDPEDRFKTLSKGNKEKVQLILVMSRKARLYVLDEPIGGVDPAARDYILKTIINSYCENASVIISTHLISDIEPILDEVIFLKQGRLFLSGNADDLRQEYQQSIDSLFRETYKV

SEQ ID NO: 4105 - DNA, 780 bp, Streptococcus agalactiae
atgtttggaaaattattaaaatatgaattaaaatcagttggtaagtggtatctaacactcaacgctgcggttttattagtatctattattttaggactggtattaaaggcacttggcggcaatttttctactgatactaatagtactagcgcccaaatattcactataatactcgttttattgttagcgatggttatttcaggatctctgttatccacccttgctattattatcaaacgtttttatagcaatatcttcggccgtcaaggatatctaaccttaacgctcccagtaactacgaatcagattatttgttcaaagctactagcttctcttctttggagtatttttaatatttttattgtcattattggaatcatattggtcatattacctttagtaggtattggtcagttcgttgtcgcttttccagaaatctataaaattatttcatcttcgaacgctccactttttatcgcctatttctttctatcgtacgttgcagggacattactgatttatctctctatcgctgtagggcaattatttacaaacaaacgtgtattgatgggaattgtttcttattttggaatatcactcttaattactttcttaacattaataatagatagtatttttcatattgatttattcaactctcatgcaaatgcaacattctctcaacctgtattgctctacaatatacttgttagcattgttgaaattgctatattctatatgttgacacactctattattaagtacaaacttaatatacaa

SEQ ID NO: 4106 - protein, 260 aa, Streptococcus agalactiae
MFGKLLKYELKSVGKWYLTLNAAVLLVSIILGLVLKALGGNFSTDTNSTSAQIFTIILVLLLAMVISGSLLSTLAIIIKRFYSNIFGRQGYLTLTLPVTTNQIICSKLLASLLWSIFNIFIVIIGIILVILPLVGIGQFVVAFPEIYKIISSSNAPLFIAYFFLSYVAGTLLIYLSIAVGQLFTNKRVLMGIVSYFGISLLITFLTLIIDSIFHIDLFNSHANATFSQPVLLYNILVSIVEIAIFYMLTHSIIKYKLNIQ

SEQ ID NO: 4107 - DNA, 783 bp, Streptococcus pyogenes
atgtttggaaaattattaaaatacgaatttagatctattggaaaatggtactttgcgcttaatgctttcgttattgccatcgctgccattttgtcatttacgataaaactgtttgctcaaagcaatagtgatggactatttggagtactaaccaataagatgttgcctctgacattaggtttaacttttggctccctgatcgctggttccctcttatcaacattacttatcattatcaaacgtttcagcaaaagtgtttttggatgggaaggatacttaacgttgactttacccgtcaattcgcatcaaattattttatcaaaactactagcttcttttatttgcagtgttttcaatactatcatccttgcatttgctatcgctattgtaattgtaccaatgtttaacatcaacgaactattagaaggattctttaatagttttaagatggattatttcatcaatatgctaactgtactagcctatgtcctattatcaacatttacgagtatcttattaatttatctttccatttctataggtcaacttttttccaatcggcgaggcttgatggcctttattgcatattttatattagttattctgattagcgttgctgcaacatatgttcacagtcacatctttaatattaatacaagtgccgatagtttcccatttactgagcaaaaaacaatttatcttcttattttggaacaatttattgaaatgataatgttttacctcgccactaattttattatcaaaaataaactcaacctacag

SEQ ID NO: 4108 - protein, 261 aa, Streptococcus pyogenes
MFGKLLKYEFRSIGKWYFALNAFVIAIAAILSFTIKLFAQSNSDGLFGVLTNKMLPLTLGLTFGSLIAGSLLSTLLIIIKRFSKSVFGWEGYLTLTLPVNSHQIILSKLLASFICSVFNTIILAFAIAIVIVPMFNINELLEGFFNSFKMDYFINMLTVLAYVLLSTFTSILLIYLSISIGQLFSNRRGLMAFIAYFILVILISVAATYVHSHIFNINTSADSFPFTEQKTIYLLILEQFIEMIMFYLATNFIIKNKLNLQ

SEQ ID NO: 4109 - DNA, 117 bp, Streptococcus agalactiae
atgaggtgtctatttttttacccgattttgaaaggaagtgaacttatgaaaacaaaaaatcaagaatcaaaaggtcgttccccactctttaagaccatcaaacattcattcagccaa

SEQ ID NO: 4110 - protein, 39 aa, Streptococcus agalactiae
MRCLFFYPILKGSELMKTKNQESKGRSPLFKTIKHSFSQ

SEQ ID NO: 4111 - DNA, 312 bp, Streptococcus agalactiae
atggaacttaaatttgtgattcccaacatggaaaaaacattcggcaatttagaatttgctggcgaggataaagtcgttcagcgaagaatcaacggacggctaactgtcttatcaagaagctataatctctattctgatgttcaaagagcagatgatattgtggtggtgcttcctgctgaagctggcgaaaaacatttcggctttgaggaacgtgtgaagttagtcaatccacgtattaccgcagagggctacaaaatcggcactcgtggttttacaaattaccttttacatgctgacgacatgataaaagaa

SEQ ID NO: 4112 - protein, 104 aa, Streptococcus agalactiae
MELKFVIPNMEKTFGNLEFAGEDKVVQRRINGRLTVLSRSYNLYSDVQRADDIVVVLPAEAGEKHFGFEERVKLVNPRITAEGYKIGTRGFTNYLLHADDMIKE

SEQ ID NO: 4113 - DNA, 384 bp, Streptococcus agalactiae
atgatgagattagcaaatggcattgtattagataaagacacgacttttggagaattgaaattctctgctctacgtcgtgaagtgagaatccaaaatgaagacgggtcggtttcagatgaaatcaaggaacgtacctatgacttaaaatccaaaggacaaggacgcatgattcaagtaagtattcctgccagcgtgcctttgaaagagtttgattataacgcacgggtggaacttatcaatcccattgcggacaccgttgctactgccacctatcaaggagcagatgttgactggtatatcaaggcagacgatattgtgctgacaaaggattctagttcattcaaagctcaaccacaagcaaagaaagaaccgacacaagacaaa

SEQ ID NO: 4114 - protein, 128 aa, Streptococcus agalactiae
MMRLANGIVLDKDTTFGELKFSALRREVRIQNEDGSVSDEIKERTYDLKSKGQGRMIQVSIPASVPLKEFDYNARVELINPIADTVATATYQGADVDWYIKADDIVLTKDSSSFKAQPQAKKEPTQDK

SEQ ID NO: 4115 - DNA, 1383 bp, Streptococcus agalactiae
atgaaacagcgtggtaaaaggattcgcccatctggtaaagatttagtctttcattttacgatagcgtcactcctgcctgttttcctgctggttgtcggactgtttcatgtgaagacaatccagcagatcaactggcaggattttaacctatcacaagcagataagattgacattccctatttaattatcagtttcagtgtcgcaattcttatctgcttgctggtagcgtttgtattcaaacgggttcgctatgatacggttaaacaactttaccaccgtcaaaaactggcaaagatgatacttgaaaacaagtggtatgaatctgaacaggtcaaaacagagggtttctttaaagatagtgctggtcgtacaaaggaaaagataacctacttccctaaaatgtattatcgacttaaaaatggcttgatacagatacgggtggaaatcacgctgggaaaatatcaagaccaactcttacacttggaaaagaaattagagagtggcttgtactgtgagctgacggataaagagttaaaggattcctatgtggaatatactttgctctatgacaccatagccagtcgtatttctattgatgaagtagaagctaaagatggtaaacttcgcttaatgaaaaacgtatggtgggaatatgataagctccctcatatgttgattgctggtggtacaggtggcggtaaaacttactttatactgacactgattgaagccttgcttcatacagattcaaaactgtatattcttgacccgaaaaatgctgatcttgcggacttaggttctgtgatggcaaatgtctactatagaaaagaagacttgctttcttgcattgaaacattctatgaagaaatgatgaaacgtagtgaggaaatgaagcagatgaagaactataagactggcaaaaattatgcttacttaggtctcccggcacacttcttaatctttgatgaatacgtcgctttcatggaaatgctgggaacaaaagaaaacaccgcagttatgaataagctgaaacagattgtcatgttaggtcgtcaagctggcttctttctaatactggcttgtcaacgtccagacgcaaaatatttaggcgacggaatccgtgatcagtttaatttcagagtggctttaggtcgtatgtctgaaatgggctatggcatgatgtttggcagtgacgtacaaaaggatttcttcttaaagcgaatcaaaggtcgtggctatgttgatgtaggaacaagtgtcatatcagagttttatactccccttgtaccaaaaggatatgatttcttggaggaaattaaaaagttatccaacagcagacagtccacgcaggcgacgtgcgaagcggaagtcgcaggtgtggac

SEQ ID NO: 4116 - protein, 461 aa, Streptococcus agalactiae
MKQRGKRIRPSGKDLVFHFTIASLLPVFLLVVGLFHVKTIQQINWQDFNLSQADKIDIPYLIISFSVAILICLLVAFVFKRVRYDTVKQLYHRQKLAKMILENKWYESEQVKTEGFFKDSAGRTKEKITYFPKMYYRLKNGLIQIRVEITLGKYQDQLLHLEKKLESGLYCELTDKELKDSYVEYTLLYDTIASRISIDEVEAKDGKLRLMKNVWWEYDKLPHMLIAGGTGGGKTYFILTLIEALLHTDSKLYILDPKNADLADLGSVMANVYYRKEDLLSCIETFYEEMMKRSEEMKQMKNYKTGKNYAYLGLPAHFLIFDEYVAFMEMLGTKENTAVMNKLKQIVMLGRQAGFFLILACQRPDAKYLGDGIRDQFNFRVALGRMSEMGYGMMFGSDVQKDFFLKRIKGRGYVDVGTSVISEFYTPLVPKGYDFLEEIKKLSNSRQSTQATCEAEVAGVD

(The sequence listing continues in the following parts.)

The invention claimed is:

1. An immunogenic *S. agalactiae* protein in substantially pure form comprising a fragment of 100 or more consecutive amino acids from the amino acid sequence SEQ ID NO:3746, wherein the protein binds to specific antibodies raised against an *S. agalactiae* protein comprising the amino acid sequence SEQ ID NO:3746, wherein the specific antibodies do not bind to unrelated antigens, and wherein the immunogenic *S. agalactiae* protein is an isolated protein or a recombinant protein.

2. The immunogenic *S. agalactiae* protein of claim 1 which is the isolated protein.

3. The immunogenic *S. agalactiae* protein of claim 1 which is the recombinant protein.

4. A composition comprising:
an immunogenic *S. agalactiae* protein in substantially pure form comprising a fragment of 100 or more consecutive amino acids from the amino acid sequence SEQ ID NO:3746, wherein the protein binds to specific antibodies raised against an *S. agalactiae* protein comprising the amino acid sequence SEQ ID NO:3746, wherein the specific antibodies do not bind to unrelated antigens; and an adjuvant.

5. The composition of claim 4 which comprises a pharmaceutically acceptable carrier.

6. The composition of claim 4, wherein the immunogenic *S. agalactiae* protein is a recombinant protein.

7. The composition of claim 6, further comprising a pharmaceutically acceptable carrier.

8. The composition of claim 4, wherein the adjuvant comprises an aluminium salt.

9. The composition of claim 8 wherein the aluminium salt is alum.

10. The composition of claim 4, wherein the adjuvant comprises squalene, polyoxyethylene sorbitan monooleate, and sorbitan trioleate.

11. The composition of claim 5, wherein the adjuvant comprises an aluminium salt.

12. The composition of claim 11 wherein the aluminium salt is alum.

13. The composition of claim 5, wherein the adjuvant comprises squalene, polyoxyethylene sorbitan monooleate, and sorbitan trioleate.

14. The composition of claim 4, wherein the immunogenic *S. agalactiae* protein is an isolated protein.

15. The composition of claim 6, wherein the adjuvant comprises an aluminium salt.

16. The composition of claim 15, wherein the aluminium salt is alum.

17. The composition of claim 6, wherein the adjuvant comprises squalene, polyoxyethylene sorbitan monooleate, and sorbitan trioleate.

18. The composition of claim 14, wherein the adjuvant comprises an aluminium salt.

19. The composition of claim 18, wherein the aluminium salt is alum.

20. The composition of claim 14, wherein the adjuvant comprises squalene, polyoxyethylene sorbitan monooleate, and sorbitan trioleate.

* * * * *